United States Patent 6,900,016 (POLYMORPHISMS IN KNOWN GENES ASSOCIATED WITH INFLAMMATORY AUTOIMMUNE DISEASE, METHODS OF DETECTION AND USES THEREOF) - sequence listing, part 5

SEQ ID NO: 857 - DNA, 34726 bp, Human
gaaagaaaagaaaagaaaaagaaattgagcacattattacaatttaatatcttgattgaagggaagaggtgagacatcagtttcattcatattaaagaggaaataggtactgttatgtcaatgggaaatgagaggaggaattaaatgtaggaaacagaataacaaagaaccaactcataaaaaactaaaacaacccatatcagacacaccttataatctgtatgtctgtgttgacttatcctcttggaatgtgaggaatattctttattaattttacttactgggttgccagatataatacaggaagcccagttaaatctgaatttcagataaacaacaaataactttttagtatatgtcccaaatattgcatggggcatatttatactaaaaaactatttattgtttatctgacattcaaatttcaccagatgttctgcatttttatttgctaaatctgggcactcttcactgggcatcttctcagggcactaacctgccaaatgccaactgctgtggggctgctcagagaatatgacctaatgacaatgggagatgacatgttgctggcaatgaaagaagtgaataaaatgttgcatacttgttttcaggagctgttctcaaagcttaccacctttttagtgtgggattaggtcttcaacttcaactttgtcttcacctttgtcttaaggtcaaaagaagacgttagagatgtctttggtagggcataatgtatccttttagattgatatttgtgggccatttgttttacagggggttagtccaggaagtacaagacaatgtcattaggcggatagagttccatttaaattaaaaataaaatctattgttaggtttaaatgagtcactgcttcattaagctatcaatattagataacacatattgaatgaatgtttcccataggccaagctctgtcccaagcatttcacatgtatttgcatttcgtgctcacaaactgcctctgactgactgattttgattttcttgattttatggatgaggagaccgagaagcagagatgatgaacttccccaaggtcacaccactcataagtgggagaaacaagctaaaattcaggccatcttactgcagaatactcaaaatcaaaataagcaaaatttcatctccagttctggcacctcaccaaaaaccaaaacacgatttaaaaatataaaattttaataacaccacacataaatttcaaactactttccctaagtttctagctgaagttttaaatgagtgtgtttttaatttattagaaagtggattgaagagaaaacattggaagatgaaggaaggcgtttcagttaaaccccaaataactctgtgttacactgagctatgaaacggctccttctagctccatttctcctcagacctaagtgctattcctgattgtccttcattgtcatttccagggagaaatgacaccagcacagtggcaggccttccaatctggagcacggtccacacaacttccgaattggtgttcagtgtaaagtgtaccggagtgcggaaaatgcgcagggcattgccaactatagatgctcggagtaattcagtgtattcagagaacacggtgaaacaaggaaaaccggcctgactggggggtgaattcagcagggagtaaatctgatcggcatcaggtctgcggaaaggagctggtgagcacgacaccacccaggcattgcctggctctctccgcggcgggctaagttaaccgcgggtccaggtgcgggccatggtcttggggagggtgctgggtgcgctcgagcaggctagcgtcgggagccgccgctgctagtgagaggccggggccacacacgctcctccccggtacctcctccagcatcaccaggggaggagagggtcggggccacaaggccgcgctaggcggacccaggacacagcccgcgcgcagcccacccgcccgccgcctgccagagctgctcggcccgcagccagggggacagcggctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagtgaggaggggccccgggggcgaggcgggagtgggaggaagggcacggtcgccgcgctggaggtcgggaccccggagcggcgaccggccggggtgggctcgctgagccgcacccgctctgctggccggtcctgggctcacagtccctgcagccctcggaaacagcgctaggatccttgcggggagagggagaggatgacggtattagacaccagttcttccaaaccttttcccgaaaggaagcaaccctaagagctcagagctggggggagaatcaggacaggcagggaacacatggagttttcttttcttttttctctctctctctctctttctttcgttccttctttctttcttttgaggcggagtctcattttgtcgccaggctggagtgcagaggcgcgatctcgactcactgcaacctctgtctcccgggttcaagcaattctcctgcctcaacttcccgagtagctgggactgctggcgtgccgtatcacgctcggctaatttttttgaatttttagtagagacggggtttcgctgtgttcgccacaatggtctcgatctcctgacctcgtgattcgcccgcctccgcctcccaaaatgctgggattacaggcaggagccaccgcgcccgccccggagttttcttatctgtagatctcctacagggacaatctctctctccgtctctctctctctctctctctctctctctctctctctctcacacacacacacacacaccactacacacctctcactctgcctcctctctctctctccctccgctctctctctcacacacccttctccctctctccctctctctcactctccctttgaggagtattgcgtttttggagcccagttatgcgtggctgctgtaagaacaaaacaaagcactctttgtcctacctggagcatccccctgccggccagataagatcacagctgtgtcaccaagtcaagggagaggctcatttttaaaaaattaagcaaaatcagaaaacagagaacactgtcttcctcatcatctcctggagcttgtaagagaaatttctgtcaccaaaaacgaaaagttcgggcttttattcatgcctgtggttcttgggattactgcagtggtgatgaggaaggagaggtgcgtatggctcataaatggcagcttgccacctttaaaaggcacacggattcagatttgggatgtgttaacaaatcaggcttgcacaaattacttttgatccaaatgagaatgctgagctgggagactggtatatgggtaggagctggaaaatgtatcccctgaggtgttggcaatcccaagaggctcagcacgaaaccttgagcttacattgaattcagagatctgagcattaagcactggcctgatcaagaagaagcagatggccttctggtcacgaggcactggtgagcctccatcacccaggcagattccctcacagaggaattctgctggccctgcagaaagtggtgagacagcgcaccaccttggcattttccagcaggcctacttcagctccttgcacttgggcactgaaagtgctttcccctccccagatatttgtgcaccagaagctgctgctggccatgtggtgatgtctcaatgtctttcttcattgaactgggcccttcatacccaaggctggcaccatagtctgtgactgcctgtacagccagcaagactgaaggagttgcagcattaggagtgttgtgaatctggttcagccactcattttacagttgagaaatcccttctgaggtgtggaagggcttgcttagcaccgcaggacttttccctcagacagaacctgggacagctgggtcctcatttcctctccattgtgtctctgtcccctttgcacttttgttgtgaggaacatacatgggcctaaacacattccctcactctcacctttgcacatgaatatgacttaccacactctttgaagctctgtcagcacagaacattaagaaaagtgctaactgggtacctgagcagctggagtgggagcccctgggaaagtcagtttaggagtcccctttatcttccttttcctgatacccaagaagatggctatttcctggaaaggaaggtggatattggattatttacactctgattcctcttaagcctaattttttttcaagattcatgataataagcctgactgacgtctcaagatgttgagaaatttccataaaataaaagcattgaagagaaagtactgagtgaagggaaattgaagagaaacattcagttctaaaattgtattgtttcagaatatgattctgggttcttactgactttcttcatgacgccagccacctgttagacacattatgtgccctcactgtcattttgctcaattttatgggcgtgactcaacactaacagaaacaggctaatacatacaaacatgtaggtttttggtttttaaagaaacttagcagttgaggagaaataaaaagtctattgtaagagtagatgctcattgaattaagtgggctagttgattcctagtagaacttgtattcattcattcattcacttcaaaaaatatttattgatcagatcctaagtgccaggtactgagtacagcacagttagtaagatagatatgctctctgctctcacagtgctcacattctagaattgagggatgaacagggtgaattcatataatgagaagaaaagcaagcagattgctgcagtatagtggtgtgtgtgtgtgtgtgtgtgtgtgtgtgtatgtgtgtgttggatatatgggaggggcctagcttcttggattggattgtgaggagagacttctctgcaagaaggcctggagatgaaacctcaggaagatgggcagacgtccctgcagagggaaccacaagcacaaatgtcctgctcctgggaacaggtgtgatgtgttggaggcacagttggaatgccagtgtggctggagttaggtgagggagaaggagagttggaggagtgagctttaggggcaggagccaggtcaggaagaccctcataggccaagggaaacatttggattttactctttacaatgagagaagccaaaagagagtttgaagcagagatgtgacataattgatttactttatagagagatgactctgggtgctatgtggagaatggattacaggggaaggagaggggacagaagaaggccagaagcgagtttactgatggggggtggtagcagtagatgggcgtaggctattttttggagttacagtgggaagttaatgtttctctgtctcgaatttcccatctacaaaatgggaatgagattgctatacctggtccacttgtaaaaactaataaacaaatgaatatgccctgaagcataatgtaagacattattaccattattatttgctcatattgtattactttgaattccctgtgctttatcttaaaatttattttaataaatttgatgtcttattatattattttcagtaaacctaatttattatacataaaagtatctttctctgttcggagaactggaaactcttaactaagagttaccaataaaaacaagtcgtcacaaaatgcagggaaattattgctaaaataatagctggcttaatttcaaaagttgaatatggtcagataaaaattcaaaaatagaataattaaagctgggaatgggaaaaaaatattttggacagatttgcctttgtcctggctgtggtcatgcagatatctgtgagtgcaaagatttgtagataactgaaaatatctatatggcagcagaatttctggagaagtctgtggaccagagttgggtagggttgtttcccttagtgaagcattctctctcagaggaagctcttgaattttctctcgtttatcactaagttttagagtgtcaggaagttttaaagttgtttaccaactaggatagtgacgttcttcgcagagacaggacaagtaactgccacaataaggcaactctatttctctttcctgactcactctgatgtgcaagttactagaaggagatatgcctgcttagaggaaaaaaagctcttcctcatttgtattgtgggcagcagaaatgtcagctcgtgacttaatagtccctaggtcatgttaacttgccagatccccttaattatttattggtcagtgtgtctgaatttcagcttgaagtggctagtctggtgattcaaattgcagacaaaatgtgatagtaattctgggatctgtatgatttatctcttgccatatcaaccaccatatttttcttagggctggagagtgggggtgtttgggtatcttaaagggagaggttacatctctccttgaagccagaaatctatttgtttcactcacgttttgaaaggttgaattagttgctcctttaaaaatcagtggatattacatacaaatgtaattttccagtttttcttggaagcaatcagatgatctagtgacatggagctgccattcctacatggaagcaattaactggaatagagtggtagttgccttctttggatggtccagtttgcaccatccaaatagaataaggacagttcacgccagtccttattctattgcatgaacctgtttgattcatttaaattacctgtctggcccttgtagacttttgatttttaacttcaggtttagggcaatcaagtgtaacctgtctgttatactttcaccttcatgtaatgcaggaatctatattccagtatccctgctggtagtccccaaacctgtactttaactgctcctctgataaagaagataatgctaattgttgaaaagctactgttgatggagctgtacagtctgggcctacatagaacatgtttaggaactttgcacaggactgtggctgtcacatgcaacctaggttttccacattaaaagtaaacattcctcattccttcaacagctcctcatgtgacttgctgccttgttccctcatcattctggttatttttgggttactgtcccttgtcctgaacctttatttgttaaaatccttaaatccccaccaattcaataagatgtggtctaactggtgcagaatgcagtgggagggtggcctccctttctctatgatgtcatacttttgtcatgcaactgaagatgtctttagatttttcctggcctatccattgtgtttttaaatttactttcagggcttattttccagttagattgttcctgagagtttacaggagaactgctcaatgtacagcttgagagcaatggttttcagctgaggatgatttatgcccccactccaggggacatctggcaatgtctggagacgtaatatttagttgccacaactggggtgtgctattggcatctagtgggtagaggccagggatgttgctaaacaccctgcaatgcacaggacagcccccacagccaagacttatcagcccctagtgtcagcagtgctgagcttaagaattcctactttagggtccgggtctaggttcagatcctggtttagctacttcctatccttgtgaacttgggcacgttatttaacctctttgtcttcattatctcaactgtatgtcaaagaactctgaggactaaatgagttcatttatatgaaatgcttagaagggtaactgtatgtacaaacactatcttatttttctaccatattttattcattttggtgtgtacatatgacatcagataagtgggtgggtaaagtttgagggatagcacttcatttctaatcttgcctatgggatgggcactagtgcatttggatgttttagggagctaacagcttttctcagaaatgccttctctctatggtccccattatcatttttccggcttcttttagtattttcctccatattggggcatatatgtcagtttaatactgcatcctcctggagaatatggacactgagttcctttagcgggagagcatctgtgcctgttgcttgtacatcccatttccggtgtgccccaggctcctccacaccccagtcaccgtggcttgcacctgcacaacagattcctggggctgtgtagcaattggtagactttggataataataatagcatttctccaagggctcacatccccataagaaccccattatcagggttcctctttgacagatgaggagagaaaagcagaaagtaggtaagaacttaactgaagtcaccaaactagtaagtagcagattcaagattcaaaccttggcagccagaaactggagctaaatttctaaaccactttattattctgatacaggtaagttttctcaagaagtatacccatgaccttaacctaaccatcatgtagccatttatgcatacaacactcaacagatccagttactcttactcttactattgtgagtaatatagttgggggactgagtctgagagtaagatcaggaacttacagtatagcagcaggctgcccattgatcttagacaacttttaccttttatgacctttaagccatatagaacaccaaacatttggacatttgcacatgggatgcagattaattcccatttccaaaattgtgagtagaatcaactaattatatgttacttgcaggttttgcatctcatgcatctgcctccctagaatgaaataaatatttcttccttattaaacaaggatagagttgccccagcattttcttagaccagggtttctcaacctcagcattattgacattttgagattcctctatgttgtagggctgtcctgtgcactacaggatgcttaacagcatccctgactgctactcactagatgccagtagcagccccctcctggttgtggcaaccaaaaatatctccagacattaataagtgtcttcttggggggcaaaaatgccttagttgagagacactgctgtagagtgatgttctagctgcattctccagccttcatcctattgtaaaatatccaaagaagattttatcttcttcagcaatcatttggtgtggtaatgggtcagttttgaggtatttaagccactttctttgactttagttgaaactgaattgggctattatttgctttttgtctcattcagttactttatatgctccatattagttttctattgctgctgtaaaaattttctacaaatttagtcacttaaagcaacataatttattatctcatggttctgaaagtcagaagtctgacatggccttactaggctaaaataacaggttcagtgaaccttcagaggtcagctagtctgtgttgctttcctgaggctctagagagaatctgtctccttacctttccaagattctagaggccatccacatgttatagctcatgcccgcttccttcattttcaaaaccagccatggtgggttgagttctcacatcacatcattcagatctcttcttctgccatcctcttatacttttaaggactcttgtgattacattgggtcagataatccatgataatctccctattttaaggtcaactgattaacattaattccatttgcatcttaattcttttttgccatggaacattacatattcacatgttctggggtttagaatatggacatttgggtgggagtgcattattcaacctgccacatgcccccattccaaaggtcaatcaggaagaatttggaaagagagtactgatacttaacaaatgagcattttcttttctgactctttactaataacacaagagctaaggcccacctgccctaatctcttgccaggactgggttttacttggatggtttatctgtcagcttttcacagagatttcaaactcgagattggacattttatctattgttttgggttgtcttttgtttcgaaaagggaaatgatgcctgatgagaatttaacagtgacaaataggggaaatcgggatttgtggcagttatggttgtgtatggagactacaactgagatctgaagaacaggtagggcactgtggtttcagtgggagaaatgaagtctgcaggagagaggcagaaaggtagaatccgtttaaatggaatgtattatctgagtgctcattgaaagtcttcttgattgccaggatgatattttatctagtggtcaaggggccaaattgaagatagttattttcaggccttactatttgaagaaaatcattgatttttaaagtgaacattcccattgatttagaatgttggtggctcatgcctgtaatcccagcactttgagaggtagaggtgagcggatcacatgaggtcaggagttcataagcagcctggccaacatggagaaaccttgtctctactaaaaatacaaaaattagccaggcattatggtgggtgcctgtaatcccagctactcagaaggctgaggcaggagaatcacttgaacctggaaggcggaggttgcagtgagctgaggtggtgctattgcattcctaggtgacagagtgagactccatctccaaaaaaaaaaagtttgtgtttttgtattgaccagtgattggggttatggtaatagattttcatacaatatgatgatgaagacggctgtatcaagggttttagtgtagtcctgttggattctctagttctaagagaatgtctaaagttaccattaagtttttcagggtcctagttcttaaatataaatacatttctagctaactcatatcccatggttgagaaaaaggcacttatctgtgtaaagagaactttaaaagttaaaagacttcttatgaattattcctgtgtgttcatattcagaagcctctgtggtcattgtgattattacatgttaatatggttcctggctcataactcccgttgcccttgctacagtctttggttataatattggagtgctttagaccccagaagcaggtctcagaaagcagaatctttctctctgaccttttcctgccttcctttcacctgcccaaggcaggactctaatctgattgtaggttataagacccttattcagggaagggtcctcttaccttggaaaaaggaatgctgcacagacagaccaagaagaatctgaatagacagggcttgctgggttgcccctctgagtctattagcattagagcttacccttactgtccagtcatatttctacacagctgttcatactttgttgaacctatgcataaaaatagacagtttcccctgtatctttgggtcttcattctgaaggctccttgtgaatacacattaaataaataatctgccttttacaagttgatttttcagtgacccttcagaggtccaaggggaatgccacccgtggcccccttggccccttcagtgtgcatgtattcgagcctagaaatgcctctggaaaaaaatctgttagcaagtcattatttgcgaagagataactcaatttacctttttctgttatgtttggatttttgaaatcatgtattaactttataatataattaaatataatactgaaataagatcaaataaaatcaaccaaaattataaataatcttaaagagttgcacatatataccttttttttctgatcaaaagaaagatgttgaataaggaaatacagtccctctgcaagtagtttaagaagttttggctggacacggcggctgatgactgtaatcccagcactttgggaggccaaggtgggcagatcatgaggtcaggagatcaagaccatcctggccaacatggtgaaaccccatctctactaaaaatacaaaaattagccgggcatggaggtgggcacctatagtcccagctactcgagaggctgaggcaggagaattgcctgaacccaggaggcagaggttgcaatgagccgagatcacactactgcattccagcctgggtgacagagtaaaactctgtcaaagaaaaaaaaaaatttagagctccagcaacacatttaccagctgcctatctgggtctttctagcctgtacaataggagctgcccttacacgaaagccccatctctttgaaatctttctgtctacattcctgttgctctcagaacttgtaccatatcatctaagaattataaaatgcccctgtaatttgctttcttcctgtattatattgttaatatatgctagtcttgtctctgaaacacaattgtaaactctctgagagtagggattgtgtcaaattctctggtacttaccacagttgttgccataggagagggcatatagtatttgcttaagaaataccctttgattgaatgactgcagatctgataatcaggataggccatgctgtgctccattaaggcaataacagcttcacctggaaatttcagtggcttaacacagcaaaggtttatttcccatttgtgaaaggtcatttgaattggcaggggctcttctctgttcagtgactaggtatccaggcgtctttcacttcaagactgcactacatcagcacatgatttctaagtttgctgtgtcagggaaaggaaggcatgaaggagatacagtgactctgttgcagacgacttctgttcaaatttttgtttctcaggaattagccccatgggcccagcccaaccacaggggcggctaagaaatgtagggaagcacatagatgttcaggagcactcattgtctgtgccacacatctatattacatcttcccgcaaaatagctatactaacgagtgcttcattagtgtcagtgggacaccggatcattaaacttggctcggtttgtattagtaaccagatgtgctagatttattcactcagcaggcatttactgagtgcctctgtacaccaggcactattctaggtcttgggaatacagcagggggaaaaaccatcaaaaatccttacactcacagaactaagtttttagtggaaggtgataaacaactaacaaataacatacaaggtacgttagttggtgataaatattggagaaaaataaagtagggagggaaatagggaatgtattggtgtgaagaaggaggttagattgcaattttaaatagattgaaccgggaaagtgtcactgagaaagtatcactggagcaaaaacccggaggtgagaggaccagtcatttgggtgtcagagcaaagagcattcccataaaagggaacacattcaaagccctcaaagtggggatggaaggtgggtgtggagtacttggcatgtttggtgaatggcaaagaagcaagtgtgattgcagcaggtgtccaagaggggctaggggaaggattgggagtgtgttgagtaaaggttatgtagatcattataagctattttgggtgaatggcttctcccccgtaacatataacaccatttgggggttttgtgcagaagggtgacacaatcactctggctgctgtgttggggatagattttagggtcaagggcaaaagcagggagactcgttagaggtgatggcaaattttaggtaagagatgatggtggcttggaccttttctatcccccacaaaagttgaagggccaaattttaggggggaaaatggatgcacaaatgcaagatagtttttgctaataagatgttagcatacagactaattataatttattattaccacacatctcatattctcttgtttcatttactgattcaacaagcatctatgcaatactacttcttccaggccctctattaggcactgagacaacaaataagacctgacttctgctttttggaaacttatatcatagtaggattatagaaattagcaagaatataacatcatattaacacccaaaacaaccacagcagcagaaatatagtcactatataattaaatgatggaaatagccaaaatttatgaattatttactatgtgctagacatacctatggatattattatgatgatgacagatggttgttatatttgttatattttgttggctatttttatagctgaccatactgttataaagttagaaaactagtgaccaaaaacttaatctaactgtctgaaagtattatttctctgctctacaatccaatgtaatccttagtaatgtaggtaatggtaatcctacattaccaaggattttaccattgtagtaccaatctaaaacccagcacagaaaatacatgttttattttttccaagtgttactagtacctcagcctttcttgatttgtcagcttatttaaggcctcttcattgcatacttcttttttcttttaatcatctgcttcgaaggagactaagctgaaactgctgctcagctcccaagatggtgccacccaaattgcatgtgcttttctgcctctgcggctgcctggctgtggtttatccttttgactggcaatacataaatcctgttgcccatatgaaatcatcaggtaagaggtgtatttgttcaaggtcttgagcaactgatctgtcgccatacttcaagtgggccccaagaagttgcacatctgcacatctaaacaagtcctatttaaaggcttatggagatcctgtattctcctggagtaggggagaggttctcactttttcctcatttcaactgaaattgaagaagcacttgtgttcttcagtatcaggactgcaggacagaaccaggatgggacattttaagatatactggacgctcagcttgcaatcaccacggagaacctccttaatgccaccccttctctctctgactgccctaacgcatgcccacacaagcatagtaatgcaactggtctggagtccactccaagacagcctcaaaacctgcttccatgaggtgaaaaagaagcaggtgtcttgttcaacaggcatactcctggttaatagtggaaagtcatgtgagataacaatttcaggtcttgggatccaaaaggaaacaatctttcctacctgataatagagagaagtagggacaagtaggtgctagggagttccagatgagaatggatgtgatcactcattctttcttgccttgtggtaagtggggaaagaaagaggtggaaggcatagactaacccaggaggagtggccaaaacgggacagccatctttagacggctacatttaatgtcactaagagagaccttaattggaaaaagattgtttctggagctttgcaaattcctgctcatcccagagggttgtgatgcataaacttctctttccagtctcctatggagagcagtgtaggtggcttctgaatggtgtcatactgactatacctacagagctgtgcacctggatagttgtgggtcactctggatctaattgttcaagcttgatgggtgactccttacgatagcatttgcaaaagagctttcataattcagtaccttaaattttgccctactacataagcaggaaaatgaatgcgttaggagaggttttatatcttatatctacatttgcataggaaatagaataatatctcacaggtccattcatcctataacgcatcaggaagttaagtcatcaaggatacactggtgactaagacaataaatgtgtagtcaaattcaagggtcctgcatcctagatgacattaagttcatttttcctactacctttttcatggattgagaacaggtaatatcttagatggtgggaaaatcatcattcgggaaacatttatatccttcacttttaattggtacagggtaaaaatttaaacatttttaaaatccctttgtctttaaaaataattggaaggctgttgctggactgacagaaacttgaggacagggacgttgctttatctttatagtcccagcattgagcccaatgcaatgcccattctaaatgttcaaaaatgaatgcaggccgggcatggtggctcgtgcctgtaatctgagcactttgggaggccgaggtgggtggatcacttgaggtcaggagttcgagaccagcctggccaacatggtgaaaccccgtctatattaaaaaaaaaaatacataaaattagctgggtgtggtggtgcacacctgtagtcctagctacttgggagactgaggcaggagaattgcttgaacccagaagaaggaggttgcagtaagctgagattgcaccactgcactccagcctgggctacagagcgagactctgtctcaaaacaaacaaaaaaagaatgcatatatattggtttaaagtattagaaacagtttattaaataagattaaaataataggtgattctttataatttcttactaaatgaatacacagaaaatatggctatgcaggttaaaaggtttgtaggaatgggctagagatatcctctttactaatggaggacataaagccatataagagtgtaattgtcctagcatgtatacagttcatctccaaacccaagactgaacatcaggaatatttgacaaatgaaaaccaccaaaaatatgtaataaaattaatagcatgccataggttccaatcctcctattaaaataaagttgaagaaaactaagaagagacatttataaattctgaaccacaaaactgtgtgagtggtcatttgatctgatgagtctcctccttccacttccttaatgatgactcctgacagatggttagagaatgggaaatccaggcccataaccgggtcagctgtaggctatggagcctgttccacagccacccccaggcaccctggcactggtgcataggaccccatagacctataccaaaacctggatcagcctgatgattcctgaggtcttctcagaggtcaggtgtcctggaacaggcagacctcaccttgacctgaatgctcctgaatgctgagtgaggaaacttcccagggagaacaggtgttggacaaccagggcactcctaacttattggaaaatgttcccctgtcctttggaattgagatctcacaagcggaggcttgtgttgggtgaaaccctcccatgcctccagaactgagcctccaattctagaggtagtgtctccaacagcagctgtggccctggggctccttagcgagttgtgtgagccagaggtctccctgcagcaagccctgcacaggcacaccatgcctgcctaggggtggggttgcagtagcaccaggctgcttaccacagaagaagaagcaggtgtccctaccttaaggtcctcctccttgggacttcacatctccctgttacaccagaagcatggctcagtagatactcttttaatggaagaagagccttttgtaattcaaaatagaccctgaaagttcaccttgcaggtaaagtttaaaaaaaaagtttctggggtttgaatctacctggggagaggttagacctgctaaaacttccctaaggactcagcacagatttacctagcaagagtaaatggactctggggaaggagtaaacagcattatttgtctaccccttatgtgtcatgttttgtactaagaacttgacctacattctcacctcatctttacaactgtactgtgggctggtcaagtgcttttatgtcattttacgaatgtggatcagagaggggagcaactaggccagaggattatagcttgtaagaggtacacctgaaatctgaaatagaaccatgtccctccaattcacagggtttgttcatctccatcccctctccccttgcctttcttgaaactacctcctaccatttgaccatggattgctgacctgtgtgtcaggcaggtggtctggaacttcagcccagtgtctcttaaactttaatgggcactccttttctgattgagtggaattgtggtgaagtccaggagcctgcatttccaagctccagctggtgccagtgatgctggtccatggatcagctttgagtagctgagccttatgtattgaaaggcttcatcatgggcaggtgtttcacacatgagtcaccagtgtggaggctgtaaattggtttcttcccatgactcaaaacttttctgggcaatgttccatggtattgatgcagacgctttatctaacatagctcttgatagctggctagcagagagtaatcaactcccaccatccaatggaaggaatgggtggacaagctgaatatgtcaagaaaagtgagagtctgaatacactgatattttgtaattaaatatggatttgattgaggtttagaaaggagaacggatgaagctgctggtgtgtggaagattgcaccagagagagaaaagtagttttaggagtggatgagtaaaatactgcatgtgataaagggtttaaaggaaaacaagagagaccagtggccattcaagttaactgagcttattttcacaagtatttgttgagcattgactatgtgccagacactgtgttaagaggatgcaaagacatggatatggctctgaagaaagagcctagtgtagcatgcagacacataagtttaatatgtgacaggaagaatgattacatgtgtgtatacacacatgcacatagaatctatgtaatattgaggatgaaatgattaagtctgtctgggaaatcagggaaggtttcagagaagacaggacatctgaccaaggtattaaagtgtgaatgggagtttgctaaggggatttaagcataggcagtagcatttacaaaggtgcagtggcatcaaccagcccagtgtgttgctcaggagtactgtagcacaaggaaggggtataacttaaggggaagaagaagaggaagagtatgaggcaatgggcctccagtggagggtttctttgcagtgcccagaaacttgggatttaacttgtgcacctgtgaacctcagtatgtttcaaccccagagcactggaaggataggccacatttttgcaagtagcagagtattggcttaggaaagcatgtgtagatttaaattcctcctacaaactgccttccaaaaagattacaatacattcctccttcaaggaaagaacacttgctgatagggaggcattgaaggattttaagaattgtctggtgtgatttgtgctttaaatccctccaggagctgtgtaaaggatgcatttgaaggggtcaagatccaacgtgggtagaacagttaggagagagagcaacagtctggtcaagagacagtgagggcataaatgagacagttgagctagagggtcagcgatatattgtggagatcattctaagctaaaaactaatgttagcaatagaggtttggggctgggcgtggtggctcacgcctgtaaacccagcactttgggaggctgaggtgggcggatcacgaggtcaggagatcaagaccattctggccaacgtggtgaaaccccgtctctactaaaaatacaaaaattagctgggcatggtggcacatgcctacacctgtaatcccagctactcaggaggctgaggcaggagaatcacttgaaccagggagtcggaggttgcagtgagccaagattgcaccactgcactccagcctggcaacacggtgagactctgtctcaaaaaaaaaaaaaaaaaaaagaaaaaagaaagaaaatagaggctccgttgaatgtagggtggttggtgagaaagaggtaggagaataggatgattcccaggtttctggcttgtggtgcaggagatgaggagttcttgagttgccggctgtgtggttggaaagtgagaagggagagttgaaagatgatcatttagtttcattttggaaactagtttcattttgacattcttatgggaaggacatcaggtagagatgctcaaggagaagttataggcacaaatctgaaatgtgaaataaagttcatgtttaggaaaaacagatttgtgaagtcatctttaatttactctggatagaagtagaatgagagggcaaggctgcaaacattaggaggtaacagtccaaggcagcttgagagaaaggctatgtctactttcatctctttaccctccaaaacccctacacagtgtttcaaacagagcagaccctcaataattgcatatcttacttgttaggttgagaaagaaagaaggccagaaactatgggaagtaacttgattccgttggaattcttttgcataataaaatctgatatgtaatggatgacaaatgagataatatttacctgtttttcagcatgggtcaacaaaatacaagtactgatggctgctgcaagctttggccaaactaaaatcccccggggaaatgggccttattccgttggttgtacagacttaatgtttgatcacactaataaggtaatgctttgatttatacaacttatcctgatactctaatattgtctgtcgctatggaccactagaaggtgttcaaatgtgaccttgccctcacctgagaatgactcattttgcaatttgtattgtttcatatgaaggcttttactagtttggccattcctcaattctttgttattgtctgattaatttctctataaaccttatttttcacttccttaatacctgaagccaggctgcttgtattttcctttcactgagatagaatattgtttttctgtttctctttcatgactatcttcaatcaccacagcagcctaaaaagttctttagacctttttgtgaacacagaggtatttgagtccccactaattaaatatgcaaaatagctgctggaatatgtttgagacacaacttctctaaaagtgcattaatttctttcttaacagggcaccttcttgcgtttatattatccatcccaagataatgatcgccttgacaccctttggatcccaaataaagaatatttttggggtcttagcaaatttcttggaacacactggcttatgggcaacattttgaggttactctttggtaagatttctgttgatccttctttgtaggctcttgcatgtatgaaaaccttgaaaacaacaagaacttcaagtagttaagaccaaagtagatttttcttcagtccaaatagctcctaaaatgataaggaaagtatttctttaaagcccaggcaactacgacagaatcaaggttctcattttgtccattctgagttggatgggagtggccgagagtatcagactgactctgacatctttctgtggctgctctttagttttcatctgacataccatggagaaggcaataccgtggtgagaatagcaggttatttggtgtggccactatcccgcatgctctgtgctaaagttagacaaaaagagaaagaaagtagaagccatcaaactctccagatccaaaacaaaggagtcaaagctaatgcctttcttgtcatacatgaagagactctactctcattcccatcacctacccccatcgctaagacaatctgatgtgtattcttcacttactgtctacattctgctaatatagacttttccttccttatctgtttgactagacactactgttggactgatgttaactgtgtcttcacatttacccctcaaaacgatctacaaattttgggattcatcttaaacatcggcttttaattttcttaaaaaccacttataacagacatgaaaatagcataactctgcatatttatgttgcaaaataatttataaatcacttccatagcaatcatcacattcagtctttatgactgcatctgcattttatagatgagaaaatgaaacacaaatgattgctgataataatggtgacaataaaaattgagaagtgaaagaagacaatatttccattttttgagccccttactatgtgatggattgcaccactgctttacatatattacctaattaaataaaattctcacaaaaaccctatgaaagagatatcattttctgaagtttacagaagaggaatctgaagtacagaaagtttaaggaacttgcccaagatccatagttaggaagtggcagagctgcatccatgactcagtatgaagtcagtggtttctctaccttttcctgcatgattatgaccaaatcataatgaacagagtctctgtttcttagattctggctcttagtgtaatgtatccaaggttttatgggtagtttggtttcagaacattccctttaaaatttttccaaaacctgggaatggcagtaagtagcagcctttatgaatacacctataagtgggaaaatctctcaccttaagtccagagctgtcagtaagaactcatcgttaatgatcctatggtctgaggaaagaacttacgccgggtgcggtggctcacgcctgtaatcccagcactttgggaggctgaggcaggtggatcacctgaggtcgggagttcacgaccagcctgaccaacatggagaaaccccatctctactaaaaatataaaattagccaggcgtggtggcgcatgcttgtaatctcagctaatcgggaggctgaggcaggagaatcgcttgaacccgggaggcagagtttgcagtgagccgagattgtgccattgcactccagcctgggcaacaagagcaaaactccatctcaaaaaaaaaaaaaaaacttacagttcagctctttggttggtgggtatctagtagcagtctttttaatgaatctactattcatccataaaaaagtagatataaatcagatgggtctgcattttatgctaatgagatatgaattaaattcactagcaacactcagagaaaaccttaactataaccttccattgttgtctaggttcaatgacaactcctgcaaactggaattcccctctgaggcctggtgaaaaatatccacttgttgttttttctcatggtcttggggcattcaggtaatgtttgagaggttgaacaattttggcttccaggaataaatgacaatttttttattcaagaaagaaatagcagagtttggaatgtcatgcaggcccttgtctggaggagttggggttcctcaataattggctgtgggtctattgatcagtcctagacctgtctggtcaagtagttttttccctactatcagctcattgggattagcctcacagcagagaagaaagggtgttgcattttctatagttgtccttcattattgtaatatttacactcttaaaattatcctctgtaaagtttagaacttttgagaaaccaattttagattagctgggaaagactgttattaagagaaatatctgtgaaggcaagagaaggagcaggaaaagatggggagaacctttggaccatgacacaggttggacacctgaaaaggtgatggggaagggagaaggattggataagaagagcttcagaatgaagcatggttctaagaaatattgagccaggccaatggaaggagtgctggactatatttgcttatcaagagtcctgtatctcataggaatgggctaatgttagtacccatgctgtgccaagtctctgggagcagctcactggatgcttagcttccacttgaccatggtgatggatacagaggggcaggagctggatagggtctttagtaagctatgcagtctgtagcatgatagctgagtggcacattttcataacaacaaccaccctcttcactttcttccaccactttctcacctgtcacccctcttctacctcaagggattgtaaaactcagaaaataagagagatggcttttagctgggaagaagttgggtagcacttgcaataaagaattctcttcagcactgtaaatgtagttcagctagctatttgatttctcctacattagtgactggcaaattagaacccaagggccaaatccagcccactgcctatttctataaagttttattagaacacagccacacccattcatttttgtacactgtctatggctacttttgtcctacaacagcagagttcagtagtggtgacaaagactatggcccacaaacctggaaatatttactctctggccttcaacagaaaaagtttgctaatccctgtgctatatcattcccccctcttgaaaaggtcctgtatcttcagcaataaataaatagtttctagctacctcctttttattctctgtggacatttcctattgaatgcatggtatgaggaaaaggttgtgcaaatgaagctgtggaagagggcataaatgcagtgcttagcacatgatttttcaactatttcacccagtccaatcatttaaataatagctaacatgtgttaagtatttacctgtttctaatataagtactgaaaatgtattaattcaattgatcctcactgatgaggtagcatactattatagtgtcaccattttatagataaggaaccaaggcagcaaaaatattgtgacttattaaaggtacacagctaacaagtggtagaaccagggttcaaactcagtggtcagactgcaggtctcattcttgtaactacaatactgtactgctttcctatatacattatcttagcaaaaccttacaactaccctaaaacaaatgctttactcttaggcccattttacaggtgaggacaaaaatgcagtaattacctaaaatcatatagctgggaagtggcagagccaagattaaaaacccaaaactctcaaaggcaatatttataatcactgccctgggttttctcaactttagtagtcttgacattttggaccagataatctcttgttgtgaagggttgccctgtgcattgtaggatgcttgacagcatccctttacccactagacaccagaaataccctcgcccacattcatgataatgaaaatacctccagacattgtcaaatatcccctaaggaacaaaatcaccctcctttaagaaccgtagctctccactccaccccagggcactactacaggggtgtaatggcctccatgttcccagttttattagtggactcagccttgtaatcatgactggtagttgtaattcttccctctttttgttttgaaggacactttattctgctattggcattgacctggcatctcatgggtttatagttgctgctgtagaacacaggtatgttacctgatataattgggctctttggccaactacagggaatgtcaatgctcataactatgtttctaattttcataaaagtttatttaaaatgttgatggaactttcaagtatggtaacatcatgagcaaaaaaggagattgagtttatcgacttaaaagacttaaaagcacctaacatttctagagtgtttattgcctgccatgtcctatgcgaaatgtttttaatacgccatttcattcagtcttcataacaatcctatgagatggttattattattattgttgttgttttaaggaagaggaatatagaggtgataaagggtaatttgcccaaagtcacacaactagtaagtggcagtgccgggatttgattcctgagactgagtttcaacatggctaacattgcctcccagaattaggaagatagaatggattgagtttacctgcaacttgatgatagacaataaggtttttttcctggaactcttttacagtcttctttaatttaagagaaaatatagagtggaagaagaaagggaagtcaaaagatcagaggaagttgagtcaaggatggaactgagaaacatgggtcagatgaggaagggaaggagcatgcataaataataattttgcttgtattatagagatagatctgcatctgcaacttactatttcaaggaccaatctgctgcagaaataggggacaagtcttggctctaccttagaaccctgaaacaagaggaggagacacatatacgaaatgagcaggtacattgcagtgaaaggagaggtggttggtgacctaaaagcatgtacaaaaggatgacatttgttaatttaattttacacctggcaagttatgctcctagctctcctatttcccattcccaaaagatctgtcaatagattcctggagcagtaaaattcccttaatggaatatctagttcatagtaaaaacaaaggcaaatacaaaaatttgggagatgacagtgaatattcagaattcccttgaattaaaacttctaattttagaatctaaaaagtgctagaaaataaattaatagattcttcctcacagacaatataaaaagactacttttcagagaggcagtatacaatagaattaagagtatgggccttagaacccaactttctatgtttgaatcctggctccaccacttaattttgttatagaataatgaatagaaacattatttgtcttacagagctattagggcagttaagttaagtgaagcatattggcttcctctttatagtgggtgttttacatgtgttattatgtttgagtccacccacatttcctttaggtaggaattattatacaatcaatggaaactcagagaggttaagtaaatcgtctgaagtcacatagtaggtaagcaacagagccaggatttggactaagctatacctatgtgcaaagctggggcctgtgtcattatggtagcaagtaatagtcactaatcagatttccagtttataactgaccaacgatttttcccaaatacagcttctacctaaactttaaaataagtgttataactttttactttgtcatttccttcttctaataattatattaggtacggcaaagagcaaaagaatgttcccaagctctcagtctgattcttgacattgatcatggaaagccagtgaagaatgcattagatttaaagtttgatatggaacaactgaaggtaagctataaaaagtaatttttctcttgtcctacagttctttattgttttttgtcatttaattttctgctatattgcaaggtacaatatgataaagggctgcaaccagccccctccccaatgcgcacacacagacacacaaagcagtacaggtaaagtattgcagcaatgaagaatgcattatcttggactagatatgaaattgccaaaagttagtcagttttgatctacaaaaacagcaatgtcatatggttcaactcaactcctgtggaagtattattatttcatggacagctcctgcatgtttttaagcttgatcttgaaaacttgacacaagtttgggagcgggtggaaaaatatcagacagagtgggcagcatgaacaaagactcaaaagtgtgtgtggcatgtgaagtgcagggattagggggaactagagaataagatgatggtctgttctccagatacaatgaagaaatttgttatccctcaagcagccactctcttctgtatccttgcctttgtacatgttgtccccttggcctgacacacccttccccttgcctaactcctacctaatttcaagactccagttgagcatcacctcctctaagaagctttcttggaccccaatacccacttctggactgggctcgctgtctgtcatgtgtgctcctttgtaccactgtactgtattgcatcatgcctctgtataactttcttccctgatggactgcaaactcactgaaatgagactgcagtacctggcacagagtaggtactcaataaatactcatggaatgaacaaacaaataaacatggggtgaggagaggcagaagtcagaactgatgttgaagtttccagtgtgggtgactacaaagaacattaagtttactttcaaacctttacatatgttatatatatgtgtaaatgtgttttatatgtgtatatagatgtatatgtgtgtatggtatgtataaatgtatgtgtgtatatgtatattctattttataagaaatcaatgtatttaaccatccccatgaaatgaacaattatatgattgacaaaatcatttcttctaacaccacgaaatagctataaatttatatcatgctttttcaaataggactctattgatagggaaaaaatagcagtaattggacattcttttggtggagcaacggttattcagactcttagtgaagatcagagattcaggtaagaaaataagatagtaaagcaagagaatagtaaattattggaagaaattatattgtgagatataattttttattcaaattcttagtgaagaagggatctcttggagtttataaggctattcttttgcccccataaaatactctatatacattttcctaggctaaaacatctacctctcctgctattaaaatctccccctactcccataagttttccctcattattcttgtttacccaaggggttaacacttttcactgaaaaatttatctttatataattttttgtgacataatgattgtgataataatattgtcatcttaacagtattgccagacttctccagtgggcaggacattttttaattaggtttttcccccttccacctttaagatggagctggatctaaaattacaattatttgggtaagagttgggacaagaccccagttttctagcttgcaggaacattttctttcttaaaccttcattccagactgatgagatcacatagaaccaaccgtacagagagtgggcaggatcatttttgaaacttcacctcaaatttcttaaaagtccatttcagtgtaagaattctcttctttgatccatttaccaaaagatcaggaaacataggataaacttacttttaaaaaggaagttagtttcatcttcaaatgatatgctccatatgtttttcttcaaccctcagacagtttttcagctgaagtgcctctaaatataaagtaatgggcccaattgttactctaataaagctataataaatacactacaaggtgcataaaagctctgaaaacaaaggtgtatttattatactttttcagatactccacagtgttgaagaaattattatgtattctaaaatttattttgaataaaaagttttaaggatatatcactcaaatggttgcaattcctaaaggcatataaagaaaatgattatataaaattccaggtctgctactttacaaagttaatcatatccctttcccacattgaagtatgatacctctttattccaatcagataacccataataaactggtatggtgcgtgtccaccaatcctagcattattaggatgtcctcaatgttggctagtatgtaaccagtttaatttcatcattgtcaacaaatatctacagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggtaagtattagtgacttatttcattatgtgaaacaaacttgaagcttgggtaaatatcaatcgatatcatttggtaactattaaagaattgctgaattggttgtttagactttcaataaggagagaattagataatctcagtttctaagtacatttagtcttactctttttaaaatgggaatgttaacgtatatagtatatatactggttatattagtctgttcttgcattgctatatggaaatacctgagactgggtaatttataaagaaaagaggtttcattggctcacagttctgcagcctgtacaggaagcatgatgctggcatctgctcggcttctggggaggcctcaggaaacttacaattatggtggaaggcaaccggggcatgagcacttcacatggccagagccggaggaagagagggatgggtgaaggtactacacacttttaaataaccaggtctcacaagaattcactgtcacaatgacagcaccaagggggatggtgtgaaaccatgagaaactgctcccatgatccaatcacctcccaccagtccctgcctctgacactggggattccaatttgacatgtgatttggtggggacacagatccaaactatatcactggtaattaaaattagcattatactacatgctacttcaatctaaacaccagaatatgcctacagatttttggggttagagctagggggaagtattccatcattaggctggggtaggaactctttaaagaaaaagtcagattatcgactgagacctgcaatatactaacctgttgagaaagaatatgagtttataaattccccaaagctataatggggtaccatgacgtgttggcaattcttgtatcctggaggtgaaaaagaactcctgataaggttttgaactctcgatgagatattacaaagcaaagatggacctgaactcacccctttcctatctgaaatctggtttatttaggagaagagaagaggcaggaaggaaatatatggagtataggcaataaacactatgggctcagagaatagaggggtctcttccaacagaaaaggattcatagatgacactaaaattggattttgtaagatcaagagagtttagatagtaaggaagggtttaggtatttcaggcaaggacttcatttagcttatgtgtatgtgcaactctttctaattctaaaacggaaataatacagaacacctaaccttccctcaaccctatttccttactaagctctcacctttgcttttgtcccttctctgctagaaaccttcaaagaatagccaatattagtcattgcatgtgcttacttctattcactctttgactcttgtggtctagcttcctgggcccccacgggcatgccaaaacaaagacactaaaggcctgctgcctgccacaccagcagcctcttcagagtctcaaccttgctctctgcatctgttcaacattgctgaccacccctcttcctgctcccttggctactatgacccacctctttgctgcttctcctgtcatttataccactccttccatttcttctcctctggcagttctctacagtcagatcatccaagcttctgctcgcaattctcttgtattcctgctgtttatcttctttatgtttctgacattcaagtttcctactacaatgtggggaagagtgagagggagttaagtggccctgttttgagcttagatgactaaaagaatgatgggttgcttataagaaccagcagagtcaagaggcagagcagctttgggcaggactgggaagatgtcttttaacttcacaatttcttagcttgagaactgaggaatctgtacacagatgtctggccacacattggatgattacataatttacatgataacacagatgaaacatttgaagtagaagagattgcaaagtgagaaaagagttggtctgccagtagaatcctaaggaatgcctacattcagccaatgggaaatgggtgaagagccagtgaagaacatagagtggttagcgtcagaagggaaggtgcaatgttaaggaaacgtaaagaaaaaaagtgcaagaaggccatcaagtgtcaaatgtcccagtggtggtagaaaacgaggacttaaaaaaggccattctatttgacgttaggctattgatgaatttacagagcagtgcaaatgatatttataaagtgcttacagtttaatactgggaaaagtggtgtttgaaatctgtttcctctaaggcttaaatctaaagtgatttaaatttaaagtgactagcatcaaatacataccacgttcagtggtgagggcaggtagcaggctctggctctgagttcagggacccttcaatacagaacacattccagtattcaaactggaagtattccaattcactaaaaagcaagaatcatttcttctaaaatcaagataccaagcaagaacaagattctttgagttgtatttctagagggaagaagaatatactctgggatccctaaacaaacagcctgtgacccttgaaacacatctaagtagatcaaattacaagttttatttcttctttggttttcagtaaacagaccaacaagaccagtacctttcttacactctaactaaaaaaataataattttatcaaacaatgtgacttttaaatgtcttgttctcttttaggggttcagtccaccagaattttgctgacttcacttttgcaactggcaaaataattggacacatgctcaaattaaagggagacatagattcaaatgcagctattgatcttagcaacaaagcttcattagcattcttacaaaagcatttaggtaagaaactatttttttcatgacctaaaccagatgaatctcaggacaaagctgtctatcttaatacagctttagtactatttaaactatttccagttggtttacaatggaacaaagcagtatatcaatttgaaaacagaaatttgagaaagtcaattttgctgctttacatcctctatatcatagaaagcaaatccaactgttaaaggtaatattctttgtatgaagcctagagtggacttccatgttgaggatactgacagcaggttgcctcactcctatcccgtttgcattcagctgctaaagcagccatgaggcagctgatacagagcacatcgtctctaccatcctaacggaacttgtgtaatttgtaaatctttattgccacctaggggcaccaaactgtttaatgctctcaaaagtttaatatgttgattaacactttatattttataggacttcataaagattttgatcagtgggactgcttgattgaaggagatgatgagaatcttattccagggaccaacattaacacaaccaatcaacacatcatgttacagaactcttcaggaatagagaaatacaattaggattaaaataggttttttaaaagtcttgtttcaaaactgtctaaaattatgtgtgtgtgtgtgtgtgtgtgtgagagagagagagagagagagagagaagaattttaatgtattttcccaaaggactcatattttaaaatgtaggctatactgtaatcgtgattgaagcttggactaagaattttttccctttagatgtaaagaaagaatacagtatacaatattcatatcagcctaaattttaattttaaagatgattccttttcagtgtcgaagttaaaaactgtttttacattactttgacagacaagtagattaaaacaggcaaaatcccagtgaaaacctgttgcaatgatacaagactccctaaacatagagtaaaaaacaatttcttgccttttattatctactatgggcagtggagtttaattatagcaacatgatattctaggtagaatttggcagctcttctctttgacttttggtcacggtaagaaaaattagaacaagcaaaagccattgtttcagcacaggattggtggtactacacaatttcaaatgatgactaaaaggagtagagaagggttaagaatattagagatgaggcaaaggcagtggattaaattggtaattttttgacactttctttaattctttaaggcattctacttgctaaagaaaggttccacaggtattacagcatatagcagggattccagttagaatacattagttactcacacaaaggctgtgaaggataataaaacattcagaattacatttagcttcttcatattccagttaattttatttaatgttttcaattctatatgtagtagtaaaacagaataacacgattaaatggaggtaaaaatatagcttaagaatttatacttataaatatgggaatcatggaaaatgattttatttcccaggggacataaaaatttataccactcatttggtaccctagtcctatcttagtggtgtcaggtgcaaagtcactcattctgagaaattttacttctgtagccattcagattaaattttttaaaatagggagttaaactcagcttgaaattgaaggcttcctataatctgatcctaatgcatcttctctgagctttgcttctggcaattcacattatattatctatatgagtaagccaaacttgtctattcattattccaggaataagtaatatactcatctacctcaattacttttaatgcaaacctctctcccttctacttacggaaattataatgggtttttaaggttcataattctatttccattaggcttcagagtctgataatgcttcacagagatacacctttaccccagtctcatttagcaaaccttttccctattcattttagaaataagcattccaactgtatggatgtcccattcaacacttttttgtttgtttgttttttacagtcttttgttgatggcgcatgctgatgctgaaaggagaaaataactattgaaaatatctaataagttaaggttaaaaagaaataacctaacatagtgcacactgagtatttttcagggtaaagaaagacacatttatcaaatgcctactccttttcagggactttatatcaattatttctcatcttaaaaaaacactgcaagaaaggttttattatcaccactttacagatgaagatcaaagttcaaaatattacataatttgcccatgtcacatatctgttaagcagcatatagctcagatctgtttctaaaagctaagatctatgctttgcaaaatcatgtttaaaaagtcatgggcttcaaagttaggtaggtctgggtttgatcaagcctctgagactcatcagctatctgaccttaggcaagttatttaacctctttatgaagcttcaattttctcacctataaaatatggataatattgatatgcacttcaaagttgatgaataaagtgaaaaaatgcatttaaagtataagctaagtgactaatacataagagctaacatttaata

SEQ ID NO: 858 - DNA, 30146 bp, Human; identical to SEQ ID NO: 599

SEQ ID NO: 859 - DNA, 601 bp, Human
tgttaatgataccagattcttcctctccctggtcttccctcagcacaaaaaacaggttcccagcctgtttatacagacaatcattttatgtagataatagaaaactcaccaactcattcagggggtgaaagttttcatccatggagacaacacgaaatttcactgaaacagaaatatttttcatgagcccccaaacccaaagtaggcctgtaggctggtaagacaagctattaaggaaccaagattataggaactttgcctggggaacatccaggggaagaagatctttcctttttgaagktgtcctgtctgtaggcttcttcatacctgtctgccctggtttgtagattgatttgtctgtctggacaaagaccagactgtcctcgttcttaaccatcactgtggtccgcttcttaaattcttgggttggtcctttcacttggacagtgaggaacattacctcctcattggatgaagactttgggacctgaaatacaggaccgatcctgaaaccccattcagcacccgcaggtctcctcccctatttgctgttgcactcttccctggagatcttgcccttcttacttaacttcactccctt

SEQ ID NO: 860 - DNA, 601 bp, Human
aatagttcaagtcctgtccacttgctattttgaaatacacagtacatctgctcttgaccattagaactcctcatcaaagtctggttcctcctccataatattcagctgtggctgggaagcggccttctatatggggactgtgtttgtcaactctctggcatcttggtggggccatgtgataggttcttgttcacagagagagcagaactgatggcctggccagctaaggcaattaagaggtgtatggttttttccttcctttgtagaagtgaatgcccatggaggctttagatggctcagygtctatcgttctgaaacactcacaatgggcaattacgagaaataaataattcccattgtgctaagttcatgattttttttgaaaaattacaatagccaacatggaattctcttctagattgttctcttcctgcgtcagaaaaatgctgcaactcactgcttttcaacaatgcctttatcgctattctctagaaaaaatagtgttcaacctacctgtccactgaatttctcacagaaagcctgtgaatcttcaccgtggcagtcggaagcgtcactatactttctgcaaatgctcacagtc

SEQ ID NO: 861 - DNA, 601 bp, Human
gatcagtggtcagataaccggtgtgatttttgtggggggacaacatcatgtaggcattttctatgacgaggacacaataaaatattctctagcaactaaatattaaatttcacaacaatatctcatgtataattgacagatgtattccttggtatctgaaattccctagatatattgcgatagaaatgtcttaaaatttgaggagtaattttttttgtacaaaggatgcataatatttatacatatttatggggtacacgagatattttgttacatgcagagaatgtgtaatgatcacatygcgggatttagggtgcctaccaactcaagtatgtatcatttctatgtgttggaaatagttcaagtcctgtccacttgctattttgaaatacacagtacatctgctcttgaccattagaactcctcatcaaagtctggttcctcctccataatattcagctgtggctgggaagcggccttctatatggggactgtgtttgtcaactctctggcatcttggtggggccatgtgataggttcttgttcacagagagagcagaactgatggcctggccagctaaggcaattaagaggtgtatgg

SEQ ID NO: 862 - DNA, 601 bp, Human
aagaaaatcaatgcctgttgtgttttctcttatacccatgtagtacacaaacctgttccttcttcttggatctgggcctcagtgtgaagtttcatttcatactccttcctcttcagctggaagaccttggtttttacttgctgatagaagcagccatggctgtttagctaagaagggagaaaataaaatacaaaaatataatgcatattatactaaatagatcagtggtcagataaccggtgtgatttttgtggggggacaacatcatgtaggcattttctatgacgaggacacaataaaatattctctagcaactaaatattaaatttcacaacaatatctcatgtataattgacagatgtattccttggtatctgaaattccctagatatattgcgatagaaatgtcttaaaatttgaggagtaattttttttgtacaaaggatgcataatatttatacatatttatggggtacacgagatattttgttacatgcagagaatgtgtaatgatcacatcgcgggatttagggtgcctaccaactcaagtatgtatcatttctatgtgttggaaatagttcaagtcctgtccacttgctat

SEQ ID NO: 863 - DNA, 601 bp, Human
ctggtaaaccatgagaaggagattgagtgacttgtacaatgctgtttcaaaagaaggggggaaaactctactaattttaataaggccttaggataattacatacatttcatacacaaatttacagaagaataaatctatttttatgtagttttatacctttggttatactaatcaagccttggtgatattttatacttttggttatattaaatgataacattaaccaggcatggttttagcacaaaccataactattgtgctaattaggtaacagtacatgggttgatgagtgaactggaraatactccacctgcccaaagaagggaattccctgtcgaaagtgtgagtccactttcacaaatgagagtttggttatggttcttgtgatttcactggactgccttccagtcaattccaccactgaaaaaagagaaaaaaatctgttatttttgggaagaatgatgtctctaaaattctatcacctccccccaacttacaattcattatttggctaagaaaatcaatgcctgttgtgttttctcttatacccatgtagtacacaaacctgttccttcttcttggatctgggcctcagtgtga

SEQ ID NO: 864 - DNA, 601 bp, Human
ccctaacagtaagagaggtacccataacattggtggtgttgatagagaactgtacaaggccatgctcatccgtggtagcattggagtaatagtttgcttcatttcctctgatgaatatgactttatttggtatagggacgcctttcccatctactaggcgcacctgaagattaaaagctgtggattagttatattggtaataactaataggcaccaaacatattcatttatcacattttttagtgcctcctctatgttgaacatggttccaggcactgaggacacagcagtgaaaaaaaaacgaagtttcttccatcacagagcttactgtctagtgaaagagatagatgctaaataaatatatacataacatacactaatttagtagtaatcaatcctaagaagaaaaacagagcagtgtgaagggatagagagtgatagggataataacaagagtgacctgaaaaatgtcttctagatattttggaagtgctgtgtattattatatataactcttagagagtcacagagcactagagtaatatgataatgaaatattttaatctattaatctattaactaaatttatttgtgccccaaa

SEQ ID NO: 865 - DNA, 601 bp, Human
cttgatggacatttgggtagcctcgatctctcagctattgtgaatagtgcggctatgaacacgggtgtgcaaatagctctttgagaccccgttttcgattcttttgaatatatgtccagaagtaggattactggatcatttggtaattctattttttaattttttcaggaactactatactgtttttcatagtggctccgccattttacgttcccagcaacactgctaaagtctaacccgcacttttaatcacaatatactgccttcttttcataaactttaaaaaagttaaccttcaatyggtttctaattgctagtttttttctctccatagaactagacacagtttggaaattttctcacccttaggttgcaaccttgtttccaaggctacttcatgtcattggtaatttctttccaaacttaccctaacagtaagagaggtacccataacattggtggtgttgatagagaactgtacaaggccatgctcatccgtggtagcattggagtaatagtttgcttcatttcctctgatgaatatgactttatttggtatagggacgcctttcccatctactaggcgcacctgaagattaaa

SEQ ID NO: 866 - DNA, 601 bp, Human
ttctttagtgtacagtttggtagtattaagtatatctgttgtgcaacagatctccagaacttttcatcttgtaaaactaaacctgaataccaataagaggaattccccatttctctctttccctagcccttggcaaccaccatcctgttttctgtttctatgactttgactactttagaaaccccatgtacgtgaatcatatagtattggtctttttgtgactagcttatttcacttaccataacgtcctcaaggatcattcatgctgtagcatgtgacaggattttcttcccttctcagrctgcataatattctgttgtatttatataccacattttgtttacctgttcatcccttgatggacatttgggtagcctcgatctctcagctattgtgaatagtgcggctatgaacacgggtgtgcaaatagctctttgagaccccgttttcgattcttttgaatatatgtccagaagtaggattactggatcatttggtaattctattttttaattttttcaggaactactatactgtttttcatagtggctccgccattttacgttcccagcaacactgctaaagtctaacccgcactttt

SEQ ID NO: 867 - DNA, 601 bp, Human
ttaaccactttatctgattcagattctggaattcacacttttcaaaaaagttattataaacacacacacacacacaacataaaattaccatcttcattattctttagtgtacagtttggtagtattaagtatatctgttgtgcaacagatctccagaacttttcatcttgtaaaactaaacctgaataccaataagaggaattccccatttctctctttccctagcccttggcaaccaccatcctgttttctgtttctatgactttgactactttagaaaccccatgtacgtgaatcatayagtattggtctttttgtgactagcttatttcacttaccataacgtcctcaaggatcattcatgctgtagcatgtgacaggattttcttcccttctcagactgcataatattctgttgtatttatataccacattttgtttacctgttcatcccttgatggacatttgggtagcctcgatctctcagctattgtgaatagtgcggctatgaacacgggtgtgcaaatagctctttgagaccccgttttcgattcttttgaatatatgtccagaagtaggattactggatcatttggtaatt

SEQ ID NO: 868 - DNA, 601 bp, Human
gcaggcgttttccattaccatgattatgtaatatatattaaatatgtattgtatatccatgtatctatagacatgtctacatctctcttgatgaatagaggactgcatgctataccgaataacttatattggtatgaacaggtcatctggagaaaattagaatagcaagacaaaataaagtaaggtaataatttttggagtatatatatttaaaactaaatgctaattatgttagaattggcttttatagtaaaagtatctaacagttaaagggggcttactaagtgattcaacatgtatkatttcacttaatcttcacaaccaccccaagagtcaggtgttagtattgcaatcattttacagataaggaaatgaagcacagaggttttagttaattccttaaaatagggttgagccagtatttttaaccactttatctgattcagattctggaattcacacttttcaaaaaagttattataaacacacacacacacacaacataaaattaccatcttcattattctttagtgtacagtttggtagtattaagtatatctgttgtgcaacagatctccagaacttttcatcttgtaaaact

SEQ ID NO: 869 - DNA, 601 bp, Human
ggctcgtctcgaactcctggcctcacgcaatccacccacctcagcctcccaaagtgctgggattacaggcgtgagctaccgtgcctggcctaggctgactatttttaatgctccctgcaatctggattctaatacctcagaggccctatttgggttatatttccaacttttcttcctgtagaagttattccttagctcctttcaggcttcctctaccttcatccccagctcccaatagcactagtgaatccttgagcaaaacattttgttcatatcttaatgtatattttggtgacaacayatatatgatcaccccaaacagggaacaggtagaaataataatttcattgtcaagactagcacagtgctggcacgtggaaagcattcaagacactttttgaaatgagtaaacattcaaattagagggaggtgcttttatgccatctattaaagctaaataaataaaatgtattatttatttctctataacaaggtaaaactctaaagaggcaggcgttttccattaccatgattatgtaatatatattaaatatgtattgtatatccatgtatctatagacatgtctacatctctcttgat

SEQ ID NO: 870 - DNA, 601 bp, Human
gtagaaagcattggtttaagagctgagctgatgaattagctgaagtctagctcttctgggctatcttaggctgattgctattattattatttttttgagacagggttttgctctggcgcccatgctggagtacagtggcacaatcttggctcagtgcaatctctgcctctggggctcaagtgatcctcccagtcagcctcctgagttgctaggactacaggtgcatgccaccccacccagctaattttttgtatattttgtagagacagggtttcaccacgttgcctaggctcgtctcgawctcctggcctcacgcaatccacccacctcagcctcccaaagtgctgggattacaggcgtgagctaccgtgcctggcctaggctgactatttttaatgctccctgcaatctggattctaatacctcagaggccctatttgggttatatttccaacttttcttcctgtagaagttattccttagctcctttcaggcttcctctaccttcatccccagctcccaatagcactagtgaatccttgagcaaaacattttgttcatatcttaatgtatattttggtgacaacacatatatgatcac

SEQ ID NO: 871 - DNA, 601 bp, Human
gagatttatatttcttaagagcataaaaggaggcatcctttgctctgattagcttgcttgaaatttctttgactgctttacctgtgcaattagagacactggagctatgaaacttcattgaggagagtaaataatctctagaaatggaagaactgtgctttcagaaagcagctgcctcttttagggtggattttgaatgggtattatgaataaataaaatattgtaaccttaggggtctgagaagacattggtagaaagcattggtttaagagctgagctgatgaattagctgaagtctasctcttctgggctatcttaggctgattgctattattattatttttttgagacagggttttgctctggcgcccatgctggagtacagtggcacaatcttggctcagtgcaatctctgcctctggggctcaagtgatcctcccagtcagcctcctgagttgctaggactacaggtgcatgccaccccacccagctaattttttgtatattttgtagagacagggtttcaccacgttgcctaggctcgtctcgaactcctggcctcacgcaatccacccacctcagcctcccaaagtgctggga

SEQ ID NO: 872 - DNA, 601 bp, Human
tggccacagggtagttcatgagacatgggctcaaggtggacaaagctcttgcttggggagaacacaagataagcagtgtgatgtgcctcttcgtgttcttctgacacccactggtagccgtaacagggactacgatccttgtaattgacctaatgaattagaaaaattatattatttttagattatacgtcataaagattaatgttctcacaaaactacgtaagtttactgtcctaccttaactagtagctagaaatcttttgttccacaatgaaaagtgggagaaggacccctgattttstttctctgcttcaaatgtaggcatgctttgtgactttacactgcagagcctcctgggattgagatttatatttcttaagagcataaaaggaggcatcctttgctctgattagcttgcttgaaatttctttgactgctttacctgtgcaattagagacactggagctatgaaacttcattgaggagagtaaataatctctagaaatggaagaactgtgctttcagaaagcagctgcctcttttagggtggattttgaatgggtattatgaataaataaaatattgtaaccttaggggtctg

SEQ ID NO: 873 - DNA, 601 bp, Human
ctttgtgatgggctgaagctcaaatccacctgtgaaattggaacaaaaggtcagaaaagcaaatttccaggtttacccatgcattcactcgcatttgcagagtgttcctcatgtacaatgtataaccactctgcttgacttcgtggagggttggcattgtgtcaatcctgaagctttttgttccctacacttctctttcattctcaagaatcacttgagccagtagaattatttctaattattcttataaattactagtcatgaaatgccatttttatctttgatacacggcaaggtgctyattaattgtggtgggacatgcatgggtctaggtgctcttgcatttttcttttggctccttagtagtcttaaaaacttgcttacatatttcccaacgtttcatcatagaagaagggaataacatactctgaactgtgtaattggtaagaggcactgctaggagaagtttgagagttttgtataaggaatcaagtgattctgcttcttagtgtgactctgccactaccttgctgaatgtctctggggaatttgtttaacccttttggccctaatgttcacatgtgtaaaacaaatgataaca

SEQ ID NO: 874 - DNA, 601 bp, Human
gttaatcctttcttttattttgcataactgcacttctcatatagcacttttcacaatctgctctgtattctctccagccttgcatatacggatgtcctgacacaatcagaagatttgaatttgtattgctatgtgctcttgagcaagaagcttaacgtgtctgaataacgagtccttttttggttgttaattttcatcacattttgtccttttaaaaattcttttatttgattcaatatattgtattttgtttatttttttaactgcagaagtgagtagttatatatatatatatataaaattccttaccaatgaaagcccacaagagagctcaaagcaattaattcctagataaatataattttaattgatcttatcctacttatccagtcatttttccttgctctgagcccctggcacggcccttcttgattcctgaggctgccaggaactcaccgaggacgccgagagctcagcatcaggcttcatgagcagcacgctttggtccacagcacggagggcgcagacggactgaggagccgctgtgactcgcaggtgggcgtgtgaggctgggagactttgtgatgggctgaagctcaaa

SEQ ID NO: 875 - DNA, 601 bp, Human
ctcagttaatcctttcttttattttgcataactgcacttctcatatagcacttttcacaatctgctctgtattctctccagccttgcatatacggatgtcctgacacaatcagaagatttgaatttgtattgctatgtgctcttgagcaagaagcttaacgtgtctgaataacgagtccttttttggttgttaattttcatcacattttgtccttttaaaaattcttttatttgattcaatatattgtattttgtttatttttttaactgcagaagtgagtagttatatatatatatatataaaattccttaccaatgaaagcccacaagagagctcaaagcaattaattcctagataaatataattttaattgatcttatcctacttatccagtcatttttccttgctctgagcccctggcacggcccttcttgattcctgaggctgccaggaactcaccgaggacgccgagagctcagcatcaggcttcatgagcagcacgctttggtccacagcacggagggcgcagacggactgaggagccgctgtgactcgcaggtgggcgtgtgaggctgggagactttgtgatgggctgaagct

SEQ ID NO: 876 - DNA, 601 bp, Human
agataatacatatgttccctcagaaattatgtgtagcttgggacagcaattatttcaactgatgtaattctttttttttttttttttttgacaccaagtcttgctctattgcccaggctggagtgcagtggcacgatctcggctcactcaacctctgcctcctgggttcaagtgattctcctgcctcagcctcctgagtagctgggatgacaggcgcccgccaccacgtctgactaatttttgtatttttagtagatacggggtttcattatattggccagactggtctcaaactcctgayctcaagttatctgcctgccttggcctcccagtgttgggattacaggcgtgagccaccaggcccagccataattcttataaaaacggaaatctgatatttcatttagcctgtatagcctcagtgcaggtatatgtatcacttttgttaggctttttgaaatgttgaaactagtttgacaactcctattactggttgcatggagctctgggattttaaggactttgggtactgtatggtctttttacattttaaatatataattttcgaacggcttccccggttgctcagttaatcctttct

SEQ ID NO: 877 - DNA, 601 bp, Human
aaagcttcagtaagaggttattacaattggtctcatattaaaaatttgaagatgtgagcaaactactattagtacatgctattaactagtttttgttgttccaattcagcatatccttttggtatttcttctattagctccatattttcaaagagttcagttatcaatgtcaattatatagtagttcaatttccctaagttttgttcctcagagataatacatatgttccctcagaaattatgtgtagcttgggacagcaattatttcaactgatgtaattctttttttttttttttttttgacaccaagtcttgctctattgcccaggctggagtgcagtggcacgatctcggctcactcaacctctgcctcctgggttcaagtgattctcctgcctcagcctcctgagtagctgggatgacaggcgcccgccaccacgtctgactaatttttgtatttttagtagatacggggtttcattatattggccagactggtctcaaactcctgatctcaagttatctgcctgccttggcctcccagtgttgggattacaggcgtgagccaccaggcccagccataattcttataaaaacggaa

SEQ ID NO: 878 - DNA, 601 bp, Human
gacactaatcaaagcttgagaagagttggtgttttaactcaggtctactactaaatccctgaaagcttctgctttattattaataaataggactgtctgccttatctacccatcagggttgttataatttgaaaaattctttgagaattataaaattatattataaaagtataaaacatgtatattattttcccacatatcctcttgagatcctactgttgaaatgtacttgatgcttcctttagaagtattctaatattttcagttaaaatcccattagaaggacaaacaagtaagaaayatttttttataagtttctatttcaggaaaataaaaatataaatttctctttgttaaattatggtagtagaaaaagcttcagtaagaggttattacaattggtctcatattaaaaatttgaagatgtgagcaaactactattagtacatgctattaactagtttttgttgttccaattcagcatatccttttggtatttcttctattagctccatattttcaaagagttcagttatcaatgtcaattatatagtagttcaatttccctaagttttgttcctcagagataatacatatgttc

SEQ ID NO: 879 - DNA, 601 bp, Human
tccagtagctcactgcttgatctctactagcacttagtataatacctagaacacagtgggcattaaataaatgtgttgaatgaatgacctacactagtagcagcaaagtgtttcattggtaagacactaatcaaagcttgagaagagttggtgttttaactcaggtctactactaaatccctgaaagcttctgctttattattaataaataggactgtctgccttatctacccatcagggttgttataatttgaaaaattctttgagaattataaaattatattataaaagtataaaacaygtatattattttcccacatatcctcttgagatcctactgttgaaatgtacttgatgcttcctttagaagtattctaatattttcagttaaaatcccattagaaggacaaacaagtaagaaacatttttttataagtttctatttcaggaaaataaaaatataaatttctctttgttaaattatggtagtagaaaaagcttcagtaagaggttattacaattggtctcatattaaaaatttgaagatgtgagcaaactactattagtacatgctattaactagtttttgttgttccaattc

SEQ ID NO: 880 - DNA, 601 bp, Human
aaataaattgtggctatgcgtaatggaatattattcagccttaagtggaagaagatcctgccacttgtgacaacatggatgaacctgggggagattatgctaagtgaaataagccagacacaggacaagtactgcgtgatcttacttgtatgtggatgctaaaagaagttgaatacataggaacagagagtagaaaggtggttggggttgcagggatgggaagaagcaggtcaaagggtacaaagttgaagttacgtaggatgaataaatttagaaatctaaagtacagcatgaggactgyagttgataatactgtattggatactgaaacttggctaagaggatagattttaggtgtgcttgctatgcacacaaaaataggtaacaatgtgagctaatggatgtgttaatttgcttgactgtagtaatcatttcactatgtgtatgtgtatatatatatatcaaaacatcatgttgtacatcataaacatataaaacaataaaaacagaaaaactagcaaagagttgaaaatagtcagggacctctattgttgcatattgcatatgcaggaagttacttactttaccaccaccaaatccc

SEQ ID NO: 881 - DNA, 601 bp, Human
ctagctccaggagtagatggagctctgcaatcaggagtctccctagaccacagtgaacacagaggtggttttaaataggcctttgagcaatgccagtggctacccgcccccaccaccccttggctcaatacagagagaacaggcaaaatctcccatttctggctgtctcctaagggttgggcttctaaacagcctgcatctgggagtgaaagggagaagtaaacaagactccaggagcctgaaagggagtatatggccattccggctctttctctccacctgccccactggcttgtttcasggataaaactctgtttccagtgtctctctggaaggaatttgttcactccccttggtgcaaatgtacattgccacagccattatggaaaacagtatggagatacctcaaaaattttaaaatggaaactaccatatgtcccagaaatccctcttctgggtatactcccaaaggaaatgaaataagcaccttgtagagatatatgtgttttggtgttcattacagcattattcacagttgccaagatataaaaacaacctaagtgtctgggtgaatggataaataaattgtggctatgcgtaa

SEQ ID NO: 882 - DNA, 601 bp, Human
tgaccattcccccggatctcccggcagaggatacaagacttataaacagttatggtttcagcaaaggtaagatgctcacaaacgacttttaaaattaggtttaatataatgaatgagctacgaaaagttaaatatatgagatcgtagaggttgaaaccttgtagaatctgtcatgagaatagagtactgacttttgtcacccctgtcagaattcttcataccacacaaatactaactttgaagggttataagggctagaaacttgctttatggtgcaatttggtatttggagatctcaaaacctgtaacttttacaatcatgaatatctagtaagcatattttgcatacaagagtttgcagtattcctaggaatgcaacttttaatttacttgatggctaccttgtatttaatttaggaaagagatccttacccggatgcatttgggaaggtagtttaggaccgtggccttgagtgtgaaggcctctccacgaatcacagagtaaggcattgtgagctccacaaagaagggctggaaggctcggagagaggcagtggaagagataccaagtccagcatcttcagacaggcagaaggcccct

SEQ ID NO: 883 - DNA, 601 bp, Human
caagactctgcctcaaaaacaaaaacaaaaacccccaacaaaacagaaagtaaatcaagagagagataggacagagagatacatgagaataatattataaaatatccatatattattatattacccacatatattatatattattgtggactatatattatttaggtttacttacttcaaccaacagaggcttgatgactgtgtctttccttccgtgttcaggaactgaaggcacctcagtcccacacagctcttgagactctagtgcctctgcgctcacagtgaaattcacatttcctgwaaaaaaaggccagtagaaatgaatagcatcttccccttcctccatgcctccaaactcaagatttagaaatgttcaatgctctgtaaacttttgttttattaaaacacagaagcaggaacggaaacatgcaaatgagaggtgaatgatactgagaattcaaggtggagatgttgaggatatccttgtaggcatcttagaataaaaggcaaaggaaaaaaatcgcagcatctagtggtcttttcctgaaggaagtagcactcaatataaggttcccactgccatatacaatctttgagtaga

SEQ ID NO: 884 - DNA, 601 bp, Human
ataggaagactaaaacactaagcagaattgtgatgtatttatattataggcttaaaagcaattccaaggaaagacctagatctacaatttaacataggtaaatctccaagacaggatgctgagtgaaaaacaaacagtgatttatagaatgaaacttatacagtttattatatgtaaatcacacatccacaaacatatacatctacacacattatttctaaagataaatggatggcaaagtactgaaaaatgttcaggggggtgacattaacctttaatgtgatgttctgtttttttttttaaagaagaatatatttttgtaaaattaggtaggcacatttgattatgttggtaattaaaatgaaatttagtaaaactatttgatgattagcccttacacttaagagatacatcaaaatgagtaactcagaaacggagaagtcatgataaaaggattgaatgataggtaatcagttcacttaaatgtagaaataaggctaaatgacaaggaagttatgtttttagggtacattttatgtgttacatcttggcaacagatgaatagataaagtatttagtacgaaaaacatactaaatttgt

SEQ ID NO: 885 - DNA, 601 bp, Human
gggaacacagcaaaagctcatcacttaaaaaactaaaccaaccaaccaaccacacgaaataaactagcagactaaatccaacaatacagtaaaaggatcatctacctagtcaagtgggatttatccctgagatgcaaaaattgttcaacatatgcatatcaataaatgtgatacattacatttacagaatgaagggtaaaaaccataccatcatcttgttagatggagaaaaagtatttgacagaattcaatgctcttttatgataaaactctcaccaaattagatatacaagcaatgttyctcaacacaataaagggcatgtatgataaacctatagcttacatatttaacagtggaaaattgaaagactttcctttaagatctggaacaagacaaggatacccactgccaccatttattttcaaagtagcactggaagtagcagcaagagcaatcaaacatgaaaaagaaatgaaaaatatccaaattgacaaggaagaagtaaaattttcactgttggtgatgacattatcttatatattggaagctcaaaagacttcaccaaagggctgcaagaacttataaatgaatgcaataaag

SEQ ID NO: 886 - DNA, 601 bp, Human
actttcaagctcattttatgaggcaagcattaccctgataccaatgtcataaaaagacattacaaaaaagaattacagaccaatattcttgatgaatatagatgcaaaaatcctcaataaaatactagcatagcagctaagcatggtggcatacacctgtgggtggctgaggtggtaggattgcttgaactcaggagttcaagtccagcctggggaacacagcaaaagctcatcacttaaaaaactaaaccaaccaaccaaccacacgaaataaactagcagactaaatccaacaatacaktaaaaggatcatctacctagtcaagtgggatttatccctgagatgcaaaaattgttcaacatatgcatatcaataaatgtgatacattacatttacagaatgaagggtaaaaaccataccatcatcttgttagatggagaaaaagtatttgacagaattcaatgctcttttatgataaaactctcaccaaattagatatacaagcaatgttcctcaacacaataaagggcatgtatgataaacctatagcttacatatttaacagtggaaaattgaaagactttcctttaagatctggaa

SEQ ID NO: 887 - DNA, 601 bp, Human
gttttccattaaagaaaagcctaataactgttggcttcactgctaggttctacttatcatttaaaaagaatgaataccaatccttctcaaactctgccaaaagctggaagaggaaggaatactttcaagctcattttatgaggcaagcattaccctgataccaatgtcataaaaagacattacaaaaaagaattacagaccaatattcttgatgaatatagatgcaaaaatcctcaataaaatactagcatagcagctaagcatggtggcatacacctgtgggtggctgaggtggtaggaytgcttgaactcaggagttcaagtccagcctggggaacacagcaaaagctcatcacttaaaaaactaaaccaaccaaccaaccacacgaaataaactagcagactaaatccaacaatacagtaaaaggatcatctacctagtcaagtgggatttatccctgagatgcaaaaattgttcaacatatgcatatcaataaatgtgatacattacatttacagaatgaagggtaaaaaccataccatcatcttgttagatggagaaaaagtatttgacagaattcaatgctcttttatgataaaa

SEQ ID NO: 888 - DNA, 601 bp, Human
atgggtcaataaagaaatttaaaaggaaattcaaaaatatcttaagacaaatgaacatggaaatggagcataacaaaacatagcataaagtaaaagcaattctaagaggaaagcttataacaataaacaccaaaaaagaagaaaaatttccaataaagatactaatgatattcctcagagaagtaggaaaagaagaacaaagtaagctcaaaattggcagaagaaaggaaaataataaagattagagcagaaataaatcaaatagagactagaaaaagaatacaaaagatcaatgaaactraattgtttttttaaaaagacagacaaaaacttttagctaggttagctaagaaaaaagagggaggccttaaatatataaaatcagaaatgaaagagaaattatggctgataccacagaaatacaaaggatcataagagactattatgcataagtatacaccaataaattggatgatctagaagaaatgaatgcattcctagacatatacatactaccaagactgaatcatgaagaaatagaaaatctgaactgacaaataatgagtaaagagattgaatcagtaataaaaagttttccatt

SEQ ID NO: 889 - DNA, 601 bp, Human
aatgggtcaataaagaaatttaaaaggaaattcaaaaatatcttaagacaaatgaacatggaaatggagcataacaaaacatagcataaagtaaaagcaattctaagaggaaagcttataacaataaacaccaaaaaagaagaaaaatttccaataaagatactaatgatattcctcagagaagtaggaaaagaagaacaaagtaagctcaaaattggcagaagaaaggaaaataataaagattagagcagaaataaatcaaatagagactagaaaaagaatacaaaagatcaatgaaacygaattgtttttttaaaaagacagacaaaaacttttagctaggttagctaagaaaaaagagggaggccttaaatatataaaatcagaaatgaaagagaaattatggctgataccacagaaatacaaaggatcataagagactattatgcataagtatacaccaataaattggatgatctagaagaaatgaatgcattcctagacatatacatactaccaagactgaatcatgaagaaatagaaaatctgaactgacaaataatgagtaaagagattgaatcagtaataaaaagttttccat

SEQ ID NO: 890 - DNA, 601 bp, Human
tctgaccacaatactatgaaaactagaaatgagtaacaggaggaattagaaaaaattcacaaatatatgaaaattaaatgacatgctcctgaacagccaatgggtcaataaagaaatttaaaaggaaattcaaaaatatcttaagacaaatgaacatggaaatggagcataacaaaacatagcataaagtaaaagcaattctaagaggaaagcttataacaataaacaccaaaaaagaagaaaaatttccaataaagatactaatgatattcctcagagaagtaggaaaagaagaacaaastaagctcaaaattggcagaagaaaggaaaataataaagattagagcagaaataaatcaaatagagactagaaaaagaatacaaaagatcaatgaaactgaattgtttttttaaaaagacagacaaaaacttttagctaggttagctaagaaaaaagagggaggccttaaatatataaaatcagaaatgaaagagaaattatggctgataccacagaaatacaaaggatcataagagactattatgcataagtatacaccaataaattggatgatctagaagaaatgaatgcattcctaga

SEQ ID NO: 891 - DNA, 601 bp, Human
tgaaacaaaaggcccctaattaataatacaaaaacacaaaagcacaaaatttaatggtataagtaatatagagccatattcaaaatactctatgactgtaatgatggtatttaaagcaattttatctctagtacaagggttaaaagacaaaatattaataacaagcatagctaaaaataaattgtcaataaatacacattacaaaatatgtaaattctgacatcaacgacataaaatgtgtgtgggggagtgaaagaatgcaaagttaagttgttatcagcttgaaattgactgtaaaccycatagtaacagcaaggcaaaaatctttaatagaagcacagaacaaaaattttaaaagattcaaatcataccactacagaacatcagaccacaaaggaagacagcaaaagaggaacaaagaagcaaaacaaccagaaaacaacaaaatggtagtaccaagtcatttttaaattaataattaccttgaatgcaaatggactaaattccccatttaaaagacataaagtgactgaatggatttaaaaaaacaggaccgaaacatatgctaattacaagagactcacctaatttttaaggacac

SEQ ID NO: 892 - DNA, 601 bp, Human
agaagaaagagactataaagcacatttaaagcaataatgaaaaaaaagagtatagaatcagaaaaaaaaaaaagcagtaagggctgaaaacttccctaattaggggatagatgctagcatccaagtacaggaggcacagaggtctccagtgaaattcaaatgaaagaactgctcactaagacacaataattaaactatcaaaaatcaaagacaaaaaaaaattctgaaaagcagaaggtgataaagaaacatatcacatacaaaggaattccaatacaactatccatggatttttagcagkaacccggcaggctgagggagagtggaataatatattcaaagtactgaaggaaaacaaaaataaaaacaacatggaatcaagaattcttcatccagcaaagctgtctttcagaaatgagggagaaataaaacattcccagacaaactaaaagctaagggagtcgtcaacattaggcctgccttcaggaattactgaagggagttctttaagctgaaacaaaaggcccctaattaataatacaaaaacacaaaagcacaaaatttaatggtataagtaatatagagccatattcaaaatact

SEQ ID NO: 893 - DNA, 601 bp, Human
cactccatggctccattcacaagggtggggtagcaatcctctattatgcacatctaagaagtatagtatttatttctgcccatcccaagcaacaactctacctaacctcacagcccggattgtgaccctgcctaacttcaggtcccaaatagcagaatcatccagccaggcaacacatcttgtgactggcctgaccagaggccattgtagtacccagccagcagctccaccagatagcagagacaaaacagtgatcttgccagagagcaaggcccaaccagtggccctaccaaacataagrgcaaaggcagtggcccagccaactagggaacccatgaaaactctgcctgctcaaggttgtcaccaactgatctttccagaattataggctagactaaatagcaaacctttatccctgccaaagaatacctataaaaaccagaagaagtggctttctcctcaaatgcacaaacaatgcaaggacacaggattatgaagaatcaaggaatgatgacacctccaaaagaaactggccaagctcaaaaaattgacctcatagaaataaagatctatgaaatcactgacaaagaattcagaataa

SEQ ID NO: 894 - DNA, 601 bp, Human
aaagatagtatttttatggaaaacctagaaaattgagggtaaggaagtgaagacgaacagtatttgatgcattgaaaataaaataattactactcatgaacatacatttacttccattttaatcttggtaaattatatgaaatgaaaatgagagaagtatagtatttattttcatactgaatcccttcctcataaaattcatattaaaatgtttcttaaaaaaaagccataagcatagttaaaggacaaatggctaagcaaaataaaatgcttgactcactgaaaataaaataactgctaytgatgaacatacatttactacaattttagtattggtgaattatatacaaatgaaaaatgtagcagttatcttccctttctcataaaattaatgttaaaacttttgtaaaaaaacagatgccataaacaaagttaaaaaaatgaccaagtgaaagaaaatatctgcaacatattcaacagataaagaattagtgtcatacaactgagtcagaaaaaaactactcaaaagacaaatagccaaagattataaaggcaattaataaacatgcaaaaataaggtcatccttgtaattaagaaaat

SEQ ID NO: 895 - DNA, 601 bp, Human
ccaccaccaacttccttactcaacagttgtatggagaaaacaccaacaacaaagccctataagtatacataagtaaaattacccacaaaaggtcctgaattctataataatgctatgttctttcttcaaatttcatatacaaagatagtatttttatggaaaacctagaaaattgagggtaaggaagtgaagacgaacagtatttgatgcattgaaaataaaataattactactcatgaacatacatttacttccattttaatcttggtaaattatatgaaatgaaaatgagagaagtatrgtatttattttcatactgaatcccttcctcataaaattcatattaaaatgtttcttaaaaaaaagccataagcatagttaaaggacaaatggctaagcaaaataaaatgcttgactcactgaaaataaaataactgctactgatgaacatacatttactacaattttagtattggtgaattatatacaaatgaaaaatgtagcagttatcttccctttctcataaaattaatgttaaaacttttgtaaaaaaacagatgccataaacaaagttaaaaaaatgaccaagtgaaagaaaata

SEQ ID NO: 896 - DNA, 601 bp, Human
acctcaccacctagagaaataagcaaatcagacatatgaaaattatttctgcattatatctttctaaacagctctatgacccagaagctaggactatgccttatacctaaactcctcctgaaaagttgtccgcctttaatacaacagtaatatataaatatcttaaaaatgggctactggtttcctgtgattttcagaatttcttcttcaatgatcttttcagtaatttatgtagaatcgcatgccaaataagacaacaaattgtaagagcctggtgatgttgtgattcagttgctgtcawctgatggctgacacaagacggttatcacaagatgatctatttagttcccaccaccaacttccttactcaacagttgtatggagaaaacaccaacaacaaagccctataagtatacataagtaaaattacccacaaaaggtcctgaattctataataatgctatgttctttcttcaaatttcatatacaaagatagtatttttatggaaaacctagaaaattgagggtaaggaagtgaagacgaacagtatttgatgcattgaaaataaaataattactactcatgaacatacatttactt

SEQ ID NO: 897 - DNA, 601 bp, Human
aacctcaccacctagagaaataagcaaatcagacatatgaaaattatttctgcattatatctttctaaacagctctatgacccagaagctaggactatgccttatacctaaactcctcctgaaaagttgtccgcctttaatacaacagtaatatataaatatcttaaaaatgggctactggtttcctgtgattttcagaatttcttcttcaatgatcttttcagtaatttatgtagaatcgcatgccaaataagacaacaaattgtaagagcctggtgatgttgtgattcagttgctgtcwtctgatggctgacacaagacggttatcacaagatgatctatttagttcccaccaccaacttccttactcaacagttgtatggagaaaacaccaacaacaaagccctataagtatacataagtaaaattacccacaaaaggtcctgaattctataataatgctatgttctttcttcaaatttcatatacaaagatagtatttttatggaaaacctagaaaattgagggtaaggaagtgaagacgaacagtatttgatgcattgaaaataaaataattactactcatgaacatacatttact

SEQ ID NO: 898 - DNA, 601 bp, Human
tgcatgctgagggtggagaaattactaaaagtaccttggcttctcttgtgacatttcttaaattttgttgtcatagattaggagtttctgagccttaaatattttattggaggttggagagtggatagtttccttgaaattaactatcatagcagctatcatagtgagctaagctaatgtatcataatattcataagtaactgaaacctactgggaaatccagttgaaataacattcaagttttcccttactcaagtaatcactcaccagtgttgagatagccaatggccttggacttgayctctggagtaagctgctgtgtttcatttagataatccagtacatagatgttaggagcaaagaggaccatattctgctctccacagccatagggcatctggagaagattttgtgtgttttgcatggcagagcctaatatgtctcctagagaatgggagagatgggaagtcataaagcttggagattatcatctatcaaagtcattaagcagaaataattagttgagcttagaaattgagaatttttaggaaggatgattcttccagggatagaagtatgattgaaagcaataaacaagccc

SEQ ID NO: 899 - DNA, 601 bp, Human
atcttctcacatgcagctcttacatgcagtaaattttaatattgctttactttagggatttaaaaaaatgttttatattactgtttccttctcaattgtttcctcttattaatgaattcattccaagtcaagctgaatgacttagaatgtgacaatataagctgaagttaacatggtttatctggaagttatatatgttcactggcaatatcattttaaaactcatggttatggtagctactttagaaagaatagccatttcagaaagaaaaccttggtacattattaataggatccattytggaaacaagcctaacataacatgtatttggatatcaggttttcttctgattaccttgctaatcttggtggatttatctagtataacaaaccatcggtctgataatacatatctgatagtgttgctgtgaatataattgaggtaatacatgtaaaagagctggcacacaaaaagaagctcaaaaaattgttctttccttaccaggtgttgccctggttcctgccatatcgctccccaaaggtgctgtaggagccatcatagtgtttgtagttcaactgtctctggtaacctggaaaggaa

SEQ ID NO: 900 - DNA, 601 bp, Human
accccacacctcccaacaggccctggtgtgtgttgttcctgtccctgtgtccgtgtgttctcattgcttaactcccacttatgagtgagaaatgtggtgtttggttttctgttcctgtgttagtttgctgaggctgatggcttccagcttcatccatgtccctgcaaaggacatgatttcatttctttttattgctgcatagtattccatgatgtatatgtaccacattttctttatccagtctgtcattgatgagcatttgggttagttccatgactttgttattgtaaatagtgccgcrataaacatacatgtgcatgtgtcattatagtagaatgatttatattcctttgggtatatacccagtaatgggattactaggtcaaatggtatttctggttctagatccttgaagaatcgccatactgtcttccacaatggttgaacaaatttacattcaagtaatttgaatgtacttatttttgttagttacttgagtaaggctttaaatctctcttatctttagagatttccttctgcagatgacagaatcttctcacatgcagctcttacatgcagtaaattttaatattgctttact

SEQ ID NO: 901 - DNA, 601 bp, Human
ctccttgattaatctttagtctgcctgattaatctgctagatgtagtatttccttgctaactctctctttgccacagggagtcttagtatatttaattttattttagttccgagatacatgtgcagaacgtgcaggtttgttacataagtatacgtgtgccatggtggtttcttgcacctattgacccatccgcttagttccctcccgtcaccccacacctcccaacaggccctggtgtgtgttgttcctgtccctgtgtccgtgtgttctcattgcttaactcccacttatgagtgagacatgtggtgtttggttttctgttcctgtgttagtttgctgaggctgatggcttccagcttcatccatgtccctgcaaaggacatgatttcatttctttttattgctgcatagtattccatgatgtatatgtaccacattttctttatccagtctgtcattgatgagcatttgggttagttccatgactttgttattgtaaatagtgccgcgataaacatacatgtgcatgtgtcattatagtagaatgatttatattcctttgggtatatacccagtaatgggattactaggtcaaatggt

SEQ ID NO: 902 - DNA, 601 bp, Human
cttcagaacaaaggctgtgagcctgaccagggaggaagcaatcatgatgtttatgttgtcaaaatggttttataaccacttcacagcaacaggcttcatatgatgtgagttagctaacaaaattcttgtgtacttagagagcttatctccttgattaatctttagtctgcctgattaatctgctagatgtagtatttccttgctaactctctctttgccacagggagtcttagtatatttaattttattttagttccgagatacatgtgcagaacgtgcaggtttgttacataagtatacrtgtgccatggtggtttcttgcacctattgacccatccgcttagttccctcccgtcaccccacacctcccaacaggccctggtgtgtgttgttcctgtccctgtgtccgtgtgttctcattgcttaactcccacttatgagtgagaaatgtggtgtttggttttctgttcctgtgttagtttgctgaggctgatggcttccagcttcatccatgtccctgcaaaggacatgatttcatttctttttattgctgcatagtattccatgatgtatatgtaccacattttctttatccagtctg

SEQ ID NO: 903 - DNA, 601 bp, Human
atgtaggctcgagcttgggcaaaagtcttcagaacaaaggctgtgagcctgaccagggaggaagcaatcatgatgtttatgttgtcaaaatggttttataaccacttcacagcaacaggcttcatatgatgtgagttagctaacaaaattcttgtgtacttagagagcttatctccttgattaatctttagtctgcctgattaatctgctagatgtagtatttccttgctaactctctctttgccacagggagtcttagtatatttaattttattttagttccgagatacatgtgcagaaygtgcaggtttgttacataagtatacgtgtgccatggtggtttcttgcacctattgacccatccgcttagttccctcccgtcaccccacacctcccaacaggccctggtgtgtgttgttcctgtccctgtgtccgtgtgttctcattgcttaactcccacttatgagtgagaaatgtggtgtttggttttctgttcctgtgttagtttgctgaggctgatggcttccagcttcatccatgtccctgcaaaggacatgatttcatttctttttattgctgcatagtattccatgatgtatat

SEQ ID NO: 904 - DNA, 601 bp, Human
agagccatatgagggcttgggtaatgtgtgcttcatcgatgaagatgtaggctcgagcttgggcaaaagtcttcagaacaaaggctgtgagcctgaccagggaggaagcaatcatgatgtttatgttgtcaaaatggttttataaccacttcacagcaacaggcttcatatgatgtgagttagctaacaaaattcttgtgtacttagagagcttatctccttgattaatctttagtctgcctgattaatctgctagatgtagtatttccttgctaactctctctttgccacagggagtctwagtatatttaattttattttagttccgagatacatgtgcagaacgtgcaggtttgttacataagtatacgtgtgccatggtggtttcttgcacctattgacccatccgcttagttccctcccgtcaccccacacctcccaacaggccctggtgtgtgttgttcctgtccctgtgtccgtgtgttctcattgcttaactcccacttatgagtgagaaatgtggtgtttggttttctgttcctgtgttagtttgctgaggctgatggcttccagcttcatccatgtccctgcaaaggacatg

SEQ ID NO: 905 - DNA, 601 bp, Human
caaaactagctccagaatgattcacctttatggcattgttgagcagtgacccagagctcctgaaacagccattgtccttctgcctctgggagagccatatgagggcttgggtaatgtgtgcttcatcgatgaagatgtaggctcgagcttgggcaaaagtcttcagaacaaaggctgtgagcctgaccagggaggaagcaatcatgatgtttatgttgtcaaaatggttttataaccacttcacagcaacaggcttcatatgatgtgagttagctaacaaaattcttgtgtacttagagakcttatctccttgattaatctttagtctgcctgattaatctgctagatgtagtatttccttgctaactctctctttgccacagggagtcttagtatatttaattttattttagttccgagatacatgtgcagaacgtgcaggtttgttacataagtatacgtgtgccatggtggtttcttgcacctattgacccatccgcttagttccctcccgtcaccccacacctcccaacaggccctggtgtgtgttgttcctgtccctgtgtccgtgtgttctcattgcttaactcccacttatgag

SEQ ID NO: 906 - DNA, 601 bp, Human
tagaaagaaagctgatgctttgcttttaataggatagtatttcagacagcaggtcagcagtttcattgcatccagaactctccttcagcagaggaatggggtggtacctacagtgactgtgagaggaatctccagaagggcgatggtgatataggcggagagggtcacttcatcttctactcctccctgtgaatacgagagagagatctgaataattcaacttctgagaatgctattgattagttctttctattctgctgtgtcatggaattcatccttacccatatccatccctataggrcaaagtatcacaatcaacttttgttctatcccctcttttttggtgccatccaggttttattttcctctgaggctttcccttagaatttttcacattatcacttcctatcctcatccttgcagatatcataatggacaaatcaaaactagctccagaatgattcacctttatggcattgttgagcagtgacccagagctcctgaaacagccattgtccttctgcctctgggagagccatatgagggcttgggtaatgtgtgcttcatcgatgaagatgtaggctcgagcttgggcaaaagt

SEQ ID NO: 907 - DNA, 601 bp, Human
ctactaagtgttttacgtgtaccaattcatttattacaacagctctgtgaggtaaatactattattatccccattttactgatgaaggaactgaaacacaaggaagttaatgactttcccaagctcacataggtagcacattttggagctagtctccagagaatgctcttcttaccagcatactatagagatggtccctgacttacaatggtcccacttaagattttttagactttacaatgagtttgtcaggatataaccccatcgtaattgagaagcatctgcacggcctcttgtcttytgatttctgatttgattaagaaatcctagattttataagatgcaatatggacaaaatatatatgatatatagaaaagaagagaggagacagggatcacaggaggtaggagtgagggatttttgccatgcagttcttgatacagaggatgggccaggagaaggatctcaggtgtgctctcacctttcttcacagcttcctcattaagtgacttgagtacttccttcctcttgtcctggttacctgccagggcaaaagcataggccagcagtgctttggtatatacatggctgccatggtcc

SEQ ID NO: 908 - DNA, 601 bp, Human
tgtgacatgtactctactaagtgttttacgtgtaccaattcatttattacaacagctctgtgaggtaaatactattattatccccattttactgatgaaggaactgaaacacaaggaagttaatgactttcccaagctcacataggtagcacattttggagctagtctccagagaatgctcttcttaccagcatactatagagatggtccctgacttacaatggtcccacttaagattttttagactttacaatgagtttgtcaggatataaccccatcgtaattgagaagcatctgcacrgcctcttgtcttctgatttctgatttgattaagaaatcctagattttataagatgcaatatggacaaaatatatatgatatatagaaaagaagagaggagacagggatcacaggaggtaggagtgagggatttttgccatgcagttcttgatacagaggatgggccaggagaaggatctcaggtgtgctctcacctttcttcacagcttcctcattaagtgacttgagtacttccttcctcttgtcctggttacctgccagggcaaaagcataggccagcagtgctttggtatatacatg

SEQ ID NO: 909 - DNA, 601 bp, Human
atatttctcaatacattttaagaagaattaatggctgtcaaaggaaaaaggtagactgttttaatggacatcttgtgatttgcattttattttctatttcttcaaccgctcatatagaccatggtatatgtagaagtactgtgtgaatatgagtagattggtcaacattattggtcttatgaaatgggcttaaaataccagaattcattcaaggagttacttccatgattattttcttatgtttaaggttatataatgtaccaggtaagggttgggcatatattgagaactgatatgttarttgtaataactagtacttttataggatttgctatgtgacatgtactctactaagtgttttacgtgtaccaattcatttattacaacagctctgtgaggtaaatactattattatccccattttactgatgaaggaactgaaacacaaggaagttaatgactttcccaagctcacataggtagcacattttggagctagtctccagagaatgctcttcttaccagcatactatagagatggtccctgacttacaatggtcccacttaagattttttagactttacaatgagtttgtcagga

SEQ ID NO: 910 - DNA, 601 bp, Human
actctgcacatacttgtataggggtcttcatcaacatagtgttgaacttagaaaataaaaagcagacaaacaaaaaactaagctgctgaaatattcaaaaatgtttctcttgtttcttgaataagagagaaataaaaatcttgtttctctcaagatgaaacacatgtgaagattctaaatattagttagggatacatatgcagcaaaaatataaggaaatccatggaattgtaacgacaaattcaggataatgattgcctctggaggtggtagtgatacacaagggatttatttttcccaygtcggtaattttctatttcttaatctatgagagagttgtacagtgttttctagttatagcttatgcccttttgtatatctattataaaatatttctcaatacattttaagaagaattaatggctgtcaaaggaaaaaggtagactgttttaatggacatcttgtgatttgcattttattttctatttcttcaaccgctcatatagaccatggtatatgtagaagtactgtgtgaatatgagtagattggtcaacattattggtcttatgaaatgggcttaaaataccagaattcattcaa

SEQ ID NO: 911 - DNA, 601 bp, Human
ggcacatgagtattcattgcagcattttttttaatagcaaaacataaaaaaaatccatgaggagaaactcgatgtgtaaattatgactaatttatagactgtaatatattatgcagcagtgaaaattaatgagctgactctgcacatacttgtataggggtcttcatcaacatagtgttgaacttagaaaataaaaagcagacaaacaaaaaactaagctgctgaaatattcaaaaatgtttctcttgtttcttgaataagagagaaataaaaatcttgtttctctcaagatgaaacacaygtgaagattctaaatattagttagggatacatatgcagcaaaaatataaggaaatccatggaattgtaacgacaaattcaggataatgattgcctctggaggtggtagtgatacacaagggatttatttttcccatgtcggtaattttctatttcttaatctatgagagagttgtacagtgttttctagttatagcttatgcccttttgtatatctattataaaatatttctcaatacattttaagaagaattaatggctgtcaaaggaaaaaggtagactgttttaatggacatcttgt

SEQ ID NO: 912 - DNA, 601 bp, Human
tctcaaagcataatttggagaaacacagatgcacaagaaaacaggcacatgagtattcattgcagcattttttttaatagcaaaacataaaaaaaatccatgaggagaaactcgatgtgtaaattatgactaatttatagactgtaatatattatgcagcagtgaaaattaatgagctgactctgcacatacttgtataggggtcttcatcaacatagtgttgaacttagaaaataaaaagcagacaaacaaaaaactaagctgctgaaatattcaaaaatgtttctcttgtttcttgaayaagagagaaataaaaatcttgtttctctcaagatgaaacacatgtgaagattctaaatattagttagggatacatatgcagcaaaaatataaggaaatccatggaattgtaacgacaaattcaggataatgattgcctctggaggtggtagtgatacacaagggatttatttttcccatgtcggtaattttctatttcttaatctatgagagagttgtacagtgttttctagttatagcttatgcccttttgtatatctattataaaatatttctcaatacattttaagaagaattaatg

SEQ ID NO: 913 - DNA, 601 bp, Human
gtgtgtctttatcagtttcttgtgaggatcacagatcacatgaaatagtagagtttgtactcattaaattgaaaaaaaaaatacagtaatccttgaaataccaaaggctgacatggatgtgaaacaatgggaaccaaaatacactgctgtgggaagccaactgctctttggcaatattcagcaatggggaagatgtgcttagcccactaatcagtcattatgcttctcaaagcataatttggagaaacacagatgcacaagaaaacaggcacatgagtattcattgcagcattttttttartagcaaaacataaaaaaaatccatgaggagaaactcgatgtgtaaattatgactaatttatagactgtaatatattatgcagcagtgaaaattaatgagctgactctgcacatacttgtataggggtcttcatcaacatagtgttgaacttagaaaataaaaagcagacaaacaaaaaactaagctgctgaaatattcaaaaatgtttctcttgtttcttgaataagagagaaataaaaatcttgtttctctcaagatgaaacacatgtgaagattctaaatattagttagggatacata

SEQ ID NO: 914 - DNA, 601 bp, Human
ctataaagtgtgtctttatcagtttcttgtgaggatcacagatcacatgaaatagtagagtttgtactcattaaattgaaaaaaaaaatacagtaatccttgaaataccaaaggctgacatggatgtgaaacaatgggaaccaaaatacactgctgtgggaagccaactgctctttggcaatattcagcaatggggaagatgtgcttagcccactaatcagtcattatgcttctcaaagcataatttggagaaacacagatgcacaagaaaacaggcacatgagtattcattgcagcattktttttaatagcaaaacataaaaaaaatccatgaggagaaactcgatgtgtaaattatgactaatttatagactgtaatatattatgcagcagtgaaaattaatgagctgactctgcacatacttgtataggggtcttcatcaacatagtgttgaacttagaaaataaaaagcagacaaacaaaaaactaagctgctgaaatattcaaaaatgtttctcttgtttcttgaataagagagaaataaaaatcttgtttctctcaagatgaaacacatgtgaagattctaaatattagttaggg

SEQ ID NO: 915 - DNA, 601 bp, Human
gtgacagagcaagactctgtcttaaaaaaaaaaaaaaaaaaaaggtgaataggggaagcacaaaatgtgtagttttgagaaaagcctattaaaggggacctaagaatggagagatttgcgaggagaggttgttggattttgagtagagttcctttgaacagtttgaaagagaccctagagctttcaggagaatggcaggagacatctccttcattctgctggtgctccactgctgcttgaggaaggcagtgttgttatgggaaataggagatggataataacacagcgatggggtgccggrattctgagcatttccttttggccctctttgactttgatttgcttttatttccattatccttggatactgaaaacttttcctcatttcaagttactgtcatctgtatttttttcttcttggatgtgtttgtttctttttcattcaaatcttttgctacctgaaggtgaaataaaaggttttggcaaatcaccaacctgggtggaggagaaaccgccctgggcattctgctgcttcgtgatccacttcacgatgttggttgcagaggtcaggtcctccgaggttggggctggctgggccgtg

SEQ ID NO: 916 - DNA, 601 bp, Human
gatagttgaagaaccataacattcacatatctaccttggactgtatgccctacatgtttattttatttatcagaaaattgatccttttctctctgtaagtatatgtgggacatggaatgtggaaaacatgtgaatggcaatcagttattggcatcagctatttgctaacatgtctttcttgacaactatgctcatatctgccaccactcaagcaaagttcagtctggctctctcccatattaaactttgctcagttgctgaggtcagtgtcctggagagaacccaaggttctttgcagccatgagcagagtcatgcttcagtttctccaaaagaaataaaagatgagtattataattatcttctggatttaatgacatttttatttggctttccctttttattggatgatttcctgttcccagtgaatgtctgctggtatgtatcctcaacaacattaaacctgcttggcctccttcaaataatatgtttctaataaatgaatgataacctttaacaaaattacttagtttttttcattcatatgataaaagattaatacaatggaaataggatggaatgccattttgtcacattttttcc

SEQ ID NO: 917 - DNA, 601 bp, Human
ttaagaaagctctacaagtgatgcacaggctgtttgtgacctctaatctatgccagttattttatttatttgtttacttttattttctttcagctgacaaaatgatgtatattatgaataataaatttcagtctacattatttacaaaaacaacaataatttataatgtttacttaaacactggctttcaacaaaacacttagaaacacctagcgtcttgtccccgagagtttgcatccgaaatttggactgcttaatttattttttggcatatatatacaccaaattaaatgaaaaaaawatatatatatatacttaacttttaggttcaggcgtacacatgcaggtttgttatataggtaaactcgtgtcatgggggtttggtgtacagattactttatcacttgggtactaaattttgcactgaattgttgtttttttctgatcttctccctcctcccatccttaaccctcaagtaggctctggtgtctgttgttctcctttttgtgtccatatgttctcatcatttagctcccacttacaaatgagaacatgcagtgtttggttttccattcctgtgctagtttgccaaggataatg

SEQ ID NO: 918 - DNA, 601 bp, Human
taatctgcccgccttggcctcccaaagtgctgagattacaggcgtgagccaccacgcccggctgaggatctgcattttaagaaagctctacaagtgatgcacaggctgtttgtgacctctaatctatgccagttattttatttatttgtttacttttattttctttcagctgacaaaatgatgtatattatgaataataaatttcagtctacattatttacaaaaacaacaataatttataatgtttacttaaacactggctttcaacaaaacacttagaaacacctagcgtcttgtcccygagagtttgcatccgaaatttggactgcttaatttattttttggcatatatatacaccaaattaaatgaaaaaaatatatatatatatacttaacttttaggttcaggcgtacacatgcaggtttgttatataggtaaactcgtgtcatgggggtttggtgtacagattactttatcacttgggtactaaattttgcactgaattgttgtttttttctgatcttctccctcctcccatccttaaccctcaagtaggctctggtgtctgttgttctcctttttgtgtccatatgttctcat

SEQ ID NO: 919 - DNA, 601 bp, Human
agtgtatgggggctgaggatctgcatttttttttttttgatggagtttttcgctcttcttgcccaggctggagtgcaatggcatgatttcggctcaccgcaacctccgcctcctgggttcaagtgattctcctgcctcagcctcccgagtagctgggattacaggcatgcaccaccacgtccgactaattttgtatttttagtacagacggggtttctccatgttggtcaggctggtcttgaactcccgacctaaggtaatctgcccgccttggcctcccaaagtgctgagattacaggcrtgagccaccacgcccggctgaggatctgcattttaagaaagctctacaagtgatgcacaggctgtttgtgacctctaatctatgccagttattttatttatttgtttacttttattttctttcagctgacaaaatgatgtatattatgaataataaatttcagtctacattatttacaaaaacaacaataatttataatgtttacttaaacactggctttcaacaaaacacttagaaacacctagcgtcttgtccccgagagtttgcatccgaaatttggactgcttaatttattttttg

SEQ ID NO: 920 - DNA, 601 bp, Human
ggaagcctgttaaagccacagagaccaggccctactctagacctgatgaatcagaatgtctagtgtatgggggctgaggatctgcatttttttttttttgatggagtttttcgctcttcttgcccaggctggagtgcaatggcatgatttcggctcaccgcaacctccgcctcctgggttcaagtgattctcctgcctcagcctcccgagtagctgggattacaggcatgcaccaccacgtccgactaattttgtatttttagtacagacggggtttctccatgttggtcaggctggtctygaactcccgacctaaggtaatctgcccgccttggcctcccaaagtgctgagattacaggcgtgagccaccacgcccggctgaggatctgcattttaagaaagctctacaagtgatgcacaggctgtttgtgacctctaatctatgccagttattttatttatttgtttacttttattttctttcagctgacaaaatgatgtatattatgaataataaatttcagtctacattatttacaaaaacaacaataatttataatgtttacttaaacactggctttcaacaaaacacttagaaac

SEQ ID NO: 921 - DNA, 601 bp, Human
gtaagtcttcccaaatatcttatcccagtggtttgtaaaagtggtgtgcgtagaatttttaggaagcctgttaaagccacagagaccaggccctactctagacctgatgaatcagaatgtctagtgtatgggggctgaggatctgcatttttttttttttgatggagtttttcgctcttcttgcccaggctggagtgcaatggcatgatttcggctcaccgcaacctccgcctcctgggttcaagtgattctcctgcctcagcctcccgagtagctgggattacaggcatgcaccaccacktccgactaattttgtatttttagtacagacggggtttctccatgttggtcaggctggtcttgaactcccgacctaaggtaatctgcccgccttggcctcccaaagtgctgagattacaggcgtgagccaccacgcccggctgaggatctgcattttaagaaagctctacaagtgatgcacaggctgtttgtgacctctaatctatgccagttattttatttatttgtttacttttattttctttcagctgacaaaatgatgtatattatgaataataaatttcagtctacattatttaca

SEQ ID NO: 922 - DNA, 601 bp, Human
taatgtgtaaagttatttatctgaagaaaagacagctaagtatcctaaacttggtagttactcatatttcaaagttcaattcagtttctatttcttcataaggagtttttttcctgttttgcttgctctatttttcttttaacttctgtaatacttatagtttatgccaatcagtcattttcatatttttcactggttcgtgttcatatcttttatcttcttagcaaaattctaagctaagaagaaattgaaaagcaggaacctgctgacaatctttttcttgtagtcatgggtcctagcrcagtgctctgcacatggtcagcattcatacaaacacatgtgattatatttctgagctggaaaaaggataaggctttgatagagattgactttaatagtattttgatattagtattgtcttatgctggggatacatacatcattaaataaaatagggcagtctggggttatgataaacctaccattttcactgttggcttcaggggaatgaagccagagaccatcttcacatcaacgatcgccatgttggaggcagagcggctccctgtgtaactgaggatccaggggaggaaaggattag

SEQ ID NO: 923 - DNA, 601 bp, Human
tattgttgttgagtatgttgataattaactaataattgactaatcacaagggctacttccttatattactgggtatccaaaaaacttgtcaacataataaacacattttgtcaagatttcttgcttatgggattttaggaatattcatatcccaagatcataataagccatttctacctgtaatccctggtgaaatataaataaaggagagaagaacattcttttagagttaacattagaattctcaaatttctagcatggaagtgatgtttctaaaatgcatttaccttcccagatgttyccttagaggattattatctacgtttttttgcaaatagactggaagttctcttaccttatcaaggtaaatcaagacatggttgctgctgacttctgtccggctcacatggttagatctttcaagctgaagaaaattgaaataccacaaatgttaataaatagatgaaacccctgggggatccagagaaaaaatctttgtattgccaaaataaccctgagggtagaattcttcaaatgctttttgtaaggaaatatataatgtaatacaattaaaaatgaaaggcataaagggtttactatt

SEQ ID NO: 924 - DNA, 601 bp, Human
gctctaaaaggttgatcttcccaggcttaagtttcataaaatttgtaaactataattcccatcaacttatgcatgaacaaactctcctaccacacatatctataaaatcagattggtttactggtgaactggtcttattattttatggttcaagtccttgtggagactgacagttttttttccctttcatattgttgttgagtatgttgataattaactaataattgactaatcacaagggctacttccttatattactgggtatccaaaaaacttgtcaacataataaacacattttgtsaagatttcttgcttatgggattttaggaatattcatatcccaagatcataataagccatttctacctgtaatccctggtgaaatataaataaaggagagaagaacattcttttagagttaacattagaattctcaaatttctagcatggaagtgatgtttctaaaatgcatttaccttcccagatgttcccttagaggattattatctacgtttttttgcaaatagactggaagttctcttaccttatcaaggtaaatcaagacatggttgctgctgacttctgtccggctcacatggtt

SEQ ID NO: 925 - DNA, 601 bp, Human
gccaaggaaggagtttgttgtgggaagaacagtattgtaccagaaacataagcatcattcatctgatgtgttgcttgctaccttatattctcctttcaaatatagtgttttatatattcttttatcccaaactcctgaaggactcttcagatgttctacttacttaaatctcatattgtcatacagtccatttatctgatgaaaagggaactaaatatcccacaggtgttttgtattagtagttgataaatttataatgtaggttgtttctataatgtatgtataagagacaaaaagaggrgcatcagacttgatggagacaaaatgaagtgataatgtaattacttaatgtaataaataaccccaacacatctcctaaacctgaatttctgtgatcaggaattaaatatttctacgtgaaaatcactctcactcacccgtctcgtagtaatcatagactttcactatggctggtttcagatctcttactgggacatcttgcagaaccgtgaagaacaagctcagtgtctgatttgacacctggaaagcaaaagtcaattaaatgacctttcaggaagctttcttctctctttgaattagt

SEQ ID NO: 926 - DNA, 601 bp, Human
ataaataaatgaacagatgggaggtaggtaggtagctaaatagctaaacagatagctcactataaaaagaacttgaaagaaagatatatagctactggcaagatacacaggttattaattcaggcacaggttattacaggtttaaagagggcatattttaaaacaaactctaggtttcacatttagtttcatagggctatcaagtttataaaatacttattattatttcttattatccttcttattaccatttatttggcctcctcattttcctttgttttttaaaacctatcttccccamctttgtgattgcaaaaacagatttcacaggtggaagaatgccaatggaagagtcttcccccacccccttcaaaaaaaaaggaaaaattgtgaatacattccacagggagaaaaaaacacaccaaacctttgtgaaggaaatattcattttttattttattattattattattattattattattattattattattatttttgagacagagtcttgctctgttgcccaggctagagtgcagtggcatgatctcggctcactgcaagctccacctcctgggttcatgcccattctcctgcc

SEQ ID NO: 927 - DNA, 601 bp, Human
tctcaggctgggcgcggtggctcacacctgtaatcccagcactttgggaggccaagatgggtgggtcacgaggtcaggagttcgagaccagcctgaccaacatggtgaaaccctatctctactaaaaatataaaaattagctgagcgtggtggcacacacctataatcccagctactcaggaggctgaggcaggagaactgcttgaacccgggaggcggaggttgcagtgagccgagatcatgacacagcactccagcctgggcaacagagcgagactccgtatataaaaaaaaaaaaaaagaaatttcaaatatcagagatgaatatgaagacagcctagagccatgcaacttttctgtaatttgatgccattaacctattccatctttttctactcatcctgattatttaatcctgtttaaactttctatgttcaatatgtgttcctttttggctacggagggttgtaaataaataaatgaacagatgggaggtaggtaggtagctaaatagctaaacagatagctcactataaaaagaacttgaaagaaagatatatagctactggcaagatacacaggttattaattcaggcacagg

SEQ ID NO: 928 - DNA, 601 bp, Human
gcttcagctgcattgttttggcccccatataattacttttactgaattgcactttggtgctctggccctagcttgaacagaagaaaatacctcaaaacatctacaagaaaaccacctaacgtattattaaaatgacatttttaaagatgttgtccaccttaccttctccttctcccaaaggagaaatttctgtcaggcctaagagccagaaaatgcttttgcttttcctgaacatctggtttccatttatcttgtaaataatgtaactcttatagtcttttcctttctttctccctcttcrgacaaataaatttcaaatctcaggctgggcgcggtggctcacacctgtaatcccagcactttgggaggccaagatgggtgggtcacgaggtcaggagttcgagaccagcctgaccaacatggtgaaaccctatctctactaaaaatataaaaattagctgagcgtggtggcacacacctataatcccagctactcaggaggctgaggcaggagaactgcttgaacccgggaggcggaggttgcagtgagccgagatcatgacacagcactccagcctgggcaacagagcgagactccgta

SEQ ID NO: 929 - DNA, 601 bp, Human
gctatttgaggtactgagaatacatccgggtccatttaaaaaaaaaaaaaaaaaagctaagattgagtagtgaggtctgctggtggacctggatgagagtggggcacacacaccctcctgtctgacatccttgcatcttgattttaaccctgaatccaatgaggcattacagagccatgtgcttcagctgcattgttttggcccccatataattacttttactgaattgcactttggtgctctggccctagcttgaacagaagaaaatacctcaaaacatctacaagaaaaccacctaacrtattattaaaatgacatttttaaagatgttgtccaccttaccttctccttctcccaaaggagaaatttctgtcaggcctaagagccagaaaatgcttttgcttttcctgaacatctggtttccatttatcttgtaaataatgtaactcttatagtcttttcctttctttctccctcttcggacaaataaatttcaaatctcaggctgggcgcggtggctcacacctgtaatcccagcactttgggaggccaagatgggtgggtcacgaggtcaggagttcgagaccagcctgaccaacat

SEQ ID NO: 930 - DNA, 601 bp, Human
gcaaaggcctgattgaaaaatttctaaggatgtacaggctgtttgctcctctagaatttccaagatgacaaagtgatcttacatcaagtctaattttaacagctatttgaggtactgagaatacatccgggtccatttaaaaaaaaaaaaaaaaaagctaagattgagtagtgaggtctgctggtggacctggatgagagtggggcacacacaccctcctgtctgacatccttgcatcttgattttaaccctgaatccaatgaggcattacagagccatgtgcttcagctgcattgttttrgcccccatataattacttttactgaattgcactttggtgctctggccctagcttgaacagaagaaaatacctcaaaacatctacaagaaaaccacctaacgtattattaaaatgacatttttaaagatgttgtccaccttaccttctccttctcccaaaggagaaatttctgtcaggcctaagagccagaaaatgcttttgcttttcctgaacatctggtttccatttatcttgtaaataatgtaactcttatagtcttttcctttctttctccctcttcggacaaataaatttcaaatc

SEQ ID NO: 931 - DNA, 601 bp, Human
tacttgttaattaatgtgtaacagagaaagaaatgtatccataaaaatagtttcagcccttacatgggtgattagaatgtcagaacactggaggtctatttaaggtttttaataactactgggcattaaagcttgaggaaatcacttcaggttctttaactgttaagtgtgagctgctttctatcagttagcagaatataggacagatacacttcattagcaaaggcatgaactacaaatatttaaaagataatacagataggagaattccagaaataaaactattcacatacttggcaamactaataccaagcaaccatgtgacaatcacatgaagcttttcttcataataatgattcacaaatttgaacttcaatactgagcctaaagatgatggcagcctatgcttttgggggaaaaaaatagaaaatgcttcttgaacaaccaaatcttctctgatgctttatgtaccagctgcattgagatataattcacataccacacaagtcactcatttaaagtgtaaaagacattggtttctagtgtattcacaggcttgtgcaactatcccaccatcacctgatttttagcaaaagagctg

SEQ ID NO: 932 - DNA, 601 bp, Human
actgcttattaaccttaaaatgaggatgataaaattgacctagctctttcttcagtcctgaactttccctataatgaaaattaagagctttacatagtttatataataaatcaattcattttaaattaaattctccttttctatgactcaataaattcaagatcttgaatacaattaatactttggtcttaaaataacttttatatggcaatcttttctcctatgtatataatggaaaacgaaatacaaagtacttgttaattaatgtgtaacagagaaagaaatgtatccataaaaatartttcagcccttacatgggtgattagaatgtcagaacactggaggtctatttaaggtttttaataactactgggcattaaagcttgaggaaatcacttcaggttctttaactgttaagtgtgagctgctttctatcagttagcagaatataggacagatacacttcattagcaaaggcatgaactacaaatatttaaaagataatacagataggagaattccagaaataaaactattcacatacttggcaaaactaataccaagcaaccatgtgacaatcacatgaagcttttcttcataa

SEQ ID NO: 933 - DNA, 601 bp, Human
ataaaatctcaatccttcaaagctatataatggtaaaaataatgtacagttaatgtgacttgttacaggtttttactctaaggtgatcacataaatgagtgcaggattcaaacaatgtttgttgttactgatgttgcgagactggcttcaaggttatttacagaagtggttctaggaagagtcatctttagtcagatgctgacacccactggtgaaagatacaaacctttcctaatagaggatctctagacataacagagccaacagatcaaactaaagtgagcactgaaataagactttkctacctaaaatgatctcaatttcaccccagatttaaatggcatcaacggcctatcccataatttagacttcacatggaagaaaatgggttttctcaaatatagttgtttctgcaaatgttccatcttttctatattttaaaatattatatttctatattttaaagtattaaaataagctgtgctacgtatgattccacttgtattaaatgcccacaacatgtaaatctatagagacagaaaatagattagtggctgcctagggctggagggactagggggaaatggggagtgattgctga

SEQ ID NO: 934 - DNA, 601 bp, Human
gtacagcgttcatgggaataataatcttcactacccaggagatatcctgcaagaatggaagacgaaaatagtcagcatagcataaaacttgttaaacaaactaatgtttcagcatttaattgcctaatgcaattgattacccgtgacgaggctaatcaaatgacaaggctaatcagcaccatttctcaacatgtctatatctggtggcagaaggcattaaaacattactgcataaaaactcaaatctattcctcattcgcctttagaatataggcgctatcatgtaacactaacagttttwttttttatcagagttgaaactcagtaagggtgataaaatctcaatccttcaaagctatataatggtaaaaataatgtacagttaatgtgacttgttacaggtttttactctaaggtgatcacataaatgagtgcaggattcaaacaatgtttgttgttactgatgttgcgagactggcttcaaggttatttacagaagtggttctaggaagagtcatctttagtcagatgctgacacccactggtgaaagatacaaacctttcctaatagaggatctctagacataacagagccaacaga

SEQ ID NO: 935 - DNA, 601 bp, Human
aaaaataagctcattggtataccaggtatatggattagaagacccaatattgttaagacatccattctccccaagttgttctatagtttcaaatataaatccaagcagacactttgggcaggggggagctggcatatagaaattgactagatgattctaaaattaacatggaaatgcaaaagatctagaatagcaaaatattcttgtagggaggaagtacaaggttagaggaactgccctgatcccaaaatttatggatcccttaaccaaaagtttgtcataataaagcctcaccttacayctaagccaatcattttttaagtcattttattaattactcacagcacatgcacataatataccaaaatttttaaactatatttctattgaaatactaccaacatagtattcctcaaagtgtgatctggggaccactcttaagaatcaccttttaagagtttctctaaaatgctgatgtacggatttctcccacgcctaataaatcacaccctagaggtgggctccaggaatcttcctttttaacaagcttcccaggctgattctgggatactgtataatttgaaaaggacttccctagaat

SEQ ID NO: 936 - DNA, 601 bp, Human
cacataccacgtccacacaggtatgtcaaccagactccacacggtgatcttcttatagtttagatatttgaccctcctccaaacctcatgtttaaatttgatccccagtgggagcctaatggcagctgtctgggtcatggaggtggatccctcacgaatggcttcatgccatctttgcagttataagttctcactgtattagttcctgagagggctggttgttagaaagagcctggcatctctctctctctcctctcctgccatgtgatctgcacacgccagctcaacttcaccttccatkatgactggaagcttcctgaagcccttacccagaagcaaatgctggtgccatgcttcttgtagagtctgcagcaccacgagccaaataaacctcttttctttataaattacccagcctcagctattcctttatagcaacacaaacagactaagacagacctgcaccaaggaccttcaggcattgtcaaagaggcaaagtgcaggaaattggaagaaccagggagcactgcatattctataatttgttgtgtcagggtcccactgaagtattatttttatgggtgttcttaatgaagccata

SEQ ID NO: 937 - DNA, 601 bp, Human
tttctttaatgatttttatcttagaacaagttccttatgctacaatctatatatagtacctgagaaattagcccagaattagattcaacatcgggataaaatcgtgaaaagctcagctcctcaaactggtgagttgcatcattttatacagaattgaaaatgtaaacatgtattagctgtcttaaacattcttgggttacagcttgactattgattatttcattcacttatgtctatgactgaaactttcctttgaagatactgggaatgctggatactgctatagcatgtttcagacacrataggaaaatgaccatcctctcatctggcaatttccaaacagttacctacgaacagcggctatggtaataacactccttccatggctagcaagcttttagggcctcctattgtcctcagttccgtgttttccccaccaccctagttaagagagcccacccacaaagatctattatttcactccagttgcttcctcttatctgcttaatgttatggaaccctgtgagggaatattccatcgttcttcagtaggaatgaatttgtattgtgggcagattacagttgttgcacagattaaggt

SEQ ID NO: 938 - DNA, 601 bp, Human
tttttgtttgtttttcttgagatggagtcttgctctgtcacccaggctggagttcagtggcacgagcttggctcactgcaactcttcctcccgggttcaagcgattctcctgcctcagcctcctgactagctgggattacaggtgcatgccaccaggcctggctaatttttgtatttttagtagagatggggtttaactatgttggtcagggtggtctcaaactcctaacctcacaatccacccgcctcggcctcccaaagtgctgggattacaggtgtgggccagtgcacccggctgacrgggggctgtttttaaaagaaagatattttatgaatatgttactttcagtctgtagtgtcactagtatggggaattatcctgctgaaaaagagaaagaaggttccttcttaacatatgtgaaatggtaattagcagtaccttcctgagtccagcatcagcaactgtgtttcagttatgaactgcctccaaatgcttttttcctcttaagtgctttttaaaataggcacaattttaagttagcctgtggattcttcatgtggctttctttaatgatttttatcttagaacaagttccttatg

SEQ ID NO: 939 - DNA, 601 bp, Human
cgtgtagaccatggtgcaggacatcccaacagatgccctgcctgggggtgatgaaggtctcggctgcgatgtctggagggaagaacgtgcaggtgcatcgctgacctgacagtgcagtatgggtctgctctgggtactgctatctgggtcttcagcactagactgagccaactccagccaccagccaaggtccagatggggataggattaaaaatcggaagtctacaacaatttgcagcccacgtaaagttttaaaaaaaatcaggaaatatcacatcgatctgtttttatataaaaaaayttttttggaaaaatcagaatttctgactactctttgtccacactccatctggtaacaaaaggctggagtatgagaaacaggggccccatccccctcaaatgctatccaattttctagtttcccactgttctacataaactgcttcacttctttaggttagcagcctggcccttgcaaacacgagattttgtgactctgatctggactcttaacagtggcagggggcaggggatacagtggggagagagggggcccacagcttaaggagaagatgttctcatccaggtcattagcagcaac

SEQ ID NO: 940 - DNA, 601 bp, Human
ttctactccagctgcatggtcatgctgaagcgtctatgttcgtgtagaccatggtgcaggacatcccaacagatgccctgcctgggggtgatgaaggtctcggctgcgatgtctggagggaagaacgtgcaggtgcatcgctgacctgacagtgcagtatgggtctgctctgggtactgctatctgggtcttcagcactagactgagccaactccagccaccagccaaggtccagatggggataggattaaaaatcggaagtctacaacaatttgcagcccacgtaaagttttaaaaaaaatcaggaaatatcacatcgatctgtttttatataaaaaaacttttttggaaaaatcagaatttctgactactctttgtccacactccatctggtaacaaaaggctggagtatgagaaacaggggccccatccccctcaaatgctatccaattttctagtttcccactgttctacataaactgcttcacttctttaggttagcagcctggcccttgcaaacacgagattttgtgactctgatctggactcttaacagtggcagggggcaggggatacagtggggagagagggggcccacagc

SEQ ID NO: 941 - DNA, 601 bp, Human
gttaaagtatttgaggcatttaaatctcataaatgaatgaaaatggttagaaacagactttggtgggggggtggtgctcatatttcattcttcattgttgacaagttgttttaaattttatattacacatccttgtaatgcaaaaaggagtatccatacatagagctcaaatagaccccccaaaagtttatttattgttcaggtctttggaactcagaaatacgttttccctaaactcacaaagttaaaaatagctgctaaatgtcaaagtcgttgctttaaaacctattaaactaaggasgcagctgatggagtgaaaatgatgataatgtagaacccgtacttccattatttccatgggaaaacattccaaattcccactccaaaagtctattctataacctctgacaccatttcagttctgcctctgcttccactcgacacacatacaccttctactccagctgcatggtcatgctgaagcgtctatgttcgtgtagaccatggtgcaggacatcccaacagatgccctgcctgggggtgatgaaggtctcggctgcgatgtctggagggaagaacgtgcaggtgcatcgctgacctg

SEQ ID NO: 942 - DNA, 601 bp, Human
ccagtttaattcctgaaactaagaagtatgacacactgattctattttaccacttacatcaatttgcaacatttaacattagtggcataccaggtcagcttctcctttttaatgagcctttctgaaggcattctcttcatagtgctacagaattctttaatgagttgaaaagcctcaaagagacaacaactagtttaacccaaaaataaacgtataattctgttaaagtatttgaggcatttaaatctcataaatgaatgaaaatggttagaaacagactttggtgggggggtggtgctcrtatttcattcttcattgttgacaagttgttttaaattttatattacacatccttgtaatgcaaaaaggagtatccatacatagagctcaaatagaccccccaaaagtttatttattgttcaggtctttggaactcagaaatacgttttccctaaactcacaaagttaaaaatagctgctaaatgtcaaagtcgttgctttaaaacctattaaactaaggacgcagctgatggagtgaaaatgatgataatgtagaacccgtacttccattatttccatgggaaaacattccaaattccca

SEQ ID NO: 943 - DNA, 601 bp, Human
ttcctgcatagtgatgcctgttcttgtcttggataaagtcatatggcttcaagtattcctcagggacctgaaggggctcatgcacagactggagagcaaggtagagaaacagaggctggaaagaaagtttgtgcaaaccagttaagaggatattgaagcattaaatatagaaggataagacagttcagatttatgcattaataaaaataatatcaagacaacctacagaatgcattgaaagtatttgtgaatcacatgtatgataagggactcatctccagaatatataaagaacccttayaactcaatgataactcaactacaaaatgggcaaagaatctgaatagcaatttctccaaagaggatacacaaaaggcaataaacacatgtaaagacagtcaacatcatcagtcattattaagatgcaaattaaaaccacaatgaggtaacacttcacatctgttaggatggtgataatttaaaaatggaaaagaacaagtattggtgaggatatggagaaattggaactgtcattcattactagcaggaatgtaaaatggcacacatagccactttgaagaaacattttggcagttcctga

SEQ ID NO: 944 - DNA, 601 bp, Human
gggctgaggacaatcttgttcttcacgtaaaacacaggcccacaatctcaaatttataatttaaaaatatatatacttacaatgtctctaaaggcacttatttttcttaaaaatcatgtatttgtaagctgaactatcattttaacacaaaagctatcattcttgctcaatggagtcaggctgctcttggagtttctgtcctgggaggaaaaagggcagggtgtaggtacctgatggttttccacacgtcgaagccatccagaggctttgtgccattggtgtgtcccctggccagcttcaygagtgttggcagccagtcagagatgtggatgagctcccggttcttcacgcccttctgcttcagcaaggggcttgccacaaagcccacccctcggacgcctccttcccacaggctccattttcttcctcgaaggggccagttattaccccctgccaaagtctgccctccgttatctgaaacacagtaaggtcttggcatgaggatgatgttaactcttaaatacatttaagaacagagactgtatgtacattgttactaaatggtgcttaaataataaaaaaaaagaaaattccttgcctt

SEQ ID NO: 945 - DNA, 601 bp, Human
atcctacatccaagggccccacaccccagtggccttgggatcacagcgggggtcctgtgcagggaagtacacggggactgagtgtttatggtagaactgtaggcgggacaggagctttgtgacgatgtgaggatattctctggacaggtcatgtctttcttcagggtcccgatcaatatcaaagagccagagggtcttggttggtgggtctgatgagggtatctcagaaacattgtattgagacggtggagggaaccagtaaccacagcctagcaaagaaaacaaaacagtttactgaggsagaagcacagaggcaggttctaatttcagggaaggagtctgaggccaaggctgcactgggttgtgggtgtggaaacataaaaagatgcggccctagatgctgtctctagatgcttctcagacttgacttctggtgctttaactagacatgtctcactgcttcacaagcaaggacacccagaaacgtgtgtgcatgtgtgtatgtccttgtcacaaggactagggcataggggtgctcctggcatttagtgggcatgagctagtgatgctaaagtcttgcaatacatgggacaatcccagt

SEQ ID NO: 946 - DNA, 601 bp, Human
taaaaaacatgacctctggttcttttcagatttaaacaaagcaattataaaaaagaaagacaaagaaatggttatagtctgagttacatatttttatgcatgaaattgtaattttgttggaaacatgattaacaattttgaaatattaagattgaaaatgaaatcatcatattactcacctttaagcagagtttgtggtgtcctcggacctaagctgcaaattattggggaaaaaataggtatgcagaatgaagagggtatatatgttaatccaaacaaagcttcttttcttattgctagstaacacaaggcaatgctgtcatatcccagaagcctagcaacacctagagggttgtcaaaataaatgttctctggaacttgaactttgcaaatgattacaccaatcagtagtaaccctgaaactctgggtgttggatgttacacagagtcctgaattttcagtgagttttcaattcaagggctattgtagtagctattgctactgcatagaaatctctctttccattttaaagaatccttagattaattgcttaaaattgctgccccccttaggaatgtatagattcttagtttttgatta

SEQ ID NO: 947 - DNA, 601 bp, Human
ggcttcttataactctgaaaccatatggtttatacgttttcaaaataaaatatataaatgtttgctgagagtctcttgagtacagtaaattcctccaggccataatagtaacctttctgtatcttaaagatagtgtgaagggataaatgtgaaataattttgaggttcttttgcataagagagtccctgtgaaaaccaatgcgaatgtagtctacactttaaaaagattttaaatggcgagtagtaaaatggtgagtcaagggagaatagaaatatgataggactaaaaagtactgacttygaagtcagaaaattcaatttattaattaatgggtgtattcttgggcaaattacttaaccccaaatgagcaataactttctcatctgtaaaatgggtagagaaacacaatatgatgtgaagtttgaataagatgacacatgaaagggacctagaacagttcccctcagaaagtagctgttccacaaatgagtttctttttcttccctgctgtgtaaatgctcaacacggccctaactgtggttcacattggccgatgcccttacaggaatgagtttgtggtgggtaaatatttcaatgggg

SEQ ID NO: 948 - DNA, 601 bp, Human
aggtcaaaatgtacctaagaaaactgggctcctcaatcacaacagtgatttttcctatggtaatatttcttatatttttactaatgattcttccaattccattattatgctcccttagggaaataatcacctctgtggatctctgtttcccaaccagtaaaatgaggaagtgggttaaaaaggtttctaaggcttcttataactctgaaaccatatggtttatacgttttcaaaataaaatatataaatgtttgctgagagtctcttgagtacagtaaattcctccaggccataatagtarcctttctgtatcttaaagatagtgtgaagggataaatgtgaaataattttgaggttcttttgcataagagagtccctgtgaaaaccaatgcgaatgtagtctacactttaaaaagattttaaatggcgagtagtaaaatggtgagtcaagggagaatagaaatatgataggactaaaaagtactgactttgaagtcagaaaattcaatttattaattaatgggtgtattcttgggcaaattacttaaccccaaatgagcaataactttctcatctgtaaaatgggtagagaaacacaata

SEQ ID NO: 949 - DNA, 601 bp, Human
ggtcaaggtcaaaatgtacctaagaaaactgggctcctcaatcacaacagtgatttttcctatggtaatatttcttatatttttactaatgattcttccaattccattattatgctcccttagggaaataatcacctctgtggatctctgtttcccaaccagtaaaatgaggaagtgggttaaaaaggtttctaaggcttcttataactctgaaaccatatggtttatacgttttcaaaataaaatatataaatgtttgctgagagtctcttgagtacagtaaattcctccaggccataayagtaacctttctgtatcttaaagatagtgtgaagggataaatgtgaaataattttgaggttcttttgcataagagagtccctgtgaaaaccaatgcgaatgtagtctacactttaaaaagattttaaatggcgagtagtaaaatggtgagtcaagggagaatagaaatatgataggactaaaaagtactgactttgaagtcagaaaattcaatttattaattaatgggtgtattcttgggcaaattacttaaccccaaatgagcaataactttctcatctgtaaaatgggtagagaaaca

SEQ ID NO: 950 - DNA, 601 bp, Human
gatcaggtaagtggtcaaaatggtataactgaaaagccataattttacagtggaatatcttgggaattggcagcataacattcccattccactctgcttaaaatgtggtgggatttctctgtgatggattctactgttagtcaattggagtaactttgatttagtcaagctatttttagtggggactgaacatttcacaaaaatacattaccactgtcacagcgaaatttattcttgcagtcagcctcttcaattttgcagagcttagatggaatgcatggttgaaaggctaccagaggckcagtgcatggctgtcccccaaactgactgggacgcaagacagatctaactttagactgaaaggaaagaagagaaagatataactctgaggcagggtcaaggtcaaaatgtacctaagaaaactgggctcctcaatcacaacagtgatttttcctatggtaatatttcttatatttttactaatgattcttccaattccattattatgctcccttagggaaataatcacctctgtggatctctgtttcccaaccagtaaaatgaggaagtgggttaaaaaggtttctaaggcttcttataa

SEQ ID NO: 951 - DNA, 601 bp, Human
aattggtgaccaatggatgcatctcaaggcttctcaaactttaagtatttttggcctgaatgcagatcctttgtaatttttcatagatttatcatctactgaataagagtcttttttgcttatatgtagtaaaaaccatctttcaagcttcaaatagttatacttcagttctagagcttgattttgatactctggatataatgatcaggtctgtattaccctcagccattctcattcggatttttctctgattcccttttttgtcaatttgtgacatgaccttattcatatagacacaaartatatctccctacccacatcctgctctcaaattccaggtttggggtggaggtggataggggaaaaccctgaccccagcattcctgtctgacattcagaaaaagctggcaaagctgagggcaggatgcagggagtaagaggggaaaacttgggttccaaggtcttgggtcaattttctgtggaattggaaatttgctatctagttataaatactttacttttcaggatatctcagagtacacagaaatgatagagatttcattcatctgaaatttaattttattgtaactttaagttgact

SEQ ID NO: 952 - DNA, 601 bp, Human
tgaactggcgatcagctgtgcttacactgctaacctttctaaaattgttcattataaattggtgaccaatggatgcatctcaaggcttctcaaactttaagtatttttggcctgaatgcagatcctttgtaatttttcatagatttatcatctactgaataagagtcttttttgcttatatgtagtaaaaaccatctttcaagcttcaaatagttatacttcagttctagagcttgattttgatactctggatataatgatcaggtctgtattaccctcagccattctcattcggattttkctctgattcccttttttgtcaatttgtgacatgaccttattcatatagacacaaagtatatctccctacccacatcctgctctcaaattccaggtttggggtggaggtggataggggaaaaccctgaccccagcattcctgtctgacattcagaaaaagctggcaaagctgagggcaggatgcagggagtaagaggggaaaacttgggttccaaggtcttgggtcaattttctgtggaattggaaatttgctatctagttataaatactttacttttcaggatatctcagagtacacaga

SEQ ID NO: 953 - DNA, 601 bp, Human
atatataattactgtatataattgttttcctgcatataatttgctatatctattttttggacaagttaagtgtctagatactacagtagcaagtagagtgagcaaatttagaaaatggtacaaattccatgtacccaaataattaccttccatttctgacttactgaatttcataaggatccttggaatcagtatataactatatattatagaaattgaaatacttatgtgcaatgacagatatctcctctcctgccttttaccttcttgcctgtagtcaatgatgttggcatctgtaccrgtatgtacaggtccaactgacaatgattaaaggttttacttgagattatctggttgattattttaagatgtgattagcatctcactacaattatgcatgactgttttgactaaaattcttgggaaaattgggcattctgttgaattaatttttttaattaatagtgggttcccaagaaagtacttggtttcaacttttttggttaataatcttcacttagaaggtagagtgtaattaaaataattacattttccatcttgcattatgtcaggactattattataaagaattatagctacg

SEQ ID NO: 954 - DNA, 601 bp, Human
gggtttgcttttcatgctggaagactggttttgtttctctagtgttttggctttcaacccacccataggcatacttttatcacaccctctttctccatttgctcctgacatttctgagtggttactcacccattcaaggcctacctccaggaccccaccctggcacctcccagcttgatgggcttagaccagtctgctctaatccattccaaaactttctgagagatgtatgagaaataaaacaagccatgtttatgaagggcccatagcattgcctggcacaaactatatttggaaatgytaacttttacttctcaggagtgaggatcatggccacatacctcctgaacatggtagctaagtatcagagatagggctggtaggagtagtaagaagttaatgaggaagatggacaatgatgtatctcattgctccctctgactcatttgttctgatacctgttctccccaagatgataaaaagatgttacatacccattgcccatcaactgtacactagggatgggattatacttccgtgtgcatactgcctttgtcctcccacagtccctttcatctgaattgtctccacagtcattttc

SEQ ID NO: 955 - DNA, 601 bp, Human
tatatttgtgtgtatgcatgtattttcacatatatatgtgtgtgatccctactcacagatctcactattttgccacatagatgaatgtgtcctttcaactgtgtgtgtatctatacacacactaagcctgggtaaaaacaaatagcatgctattattgcctgattcttgcttcatatttagaacctagtgactgatgttggcaatgtagaaatttttatatctcttgttaaaatttttcttggagaaatatcagttaagaaggtcagccactcaggaagctattttttttttttttttttktggggttagaaatatgttggatagcaggattggagaggcagagattctaaggccagcagattagaacaagattacagtaagcaattctcaaaactctcagtctctggggaggcaaggagaggactggttgtcccgagccggcaggctttgctcatttctcagaatcactgggacaacagctctggttggcagagggccacgtcgtccttcagccaaagtacacatagcatgtggtcctccccatctgtaactctagagtctagatcaactgaacaaaaggtgattttgtaatgtcaccct

SEQ ID NO: 956 - DNA, 601 bp, Human
tggtaagtttttttttgtatccaggaatttatccatttcttttagattttcaaatttgttggcatattgctgtttataatagtctttaatgatcatttgtatttctgtagtaccaattgtgagtattgggatgaatcttaaaaacattatgctaagtgcaaaaaggcagacacaggctgcatattgtagaatttcatttttatgaaatgtctagaatacacaaatttacatgaacagaaagtgaattagtggtttcctagggttaggagtcaggtagaagggggaaagaaatgaagcttgmtatctaatatgtacaaaggttttactttgggtatgttgaaaacattctaaaattatatcatggtgatggttatataagtctttgaatacgctgaagatggttgaattagacactttcaatggatgaattgtatggcatgcaaattacatctcaataaggctgttttttaaaatgagtgaattctgtgggttgtctaagatgcatattatattcaaatagctgaaagcataacagcgaggactaaaaaaccattgaccttatactgctttacactatgtacttatgtttgtcacaagcaaa

SEQ ID NO: 957 - DNA, 601 bp, Human
actttttgttattgatttaatctcattactcacaattggtctgttttctatttcttcttgattcaatcttggtaagtttttttttgtatccaggaatttatccatttcttttagattttcaaatttgttggcatattgctgtttataatagtctttaatgatcatttgtatttctgtagtaccaattgtgagtattgggatgaatcttaaaaacattatgctaagtgcaaaaaggcagacacaggctgcatattgtagaatttcatttttatgaaatgtctagaatacacaaatttacatkaacagaaagtgaattagtggtttcctagggttaggagtcaggtagaagggggaaagaaatgaagcttgctatctaatatgtacaaaggttttactttgggtatgttgaaaacattctaaaattatatcatggtgatggttatataagtctttgaatacgctgaagatggttgaattagacactttcaatggatgaattgtatggcatgcaaattacatctcaataaggctgttttttaaaatgagtgaattctgtgggttgtctaagatgcatattatattcaaatagctgaaagcataa

SEQ ID NO: 958 - DNA, 601 bp, Human
acagtgctgcaaataaacttagggatgcagatatctgttcagtataccgatttcctttgctttggatgtatgctcagtagtgggattgctggatcatatggcagtgctgtttgtagtttttttgaggaatctccatactggtctccataagagctacattagtttacattctcaccaacagtgtatgagcttccttttctccacatcctttccagcatttgctatttttttgtctttttgataatagtcatttcaactgtagtgagatgatacctcattgtagtttgattttcattttccmgatgattagtgatgttgaacattttaaaatatatttgttgggctccttttggtaaatgtcttattaagttcactggtgaacttaatccgttaaattggattatttatttatttttgaggtgagttgagttccttatatatcctggatattaactccctgtcagatgaatagctggcacatacttttttccactgtgtatgtttatgttgtcttttcactctgttactgttttctgcactgtacaaaaagctttttagtttgatataatcccatttgcttttgttgcttctgcttttgaag

SEQ ID NO: 959 - DNA, 601 bp, Human
atccattcatctgttgatggacacttagactgattccatatcttggttattgtgaacagtgctgcaaataaacttagggatgcagatatctgttcagtataccgatttcctttgctttggatgtatgctcagtagtgggattgctggatcatatggcagtgctgtttgtagtttttttgaggaatctccatactggtctccataagagctacattagtttacattctcaccaacagtgtatgagcttccttttctccacatcctttccagcatttgctatttttttgtctttttgataatmgtcatttcaactgtagtgagatgatacctcattgtagtttgattttcattttcccgatgattagtgatgttgaacattttaaaatatatttgttgggctccttttggtaaatgtcttattaagttcactggtgaacttaatccgttaaattggattatttatttatttttgaggtgagttgagttccttatatatcctggatattaactccctgtcagatgaatagctggcacatacttttttccactgtgtatgtttatgttgtcttttcactctgttactgttttctgcactgtacaa

SEQ ID NO: 960 - DNA, 601 bp, Human
taacctttaaccaatctcttcctatcctccccttcccctactctttccagtctcttgtaacccttattctaatctacttgtatgagatcaactttttaagcttctgcatgtgagtgagaacatgtagtatttatgtttttgtttctggcttatttcacttaatatcctccaggatcatccatgtttctccagtgacaaggtttcattctattttatggctgaatagtactccattttgtatatgtaacatgttttctttatccattcatctgttgatggacacttagactgattccatatsttggttattgtgaacagtgctgcaaataaacttagggatgcagatatctgttcagtataccgatttcctttgctttggatgtatgctcagtagtgggattgctggatcatatggcagtgctgtttgtagtttttttgaggaatctccatactggtctccataagagctacattagtttacattctcaccaacagtgtatgagcttccttttctccacatcctttccagcatttgctatttttttgtctttttgataatagtcatttcaactgtagtgagatgatacctcattgtagtttg

SEQ ID NO: 961 - DNA, 601 bp, Human
cctgcaatgctatagaacactagaacttattcctcttatctagctgtaattttgtaacctttaaccaatctcttcctatcctccccttcccctactctttccagtctcttgtaacccttattctaatctacttgtatgagatcaactttttaagcttctgcatgtgagtgagaacatgtagtatttatgtttttgtttctggcttatttcacttaatatcctccaggatcatccatgtttctccagtgacaaggtttcattctattttatggctgaatagtactccattttgtatatgtamcatgttttctttatccattcatctgttgatggacacttagactgattccatatcttggttattgtgaacagtgctgcaaataaacttagggatgcagatatctgttcagtataccgatttcctttgctttggatgtatgctcagtagtgggattgctggatcatatggcagtgctgtttgtagtttttttgaggaatctccatactggtctccataagagctacattagtttacattctcaccaacagtgtatgagcttccttttctccacatcctttccagcatttgctatttttttgt

SEQ ID NO: 962 - DNA, 601 bp, Human
tgtcacataattgtacatatttatggggtacgtagtgatgtttagatacatacaatgtatagtaataaaatcagggtaattagcatattcatcacctcaaacatgttgggaatattcaaaattttctcttctcggtatttgaaaatatgtactaaattattgttaactatagtcacctgcaatgctatagaacactagaacttattcctcttatctagctgtaattttgtaacctttaaccaatctcttcctatcctccccttcccctactctttccagtctcttgtaacccttattctamtctacttgtatgagatcaactttttaagcttctgcatgtgagtgagaacatgtagtatttatgtttttgtttctggcttatttcacttaatatcctccaggatcatccatgtttctccagtgacaaggtttcattctattttatggctgaatagtactccattttgtatatgtaacatgttttctttatccattcatctgttgatggacacttagactgattccatatcttggttattgtgaacagtgctgcaaataaacttagggatgcagatatctgttcagtataccgatttccttt

SEQ ID NO: 963 - DNA, 601 bp, Human
ttctatcaaagaggagcaaggatagtttgaaagttgtaaagtgatgttagaatactgaaaagaaagtaaggctaatataaatacttgtaaattctctaccaataaaattgtgttaatgtaaaagtacacagacacacacatacacacacacacacacacacacacacacacagcttttaagtttctgaaatggtttcttcacttgaaaatggagctaattgcttttttatagtagttgtggaaattaatagtgactagcacaggcctggcctgccctatgaaaggaaacaatacatactawctctcccattttttccaccagggaaagtatattttaattttattaaaaggttgcatactaagttcaaaagtaattgcttgcagaaacaaaatcaacaaacaaaaatcaaatgtatttccctacaaatagcaatgaacaatccaaaaataaaattacagaaacaattccatttataatagcctctcaaagaataaaatcctcaggtatttatttaacaaaagaagtctaagactcatatactgaaaagtataaacaatgttgaaagatattaagtgaaatctcaatgaatagaaagacatt

SEQ ID NO: 964 - DNA, 601 bp, Human
ttttgttatagataaaaaaacttctccaagatgctaatgcttttccaaattctaagagatattaatatgtattctgtgaaaaaagtagtttttttgtcaaacagtttggtaatgctgtattacatagattataaaaatcgttttctacaggtcatgtcacagccttaaaaatataaattgtcagtctccaagtacatttgaccaaataaccttgtctttcatagaacatgtagtgtagttctacagaatatcactggaaaattccatgtagcagaaggaatagcaccaatgcccttccctyctcatgacccttcagtacacccatcccttctgatagttgtgggggctcaagggaactctaaacatcctcaagaatgtcattgaccacttacatgtctgtttcccttgtacttctatggcattaactcacaagacaaaatgtacctgaaaggcaccacctttaccagagctgaaatattaagttttgtaactatcacaaagatctgaaaaaaagacaaatagactcattcatttgtgagggaatcaagaagcagttcactatgggaggcttttgcgatctattagacatttggatttaaag

SEQ ID NO: 965 - DNA, 601 bp, Human
aatctggatttataattttttatgacttacaaagccagtgcaaagtttggaagcagattatgaaataagttattatataataaatgctatcccaggtctacttctttctgagtggaattctaatagagagctcataataaaatagtaacagcaatattttaatggaattgtaataatattatagttttactaataactgactataatatttaaaatatattttatttaacaaatgcttatatactatttactataagccaagcaatagtaagtgctttacaaatattaacttggttaagtrctttactaataataacttatatttattacaaccatatgatgtagatataattattatacctgttttacaaatgaggacattgaggcacatagagattaattagcttagcataaatcaactatttaagaggttattttgttatagataaaaaaacttctccaagatgctaatgcttttccaaattctaagagatattaatatgtattctgtgaaaaaagtagtttttttgtcaaacagtttggtaatgctgtattacatagattataaaaatcgttttctacaggtcatgtcacagcctta

SEQ ID NO: 966 - DNA, 601 bp, Human
gcccaaactcagcttctctggctctattaggttctcctattccacttacttaattgttcttggctttcaacatacaacaaaatctggatttataattttttatgacttacaaagccagtgcaaagtttggaagcagattatgaaataagttattatataataaatgctatcccaggtctacttctttctgagtggaattctaatagagagctcataataaaatagtaacagcaatattttaatggaattgtaataatattatagttttactaataactgactataatatttaaaatatatyttatttaacaaatgcttatatactatttactataagccaagcaatagtaagtgctttacaaatattaacttggttaagtgctttactaataataacttatatttattacaaccatatgatgtagatataattattatacctgttttacaaatgaggacattgaggcacatagagattaattagcttagcataaatcaactatttaagaggttattttgttatagataaaaaaacttctccaagatgctaatgcttttccaaattctaagagatattaatatgtattctgtgaaaaaagta

SEQ ID NO: 967 - DNA, 601 bp, Human
ttgtaaaactacatgaaatagatgtttgctgaaaatacaggcaatatccttttgtgaaatgaccatattttgaaagtaaacttgtggattggttgttttggaactggaaagcaacttccatcagaacaatattacatataaatgtttaggttttagctctgtctacaaagcctgttcaaatacaatatatcttaagagcagtattatcagtcttcccagaggtattcaaatttgacggttagttcccaaagacattccccacctatcagtatatattagatggttttaaattgagtgaatygaattggaaaatgcctgtatttatatgtatataaaggtctttttaaaggaaggattaaatgagtttttgctgaactcatattacccataaagtggttctcagaaataattacaactctgaaattctctctagcttgtcaaatttctatgcatgaacgtcaccattaaaacgtgtattttctgttcttatcacaatttaaaagaagcagattactcactttagtgcaacgagtatggagcacttacgtgtaaagcatgagttagattctgagagtaggtagtatgctgctcattataattt

SEQ ID NO: 968 - DNA, 601 bp, Human
ggctaagcctaaattttctgttagtaatgtggatgtaaacaattttctacctttctggggaggttgttatgggaatcaagtaaagcaatatatgaaagtactttgaagactctaaggtatcatatgagtatgaagtgttatctaagcctcaatttgctccagcctcatatacttcctttattttgttacttgtaaaactacatgaaatagatgtttgctgaaaatacaggcaatatccttttgtgaaatgaccatattttgaaagtaaacttgtggattggttgttttggaactggaaagmaacttccatcagaacaatattacatataaatgtttaggttttagctctgtctacaaagcctgttcaaatacaatatatcttaagagcagtattatcagtcttcccagaggtattcaaatttgacggttagttcccaaagacattccccacctatcagtatatattagatggttttaaattgagtgaatcgaattggaaaatgcctgtatttatatgtatataaaggtctttttaaaggaaggattaaatgagtttttgctgaactcatattacccataaagtggttctcagaaataatta

SEQ ID NO: 969 - DNA, 601 bp, Human
aactctgagagagttgtttaactccaataagcctaaattttcttttcttttcttttctttttttttgagagagtctcactctgtcgcccaggctggagtgcagtggcgtgatctcggctcactgcagcctctacctcctgggttcaagcaattctcatgcctcagactcctgagtagctggaactacaggtgtgcaccactacgcccagctaagttttgtatttttagtagagacagggtttcatcatgttgcccagactggtcttgaactcctgacacccaagtgatctgcacccccttrgcctctcaaagtgctgggattacagatgtgagccaccacacccggctaagcctaaattttctgttagtaatgtggatgtaaacaattttctacctttctggggaggttgttatgggaatcaagtaaagcaatatatgaaagtactttgaagactctaaggtatcatatgagtatgaagtgttatctaagcctcaatttgctccagcctcatatacttcctttattttgttacttgtaaaactacatgaaatagatgtttgctgaaaatacaggcaatatccttttgtgaaatgaccatat

SEQ ID NO: 970 - DNA, 601 bp, Human
aagggatcatttgtacccccaacctcagcatcacacaataaagccaggtgacaaactcgcatatgtattccctgaatctaaaatgaaagttgaaaaagaaaaaaaaaaaatctatgtttcacaattggattccaaaattcctgaaaagttaacagttgactcttgtgaactcaaagagctgggtccagcacatcattgtctaacttcaagggggatacattttaactgatagtttatgaaggtgctcagacttttaacccactgtgtggagttttaatgtctttcttgatatactacaaaygtctcatctaacataggccgcctccgactataagagccagaagccaggaatccttatttttctgtgccatttatttgctgtataactctgagagagttgtttaactccaataagcctaaattttcttttcttttcttttctttttttttgagagagtctcactctgtcgcccaggctggagtgcagtggcgtgatctcggctcactgcagcctctacctcctgggttcaagcaattctcatgcctcagactcctgagtagctggaactacaggtgtgcaccactacgcccagctaagttt

SEQ ID NO: 971 - DNA, 601 bp, Human
attatcctaagcaaattaacacaggaacagaaaaacaaatactacatgttttcacttataagtgagagctaaacatcgggcactcatggacataaagatggcaacaacagacactggggtctactagggggggaagggagggaggggcaagagtcgaaaaactgttgggtactctgctcagtacctgggtaaagggatcatttgtacccccaacctcagcatcacacaataaagccaggtgacaaactcgcatatgtattccctgaatctaaaatgaaagttgaaaaagaaaaaaaaaaaatctatgtttcacaattggattccaaaattcctgaaaagttaacagttgactcttgtgaactcaaagagctgggtccagcacatcattgtctaacttcaagggggatacattttaactgatagtttatgaaggtgctcagacttttaacccactgtgtggagttttaatgtctttcttgatatactacaaacgtctcatctaacataggccgcctccgactataagagccagaagccaggaatccttatttttctgtgccatttatttgctgtataactctgagagagttgtttaactcca

SEQ ID NO: 972 - DNA, 601 bp, Human
caactgggcttgttctttataaccaagtcccaccttgttttatactttttcaagagacgagtctgacttcgggatcacagtttctgaggttgggttcccattgcctgctaccaaagctcccagtgctgatcaactcttgattgacctttgtgttagtcattacgctgtttacaactactctagtctctttctgggcacataaaaagcatgcatttccctactctttttggccaataaaatgtaaatataaatggtatctgtcactttaagagttgatgggcaatatgtcacttccccccgyccctttttttttttttgcaattcatcatcacaccagtcaggatgtgtcaaagcaggatcccttaagtcccttgctttctaagtgactattatcagtagaacgtacagtatgagtggcactgttttaagacactgacatcttagtattgatattgcagtgtaacctaacttgtcttgattaaaatgctgagtctggtgtctgtattccatcatctgtcctgtagttattctaaggtcttctaactccctgcccagttgccttctcttcctttcatgagtctctttaatctttgtataccag

SEQ ID NO: 973 - DNA, 601 bp, Human
ttgccaaaagtccctgtcacttacagaggttggacttgtctgttactcattaaataaatatacttgtgtgcaataacatcattgctctagcctggaattaggcatatctgcctctatttgaatctatacaaggggcattttgccactagaaattccagaagatgcttattaggaaaaaataaaattttattacatttgagtaaaaactattgccagacagagaccaggcctttagtaaagagcaaaataaaataagaaatgaatttatccatgaaaatgggaatatataatctaaccttaygaaatgagttagaagaataatgcatcactgttgaaagccttcgtgtgttttaaaaatgagaatgtcaataattttaacggtctttgtatgcagccagaacaaatagattaaaagttattttggtatctggatctgccaatatgtgattttaaggataatgttctagggcaggggccagtaagcttttctataagtggcctggatagtcatctgtaggccatatggcatctgttgaaattactcacttctgccattattgtatgaaagtagccatagacgatatgtaaacatatgaatgtg

SEQ ID NO: 974 - DNA, 601 bp, Human
ttttgatcagaaaacctgggggataagaatcctgggctttccctcagacccttcattgaaaaattccctttagtttcattatctgagattcccttgctaaagaactggctccagacacatccaacttttatgaaatcattgggaccttttcctttcaagaaacactttcttttctcttatccctagtggatttctccaaatgcaagttaccacgctatgactgatgcagagtgatgggcattctaattgacactggtctcaactctgcttcatggtctcccacaataagtctttggactcycattcaagccttatttgaatcttgtttttcactttactctagcacagatatgtgcagagcctaaagctcattcactctttctcagtaaagaatgtgaacatgaaccaaggagtagtgtcttggcgaaaactacgtcttacacaaaatcccatcttacacaaattcccatttctgttacataaagagtgtaaatatcatcttcttgagactcagcattttgcgtcaatttgaacattgggcaaagcagatgtctgtggttagatacagcttgcagacttcctggatttcttttgaagtgca

SEQ ID NO: 975 - DNA, 601 bp, Human
agcagaataaacaacaaatttaggcaaattttgtgcaaccaaagaggtgattttgatgagatttactgcatctgttcagctttggtgcctccttttgatcagaaaacctgggggataagaatcctgggctttccctcagacccttcattgaaaaattccctttagtttcattatctgagattcccttgctaaagaactggctccagacacatccaacttttatgaaatcattgggaccttttcctttcaagaaacactttcttttctcttatccctagtggatttctccaaatgcaagttrccacgctatgactgatgcagagtgatgggcattctaattgacactggtctcaactctgcttcatggtctcccacaataagtctttggactctcattcaagccttatttgaatcttgtttttcactttactctagcacagatatgtgcagagcctaaagctcattcactctttctcagtaaagaatgtgaacatgaaccaaggagtagtgtcttggcgaaaactacgtcttacacaaaatcccatcttacacaaattcccatttctgttacataaagagtgtaaatatcatcttcttgaga

SEQ ID NO: 976 - DNA, 601 bp, Human
agggaattagcagagctattgcatagttccggtttgacccacactgtctaaacttgcatcttttttagcctctcagtgcttaagaaatataatggctatagaggctatactaccaatctcagggtgcaccaccttatcagaccccagaacactgagctgctactcacctttttcacaggtgagagagtttgaaatgggtggtgtccaggaattcccctggcatgtgtaccttgatggcccagcaacaacaaagcctttggggcaagttagctcaatggattcaccaattctatacaatctstgaaatggtgtaattgtcaggacttcctgcacaactggcttgatgcactccgtccctgcaagagagcaacatttcatatgtgtttagtggagcagaataaacaacaaatttaggcaaattttgtgcaaccaaagaggtgattttgatgagatttactgcatctgttcagctttggtgcctccttttgatcagaaaacctgggggataagaatcctgggctttccctcagacccttcattgaaaaattccctttagtttcattatctgagattcccttgctaaagaactggctccagacac

SEQ ID NO: 977 - DNA, 601 bp, Human
atctgactattcaggcatcccaagaaccaaaatgacctcgtgagcaagttaattgtcaaggcaggactggaggctcagctcactcttcctcctcttagcttatcaagtagaaggtttgataaggaaaggtggctcacgtaagaagcaaaaataaagatgtaaaaaattcctaggtttcttattcacagttgttttcctttccttctattaccaccattttatctggtgaaacttggcccggaactctcctgaacttggagacctatccttccggtaaggctttagctactatggtttacawtgtggtgatattgtttacctgtgcctctttgccctttgtaattaggcctgggaggagcagcaaggtatacattgtttccaaaaagaatcaattcagctttcaagtggcacacagccttcctctatcactacaggtttgaaattgtcaatgatcttatgcaaggaatctgctcttccaatcagcctcaggttgaagcagtgctgggactcagctgcccacacctcccagcacaggagcaacaaatactccacagtctgtaaagtgctcagggcaagaggatcctctgaagggctaagggag

SEQ ID NO: 978 - DNA, 601 bp, Human
tctgtctaaaaaaaaaaaaaaaaggcaggcagcatgtgagtttcctggaactgaaagaacccagtgtggttgaagtgctgaaaaacaagaggatggaacaagatgtggccagagaggtaggtgtctggtaggctgtgtgggaggctaatagggtctttgaagggttttgtcttcattttataaatagtagacagtctctgataggttttaagcagggagtggtgtaacaaaatcagccctcgattttgaaaaaaagaaattaattatggcttctgtgcagagaatggatttgaagaggcayggtggtcaatagggctccagggagctaatctatgaggttattgtggtagttcaggtgaaagaggatgataatttggaccaaggttccagaggtggaaatggagaaaagtggataaacttgagacacagctagcaggtaaaacaagtgatattacctattatgtaagttatgagagctgtcaattatatgattcttcggtttctgatttgcataaaagaatatacattagtgccttacctgaaatagaaaatattagaaaatgcttagttttaggaaggaagggtgatgaattaagagttc

SEQ ID NO: 979 - DNA, 601 bp, Human
tttctcagataaaaagttgatatttaaaataaaaatgatgttgtataatactttcagctcttttctatcacagattattgtttgcaagagacgtcagttgagtaatggtgttgatcaagcatcaaaaaaatgaatagtagagtttttgtctaaaaagttatttaatagtgattagaattaagcaacgtgcatatcaggccctagttttctgtaacttatatggaattgctttgtttagacatggcatgaaggttgaaaaccccagatactggcatcctgagttgtcaccatcagatgccarctatgtccaccctctgtcatgtttcaatcttgtggcctgtcaagggagctgaagcttgataatcaaccttaagtggatcggaaaagaactggttttgagtaataagacctctcccctttccaggactgagctgaagaacactgggccacaaagtcaaaaaagagtcaagaggaacaatatggtttttgtctttctttttgcaaaagtaaggtggtttcagcaaagattcctttgcatactttatgctccaatttaagataatttttttggaaaatgttccacaaaggaaatatctctaac

SEQ ID NO: 980 - DNA, 601 bp, Human
gcttctatacttaagaaacccttccagaccagaagatatttctctctcttaatgctcttatcacatcctgacttgcactaaagtgattcatgtaattattgtctaatgttactcctccaaaaatttgacgggtaaaaagggtgcctcatcttaaaaccatcatcatggctgctaaatggatgttggctgaaaaaatttcccgttcctgtcggttggtggtagatatttctgaaattcagataaaatacttaatatctataaaataggcttctgggggatttcattcatgttgtaacttttgaaaggtgaccttcatattactttgaagttctattttaaagttttttaaaattccattttagatagagaaggaaaagagtagctaagagcacaatgtaatcaagaacacagtttaatcaaagtgacattcaattgaactgaaaattactaatattccaacttcccatgagtggcctgggtataaagtacatttttagctttctctgtcttcataaatgctatcatttgtatattgatacttttctatagtgctaatccaaacagaaccctctgtgacatttacttttgctcaccaattaaa

SEQ ID NO: 981 - DNA, 601 bp, Human
tagcttaaatgttctttgcttaattattttcagaactaccagcaccaaaagacccttcccaccacctctactaattcatccttcaacactcagttctcacgcttctatacttaagaaacccttccagaccagaagatatttctctctcttaatgctcttatcacatcctgacttgcactaaagtgattcatgtaattattgtctaatgttactcctccaaaaatttgacgggtaaaaagggtgcctcatcttaaaaccatcatcatggctgctaaatggatgttggctgaaaaaatttccygttcctgtcggttggtggtagatatttctgaaattcagataaaatacttaatatctataaaataggcttctgggggatttcattcatgttgtaacttttgaaaggtgaccttcatattactttgaagttctattttaaagttttttaaaattccattttagatagagaaggaaaagagtagctaagagcacaatgtaatcaagaacacagtttaatcaaagtgacattcaattgaactgaaaattactaatattccaacttcccatgagtggcctgggtataaagtacatttttagcttt

SEQ ID NO: 982 - DNA, 601 bp, Human
tatctctggcacctcccttttactcactgcctacattcaatcaggcactagtcctatcaatccatttctccaatgtcttcagcctgtcctttctgttttattttatttttatttttaacattggcattgcctaactacattcatcgttatcatttgtagagcatgtactgtgaagccacacaatatgccaagcactttacatgctttatttttttgaacccttacagcaaacatatgaataggctatcatactaattctacagaagaggaaactgagctcaaagaatgtaagccctttgcrcattgccacacaattagtaaatggtagaagcaggatttaaataatacatgactcacaggcctgagctctttaacataactccatatcacatttgtttctttctttctagaatattattgggttatgcctggggatctgtatttttagtaggcagttaaattgagtgattctcctatgaggcctgcttttggaatcaccaaagcacttcataattcatttaagtcttatgttcatgaaataggtttaaaacaatcatttagagataaagttaccaaagttgagtatatcaaattaattttg

SEQ ID NO: 983 - DNA, 601 bp, Human
ctgatctaggttcatggagccggggctgtggctccttttcgggctcacagtgacctccgccgcaggtaagcgcacggggcggcgcgcctctcctggcgcgagcgcacacaaaaggacccagggcgggggacccgaggcgcggagaagatgtgcgtcgcggggagcaaactcttgcctgggctctgcactcgtgaagacgcctgggggagggctggggagcagaagcggcgcgcaacgactacccgcacgggctccgggagttgcagcccgcgcactggctggagacctgctgcctgggccracttggtcaatttttcatgaaactggggacttttcagaaagtttgcgaactattcagaggctgtgccaaaccctggcaaagtttgcagaaagtatgcaaaatgcatgcaagttttcaacgggtgcagatagcttgcaagcttttcacagagtgtgcagatagcttggaaacttttcagaaactgcgcagagctttggaaactttgcagacattttgcttgctccacccccctcctcaggtgtttgggggtggcgggtgttgaggggtctgcacactcagcttaggagcccctcaatctgc

SEQ ID NO: 984 - DNA, 601 bp, Human
acatgcccagacgcctgctgggctccaagagtgctggctgctgcccagctacccagaccctccatgtccttccatgccctcagccccaactctcttcctgggggttgtggagggcagggggtgcacagttcactccagaaccttcctaagacccagagctgtagtggggagggttgtgaacaccagtttctgagaccttttcagccaggcggtggttctcgctccacacccttgggggcccctgagcagggaggcctgggtgtgctcacctaacattaccctgtgctttgcagacagacgktgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcaggtatgacacctcctccagtttcactcatttgcagatatgcatcaaccctcggcaaggccaggccaggggcttctcaaaggagggtgtaggatagttcagtcacatcctgacctactgtcgtcctgtgggcc

SEQ ID NO: 985 - DNA, 601 bp, Human
ctgtgggccagagaaaggaggtgctgagcccagaaaagacccaggtcctcagcatcaggagggcaggagatgcagcgtccccacccccttgctgccttttggaacagaagcttcacagtggccgtggctacatctggtttccagacatatgtttttctggcctgcacagcactttgtgaaaatctgaataagttgccaacacttaaaagattgaagaattaacccctgccaaatgcgtatttttagccttctcgaaaatagcccatgataagagtgcaaaaggcttattgggaggggggggaacccagcacgtaggaccatctggtctcagagccccccttctctttggccaccctcagctggaactgagtgggggcatctcacgtttgagtaggatgtgcaatatccatttacctgttaccaatttatcttactttgtagcccctggaggcccccaagtttgagaccctgtggtctgtcctggctgccttagggaagcttgcaaatcacgttgaatggaaccaacaggcagactccatgtttgacccaggggctttgagctggtattcacataacaggtattcctgttaatgctccttac

SEQ ID NO: 986 - DNA, 601 bp, Human
ttctccagttcattgtattattttttttaacccacttgtcttttttgtatgagagatcctgagggtttcctgcagtcaaactgggtttatttgtcattctatcaatcagaagtcattattaatgactccgcagctcatctgcaatgggatggtaatttatgttcataataatagcctggaggtggcttgggtttctacagagactgatcgagggaagatgaaaccatgctcagtatacaggagctttccaaattggtggcagatcgcttctagtctagtccagagagggatctgtcagcawccataataaaaatggagcgggaggaggagggccgaggcggaagagacagagcccgggagagcatgagtcagacccagatggtcccactttgcctcttcattctttttcctctttttctcttcctcaccccaaaccaaagctcctctcagcgagggcgggatgtaattaaacccatccatccattgcatcatttattcattcgcttatgcattcgttcagcaaagacttgttgggcacctgctacgggctgggcaccattctcgatgctggggacatagcaggaacaaggcataggatctc

SEQ ID NO: 987 - DNA, 601 bp, Human
acaagaggtgaagagtccccattatagaggccaccagagtagagagatggttccagagacatgtggagcactaacaacatgctggagaaaagacaaccacgcctaaggtgtctggtctgagaaggagacaggagtgtttggatgcataaggtgtgaatgggtatccataagtatagataaatatatttacagtcattggtgagctgacgggggaagggagggagaagagcgaaaaagggttaatgatagggagaaggctgcgagagccatcctctagtgagaaataccgaaggtaggctgyggcattgccaggggtgcagaacagtgtggcgcgctgtcgggagacacagtgctaagggggagaaggggggagccccaggtgcacgcctggctgggtgagtgcggcgggcaggagccctcgcttctgggcgggtctaaggaggagaagtggctcgagttcagctccaaattgggatggaggcaggcgatgcgcaggagtggggaggcgcgcaggagtggggagccaagccggcggggttccagtctagcaggctgttctcacttggccccactccctccaccttttgtgttccagctccat

SEQ ID NO: 988 - DNA, 601 bp, Human
ggaggtggagaggttgggcatgcaattttcaatagggctatcaataggcttaagaagtcagggttgccaacatttcccattccccaagcctgcttccccttcccttggagcttgtgcaggcactgagccagtttaaacaacacacacctgacggtcagtgcccagtaagtacttgttgaccaaatgaccaaatgaagggggactttgtttctgggcccagtgaaggttcccccttgatcccctggattacccagtcatgactcctggagacttggctattttcaaaaaccaggcacacccmcaagaggtgaagagtccccattatagaggccaccagagtagagagatggttccagagacatgtggagcactaacaacatgctggagaaaagacaaccacgcctaaggtgtctggtctgagaaggagacaggagtgtttggatgcataaggtgtgaatgggtatccataagtatagataaatatatttacagtcattggtgagctgacgggggaagggagggagaagagcgaaaaagggttaatgatagggagaaggctgcgagagccatcctctagtgagaaataccgaaggtaggctgt

SEQ ID NO: 989 - DNA, 601 bp, Human
gattagtctaatgatggaatacagttccccaaggatcttggggagatttttgtatgtgtcaaaacatatggaaagcagaagaaaaggggcttattcaaagaaatttaaaaattaaaagatttttggagacccagattcccccaccctccataatcctacagcagcatcttcgcaagaaatgtttcctgttatatgcatgtgctgtatctatgttcatttcatacagatttatgagattataagtcacttttaagaataaacgcacacaaccatgtccagacaaatgttgtcttctaaagcrtttacatttgcaatttaattcaaccaatatttattgagggcctatgacatgccaggctgtgatctaggtacatgggatacatcagagaacaaaacagaatgtttgctctgatagattatagtctgatagggttagggtggagcccaagaagagccataagtaaatccacttaggggtgaggaggtaggaactgctttggaaattgagccacatggaggaggataaggaggtggagaggttgggcatgcaattttcaatagggctatcaataggcttaagaagtcagggttgccaacattt

SEQ ID NO: 990 - DNA, 601 bp, Human
aactgagaagtggcagcaaggattagtctaatgatggaatacagttccccaaggatcttggggagatttttgtatgtgtcaaaacatatggaaagcagaagaaaaggggcttattcaaagaaatttaaaaattaaaagatttttggagacccagattcccccaccctccataatcctacagcagcatcttcgcaagaaatgtttcctgttatatgcatgtgctgtatctatgttcatttcatacagatttatgagattataagtcacttttaagaataaacgcacacaaccatgtccagayaaatgttgtcttctaaagcgtttacatttgcaatttaattcaaccaatatttattgagggcctatgacatgccaggctgtgatctaggtacatgggatacatcagagaacaaaacagaatgtttgctctgatagattatagtctgatagggttagggtggagcccaagaagagccataagtaaatccacttaggggtgaggaggtaggaactgctttggaaattgagccacatggaggaggataaggaggtggagaggttgggcatgcaattttcaatagggctatcaataggcttaaga

SEQ ID NO: 991 - DNA, 601 bp, Human
gcataaataaaaactgagaagtggcagcaaggattagtctaatgatggaatacagttccccaaggatcttggggagatttttgtatgtgtcaaaacatatggaaagcagaagaaaaggggcttattcaaagaaatttaaaaattaaaagatttttggagacccagattcccccaccctccataatcctacagcagcatcttcgcaagaaatgtttcctgttatatgcatgtgctgtatctatgttcatttcatacagatttatgagattataagtcacttttaagaataaacgcacacaascatgtccagacaaatgttgtcttctaaagcgtttacatttgcaatttaattcaaccaatatttattgagggcctatgacatgccaggctgtgatctaggtacatgggatacatcagagaacaaaacagaatgtttgctctgatagattatagtctgatagggttagggtggagcccaagaagagccataagtaaatccacttaggggtgaggaggtaggaactgctttggaaattgagccacatggaggaggataaggaggtggagaggttgggcatgcaattttcaatagggctatcaa

SEQ ID NO: 992 - DNA, 601 bp, Human
gaggaaatagttgagaggcagaaagacaaagcaacttctctgaggttacaaggtcagtaaggggcagaactgggacaaggctctgggtcttcggtgctttcaccacttaaaagaaagcttttgctttcttcctttataaaaccagagattggcagggggcttccttttgtgggaaccccagtggagacagaggatgtttacctgcagggaagaggggccagggcccggctgtgcctggacccagagtggtggggaaggggggtatgctcataccttgcaggttgacgccccggggcaccamgccctgaagctccactgtgggcaggtcatcttccgctgcattagagttattgggtggaactgctcttctgcctccaaaggcggtcctggaagtttctgacatttttgactttacaaggtccttcagaaaaaaaaaaaaaaagaagacaacagaaaaggcatgtaaagtgagtaacatttgagacaaggattccaaaatagagaaacagatatatctgtgtgtgatagcacttgagcaacacattttgccgtttgcataaataaaaactgagaagtggcagcaaggattagtctaatgatg

SEQ ID NO: 993 - DNA, 601 bp, Human
tttctttgaattgggcacaccccttgcagtattctttgcatcactttgaaaatacctttctttataagccaggttgaactaatgagatttcactgttctaagtggccaaagcatttctcaatagaatgccacattattcatggaatctctcatttctgtaacactgtaatacccagagatatgtggtttcagctgataaattacgcagttgtctttatgagtccctactcctatgctctctgccttggagtctcagatcctaaaaagcaggaaattgtgcttgtctaatatcgatatatgrgatcctgtagggatacatgtgacaaaaaatatgaagtaaaaatgtccttgacaataacaaattttaagtggctcacctgaccatagctccagcttctggtcttgatgtcattgacctctccataaaaaattaccccgatgtcattcaggacatactcttctctttctttctcattgtccagatacacagcatcatctgcatcagggtttaaacatagtgactattaccaaaccagactgtttccaaacacttgcaagtttatgcaagtttattttgtttctaaactacatttaatcagcc

SEQ ID NO: 994 - DNA, 601 bp, Human
ttttctaattagcagtaccctaggctaacacttaaaaaaaaaaaaaaagaagctatttctttgaattgggcacaccccttgcagtattctttgcatcactttgaaaatacctttctttataagccaggttgaactaatgagatttcactgttctaagtggccaaagcatttctcaatagaatgccacattattcatggaatctctcatttctgtaacactgtaatacccagagatatgtggtttcagctgataaattacgcagttgtctttatgagtccctactcctatgctctctgcctwggagtctcagatcctaaaaagcaggaaattgtgcttgtctaatatcgatatatgggatcctgtagggatacatgtgacaaaaaatatgaagtaaaaatgtccttgacaataacaaattttaagtggctcacctgaccatagctccagcttctggtcttgatgtcattgacctctccataaaaaattaccccgatgtcattcaggacatactcttctctttctttctcattgtccagatacacagcatcatctgcatcagggtttaaacatagtgactattaccaaaccagactgtttcca

SEQ ID NO: 995 - DNA, 601 bp, Human
acattcgcccccgcttgtgtcgctaattaaaaatcattttgaaatcacaggacatgcattcatttatggaaaattggtaaaatatcattcatttgctccattgttaaagataccaaactgaaatagtttgaatgactgaacatcttaaagaaatgccatttgctactttgtgtctagacaatcaacttgcagctgataaaatctttctatgtaaaagctcagtggcccttcctttgatgaaatgataacactcttttctaattagcagtaccctaggctaacacttaaaaaaaaaaaaaaagaagctatttctttgaattgggcacaccccttgcagtattctttgcatcactttgaaaatacctttctttataagccaggttgaactaatgagatttcactgttctaagtggccaaagcatttctcaatagaatgccacattattcatggaatctctcatttctgtaacactgtaatacccagagatatgtggtttcagctgataaattacgcagttgtctttatgagtccctactcctatgctctctgccttggagtctcagatcctaaaaagcaggaaattgtgcttgtctaatatcg

SEQ ID NO: 996 - DNA, 601 bp, Human
agtatagtcaaaggttgcatgtcactgaggaggggatggcttgaaaccagggagtcaggcaggaatccaagaacagggggtgccaactagcttgtagcttggcaggacattagaaatgcaggcggggaagcctgagcactgggcatgtaattctccggagtcagggaagctgttcacaaagccaggtaggcaggataacacgggtactggagcagtgggtaaggaacacagggagatcccatatggaagtcaaagcaaggcatccggagccaagaaagtaccctgtgaccaccagattccrtgaaaactccctgctggatgcccagcgcaatgatgcacagttccagccatcccagccaaaactcctgagaaatgacattcgcccccgcttgtgtcgctaattaaaaatcattttgaaatcacaggacatgcattcatttatggaaaattggtaaaatatcattcatttgctccattgttaaagataccaaactgaaatagtttgaatgactgaacatcttaaagaaatgccatttgctactttgtgtctagacaatcaacttgcagctgataaaatctttctatgtaaaagctcagtggc

SEQ ID NO: 997 - DNA, 601 bp, Human
attggggacccaagacaagggcatcaggcagtaggcagtatagtcaaaggttgcatgtcactgaggaggggatggcttgaaaccagggagtcaggcaggaatccaagaacagggggtgccaactagcttgtagcttggcaggacattagaaatgcaggcggggaagcctgagcactgggcatgtaattctccggagtcagggaagctgttcacaaagccaggtaggcaggataacacgggtactggagcagtgggtaaggaacacagggagatcccatatggaagtcaaagcaaggcatcyggagccaagaaagtaccctgtgaccaccagattccatgaaaactccctgctggatgcccagcgcaatgatgcacagttccagccatcccagccaaaactcctgagaaatgacattcgcccccgcttgtgtcgctaattaaaaatcattttgaaatcacaggacatgcattcatttatggaaaattggtaaaatatcattcatttgctccattgttaaagataccaaactgaaatagtttgaatgactgaacatcttaaagaaatgccatttgctactttgtgtctagacaatcaacttgc

SEQ ID NO: 998 - DNA, 601 bp, Human
tcatatttgggccataaatagaatcaccaggctaaaggctagaaattggggacccaagacaagggcatcaggcagtaggcagtatagtcaaaggttgcatgtcactgaggaggggatggcttgaaaccagggagtcaggcaggaatccaagaacagggggtgccaactagcttgtagcttggcaggacattagaaatgcaggcggggaagcctgagcactgggcatgtaattctccggagtcagggaagctgttcacaaagccaggtaggcaggataacacgggtactggagcagtgggtraggaacacagggagatcccatatggaagtcaaagcaaggcatccggagccaagaaagtaccctgtgaccaccagattccatgaaaactccctgctggatgcccagcgcaatgatgcacagttccagccatcccagccaaaactcctgagaaatgacattcgcccccgcttgtgtcgctaattaaaaatcattttgaaatcacaggacatgcattcatttatggaaaattggtaaaatatcattcatttgctccattgttaaagataccaaactgaaatagtttgaatgactgaacatctt

SEQ ID NO: 999 - DNA, 601 bp, Human
gaagagtgccctgactgggcttgggacacttttccagacctccttgctgcccaccttgatgacttttccccttgttagctatctatagattgtcatatttgggccataaatagaatcaccaggctaaaggctagaaattggggacccaagacaagggcatcaggcagtaggcagtatagtcaaaggttgcatgtcactgaggaggggatggcttgaaaccagggagtcaggcaggaatccaagaacagggggtgccaactagcttgtagcttggcaggacattagaaatgcaggcggggaagcctgagcactgggcatgtaattctccggagtcagggaagctgttcacaaagccaggtaggcaggataacacgggtactggagcagtgggtaaggaacacagggagatcccatatggaagtcaaagcaaggcatccggagccaagaaagtaccctgtgaccaccagattccatgaaaactccctgctggatgcccagcgcaatgatgcacagttccagccatcccagccaaaactcctgagaaatgacattcgcccccgcttgtgtcgctaattaaaaatcattttgaaatcacaggaca

SEQ ID NO: 1000 - DNA, 601 bp, Human
gctggcgaagagtgccctgactgggcttgggacacttttccagacctccttgctgcccaccttgatgacttttccccttgttagctatctatagattgtcatatttgggccataaatagaatcaccaggctaaaggctagaaattggggacccaagacaagggcatcaggcagtaggcagtatagtcaaaggttgcatgtcactgaggaggggatggcttgaaaccagggagtcaggcaggaatccaagaacagggggtgccaactagcttgtagcttggcaggacattagaaatgcaggaggggaagcctgagcactgggcatgtaattctccggagtcagggaagctgttcacaaagccaggtaggcaggataacacgggtactggagcagtgggtaaggaacacagggagatcccatatggaagtcaaagcaaggcatccggagccaagaaagtaccctgtgaccaccagattccatgaaaactccctgctggatgcccagcgcaatgatgcacagttccagccatcccagccaaaactcctgagaaatgacattcgcccccgcttgtgtcgctaattaaaaatcattttgaaatcac

SEQ ID NO: 1001 - DNA, 601 bp, Human
agctgtgtttgctgggcaggatagcaactaactggagagttaaggaaatagtcatagaacggattgattccctgcatcactgtaaacatgcttggctggttattctggccaaaggatacacaccaatagcctctttgagtggcagaagatacaatcaagtgactgtgctccagggtgcctacccaaaggcaagctggcgaagagtgccctgactgggcttgggacacttttccagacctccttgctgcccaccttgatgacttttccccttgttagctatctatagattgtcatatttggrccataaatagaatcaccaggctaaaggctagaaattggggacccaagacaagggcatcaggcagtaggcagtatagtcaaaggttgcatgtcactgaggaggggatggcttgaaaccagggagtcaggcaggaatccaagaacagggggtgccaactagcttgtagcttggcaggacattagaaatgcaggcggggaagcctgagcactgggcatgtaattctccggagtcagggaagctgttcacaaagccaggtaggcaggataacacgggtactggagcagtgggtaaggaacacag

SEQ ID NO: 1002 - DNA, 601 bp, Human
gagaaaccttgtgtgctatccacccaagtgcttgtgacagaaaccacaatcataatggctaattaccacacaattctttattcagtccagttagaatacccactctgggtgtatcccaaactgacaggatggatgcagtaatgggtaattgcactagttcttcaggtatgcaaatagctcagtattttggttcttattaagcagcttctctcagctgtgtttgctgggcaggatagcaactaactggagagttaaggaaatagtcatagaacggattgattccctgcatcactgtaaacaygcttggctggttattctggccaaaggatacacaccaatagcctctttgagtggcagaagatacaatcaagtgactgtgctccagggtgcctacccaaaggcaagctggcgaagagtgccctgactgggcttgggacacttttccagacctccttgctgcccaccttgatgacttttccccttgttagctatctatagattgtcatatttgggccataaatagaatcaccaggctaaaggctagaaattggggacccaagacaagggcatcaggcagtaggcagtatagtcaaaggttgca

SEQ ID NO: 1003 - DNA, 601 bp, Human
aaaaaggaataaagatcaaatagcaagacaggaagattttacctatactgtacctcactgtagtaagagattttcctgaatagagaaaccttgtgtgctatccacccaagtgcttgtgacagaaaccacaatcataatggctaattaccacacaattctttattcagtccagttagaatacccactctgggtgtatcccaaactgacaggatggatgcagtaatgggtaattgcactagttcttcaggtatgcaaatagctcagtattttggttcttattaagcagcttctctcagctgtrtttgctgggcaggatagcaactaactggagagttaaggaaatagtcatagaacggattgattccctgcatcactgtaaacatgcttggctggttattctggccaaaggatacacaccaatagcctctttgagtggcagaagatacaatcaagtgactgtgctccagggtgcctacccaaaggcaagctggcgaagagtgccctgactgggcttgggacacttttccagacctccttgctgcccaccttgatgacttttccccttgttagctatctatagattgtcatatttgggccataa

SEQ ID NO: 1004 - DNA, 601 bp, Human
gctcctgtacccaagaagaaggaatgaatcatttaccaaagtcaggccagagtcttaggacctcgaaagtaatgtgaatcctcgtgcatttagaaaataaagagctctcaggtgtatcacaggaaggtgcttcacactacttagtttgcacccaaaatagtaggagacctcatatagtgactgtccctctaaggtttcccctcttctgagacaaggtggaccccaggatcaaggagagggcagaaggctgcagaaagtagattacactatcaagggaggagtctggtaccagttcagtctycttagaaagaactgctagccacaggcaataccagaattttcttaaaaaggaataaagatcaaatagcaagacaggaagattttacctatactgtacctcactgtagtaagagattttcctgaatagagaaaccttgtgtgctatccacccaagtgcttgtgacagaaaccacaatcataatggctaattaccacacaattctttattcagtccagttagaatacccactctgggtgtatcccaaactgacaggatggatgcagtaatgggtaattgcactagttcttcaggtatgcaaat

SEQ ID NO: 1005 - DNA, 601 bp, Human
tactgaaataaatgtatttttaaaaatattcactgaattaattgtaatatcgtctgggtctagagaggcaaatgcctctgaaaaatgatgcatgacactgaagagaataattctgttctcatatgctttcctctacagattggatgttgggtggattaaaaaccagaggggaaactggagagggaaagattgttcattatgttctgatctctaattgctcaggggcattgagaaatgtggaaaaatgaatatgagaccacctgctataataccttccataactgggataaaaattaagtgkatatatttataaaattctcaataataaataaatacgcatatttatacaacttctcaatgataaataagcaatatatatcttttgttatttattattttagttttaactgttttagtttttttaaaatgtggtggctgaaaagaaaatggcttttttctctatatttttactgtaaccctctatttcttcgggtgttaagtgatggattacacaggatatagtctatcattctttctataaagattctgcagtcaaagagaaactatgagcatatttggcccactacaatttaattatgca

SEQ ID NO: 1006 - DNA, 601 bp, Human
gtcttggtttgggagcctcgagggatgggatgacctccaacctttaacctaccatgaagttccggcttctatctggaacttcagagaccagtgcttctaggggactatacttttgattttcattgctcccaagaaatatgtattccttcttccctgggttatatttaaatggctaagaaaataatcttatcctgtttgatactatgggaaaataaaacaaaacaaaactcatgactttttttttttaaatttagatcaccaagtcttagactgttgagactttgagctaaaacaaataggwtttgtaatcatttttttaaatgacctccctccagcctccaacccctccctttgtttttgatttaaaaaatgttagctaggtaaaaattctttattaatgagcaggcagaaaggacaccccaacttgagcttaatgtttctccaaggctgtagaaatgacttgtgaatgaaaatcattaccagtgatgaagacatactgaaataaatgtatttttaaaaatattcactgaattaattgtaatatcgtctgggtctagagaggcaaatgcctctgaaaaatgatgcatgacactgaagagaa

SEQ ID NO: 1007 - DNA, 601 bp, Human
tcaccagcatttaataaacacagagtgaaaaaacccttcttgtaggggactttcttcctgacccaacatgaaaagccctttggacatgttattctcaaatgttccatgctggaaaagggtggtcattcaaccccatgggggcggtagagagaaatcttgctgtgtgatccttcagaattgcagctggtgtcaggtgaagccaactagagtagaatcccaacagggttctaattgtttcgtttctaagcgtttgatcatcaacgtagtattattttagtcccatgaatgggactatgttccygaaaatacaattttaaaaacccactaataggaagttaggaatttacagagtaggtccttggtggaatttgctgtcttggccagaatttgctcctgtgacatgcattggtgggtgacaccacagattcattttagttcattttaatagataacaaattatctgaatacctttcttgccatatgtacctactgattaaacttaatccaaatgccctccctgcctcccaggacaccagacatcagggctcattgaaaataattcagctgacaattttaagattaatgacttggcttgcctttt

SEQ ID NO: 1008 - DNA, 601 bp, Human
tgaagccatggaaataaatacaaggcaacactattcctgcatctactctgccacctacagacacatacccagatgtgttgatgccaagcaggtggcttacacagcatttatctcttgttcaggtggtatctgaaatgttggaaatgttgatgtgtgctctgtggttgtgctgctgttgctgtttgttttgctttttgtcttttgtttttggacattatgaacatatgtcaagtttaactggagaatttggacattgcctgtgcattttggccatgcccaccatgcatttaggaagtcagarggcctatgttactcttctaaaatgctttaaattttaaccacctatctatatagttaataagagattagctgctattagtcacctgtaaaatgtccccatgatatatataccagaacaccagaaagtgctaaactttcttccttaaagcctaggattataatatggtttcagtatgaatatccattgaatgtttatgcatgttcctgtgtgtgcccatcgatatatcaacacctgaggaaataaacataatatccacagtctactgattctttatattatcatattaaagagagatggagg

SEQ ID NO: 1009 - DNA, 601 bp, Human
aaaatgttaaacaagaactgcatttagcattaatagcctggaagttggaataatgcctagttacctttgtcaacacgaagcatacgctatgtacctggaaaacttagaaacaacaacttttagcttactctttcatgtgttaagaggttggggagaaaaacagcactttcctccagcttcctgcttacctctgcaaaaacaaaaggtgcatcaaattggaagcagacatggccgtgcttgatggcttgaaccgaggcggggccacaccgatacatgcctgcattgcacagaggaagggcgrtgtgagtttgtcatctccaattctgtccagatactgcaagattcatggcactgagggtgactctgtaaagaccagtgttcccaacttcattgctgatttagcccagatgctttccaaggctgaagagaattccattggctatgccccctcaagccaaaaattgaagccatggaaataaatacaaggcaacactattcctgcatctactctgccacctacagacacatacccagatgtgttgatgccaagcaggtggcttacacagcatttatctcttgttcaggtggtatctgaaatgtt

SEQ ID NO: 1010 - DNA, 601 bp, Human
aaaaatgttaaacaagaactgcatttagcattaatagcctggaagttggaataatgcctagttacctttgtcaacacgaagcatacgctatgtacctggaaaacttagaaacaacaacttttagcttactctttcatgtgttaagaggttggggagaaaaacagcactttcctccagcttcctgcttacctctgcaaaaacaaaaggtgcatcaaattggaagcagacatggccgtgcttgatggcttgaaccgaggcggggccacaccgatacatgcctgcattgcacagaggaagggcrgtgtgagtttgtcatctccaattctgtccagatactgcaagattcatggcactgagggtgactctgtaaagaccagtgttcccaacttcattgctgatttagcccagatgctttccaaggctgaagagaattccattggctatgccccctcaagccaaaaattgaagccatggaaataaatacaaggcaacactattcctgcatctactctgccacctacagacacatacccagatgtgttgatgccaagcaggtggcttacacagcatttatctcttgttcaggtggtatctgaaatgt

SEQ ID NO: 1011 - DNA, 601 bp, Human
gggcagctttgtcttcagtcactgggcattctgagcctgcaggatccccctaaacataccgggctgctgcacgccctgtaactttggtcatgttcacactgtctggaaacccctgtccagcttctttaaccgaggtccacgacttctcttctcaagtctttttctgaatcagttggactaaatgcccctacttattgtttccaaagacccctctgcacaataatcctgtcactcggaccaggacaggaactgagtcctgctcactgctggaatcgccagcaccaaaccaattgcaggcatrgagcggacactaagcattgattgagatagaattaaactcagtagtgccatttgaaacattctatgcaataaaagttaacaaaaacccaccatgacattattttggaattgaaactggccttcgacctaattgtcctgagttagagagattgcattgtcctattaatattgtattatctacgttgtagtcttccatgataatgtaatagaacaatgtatgtggaaataattggtaaagtactaaacaaatgtgaagtagttattttaatttctattattggactaaaattacattagttat

SEQ ID NO: 1012 - DNA, 601 bp, Human
ctaacttttctatgaacttgcttttttgtttctccaaacctttttttgcttataactctacagtaagagggcattgcttgtttgttttgttttatttgcacttatattgttttaaattttcctttaaggaaaaatccaaatgacaaaaaaataccacctttgtatctgtgttgtgcaatggatgataaccaacagaagaggaaaatgaagcatttaaaaaatacagtgaaaattcactagttcagataacaaaaattctgactttctgagactatgcacaagtgttctcaattcagcaagyttcttctttgtagtgcaaattacttttgtaaataagagcagggagactgtctaaactatttaaaataaattctgcactccttagcacttcatggattccaatgaatatttaggtatatgctaattacttgtcatttttatccatttactaaaaataaatactcctaagaacctctggcagtgaatcatttgcaaaatatgttgcatgttccccatcaggacactcacggtcctccagttctggccactgctggcctcgggcagctttgtcttcagtcactgggcattctgagcctgcagg

SEQ ID NO: 1013 - DNA, 601 bp, Human
tctttccatgatttaattcattaaaatagttaagtcctaaatctagtaataatttgtttcctgtgattctactcatttccatattttggtatctacactcagcatttgtggatcagagaaattataagagattcaacggtgagaatcagggtggtaagtactgagccacggatatgacgagtcctcactgcatgccagtggccaatggcggccatcaatccttctacccgccacattcagatgcagtcttggtgttcttctcaaaacaacattctacttggtcacttccaaagttccagtytgaaatgtgtatgccacccttgattaagaaactatccacttggggtcaaactccagccccgaagcaggatgagtcgtcgcttacaaccatctatgtggatttagggattcttctagttggaccagacctccacactgtccctctccctcagccttgcctccttgctaaactctagaggcctggacctcagatgtcttcctcatgcagtgcggacacattttgttttaatttgttatccacccccagccaagcccctgactcctgtttcgtggactgggttttagtctttcctctcgtggc

SEQ ID NO: 1014 - DNA, 601 bp, Human
actgctggcaggtccctggcctctgcatacaatacctgtgggggcatgctcaggaggtgcagtgaccaggtgccgaaaagccacttagcaagaggctttgtgagttaggactggatgccctggaggccacagggagaggggggggggggtggggcttttaagcagtgctgggagaggctcaggtttacatttcagatattactttggcagcaaggcaggggctagactgagggaaggagggcctgaggaggtgaggtggaattgggaagctagagcaagtatttttccaggagaaaactawtcatagcccaaactaatagcagtagtatggcaggaataacagaattactagtaataggggaaacttttattggacacttattatgtgtcaggcactatattaagagttgtacacaccagataatatttaatttttaggctacagagctggaggggaggggatgcattcgagaacaatttcagaggggacatttagaggatttgttgcttaactcattcttaagtagctaaatttgagtggatggtggttctcttcaccagagtagggggagtgggagaaacggacctgaggtgagggaga

SEQ ID NO: 1015 - DNA, 601 bp, Human
cagaaggcattgcatacgaatgtgaatgtgtagtgtgtgtgtgtattaacgatttccctgattgtcaagactgcaagaatgtgccaggaacagttggtctaggacaagcatcagctagagcactcggagggaggtaagaaaaagggaaggaggagtgaggacaagggaagtgcagtgaaatcttttagcagaaatcatctggccaatagatccatgagaagagaacattaatgatgatcactttggatgcgggccagagatgcattgaggcaaaatgcaggagggaaattcgagcatcagkaacacatcagagaggagctgagctggccaaggtgaggtgaatgggagaagaagccttgaagccagccacaagcaacttcacagcctgccatgggtgcaggaacctggagcttccttctggggaagcactgtcctctgtgagcggagaccgccaaacagaagcaggctggggctgttccaggaagcgcaggcccagagaggagaaaacaactgcacggctttcccagagcctggcagagtaattcctgtttctctacagttatgctgcgtgctctggcatcttacataattcagggccaca

SEQ ID NO: 1016 - DNA, 601 bp, Human
aagacagaaaaaatgccagaaggcattgcatacgaatgtgaatgtgtagtgtgtgtgtgtattaacgatttccctgattgtcaagactgcaagaatgtgccaggaacagttggtctaggacaagcatcagctagagcactcggagggaggtaagaaaaagggaaggaggagtgaggacaagggaagtgcagtgaaatcttttagcagaaatcatctggccaatagatccatgagaagagaacattaatgatgatcactttggatgcgggccagagatgcattgaggcaaaatgcaggaggsaaattcgagcatcaggaacacatcagagaggagctgagctggccaaggtgaggtgaatgggagaagaagccttgaagccagccacaagcaacttcacagcctgccatgggtgcaggaacctggagcttccttctggggaagcactgtcctctgtgagcggagaccgccaaacagaagcaggctggggctgttccaggaagcgcaggcccagagaggagaaaacaactgcacggctttcccagagcctggcagagtaattcctgtttctctacagttatgctgcgtgctctggcatcttac

SEQ ID NO: 1017 - DNA, 601 bp, Human
cccccaacacccatgccatggcagaaggttctaccaaaacttgcatcccccagtccccaaggatgctgggctctggcaagacattaaaaaggcgaccctgcccaaggtgctccggtcagatcccttggagatgccctagttgtccagcgcctcctggagatgttctccaccttaattagcaaattagaggttctaagtgaagcccagcagcaaggacacctctttgcctttctttacacaaggtttcccaaactcatctgacacggagggcagttttttgagggacatctgttgacaggcrgtggtgcacctaagttctaatgcagttcgaggtgtgtgtgctgcttttaggaaaatgttttgtgcagggtttgcaaagtggttgtggtggagatgaagggaggaaaaagaggagggtaacctccagaagaagaaaaacatagctttgtctaagtgatgaggcagaaaatacagatacaagtcaggcctcagaaggagcttatgcctcagacactgggaaggtgggagaacggtccttacagagccttggacaaaaggctttggcttggaaacagggctcatgcagatgtgagggatggtc

SEQ ID NO: 1018 - DNA, 601 bp, Human
ggtgggaggtaaaattggcaatgtctatcttttcttaaactgtggtgtcagtttgcttgcttttcttagtcccagccatgtggctagaatttggggacctctaataattggaaataattgcctcttgccattccacctcctgcaatgtaacttttctctctgatttgtgaatacctgccccccaataagacctgtcttcctcatctctccttccacttgggcctgtcccacttgctgtttgctgagctgacccttgagggctcctgccccgttcttccctatctcactcaattgccattgyccccaacacccatgccatggcagaaggttctaccaaaacttgcatcccccagtccccaaggatgctgggctctggcaagacattaaaaaggcgaccctgcccaaggtgctccggtcagatcccttggagatgccctagttgtccagcgcctcctggagatgttctccaccttaattagcaaattagaggttctaagtgaagcccagcagcaaggacacctctttgcctttctttacacaaggtttcccaaactcatctgacacggagggcagttttttgagggacatctgttgacaggcg

SEQ ID NO: 1019 - DNA, 601 bp, Human
gtgaccagcctaggctgcaagttaggaggtgacagtgttgggatctatccagaaaggggtttctccggggccactatttcagggggtgggaggtaaaattggcaatgtctatcttttcttaaactgtggtgtcagtttgcttgcttttcttagtcccagccatgtggctagaatttggggacctctaataattggaaataattgcctcttgccattccacctcctgcaatgtaacttttctctctgatttgtgaatacctgccccccaataagacctgtcttcctcatctctccttccacytgggcctgtcccacttgctgtttgctgagctgacccttgagggctcctgccccgttcttccctatctcactcaattgccattgcccccaacacccatgccatggcagaaggttctaccaaaacttgcatcccccagtccccaaggatgctgggctctggcaagacattaaaaaggcgaccctgcccaaggtgctccggtcagatcccttggagatgccctagttgtccagcgcctcctggagatgttctccaccttaattagcaaattagaggttctaagtgaagcccagcagcaaggac

SEQ ID NO: 1020 - DNA, 601 bp, Human
aaggttgcagtgaaccaagatcatcgcattgcactccagcctgggtgtcagagcgagattccatctcaaaaaataaaaataaaaaaaaagaaagtggaggcttttgcagaatgagtgggttctccctgtgaggctcacacttctgagatcttggagggaactttaactttgatataaagctataacgggcattaacacctagcaagacaggggccagacagcgagtctcacaaagaaccacaccattgttagcttacaggacaagggctccagcgtcacgtcgaacgtctccttcttgaaytctgccttcgggaccccggtgtagaaggtgatgttggctgagagataagctgtgatggtgtaacggttgtggctgttgttccggaaggtgatggagagcttgaagtcttttcccagcacagcattttccacttcaaagtccatgtcaacgttggaccttgatttcatgacaccttctgtgttgaggggctttttagctccgtacatcagggcagtttctagggccaatctctcttcttcttgacctgggggagatccagagataatgacaggcaaaaatacaatccaccagagagaaagt

SEQ ID NO: 1021 - DNA, 601 bp, Human
gggtgtggggtgggacatgagattctacatttttttcaaactcctggggaatgctgatgcagctggctcatggaccacactttgagtagcaagaagttacatttaattctcacaactcatggggctctaggctttgaaattttcaatgttcacttctgtgcatgagacgtgaggatgaaagtggaggcttttgggccgagtgcggtggctgacgcctataattccagcactttggcaggccgaggtgggtggatcacctgaggtcaggagtttgagatcagcctggccaacatagtgaaaycccgtctctactaaaaatacaaaaatttgcctggcgtggtggcatgtgcctgtaatcccagctactcgggaggctgaggcaggaggattgcttgaacccaggaggcaaaggttgcagtgaaccaagatcatcgcattgcactccagcctgggtgtcagagcgagattccatctcaaaaaataaaaataaaaaaaaagaaagtggaggcttttgcagaatgagtgggttctccctgtgaggctcacacttctgagatcttggagggaactttaactttgatataaagctataacgggcatt

SEQ ID NO: 1022 - DNA, 601 bp, Human
tcaagaaccccggggtgtgtgtgctgtttttcccctttgcagatgaggagagacagctcagagtgcttaagtaccttgctcaggaaacacagctggtaggtgacacagtcatcgcttacatccagaattgtctatttgcaaaactctctgaaatcaaatgtggctgcctgttttaaacaatccccatgactgttgtcctcttcagtcctttacactgactattcttttccatgaaaattacctttactaccctaggaataggaaaagtgccaaagcttttagtttccaaagaaaacactayagtgtttttttttttttgagatgaagtcttgctctgtcccccaggctggagtgcagtggcacgatcttggctcactgcaacctccacctcctgagttcaggtgattctcctgtcttagcctcccaagtagctgggattacaggcacctgccacaacgcctggctaattttttgtatttttagtagagatgagctttcaccatgttggccaggctggtctcgagctcctgacctcagttgatccacccgcctcagcctcccaaactgctgggattacaggcatgagccaccatgcctggcc

SEQ ID NO: 1023 - DNA, 601 bp, Human
cacttctgaccttcactcaggtctctgttaaatgtcaccccattagagagggttttttttctgaccatctccacaggtactccccgttttccttaacctgctttgtatttttctattacccatataactatactatagattcacttgtttgtttggttcccccatgagatcagaaattcagtaagaataggcattgctgtgtctccagcataaaacagaacctggacttgcaagcactaaataaaggttaggggaatgaatcaagaaccccggggtgtgtgtgctgtttttcccctttgcrgatgaggagagacagctcagagtgcttaagtaccttgctcaggaaacacagctggtaggtgacacagtcatcgcttacatccagaattgtctatttgcaaaactctctgaaatcaaatgtggctgcctgttttaaacaatccccatgactgttgtcctcttcagtcctttacactgactattcttttccatgaaaattacctttactaccctaggaataggaaaagtgccaaagcttttagtttccaaagaaaacactatagtgtttttttttttttgagatgaagtcttgctctgtccc

SEQ ID NO: 1024 - DNA, 601 bp, Human
agcactgcccccttgccacctttgttcctgattctggctccttcctgctcattgaacacatcagacatgctctggccccagggcctttgcacatacagtttcttctggctggaatgctcacttctgaccttcactcaggtctctgttaaatgtcaccccattagagagggttttttttctgaccatctccacaggtactccccgttttccttaacctgctttgtatttttctattacccatataactatactatagattcacttgtttgtttggttcccccatgagatcagaaattcagtmagaataggcattgctgtgtctccagcataaaacagaacctggacttgcaagcactaaataaaggttaggggaatgaatcaagaaccccggggtgtgtgtgctgtttttcccctttgcagatgaggagagacagctcagagtgcttaagtaccttgctcaggaaacacagctggtaggtgacacagtcatcgcttacatccagaattgtctatttgcaaaactctctgaaatcaaatgtggctgcctgttttaaacaatccccatgactgttgtcctcttcagtcctttacactgactatt

SEQ ID NO: 1025 - DNA, 601 bp, Human
ggctggcatttggttctttgtctaaggatctgtgctagactccaggtaatgggagcacaaggaagggacctggcccacttggggccaagtttaccctgaactggctcactgtcactgctattatctgtctactctattatctgctttgcctctcattgctgtgtgggggcttgaacacatcgactcatctctcgagcttcagtttccccaaatgtaaacatgttggaagttaccatttactaagattctaccatgtggcacacatttcacattcatcactcatttggcttcctccataccytccttctctcacaccacatatccagtctctcagccaatcaggcgggctccaccttcagcacatgcccagatcggactggttctcgctgcttccatcactgctatcaacccctttcagtggagtgattgcagaagcatcctaccagtctctaaccttccgccctacttcctctttagtctcttctcaacacagcagccagtggtcttttcaaaacctaagttagattatgccacatttctgctcaaaactctctaaaggctcctcagctcactcaaaataaaaaccaaaggccttataaag

SEQ ID NO: 1026 - DNA, 601 bp, Human
gtttggtcagctgtccctaggtcgatgactgagagaatgatatcattctactcacccatacaagctcattctttaattggattaaagagggaaggggaaggagattatgagacaggacacttgtgaggtgggaaaagggctggcatttggttctttgtctaaggatctgtgctagactccaggtaatgggagcacaaggaagggacctggcccacttggggccaagtttaccctgaactggctcactgtcactgctattatctgtctactctattatctgctttgcctctcattgctgtgkgggggcttgaacacatcgactcatctctcgagcttcagtttccccaaatgtaaacatgttggaagttaccatttactaagattctaccatgtggcacacatttcacattcatcactcatttggcttcctccataccttccttctctcacaccacatatccagtctctcagccaatcaggcgggctccaccttcagcacatgcccagatcggactggttctcgctgcttccatcactgctatcaacccctttcagtggagtgattgcagaagcatcctaccagtctctaaccttccgccct

SEQ ID NO: 1027 - DNA, 601 bp, Human
tttaaagctatgaccttgccttgaccttggcccccaggtcctgccttttggaatgacccgctctcgtattgctgtctttggacctaagcctggaccctgcttcctccatggctccccttgcaattaattgtttagatgagtgaggttctggccctctattggttacagcctcagatgagcacaaatggtcagtttatcgtgtctctagatagaatggatgaagtggcaaggtggaaggcctcgaagaagatgccttttgcctctagctgtttccagtaataacaataataaaatgacttcytctgactatttctagaggactatgtttgaccactggatttcttttggctaatgggatatgatttctttacagaggctcttgctacctttataatctcagtatcaggacccctttcttctctgaggtagaacactccctaaatcatagcactaaagaaaccaggctgtgcttcagagcccaagagaacagtgcttctgaaatagtatgttatgtaagtgctgtgttttgccactgcacaagaaattgttctagataaagtttattaaacgtggcaggagaaggaggaataggttttcgctc

SEQ ID NO: 1028 - DNA, 601 bp, Human
tgacttcttactgcaccagtgaagtcaggatctgcatttgaataagaccccagacaatgcctattgaagtgtgagatactctgagagacaggaggttctaacagcagaaggggtaagttagggcagagttagggtggactgagaactacctgggttttaaattgaaaggcctgcatcctgagaaccccatcaatccctggaaaactagaaaggttggtcatcctagactagtagttgtcaataggaggcaatgttatccccaggggacatttggcaatgtctggagaactttttgattgtyacaactggggtggagggtgggttactactggaatctggtggataggggccaaaaatgcagttaaacatcctacaatgcacaggatagtcccacaacaaagtatccagcccataatgtcaatggtgctgaaaccaagaaaccccgcatagggcaggtggattattagaatgtattggcctattttgggcaagcgctaaagagctagctttgttggcttgattcctggggcagagctattccatttagagctgactctttaaagctatgaccttgccttgaccttggcccccaggtcctgcc

SEQ ID NO: 1029 - DNA, 601 bp, Human
ctctgacttcttactgcaccagtgaagtcaggatctgcatttgaataagaccccagacaatgcctattgaagtgtgagatactctgagagacaggaggttctaacagcagaaggggtaagttagggcagagttagggtggactgagaactacctgggttttaaattgaaaggcctgcatcctgagaaccccatcaatccctggaaaactagaaaggttggtcatcctagactagtagttgtcaataggaggcaatgttatccccaggggacatttggcaatgtctggagaactttttgatkgtcacaactggggtggagggtgggttactactggaatctggtggataggggccaaaaatgcagttaaacatcctacaatgcacaggatagtcccacaacaaagtatccagcccataatgtcaatggtgctgaaaccaagaaaccccgcatagggcaggtggattattagaatgtattggcctattttgggcaagcgctaaagagctagctttgttggcttgattcctggggcagagctattccatttagagctgactctttaaagctatgaccttgccttgaccttggcccccaggtcct

SEQ ID NO: 1030 - DNA, 601 bp, Human
gaaggaaacagcttcatggccaacagtttgagcacagagggtaattcattttagcctgctgtactgaacagcagttttgcagcagggtggggtgcctgtggatgggcatgcaccagagcagagggcagggcccctgactccccactggctcgaaggtgtgggtgcattgagccatgcccatcatctgtggaggaactctcacacctgcgatggatctgcagcagcttgctctggaccttgaagaccaagaggctgggaaagcctctgtcttgggcagcacttctatttggaagtctctttrcagatgcgtaagtgctgtgccttgcttccaggacttctgattgaagagttctcagtcatggctctatatcacaatcacctggggacccttaaagacctaccaagctggctctcattccaggccaattaaatcagagccttggaggacctagacatctgtatttttaacagctctgcagctgactctgatgtgcagccagggttgagaagggccactccaacaaccaggggcatccctgtagaatcagccctgcagacagcctgggttccagtggaagggatggctttccagtccaggtct

SEQ ID NO: 1031 - DNA, 601 bp, Human
ccatttcccactgtccaggattctagagagcaatgggcagtttttctgtaggctgagcccaggtgtgcacccactgctacctggttggagccagatgcctgtatgtgccgacagctggcagactccgcaggtgaatgggtgactcattcctccatccccagccacagagaacagactctatgaaccttcacagaactgaatgtctttactgctttccttctcagtttctggcttttgccaaagacttccccttcctgtggaagttattgaaggaaacagcttcatggccaacagtttgagyacagagggtaattcattttagcctgctgtactgaacagcagttttgcagcagggtggggtgcctgtggatgggcatgcaccagagcagagggcagggcccctgactccccactggctcgaaggtgtgggtgcattgagccatgcccatcatctgtggaggaactctcacacctgcgatggatctgcagcagcttgctctggaccttgaagaccaagaggctgggaaagcctctgtcttgggcagcacttctatttggaagtctctttacagatgcgtaagtgctgtgccttgcttccagg

SEQ ID NO: 1032 - DNA, 601 bp, Human
gacagggtctgctttacttttctccaagtttccctacccctcccacattagcctggaagccaccaggaacacagcaaaggtaaggggcaagtggaacaaagagtcaattggggataagctgtcctgcttcttaggtaaagaatgtgctggaaatttaatattcattgaagtctcactggagaaaatgtgtcaaaccttccaaacagttcttttgctgttgtaaaagaaatgccatggaaaagatgtgattttcatggcaaagaaggaccaatgggttttaatggtggctttgatttgggcygggatcatcccaaaatggaacatgtggggtgctgaagtccaaggcccccattccacataggatcccttgtcaaataagaagtgtctcacctaggccatgggccacactcagactaaattgtcaactacctacacattttctctgtagcattccacattttctctccaatctgatatgatttttctatttaagagaaggaagctgttgaaaccagtttctaccaaaggcattcaactatctccgaacctctgtttgtgatttagaagacctctgtgccaaacaattgttttctcaatggaa

SEQ ID NO: 1033 - DNA, 601 bp, Human
aagagaccatacgtgagtaggtagtacagcaaagtggttcaaacttgggttctggaattcaccagcctgagtctgaatcttggctctgttttcataaactgtgtaactgaacctgtgtaaccagtcaacctctcaaagcctcaaattcctcagctacagaagggagataatagcagtatctacatcgtagggtgtctttaaggattaaatgatgaaagtgctggtcaaaccaaccctagttttactccacgccctacagaaatggtcggcaaggaggaggcagcttccaagacattttcaytggggagcagatctatgtttggaaaagacacacacagagaaagcttcccacagccctgcactgcctgcccggtctccccaacccaaggtttaccggaacatcttcttcattggtcttgttactccaggaccatccaggtgtacccagacatttcgcagggtttcttttaaaggattggtaaactgaattgtcacagtcatgtcagaaccaactacctgagtgccacggacctaagagagagaatgcaggtcattagcagcaaataaaacctcgttctgctctcttgttgtcttaaccatc

SEQ ID NO: 1034 - DNA, 601 bp, Human
gccagtgtgtgggcaggacatctgtgtccaagaagggactggccttatccatcctttctcccgattcactccactttgctccactccaatgtcagacattaacaataaacaaaccatctggagatttaacctattttgagcctgaggcctcccaaatagtgggtcattgcactgtgtaataattcactgtgtaataattcatcttttgtctaagacacacagtgtcttttttcatgtgttggccttgaccaaggtggaattctagggggatagccaaggtgtaaagatagagaagtttccrgtacactcagataaagcttgtgggtttactgtctgggaaggaaaaagttggatacagcagggggctgtatggaagaggaaacgtgtttcactttgcctgaacgattcttgcatctgatttgagtgggaaggtgcgagaatgggtgagtgagactgtcgtttctgacgaaagcaggggtatggctgctgacctctctatgtagctggggttgattactaatttacttatttttttttcctgtaactttcctgttagcacaggaaggttgctatgttttgtgcttgcgttgtttcaaaagca

SEQ ID NO: 1035 - DNA, 601 bp, Human
agtgaaaagacagccatctgcaagctgggaagggagccctcatcaggaaccgaattggtcggcaccttgtcctcagacttcccagactccagaagtgtgagatataaatgtttgttgtataagccacccagtctatggcatttctgttacagcagctcaaactgactaagagcagctagctctctgtctatctacttgtctgcctagacttacgtgttgcagtaactactaacagtaccttaagccagtgtgtgggcaggacatctgtgtccaagaagggactggccttatccatcctttytcccgattcactccactttgctccactccaatgtcagacattaacaataaacaaaccatctggagatttaacctattttgagcctgaggcctcccaaatagtgggtcattgcactgtgtaataattcactgtgtaataattcatcttttgtctaagacacacagtgtcttttttcatgtgttggccttgaccaaggtggaattctagggggatagccaaggtgtaaagatagagaagtttccggtacactcagataaagcttgtgggtttactgtctgggaaggaaaaagttggatacag

SEQ ID NO: 1036 - DNA, 601 bp, Human
attagtgcccttcgaagaagaggtgccagagaacttgccctccctctctctgccccatgtgaggacacagtgaaaagacagccatctgcaagctgggaagggagccctcatcaggaaccgaattggtcggcaccttgtcctcagacttcccagactccagaagtgtgagatataaatgtttgttgtataagccacccagtctatggcatttctgttacagcagctcaaactgactaagagcagctagctctctgtctatctacttgtctgcctagacttacgtgttgcagtaactactaayagtaccttaagccagtgtgtgggcaggacatctgtgtccaagaagggactggccttatccatcctttctcccgattcactccactttgctccactccaatgtcagacattaacaataaacaaaccatctggagatttaacctattttgagcctgaggcctcccaaatagtgggtcattgcactgtgtaataattcactgtgtaataattcatcttttgtctaagacacacagtgtcttttttcatgtgttggccttgaccaaggtggaattctagggggatagccaaggtgtaaagatag

SEQ ID NO: 1037 - DNA, 601 bp, Human
gtggttaccagagactgaggaggagaacatgaaggggaagatgggaagaggttggccaatgagaacaaagtgacaattaaataggaggaataagttctggtgttctattgcatgataaggtaactatgattaacagtaggtattgtatattacaaaagagctagaagacaggcttttgaatgttctcaccacaaagaaatgataaatgcatggggtgatggatacactaaatactccgatttgatcattatacaacatatatatgtatcgaaacatcaaattgccccacataaatatgtasaattacaatgtgtcagtaaaaaaaacttaaaaagagagattgaggactgttacggactaaatgtttgtggtcctcacacattcatttgttgaaacccaaactccagtgtgataccatttagcgatggagctttggggaggtaactaaattagaataggtcatgagggtggggctcatgatgggattagtgcccttcgaagaagaggtgccagagaacttgccctccctctctctgccccatgtgaggacacagtgaaaagacagccatctgcaagctgggaagggagccctcatcaggaa

SEQ ID NO: 1038 - DNA, 601 bp, Human
atagaagctaagtatttagccccctcttatcattttctcttactcataaaaccatccggcataatgatgtgtacatacgaaaaaactcatacatgaaaatactcatacatgaagatacgtatgcatgctattttacatacagataaattcataacagagaaaaaagtattttgataagtggagcaatgttggagtaatcctattttctggggatggatgttgtgataaacgattctcagtaacgtgctgagccatcaggagataccggccatttatcatcttgaatgcacgcaggcaaatragattattattacaataaactgcaactgcccatggtttgtcctctgtgcgtctagaccttagcttctgtcctatttgagaaacttaaagtttaagcccaaatcacaaagtgggggagtttttctcttgaaataacatattgaactggatcattttctaaagagcaaaataaatctggaagataaattatttgacgctctggaagcatcaagtgcagaaagttaagagtctgtggaggtggaacctctgcacatctgagacaggccggaggcagtgggggaagagcaggaagataaaccat

SEQ ID NO: 1039 - DNA, 601 bp, Human
aacctgtcactgacagtcttattgggtcatggttccttccactgggatgcatccgccagcctcccagtggccatcaggagctgggctgattcccatccaaccattaatcaactgaactctagcttgtctccaagccctccatagtagccttatctatgtgactgatcttctgagcctcagctcagtttttgccactagtttcctcctggaattacagtcctatatgaatcccccagctgcctttgctgaggccctgacactcgaattagcttttgccaactcccttgggatagaccttgtkcccaggctcagcatctggaatatagccctgcctgctgccatttgactttgagaatcttcatgttctgtaattcaaattcctatttcaaccaccaaattgggcccctccacctatgcaactttctgctaccatttgttgccaatgccctaatgtatgcggctaatgacatagcctttcatggttctagtgttctcctcttcctcccagcctttgccctgaagtcttcctgagtgtcacgaacaagcccacatcagtgcagactgagactaatcagggttggtgagatttagtgttctctgg

SEQ ID NO: 1040 - DNA, 601 bp, Human
cttaggacactgaagactctcactggctgattcagcaagttatgccccaaatgaggcccccacataaagctctgcagaacctgtcactgacagtcttattgggtcatggttccttccactgggatgcatccgccagcctcccagtggccatcaggagctgggctgattcccatccaaccattaatcaactgaactctagcttgtctccaagccctccatagtagccttatctatgtgactgatcttctgagcctcagctcagtttttgccactagtttcctcctggaattacagtcctatrtgaatcccccagctgcctttgctgaggccctgacactcgaattagcttttgccaactcccttgggatagaccttgttcccaggctcagcatctggaatatagccctgcctgctgccatttgactttgagaatcttcatgttctgtaattcaaattcctatttcaaccaccaaattgggcccctccacctatgcaactttctgctaccatttgttgccaatgccctaatgtatgcggctaatgacatagcctttcatggttctagtgttctcctcttcctcccagcctttgccctgaagtc

SEQ ID NO: 1041 - DNA, 601 bp, Human
attctagagcccaaatcatgtgctattattcccaaaaggctgagtggggaatctgaagtcttgttttaaatgaggccaggtattgagcaaatctccctggtaagagagcccactgatatttggagatgtagccatttgtgatgataaatgatgactgttactcttatgagctatgagagcttaattaaagctaatgcttagcactctttggaaggtggagagattaaaaactaacttccttgccgaatagcctgggtttggaaaagcatgtttttgaaatatgtgggatctccactctggrgccctctgcagtcctgtctgggtcttcacacctaagtcaaagcaagagctatttttgcgttagaatttccttagccaagactacaagaggccaaatgccagggttcatctcagcttcctgtgcattcacatggaaggtcgtctttgaatctgcacgtccagctcgccatacacatgtctcagggagtcactgctcatgctggctatcagcttccgatgcccagagacccagggccggcacacttcttcccactgcacggtggagttgggccggatttcactgaaaggatggaaaagagag

SEQ ID NO: 1042 - DNA, 601 bp, Human
tagatacattttacctttaaaaggcattgtcctgctaatattatatgaaataagtagatagatgtctgctttgtgctaaaatacactttgccaaaagatggagttggctatgttgatattcacctagtgagtatcatagctctaggggcaggacaagttagaacaagttcttagtttaagcagccagatatatggattagatttttcataagaaaatgctagagagaaatgatatgatttagggttaaacaatatgacagtttgtctgggttgtgtttctatggttttgactcaacaattsctaccagaggaacgaatctccagaactttggaaacttacccacaggatgaggggacagaatgaccagtcatggttccctgtgtactcaccatgtgaatcagacctttgccctatctggttctgcctccggtattttgcttgttattttcaacgctaactacagacaagagaaaaaactcccaagcatgaacccagcatgctacaagaaagccaacaaccaagtctgcattctactcatgagcaggcaagattagtgttagaaggactgttattttccttggggttttagcttacggcagt

SEQ ID NO: 1043 - DNA, 601 bp, Human
gaagagtatatagatacgttagctcagttggtaaaagcatcatgccccaagtttaatgctgtcatcttatttgtatatgaaagggggcattagataattgggtggaagtatcagcattaatccattctcactatgagaaaaacatgctgctgatggtaaaatgcaagaagagtcttttgtaagttttaaggtttttttcagtaccatcacagtatcttatatataccaggaaatggaaaaaaagtctttgtataatgagtaaatacattgggcatgtatgtaggtatggcctgagcgtgtrtgtataggcagatggtgagtccatcacgttatttcccatgctgtggctcactgtggttgtttgttttaatgaaagatgggctggattctcatgggataaaatgaaaatccaagcttgctcctaagaagcccagccaataaaagttcttgtaaagtcacttgagtgtgtttgaaacctaccacccaaagttttcaacttgtttgtaagaaaggaagctggcatttcacgtgtttatagagcaaattaccagcccaaacctcagatatgtcaaacatgttagccaaagttctttccaagagc

SEQ ID NO: 1044 - DNA, 601 bp, Human
cagtctcaatagaagagtatatagatacgttagctcagttggtaaaagcatcatgccccaagtttaatgctgtcatcttatttgtatatgaaagggggcattagataattgggtggaagtatcagcattaatccattctcactatgagaaaaacatgctgctgatggtaaaatgcaagaagagtcttttgtaagttttaaggtttttttcagtaccatcacagtatcttatatataccaggaaatggaaaaaaagtctttgtataatgagtaaatacattgggcatgtatgtaggtatggyctgagcgtgtatgtataggcagatggtgagtccatcacgttatttcccatgctgtggctcactgtggttgtttgttttaatgaaagatgggctggattctcatgggataaaatgaaaatccaagcttgctcctaagaagcccagccaataaaagttcttgtaaagtcacttgagtgtgtttgaaacctaccacccaaagttttcaacttgtttgtaagaaaggaagctggcatttcacgtgtttatagagcaaattaccagcccaaacctcagatatgtcaaacatgttagccaaagttc

SEQ ID NO: 1045 - DNA, 601 bp, Human
ctttgataccttcttgctttggggaacaggctttatttcatccagcttgggaagaaaacatttggtgactctcaagactctgtacaagtatccatttcccccagtctcaatagaagagtatatagatacgttagctcagttggtaaaagcatcatgccccaagtttaatgctgtcatcttatttgtatatgaaagggggcattagataattgggtggaagtatcagcattaatccattctcactatgagaaaaacatgctgctgatggtaaaatgcaagaagagtcttttgtaagttttamggtttttttcagtaccatcacagtatcttatatataccaggaaatggaaaaaaagtctttgtataatgagtaaatacattgggcatgtatgtaggtatggcctgagcgtgtatgtataggcagatggtgagtccatcacgttatttcccatgctgtggctcactgtggttgtttgttttaatgaaagatgggctggattctcatgggataaaatgaaaatccaagcttgctcctaagaagcccagccaataaaagttcttgtaaagtcacttgagtgtgtttgaaacctaccacccaaag

SEQ ID NO: 1046 - DNA, 601 bp, Human
tgttttagtaagtgaagctatttgtgattttcagatggcattagagaataacctctaagaagtttagtgttttgaaatatggtttatttagtaaagtggcattttaattttttaatgtttttccctcaggctagtatcatataccctggatctttagttgtaggtcagttctaccagagagaaatagaagagatgtggtctaagtgggaattagttattttttctcttaacgattgctatgattttgccttctcataagtgcccaaatgcaaatggaaagagaaaatattctagatgccaytgaatattactcttctgtcaccttttgaaatgctggttttttttgtgtgttgaggattactcctaatctgttcatctttactgcaatcttcctgctgatccttcctgctagggcttgtccttgaagaagccatggtcatcatatagaggaactgcagaactcggagagagtggctgagctgataccttaaggtcttattcaaagtacaggccaaggtgaaacctactcaggtcactatacctaacaaggctgcacatttcttctctagcttctaatttgtctcttctatttcctgtttaa

SEQ ID NO: 1047 - DNA, 601 bp, Human
atttgcagtttgtcttgtgctagcatctaggtcttttttgcatatgaagtaacccgaagaaagaatatctctatgtatgcatttgttttcttcctcttttcttctttcgaggaagttagagatctctttagcttttgcttaattaaaaaaaaaaaaaaaaaaaaaaaaaaaacctttgccaattccttcgctttctccatccccaaagagcaagttataaatctaagagcaaaatatctaagtttggttgttaggaactgaggaaagtttgtctgcggtgcaggtggcttgaaagggcaarggagaaagagggagttagtgcatgggaagaaaggattctgcattgagaagcaagactgtcaggagagtttcttgccttgcaaatgttttggggtgagagaagatatgatccactttccctctgggcccacagtcatatttgcggtagtggatgtagcactgacaagggtgatggctgagaccttatgatggttctgctccaggacctggccgttgaaatgaatggagaataattctggccccgagctcattcccagcagatgccagctgatgtggtcatgggcacaaactgttatatctg

SEQ ID NO: 1048 - DNA, 601 bp, Human
atgctaaacttttacactttctacaacttagtgcttctgtaaatttgcagtttgtcttgtgctagcatctaggtcttttttgcatatgaagtaacccgaagaaagaatatctctatgtatgcatttgttttcttcctcttttcttctttcgaggaagttagagatctctttagcttttgcttaattaaaaaaaaaaaaaaaaaaaaaaaaaaaacctttgccaattccttcgctttctccatccccaaagagcaagttataaatctaagagcaaaatatctaagtttggttgttaggaacygaggaaagtttgtctgcggtgcaggtggcttgaaagggcaagggagaaagagggagttagtgcatgggaagaaaggattctgcattgagaagcaagactgtcaggagagtttcttgccttgcaaatgttttggggtgagagaagatatgatccactttccctctgggcccacagtcatatttgcggtagtggatgtagcactgacaagggtgatggctgagaccttatgatggttctgctccaggacctggccgttgaaatgaatggagaataattctggccccgagctcattcccagca

SEQ ID NO: 1049 - DNA, 601 bp, Human
taccctccctgaattttctaggtagccatatattaatttcatgcgtgtaattccagaatacctttatgtcttacaaataagaaaatataaatattcttatccctttcactcctttaacaaaaggcagctatgtatacacgctatactacatcccagctttttaatttaataacatatcttggagaactttttgtattagtacatacagagtgtttgcatcctctttttttgatgcttagtattccattgtatgaatgtatcctaatttattaaactagttttctactgatggacattttgrgttgtttccagtcttactactactaacgttgcaacagtgaatatgttgtacatacatcatttcacctgtgaacaagtgtatctgtatagttagatttccagagtgagatagctgagtcaaagggtatatgcatttagaattttgatacatattgccaagttattcttcagaatccttttaccaatttaatcttccacgaacaatatatgatagttcttttttctcacagccttgtcaacagatgatgtcatctggacttgtgaatgtgatagataaaagtagtattcccatgaagtttaa

SEQ ID NO: 1050 - DNA, 601 bp, Human
taatcttggccaaattttttttgttctttttcctagtttaattgtttttaatagaaaatacattcacataatttttattacagtgaaaactctcacttttctctgatgactctcaaaatgacctccctaccctccctgaattttctaggtagccatatattaatttcatgcgtgtaattccagaatacctttatgtcttacaaataagaaaatataaatattcttatccctttcactcctttaacaaaaggcagctatgtatacacgctatactacatcccagctttttaatttaataacrtatcttggagaactttttgtattagtacatacagagtgtttgcatcctctttttttgatgcttagtattccattgtatgaatgtatcctaatttattaaactagttttctactgatggacattttgggttgtttccagtcttactactactaacgttgcaacagtgaatatgttgtacatacatcatttcacctgtgaacaagtgtatctgtatagttagatttccagagtgagatagctgagtcaaagggtatatgcatttagaattttgatacatattgccaagttattcttcagaat

SEQ ID NO: 1051 - DNA, 601 bp, Human
aaacactcctggattcctatctcagttctgtcaacaattctataatcttggccaaattttttttgttctttttcctagtttaattgtttttaatagaaaatacattcacataatttttattacagtgaaaactctcacttttctctgatgactctcaaaatgacctccctaccctccctgaattttctaggtagccatatattaatttcatgcgtgtaattccagaatacctttatgtcttacaaataagaaaatataaatattcttatccctttcactcctttaacaaaaggcagctatrtatacacgctatactacatcccagctttttaatttaataacatatcttggagaactttttgtattagtacatacagagtgtttgcatcctctttttttgatgcttagtattccattgtatgaatgtatcctaatttattaaactagttttctactgatggacattttgggttgtttccagtcttactactactaacgttgcaacagtgaatatgttgtacatacatcatttcacctgtgaacaagtgtatctgtatagttagatttccagagtgagatagctgagtcaaagggtatatgc

SEQ ID NO: 1052 - DNA, 601 bp, Human
atgcaaatcaaaaccacaatgaggccgggcgcggtggctcacgcctgtactctcagcactttgggaggccgaggcgggcaaatcacgaggtcaggagatcgagaccatcctggctaacacggtgaaaccccatctctactaaaaatacaaaaaattatattttttgtattttgtatttgtgttggcgggcccctgtagtctcagctactcgggaggctgaggcaggagaatggcgtgagcctgggaggcggagcttgcagtgagcagagattgcgccactgcactccagcctgggcgacasagcgagactccgtctcaaaaaaagaaagaaaaacgcaatgagatgccctctcatgccagtcagaatggcgatgattgaaaagtcaagaaagaagagatgctggcaaggtcatggagagaaaggaacacttatacactcttggtggaatgtaaattaattcagccattgtggaagacagtatggcagttcctccaagacctaaagtcagaaatatcatttaacccagcaatcttttaagatggaatatcattttatgaatttatttttcccagtggaaagcactgactgttgccaaacact

SEQ ID NO: 1053 - DNA, 601 bp, Human
agcaactacatgcggccaaaaagcacattttaaaaagctcaacatcagtgttcatgagagaaatgcaaatcaaaaccacaatgaggccgggcgcggtggctcacgcctgtactctcagcactttgggaggccgaggcgggcaaatcacgaggtcaggagatcgagaccatcctggctaacacggtgaaaccccatctctactaaaaatacaaaaaattatattttttgtattttgtatttgtgttggcgggcccctgtagtctcagctactcgggaggctgaggcaggagaatggcgtgarcctgggaggcggagcttgcagtgagcagagattgcgccactgcactccagcctgggcgacagagcgagactccgtctcaaaaaaagaaagaaaaacgcaatgagatgccctctcatgccagtcagaatggcgatgattgaaaagtcaagaaagaagagatgctggcaaggtcatggagagaaaggaacacttatacactcttggtggaatgtaaattaattcagccattgtggaagacagtatggcagttcctccaagacctaaagtcagaaatatcatttaacccagcaatcttttaag

SEQ ID NO: 1054 - DNA, 601 bp, Human
gatagcctttttggttttaaaggtatttcttaatccctaaaagcaacttccaaccccaggaaacatttactagcattgttaatcatagttctgtgctattgggctatctcttccaccatctagccaattctctgagctgactgaaaagcaacctccttcacccatcttttgtagctactgggataaatactttgggagcagaaacatgaaccacttttcccctgccctctttattaccttagtttgcaaaagcaactacatgcggccaaaaagcacattttaaaaagctcaacatcagtgwtcatgagagaaatgcaaatcaaaaccacaatgaggccgggcgcggtggctcacgcctgtactctcagcactttgggaggccgaggcgggcaaatcacgaggtcaggagatcgagaccatcctggctaacacggtgaaaccccatctctactaaaaatacaaaaaattatattttttgtattttgtatttgtgttggcgggcccctgtagtctcagctactcgggaggctgaggcaggagaatggcgtgagcctgggaggcggagcttgcagtgagcagagattgcgccactgcactccag

SEQ ID NO: 1055 - DNA, 601 bp, Human
atgcaacttttaatctattattttatgcaacttttaatctattatgctggttataagaattttatcaaggatgccatctactgtatcactcagcactctcttttgtagaactcattaaagaagttcctcttagatcttaacatcaggataaatggtgctttctttttgtagatgatgtaaacttcaccctgacatatttccttttttacactgactgccataaagcttaggacaaaatttgaagacagccttacagggtcacatggtatctacttatctgtggctttattttctttgtccscatattctatcccaattacatagactccttgttttatgcctttataacttgagaaactgtctcagatcctttgtattactgagtaagctgtaaataaatacaaatactaaataaaaactaaaagttgcatttgaatttaaaattatatgagcatctttttcttttaaaattaaaaaataaccaggtactccataatattttactatgtaatttctcccatgattctgtatttgtgttacttactttgagtgtgtctctgacctgggctctgataataggacccaaaatcccatcttcttt

SEQ ID NO: 1056 - DNA, 601 bp, Human
tttggatcatcctttgtctgtagattaactacactctaggattttgtcaaagattgcaacctttaattctctgctgtccaattcttatctatcttggtgaagtgacatgacatttaaggagaattgtctgaggaaaactccgtgctcttgatacatggagtttaccttcatcagagtccaaccattagagagctgcatacctagactacattaaaaaatgagtaaaaattgtttctattcaattgtgtttactgttatatcttagctataatgagaaatattttaatgcaacttttaatcyattattttatgcaacttttaatctattatgctggttataagaattttatcaaggatgccatctactgtatcactcagcactctcttttgtagaactcattaaagaagttcctcttagatcttaacatcaggataaatggtgctttctttttgtagatgatgtaaacttcaccctgacatatttccttttttacactgactgccataaagcttaggacaaaatttgaagacagccttacagggtcacatggtatctacttatctgtggctttattttctttgtccgcatattctatcccaa

SEQ ID NO: 1057 - DNA, 601 bp, Human
tttgaagtcatcttctcagctaggttcagtggctcaaacctgtaaccccagcactttgggaggctgaagcaggtggatcacttgagctcaggagttcaagaccagcctgggcaacatggtgaaacctcatctctacaaaaaaatacaaaaattagccaggcgttggggcgtgtgcctgtagtcccagctacttgagaggctgaggtgcgagaatcgcctgagcccaggaagtggaggttgcagtgagccatgatcacaccactgcactccagcctgggtgacagagtaagacccttggtgrgggggaaaagctacttgcttgagaggcacagacaaatagccagatcctgaacttttaataaggtatgtctacacttgctgagagcacataaaagggatcagaaatggaagaagggaaagaggcatggagaaaaaaaactgcttttgtcctttggctattttaaatgaacagaatagaccttgtcaggtgcataaaacacacaggagtcctagttaggctctttaatctgcaaaagagaaccttaatcctatcttctatttggttgattgtcaaagcctttggatcatcctttgtctgtag

SEQ ID NO: 1058 - DNA, 601 bp, Human
cagtatcactctctccaagcaagtcctccttcccctgcccttctcttttcagcttgggccacatctcattttgaatctgcttctcatctctagaccatgatccccttcccctgcccggtagattttttaggacactgtctttgaagtcatcttctcagctaggttcagtggctcaaacctgtaaccccagcactttgggaggctgaagcaggtggatcacttgagctcaggagttcaagaccagcctgggcaacatggtgaaacctcatctctacaaaaaaatacaaaaattagccaggcrttggggcgtgtgcctgtagtcccagctacttgagaggctgaggtgcgagaatcgcctgagcccaggaagtggaggttgcagtgagccatgatcacaccactgcactccagcctgggtgacagagtaagacccttggtgagggggaaaagctacttgcttgagaggcacagacaaatagccagatcctgaacttttaataaggtatgtctacacttgctgagagcacataaaagggatcagaaatggaagaagggaaagaggcatggagaaaaaaaactgcttttgtcctttggctatttt

SEQ ID NO: 1059 - DNA, 601 bp, Human
gagagagtgtttcactcacacattaaggtggaaaatggaaagagaagtctgactttagaggataggttaggagaagtgacgttttcctcacagtatcactctctccaagcaagtcctccttcccctgcccttctcttttcagcttgggccacatctcattttgaatctgcttctcatctctagaccatgatccccttcccctgcccggtagattttttaggacactgtctttgaagtcatcttctcagctaggttcagtggctcaaacctgtaaccccagcactttgggaggctgaagcasgtggatcacttgagctcaggagttcaagaccagcctgggcaacatggtgaaacctcatctctacaaaaaaatacaaaaattagccaggcgttggggcgtgtgcctgtagtcccagctacttgagaggctgaggtgcgagaatcgcctgagcccaggaagtggaggttgcagtgagccatgatcacaccactgcactccagcctgggtgacagagtaagacccttggtgagggggaaaagctacttgcttgagaggcacagacaaatagccagatcctgaacttttaataaggtatgtcta

SEQ ID NO: 1060 - DNA, 601 bp, Human
gagcattggagagagtgtttcactcacacattaaggtggaaaatggaaagagaagtctgactttagaggataggttaggagaagtgacgttttcctcacagtatcactctctccaagcaagtcctccttcccctgcccttctcttttcagcttgggccacatctcattttgaatctgcttctcatctctagaccatgatccccttcccctgcccggtagattttttaggacactgtctttgaagtcatcttctcagctaggttcagtggctcaaacctgtaaccccagcactttgggaggmtgaagcaggtggatcacttgagctcaggagttcaagaccagcctgggcaacatggtgaaacctcatctctacaaaaaaatacaaaaattagccaggcgttggggcgtgtgcctgtagtcccagctacttgagaggctgaggtgcgagaatcgcctgagcccaggaagtggaggttgcagtgagccatgatcacaccactgcactccagcctgggtgacagagtaagacccttggtgagggggaaaagctacttgcttgagaggcacagacaaatagccagatcctgaacttttaataagg

SEQ ID NO: 1061 - DNA, 601 bp, Human
cgggcaaggagaatagcagaaaaatgtggcagcctctcagaagttactagttggattcagtagaagtgaaagattcaaacctgaggtgaaagaagagttgacttcatcttcataaggcgagaaggtcactccatgagggtaaatgctataggggcggctggccatatttttgaacacgatctacaaagttaaatcaaatttattctaggatttaaggttgatcatgacaaataatataagatactagctttgcatattcaccttttggatggtgtgtgtgtatacatgtgtacacacagtrggaaaattagatctgtttatctgagcagtaacctcccctcatcacttggcaggagcattggagagagtgtttcactcacacattaaggtggaaaatggaaagagaagtctgactttagaggataggttaggagaagtgacgttttcctcacagtatcactctctccaagcaagtcctccttcccctgcccttctcttttcagcttgggccacatctcattttgaatctgcttctcatctctagaccatgatccccttcccctgcccggtagattttttaggacactgtctttgaagtcat

SEQ ID NO: 1062 - DNA, 601 bp, Human
aattcagtatctttgttcacattcttctgtatactttagtctcaacagagatgggccataatctgggtccaatttcactaggaactatgtctctaaatttggttgctttcagagaatctctcctctgtctccctattgcaggtctctaaaaatagcaaagactggtaaagagctttatacttttaccagatggtatctcactgaacccccaaacagacctgtaacatttttaggagggttattacccatttgataaaaggaagaaattaggaaaggctaatcaacttgctcaacacatccrataccaacagacctggaatttgaaactaagacaaaatatgttatcacactctagacttgccttcggcagtgatggtactgataaaaatagacaagacaaaaaaaaaaaagaataaatgttatcacactggtgctaaaaaggactacttgacaattactgttctcttgaaggaaatgccccattatttagccaggagacctaacatgttctagccagaagaaattctcagaatttctgaaaggttacttcaaggacaaaatacctgtattcctcgcctgtccagggatctgctcttacaga

SEQ ID NO: 1063 - DNA, 601 bp, Human
actaacagatgttggcaaggttgtggagaaaaaggaacacttatacactcttggtgggagtgtaaattagttcaaccattgtggaagataccatggtgagtcctcaaagacctaaagtcagaaatacctttgaacccagcaattccattacttggtatgtacccaaaggaatataaatcattctgttataaagacacatgcatgcgtatgttcattttcgcactcttcacaatagcaaagacatgaaatcaacccaaatgcccatcaatgacagactggatgaagaaaatatggtacatawacaccatagaatactatgtgaccatcaaaaagaacaagattatgtcctttgcagggacatggatggagctggaggccattattctaagcaagttaacgcaagaacagaaaaccacatactgcatgttttcacttacaagtgaaagctaaattatgagaacacatggacacatagaagggaacaatacatactggggcctatcagaggatggagggtggaaagagggagaggatcagaaaaaataactaatggatactaggcttaatacctgggtgatgaagtagtaagtacaacagacct

SEQ ID NO: 1064 - DNA, 601 bp, Human
tctcaaaaataacagaaacaaacaaacaaaaaacaacaacaacacacttaaacgtaaaaccccaaactacaaaaaccctggaagacaacctaggcaatattatttgggacatagggatgggcaaagctttcatgacgaacatgccaaaagcaatagcaacaaaagcaaaaattgtcaaatgggatttaattgaaataaagagctcctgcacagcaaaagaaactatcaagagagtaaacagacaacattcagaatgggagaaaatttttgcaaactatgcatctggcaaaggtctaatatsgagcatttataaggaacttaaatttacaagaaaaaaacaaacagccccattaaaaagtaggccaaggacaggaacagacacttttcaaaagaagacacacatgtggccaaagagcatatgaaaaaaacgctcaacatcactgatcattagagaaatgcaaatcaaaaccacaatgagataccatctcgcaccaataagaatggctattattaaaaagtcaaaaactaacagatgttggcaaggttgtggagaaaaaggaacacttatacactcttggtgggagtgtaaattagttcaacc

SEQ ID NO: 1065 - DNA, 601 bp, Human
cactgaactttagaactgcagcaaatgccggaaccctcattcagggaattccttttgttctgaaaatcttactgatcacttgaaatgtcttcatgcatgcctttccaagactcttgggtccctatactcattttgctctactttgatgtgtcaatccatctttggattacttgccttctttctgtcctagccatatattcaccctgaactcagtctaggatactattgacatggactataacaccttccattagtcctactctctcacccttttcctcaccacgcagagtatgtctgtgtacacacacacacacacacacacacacacgcttggaatagaagatcaaacgcatttctaaggatgtgagcctttgacctcttgcttaaaaatgttgctatgatgtcacccacggatttcatcaccaagtctttggactggaagtgaggattggaggtgccccttagcgagtagattttaatccatgtctctgactctaggcacagtcatatttcaaccacaggaatgaaaaactgatgaacaaaaatagtactctgacttactgctcatgatgtttgattcataaaacttggggtcatcacg

SEQ ID NO: 1066 - DNA, 601 bp, Human
gaattatttgacctggcacctgtcagctctgataatccctagctgtcggtcatctgaagctatatgaacagaacatgcagaaatcatcctcacatgtgtgattacctactagagaaggtgattaccatgactctagactctgaggatcagtagggggaccctggctgttgtggagaagtttgcttccagctggctcagtgacatttctctcagactgccatggcagtgcttttggccactgaactttagaactgcagcaaatgccggaaccctcattcagggaattccttttgttctgaamatcttactgatcacttgaaatgtcttcatgcatgcctttccaagactcttgggtccctatactcattttgctctactttgatgtgtcaatccatctttggattacttgccttctttctgtcctagccatatattcaccctgaactcagtctaggatactattgacatggactataacaccttccattagtcctactctctcacccttttcctcaccacgcagagtatgtctgtgtacacacacacacacacacacacacacacgcttggaatagaagatcaaacgcatttctaaggatgt

SEQ ID NO: 1067 - DNA, 601 bp, Human
attctaataattccacttggaggaaaagcataatataagaaattcatctttttgatatattagtcattgggtaagaagtaatgtccctaaaaataaagcccatttagcatattttatagtttttattgctgtcttataatctacatagtattcacagtttccatttgagtatccagttcatacatttcattattgttaaaagggacactgctgtaggcaatatttttatttacttatgtactaagcatagtaaaaaaccaaaggtatgatttctacaagggcagggctcatgtctacctcsattaccactcttagccttagtaccagtataatgactggcattaacaaatatttaaatacctacttaaatcacttaagtgactttaataatttacatgatgtattattagtttatacctcattctagatgtttttctaaatggtctataactgcattgttcaatatggtagccactggctacaagtggttatcgagcacttgaaatatgggtagactggactgagatatgctgtgagtataaaatatacattgaatttcaaagacttagtaataaagtaagtctcattaatttttatattg

SEQ ID NO: 1068 - DNA, 601 bp, Human
ttctctgcctttaaagatattctaataattccacttggaggaaaagcataatataagaaattcatctttttgatatattagtcattgggtaagaagtaatgtccctaaaaataaagcccatttagcatattttatagtttttattgctgtcttataatctacatagtattcacagtttccatttgagtatccagttcatacatttcattattgttaaaagggacactgctgtaggcaatatttttatttacttatgtactaagcatagtaaaaaaccaaaggtatgatttctacaagggcrgggctcatgtctacctcgattaccactcttagccttagtaccagtataatgactggcattaacaaatatttaaatacctacttaaatcacttaagtgactttaataatttacatgatgtattattagtttatacctcattctagatgtttttctaaatggtctataactgcattgttcaatatggtagccactggctacaagtggttatcgagcacttgaaatatgggtagactggactgagatatgctgtgagtataaaatatacattgaatttcaaagacttagtaataaagtaagtc

SEQ ID NO: 1069 - DNA, 601 bp, Human
aggtctttcagcacagatagttgctcactattttaaaatatattaagaaagggatgaatcaagaataaaatggacttttaatatcataaatatcctaacagcacatcttgtcttagaattaaagggatggtgatgagctctatccccacaaataagagacatttagatgtttctaagtaataattcacgaggacaattttgaatctctgaaatggcatgcattgctggaacatcaaagatttcttggtgagtctccaatagttaccattgttggtgtctactgagtgctaggcacttggcrcatattactattttaatggtcaaagtaactctgtgagatgtgattacactgttttccagataaatgacttgtggctcagtgtggccaagtaacttgtgtaaggttacacagcaatcgattggcagatcaggacttgcattccagtctgacaaactccaaagctgttgctgaagcagcctttaaggcactgtacctgatgattgaagatgactgttgcaaaaaaccgaatagggcattttgataaaagaaatgctcttttgtggccaaaatatttatgcttcttcctcagagttatgcctt

SEQ ID NO: 1070 - DNA, 601 bp, Human
gtgcgttcatctcgcttaacagaataaaaaacaaaagtgttgcttagtggagattagaggggaaaaaaggtctttcagcacagatagttgctcactattttaaaatatattaagaaagggatgaatcaagaataaaatggacttttaatatcataaatatcctaacagcacatcttgtcttagaattaaagggatggtgatgagctctatccccacaaataagagacatttagatgtttctaagtaataattcacgaggacaattttgaatctctgaaatggcatgcattgctggaacatyaaagatttcttggtgagtctccaatagttaccattgttggtgtctactgagtgctaggcacttggcgcatattactattttaatggtcaaagtaactctgtgagatgtgattacactgttttccagataaatgacttgtggctcagtgtggccaagtaacttgtgtaaggttacacagcaatcgattggcagatcaggacttgcattccagtctgacaaactccaaagctgttgctgaagcagcctttaaggcactgtacctgatgattgaagatgactgttgcaaaaaaccgaataggg

SEQ ID NO: 1071 - DNA, 601 bp, Human
tagagaaagagttgtatggctggggtctggagaaaggggcatctgaccgagggctggggaaaggtttgtttgactgagttctggagagaggtttgtctggctgaagtctagagaaagggttgtatggctgaggtctggagaaatgggcatctgaccgagggctggggaaaggtttgtctgactgagttctggagagagagtcatatggctgagttctggagagaggtttgtctggctgaagtctagagaaagggttgtatggctgaggtctggagaaaggggcatctgaccgagggctggrgaaaggtttgtctgactgagttctggagagaggtttgtctggctgaggtctaaagaaagggttgtatggctgaggtctggagaaagggttgtatggctgaggtctggagaaatgggcatctgaccgagggctggggaaaggtttctctgaatgagttctggagagagagtcgtgtggctgaggtctggagagaggtttgtctggctgagttctggagagagggtcacctggctgaggtctggagagatgactgtctgccagacttcatgttctgaggaaggggacatttgacttatatct

SEQ ID NO: 1072 - DNA, 601 bp, Human
gtagaatatctgatcaaggtctggaggaggtgatatctggctgagatccgggagaagggtggtgtcactgatgtctggagagagagtcacctggctgaggtctggggaaagggacatctgaccaaagtttggggaaagatctgtctcaccaaggtctggagaaagtgtcatctggtcgaggtctggggtaaggggaatttgactgagatctgcaaagaggggcatctcactgaggtctggggaaaggtttgtctgactgagttctggagagaggtttgtctggctgaggtctagagaaagrgttgtatggctggggtctggagaaaggggcatctgaccgagggctggggaaaggtttgtttgactgagttctggagagaggtttgtctggctgaagtctagagaaagggttgtatggctgaggtctggagaaatgggcatctgaccgagggctggggaaaggtttgtctgactgagttctggagagagagtcatatggctgagttctggagagaggtttgtctggctgaagtctagagaaagggttgtatggctgaggtctggagaaaggggcatctgaccgagggctggagaaaggttt

SEQ ID NO: 1073 - DNA, 601 bp, Human
aaaaggtgttttaaacagagttctaatgtggagatgtcaggcatcagattaatgaactcatatgcataagtcacaccatacattgtgtttgcctactgtaattacactttggttttttaagtgattagtgtaacagctttagtaaaagctgtgggcatatctagacagctgatgcacagtcatcatgctatatccctgagaatttgtagttgactaagccttgctcctttcctcctctctcttctctttctgtatcttcatcccagaacaaagagcccagttcaacatggctttctacccstaagcaaaactgaattgtaaatattcttttaaaaaagggatttggatctcttagaaattctgatctaaacaagtaaatgcaaaaaggagatttctacatcatatttgagtttggatttgaggctaacttcaattaaatcatattgattagcatatagctatggataggttgggctctgcctggagcaataagagtcagtagaaacatgggtagtaagaggagaggacacagaaaaatgcttaattacagaatattatagagttctcacagtgattgttcttatattgtccaggggtcatc

SEQ ID NO: 1074 - DNA, 601 bp, Human
atatactgtgagtcatcaacagagaatctccttctgcctttcttctggtctacctcccctactaatcccatctttccagactctgagcataacatgcaaactcacagaacacaagggagtgggtaaagcaactccgaatgccataaaagtgggttgtgagccttgaatggaatacaagattttgaaggtggttccatccctattcactctggacaggccctgcatctcactccctcggggccttgcttagaaatactcaggtagctagttgttctcatgtggtattgagtgcaacatttawataggaagtcataggaaaaggtgttttaaacagagttctaatgtggagatgtcaggcatcagattaatgaactcatatgcataagtcacaccatacattgtgtttgcctactgtaattacactttggttttttaagtgattagtgtaacagctttagtaaaagctgtgggcatatctagacagctgatgcacagtcatcatgctatatccctgagaatttgtagttgactaagccttgctcctttcctcctctctcttctctttctgtatcttcatcccagaacaaagagcccagttcaa

SEQ ID NO: 1075 - DNA, 601 bp, Human
tttaattacaaattataaataaataaataaagcacattatttccatctagttcattggctcagtctaggactgaagcatgtcgaattctcccactgactctcacatttcccaagcctgtggaaacaagccaaacactcacccatcaaacccataatatttgctatatactgtgagtcatcaacagagaatctccttctgcctttcttctggtctacctcccctactaatcccatctttccagactctgagcataacatgcaaactcacagaacacaagggagtgggtaaagcaactccgamtgccataaaagtgggttgtgagccttgaatggaatacaagattttgaaggtggttccatccctattcactctggacaggccctgcatctcactccctcggggccttgcttagaaatactcaggtagctagttgttctcatgtggtattgagtgcaacatttaaataggaagtcataggaaaaggtgttttaaacagagttctaatgtggagatgtcaggcatcagattaatgaactcatatgcataagtcacaccatacattgtgtttgcctactgtaattacactttggttttttaagt

SEQ ID NO: 1076 - DNA, 601 bp, Human
ttaacattgctgagtacattttaagtgttctaaccacaaaaaagtatgtgaggtaatgcataggttaattagcttgatttagccaattcacaatttataaatatattaaaacatcatgtttacaccataaatgtgtataaaacaacaacaacaaaaaaactggggtacacccatataatggaatacatgcaataaccagatgaatctccagagaattatactgagtgaaaaaataccagtccccaaaggttacatgttgcctgattccatttatgtaatattcttgaaatgacaaaattayagaaatggagatcagactactggttgccagggaataaggaagggctatggtgggaggaaggcagatgtgactataaaggggtaatgagagggatttttatggtgatggtgaacattctgtgtcttgacagtatcaacatcagtgtgctggttgtgatatagtattatagatttgcaaaatgttacccctgggagaaactgggtaaagaatactcaggatacccaaaggatctctccgtattatttctcttgactgtatgtgaatctattttatttttgttccaaaataaaaagtttaatt

SEQ ID NO: 1077 - DNA, 601 bp, Human
gtaaaagaagaaattaaagactgttcccagaatttaggaaattgtctctttctaaatatagcatctagcatagagaaggtctttaataaatacttggtggataaatgagtaaatatataagtggataaaaacaaaagccagtaaatatctttcaattcctaactcaaatattattttataggtaagtcttcctatgaccttttagactaggtcaagtctctatatcaatttctcatatttctatagtattattatagtatatatagtaaattcctgtagtattcttataatatctctagartatatattgtagattatatataatttatttgtgagattatctattaatatctgtctctcactgggtataagtgccatgaggtcagccattgtgcctagtttgctcatagtactctctccagtggtaagcacattatctgacacacagcaggaacttaataaatttttgtcaaacatataaatgaatgtataaatataatcgtatgttaacacaccaaattttaagatcaaaggcagacaaagccatgtaatgggacagtgccagagcttggggctatcaggtgacaatggtcagattaat

SEQ ID NO: 1078 - DNA, 601 bp, Human
acatacagtgtctggtttttgattcctgagttacttagaataagttttttaaatattgtgttaaattatcgttcatcttgaaaaaggatcccctaatcataaaagagaatattgcctcccatagcttcatggaaaatttagaataattaagattcttatatccctatgtacttgtttacgtttttaaaaagagcaaatggtcactgaaaatgtagtgaatgcttacacaggtatagtagattatattttaaaatctagaatagcttactttagaatcagggttctttctgggtttttgaaygtgagcggttagcaaaaatggcggaagtaaactttgttataaaagcaagttataatcgtgggtctggacacaagattttgaaagaaattaccagaactaggaagacactgaagaaacttgctcacttttggagggcatggagacatctttactttccttactcattttatttaacttcattttatttaatttttaggaaaacacctgaagatatttctaaattactattactactagcactgctactgccaccaccaccaccactgctatgaaacccaattcaattgctcttgaatatat

SEQ ID NO: 1079 - DNA, 601 bp, Human
gtatgtctcaatgcaacattgttacttatcctgtctttattcacaattgtgaggttttgtttattgtggctttcgtgcattaattttgatttttaaattttttaaaaaacttcagttgctttaggaatgcaagtggtttttggttacatggatgaattgtatagtggtgaagtctaggattttagtgtacctgtcacctgagtagtgtaccctgtacccaataggtagcttttcatccatcccccgttcccttttgagtctccaatgtccattataccaatctgtctgccttcgcataccygcagtttatctcccatttgtaagtgagaacatacagtgtctggtttttgattcctgagttacttagaataagttttttaaatattgtgttaaattatcgttcatcttgaaaaaggatcccctaatcataaaagagaatattgcctcccatagcttcatggaaaatttagaataattaagattcttatatccctatgtacttgtttacgtttttaaaaagagcaaatggtcactgaaaatgtagtgaatgcttacacaggtatagtagattatattttaaaatctagaatagcttacttta

SEQ ID NO: 1080 - DNA, 601 bp, Human
tcctgttctgttctgttctaattactggtgcatgcagcccccagtcacgtaccccctccttgctcaatcaatcacgacccactcacgtggaccctcttagagttgtgagcccttaaaagggacaggaattgctcactcggggagctcggttgttggagacatgagtcttgccaaagctcccggctgaataaagcccttccttctttaacttggtgtctgaggggtttttgtctgtggcttgtcctgctacaatttgacctagcaattctattactgggtatatagccaaaaaagaaaatamattgttcagccgggcgcaatggctcatgcctgtaatcccagcactttgggaagctgaggcaggcagattgcccgaggtcaggagtttgagaccagcctggccaacatggtaaaaccctgtctctactaaaaatacaaaaattagctgggcatggtggtgggtgcctgtaatcccagctactcgggaggctgaggcaggagaattgcttgaacctgggaggcagaggttgcagtgagttgagatcatacctctgtactccagcctgggcgacagagtgagactccatctcaaaaaaaaaaa

SEQ ID NO: 1081 - DNA, 601 bp, Human
acaccagtcagaatggctattagtacaaagtcaaaaaatagatgctggtgaggctgtgaagaaaagggaatgcttatacactgctgcttagaatgtaaattagccactgtggaaagaagtttgggggtttctcaaagaatttgaaacagaactactattttaagggaggagaccacccctcatattgtcttatgcccaatttctgcctccaaagaaagaagaagtaaaaactaaaaggcagaaatgaaatccacaagcagacagcccggcgccacaccctggacctggtagttaaagatckacccgtgacctaatcggttatgttatctatagattacagacattgtatagaaaagcactgtgaaaatccctgtcctgttctgttctgttctaattactggtgcatgcagcccccagtcacgtaccccctccttgctcaatcaatcacgacccactcacgtggaccctcttagagttgtgagcccttaaaagggacaggaattgctcactcggggagctcggttgttggagacatgagtcttgccaaagctcccggctgaataaagcccttccttctttaacttggtgtctgaggggtttt

SEQ ID NO: 1082 - DNA, 601 bp, Human
taccacagtgaaataccatctcacaccagtcagaatggctattagtacaaagtcaaaaaatagatgctggtgaggctgtgaagaaaagggaatgcttatacactgctgcttagaatgtaaattagccactgtggaaagaagtttgggggtttctcaaagaatttgaaacagaactactattttaagggaggagaccacccctcatattgtcttatgcccaatttctgcctccaaagaaagaagaagtaaaaactaaaaggcagaaatgaaatccacaagcagacagcccggcgccacaccmtggacctggtagttaaagatcgacccgtgacctaatcggttatgttatctatagattacagacattgtatagaaaagcactgtgaaaatccctgtcctgttctgttctgttctaattactggtgcatgcagcccccagtcacgtaccccctccttgctcaatcaatcacgacccactcacgtggaccctcttagagttgtgagcccttaaaagggacaggaattgctcactcggggagctcggttgttggagacatgagtcttgccaaagctcccggctgaataaagcccttccttcttt

SEQ ID NO: 1083 - DNA, 601 bp, Human
tagacaaagctattctaaaattcatatggaatcaaaaaagagcctgaatagccaaagcaatcctaagcaaaaagaacaaatctggaggtatcacagtacctgacttgaaactatactataaagttacaataaccaaaatagcatggtactgatacaaaaacagacacataggccaatgaaacagaataaagaacccagaaataaagccacacacttacaaccacctgaactttgacaaagtcaacaacaacagcaacaacaacaacaaaaaacaaggggaaaaggactcatatttaataartggtgctggaatagccggctacccatatgtggaagaatgaaactgaaccccaatgaatccaatgaaactggattcatcatatacaaaaattaactcaaaatggattaaagatttaaatgtcagacctcaaactataagaatcctagaagaaaaacctaggaaacaccattctggatatcagccttgggaaagaatttatgactaattcctcaaaagcatttcaacaaaagcaaaaattgacaaattaaactaaagagcttctgctcagcaaaagaagctatctacagagtgaacagacac

SEQ ID NO: 1084 - DNA, 601 bp, Human
aagtttcaggatgcaagattaatgtacaaaatcaattatacaaaataaaatgtacaaatgtacaaaatagcatttctatacatcagtaatgttcaaactgagagcgaaatcaagaacgaaatcccattaaacatagccacacacacatacaaaatacctaggaaaacatctaaccaaagaggtgaaagatctctataagaagaattacaaaacactgatgaaagaaatcatagatgacacaaacaaatggaaaaacattctatgcttatgtattggaagaatcagtattgttaaaatagcyattgtgcccaaagcaatctacagattcaacactattttttaacaactactggaatcattttcctcaggattagacaaagctattctaaaattcatatggaatcaaaaaagagcctgaatagccaaagcaatcctaagcaaaaagaacaaatctggaggtatcacagtacctgacttgaaactatactataaagttacaataaccaaaatagcatggtactgatacaaaaacagacacataggccaatgaaacagaataaagaacccagaaataaagccacacacttacaaccacctgaac

SEQ ID NO: 1085 - DNA, 601 bp, Human
aatctggagacaacaggtgctatatacaaagtctaagtgggttcagatgacaatgccctggaggaacaatttggttgaatatttaggagtggttggaagaattaaggtaagtttcttagaggaaatggaattggccatcatagaatgaacaggagctagaaagacatttcagactctcagaagggcagaaggatgcctgtgagcaggggagtaaaggaagagtttggggaatagcaaggatctcggtggaactgggctgtgaaatgcacagggacaggtggaacctggtgagaaatgaggstagaaaaggagcaggttggggccagatggtaaaggacttaaatgccatatgagaagtcttcacaccccagcagtcagacccatgaagctcctcccagcccttctataacttctagtgattaaagactccctaattgtctgttccttattttattctacaaagccagcatcaccctaataacaaaacctggcaaagacacaatgaataatgaaaactaccggccaatatctctgatgtacatagacacaaaaatcttcaacaaaatattggcaaaccaaatccagcagcaaattaaaaatt

SEQ ID NO: 1086 - DNA, 601 bp, Human
tgcctctttctcaggaatttccttgctcttctgataatcactcatcatatagaaaaggaaactttctgataggctctgaatttgaagatgaagattataaatgaatggcataataagcctggatatttatcacctaattctgttgtattcataatcctccttcctctgattgatctttatcccagtaacaatgatgataataataaattgataatataagggatactatttattgagaatctattactatattaaatgatttgcctgcaatctcccatttaatcctgacaactatcttatmtggtaaatataaattcattcattgaacaaatatttaccaagtgcttaccatgcactatgtactgttatctcatttttaacttctgataccaggctaagagaggtcaaggaatttcctaggattatgcattgacagggtaaaaatttaaatctgagtctgtgctctttccactatgcctgaaatggaggagttgtttctctttttaattgacagataaaattgtatgcatatactgtgtatgacatattgttttgaagtatatatacattgcagaatgtcagataaaggagtcttgacttt

SEQ ID NO: 1087 - DNA, 601 bp, Human
caagaacttcgggacttcttttcatagtaccagctcttcttttcatcaaaggtcataaatagtaagacaaattctctcatgtccataggcatgttgctgtccttatgtagtattcctttttggcagattaggaggggacctatcaagcctgagtgaatatctttttcctggaaaaacagagtaaattgtattgcctctttctcaggaatttccttgctcttctgataatcactcatcatatagaaaaggaaactttctgataggctctgaatttgaagatgaagattataaatgaatggcrtaataagcctggatatttatcacctaattctgttgtattcataatcctccttcctctgattgatctttatcccagtaacaatgatgataataataaattgataatataagggatactatttattgagaatctattactatattaaatgatttgcctgcaatctcccatttaatcctgacaactatcttatatggtaaatataaattcattcattgaacaaatatttaccaagtgcttaccatgcactatgtactgttatctcatttttaacttctgataccaggctaagagaggtcaagg

SEQ ID NO: 1088 - DNA, 601 bp, Human
tcacctgccagattacatcagccctctggaatgttaaggaaccggttttagttgtagctctgggtgtctcagaagcatctcatgtctaatcttgtgaatatctaagggcagaaatcactgtgacccagtgtgatttaattaggagattagatcaaagtccgaggaaaataccgtgaaactcatgggattttttcatttctgaggatgtgagtctccaagaacttcgggacttcttttcatagtaccagctcttcttttcatcaaaggtcataaatagtaagacaaattctctcatgtccayaggcatgttgctgtccttatgtagtattcctttttggcagattaggaggggacctatcaagcctgagtgaatatctttttcctggaaaaacagagtaaattgtattgcctctttctcaggaatttccttgctcttctgataatcactcatcatatagaaaaggaaactttctgataggctctgaatttgaagatgaagattataaatgaatggcataataagcctggatatttatcacctaattctgttgtattcataatcctccttcctctgattgatctttatcccagtaacaatgat

SEQ ID NO: 1089 - DNA, 601 bp, Human
ctgcccacttctcagattagataactagggttctcaggctttatctactctccccacagtaaaatacgcggattttttaaaaagttcctgagaaacttgatcaccttaaaaatgtaacacaaaactgtaaagataaagtttagtgttaccaaacgtttaactgaaaccaaagtgagggaagtgctttgtttcctccttcttaagttagaggaactgctgtgaaatttcagaaaccaggcaggtgaatttttggagagggacgggttgagatcatttgggcatccttcaaattatatcaggygtgagaacacctatctacatattcataacacaagctcgtacctttctcttctcagtttctgtttcagttactagcttacagggcaaattttccttgtgaatttccaaataggcacacttttcccagtgtgaccacccaaatgctctcttgccactattctcctattacctgggtacctagtttcttatctcattttgttctcatatgctttgggtgccacctggtagctgctgagagctaaaactgttagcgtcattcttattttagaaaagacacacaggtgatcatttcttttatata

SEQ ID NO: 1090 - DNA, 601 bp, Human
ccttctcatatcattcacaccagcctacagcagaaggcagggggaactccctttccaagcagtttatcactcttttcctcagcttttacagttccgtgctttacccgtgtatactttccattaacagtcttaattttccttaactacaaaagataaatacaaatatgggcagacaaagtaaactccagggattagagtcagcaaggagatatgcagcatgtcaccttaaggccttctaaattcagagaaagtttcaggcaaattaggaagtctaggagtttataaaattaggagtttatcrttggtgtatccagcaaccatagcaagtcatgtttattctcttattggtatgacaactcctctgcccacttctcagattagataactagggttctcaggctttatctactctccccacagtaaaatacgcggattttttaaaaagttcctgagaaacttgatcaccttaaaaatgtaacacaaaactgtaaagataaagtttagtgttaccaaacgtttaactgaaaccaaagtgagggaagtgctttgtttcctccttcttaagttagaggaactgctgtgaaatttcagaaaccaggca

SEQ ID NO: 1091 - DNA, 601 bp, Human
aatactacatgtgtggtcaaacccagaaaagatgactgaggagagttttggaaatgggcgcgtggtcataagactaaggtatctgatccttgccaaatccctgcagagaggctgggctttttatgtagagaaatcaatgacccccagctatcggtttttcctggaaaagactctttgggatcattatacaccagaagaggtggcagtgttaagagcacactaacaggcctttagctcctaccatagtgttccttcctttaccatatatgtaccccaaatggagctgcttcactacattgtmgtagagaaaagcataaagagaaaaactgattcatagataggattgtcatgtatggtttcataggctgcatgctgcacaactgtagggggtaccattcacagaccatggtgctacaacttacccagaaactctgaagccttgatctgtgaatcagatatgataccagtgcttagtcccattggcatcctacagtctatgaaaaacagaaaaaaaatgaataatttttgcttagaaaatatatacaataaagtaaaactccatggttagggattatgtttctgactcaataattagatattt

SEQ ID NO: 1092 - DNA, 601 bp, Human
aacaggaagacatggaagggtatatgggagcctcatcatcctcttgatcatgacctcttgatcttgggaagggctttgaggcagtgtgggaaaactttggaggagttcctcacatatagtggaggttcaacaaagttttctgaatagatgaatggttgccacaggcaaagggccatattaatggggactataatgcctggctgataagaccctgtgaatctggctgaaatactacatgtgtggtcaaacccagaaaagatgactgaggagagttttggaaatgggcgcgtggtcataagastaaggtatctgatccttgccaaatccctgcagagaggctgggctttttatgtagagaaatcaatgacccccagctatcggtttttcctggaaaagactctttgggatcattatacaccagaagaggtggcagtgttaagagcacactaacaggcctttagctcctaccatagtgttccttcctttaccatatatgtaccccaaatggagctgcttcactacattgtcgtagagaaaagcataaagagaaaaactgattcatagataggattgtcatgtatggtttcataggctgcatgct

SEQ ID NO: 1093 - DNA, 601 bp, Human
gactcaaggttattggtataataatggcaggcagactccttgcattcagacttctttggggaagggaatagagaggaggagaagagttagggcttatggctgagcccctggaagaaccagaaggagaatgtcattcctcaggcatggccccccaaaaagtctgagaatcacactgcctcagaggcttactagcattaacactactatttacttcaggtacactgaaataaagaacaaaacaaactacaatagtaaaatcaaaagtcttggtagccaatttttagcatgagctccttgaggygcaagaccagatgttctactctgccgtataccattggccagtctgagaaatctgggtattttgtttgatgataaaatgattttttaaagttttgtggggttttgaagtttcagtaaccctgcttctctctttaatttgtaagacacagacctatcatattactgcttttctccatatgacccttagaaagccattcacatttctaatacccagaaaggtattttttaaaatacataatcattaggtatagtcataataattctaggccaagtctagagtctagagattcagatagaaata

SEQ ID NO: 1094 - DNA, 601 bp, Human
aagcccaaataaaatctgctttctctaaccaaagtaccagtaaagggcagcatagcgagatatgatagaaaactggtggacactgacttctctcctttagccaaacaccacagaaaaacctgaggcccctccccaacccacaacagcaaaggctgaatggggagcctagacttctatgctcctgaggctaaagaggcaccctacaccctcactggggttgtgtcagaaaaggccatgtagggatttagggctttcatctccagcccctaatgaagctcctgcccctgcagtatcagtggakgccaaatggggaacttcccttcccacccagccaccaaggaacaatcccttcttaggtggcaatggagtggggaacctggactttgacccccacttggcagtaaacaggctgtgccctaccccttttcctgacagagcaatgtcagaaaaagccaactttttaaaacagaagattggagcaggtatcggtaatactgaaaacagaaaaacaatagagaaaaatcaataaaacaaggctggttctgtgaaaagattttttttttttttttgtttttgagacggagtctcactccgtcaccag

SEQ ID NO: 1095 - DNA, 601 bp, Human
ctaagctaaaattatttaatctcctgtgtatttagaattaaaaggaaaaatctagaccagatgctttgctccttgctactgtaacattctgtgattccatattgggccagaatgagtttcaagacacagatatcagttcccaagactgtgtggaatccaatcttttctatttaccccaccagcaccacaattcttttttcctttctagtggcctaatttaaggataggccctggaattctatagaaagccaggaaattggagtgtaggtatcttaagggagggagatatgaggatagaaaktagggaatttggatttagttggctgaagggatcatcaagttattcatgccattctgatatctcaggtcatttaaagaattaataaaaatgagtcaaatattaagagttacccccaaattaaatcacctgaattactcagtgggctaatatcagggacagtataactctctggaaggtgtttgtttaacttagatcactgattttataactctggttttgcaacattttactatgcttctagttgcctcaaggaatatcacaaagctcttaaaataaggagggcggggaagagaacaaaaa

SEQ ID NO: 1096 - DNA, 601 bp, Human
gtatggagtgacaaggttataccatgaacaagtctaaagagtcatctgaaaaagaattggataacatctctttaattattatttatattgctatgtaaattatataaatgtaatataacactatttttattattttaacttctctgggtgtcagctttgccctctgcaaaattgcaaaatgaggtatttgggctgcttcaaatggtggaaggagcatggcctgtttactgggagaatgggattctagtcctgattctgctaccaaactaagctaaaattatttaatctcctgtgtatttasaattaaaaggaaaaatctagaccagatgctttgctccttgctactgtaacattctgtgattccatattgggccagaatgagtttcaagacacagatatcagttcccaagactgtgtggaatccaatcttttctatttaccccaccagcaccacaattcttttttcctttctagtggcctaatttaaggataggccctggaattctatagaaagccaggaaattggagtgtaggtatcttaagggagggagatatgaggatagaaattagggaatttggatttagttggctgaagggatca

SEQ ID NO: 1097 - DNA, 601 bp, Human
cttactgcttaagggtagaggcttatttcattttgtttcctggtactcaccacaatgttaagacactcagttggtgttcaataaatagttgttgaataaatgaatgaataaatgagctttatttggaaaaataattaaactgctaaattatctgtgaatattattttcttaagcaaatttctttaaatactctggtaatattgctgcagggttatctgggaaataattggatagcattctctctctatttcacctgttttacaaaacacaacttctctttccccctgttaatgtcaaagakcagaaatagttcaatttcttctaatatttcaaataaatgtaacatttgagagacctgataaaaccataagtagagcttgatacacagtacagttattgtcctgtctctggcctaacaaaatgcctaatcacatggttggtgatatgtgtttggagaaagatcagaaggtctaaactgagttttagagtcatctaagataaatttttacctttgggagatttatcgtctaccataacctcattcaattctaaaggaaataatattgatatgtttcttcaacatcacccacacatacataag

SEQ ID NO: 1098 - DNA, 601 bp, Human
ttcaattctagtaaatatcacagccaaagagttccaggcgaagtgcaatactttgattccatgttttaggaatgacacggataaacctggaaatgattggggggttgaaaaagttcttcacatgtcctttggtattagtatttccttcaaaaatctgaaagccaaataagagaaaatctttaatgacaacataaatggctaaggttttttgtttttgtttttttttagacagggtcttattctgttgcccaggcttgagtccagtggcacagtcatggctcactgcagccttaaactcctytcaagtaatcctcttgcctcagccttccaaagtgctggcattgcagacatgagccatcatgcccaacccagaaaattttttatcctattagctcaaaatgagcatatcaaagaacacatagaacactctcacagagatgatcctctatcagttatgaaatcacatgccagatagatttcatctcaccagtgatctgacttaaattagtgaaaaataaacaagtctcacatggtgctgtggagcagctgcaaaaccatttctgccttcagcccgtctgtattagctgtatgactgaacaag

SEQ ID NO: 1099 - DNA, 601 bp, Human
tctcagatagagacttgttttgttaagggctctggataggtagaagataccatgaggtaggcatgttgacatccagtgtacctggcttcttgtaggttgagcagagcaattagtgtactgagaagctctagccaaacctcgtttgatatgttcggtctaagtagatttgcagattcgtgtctatgttcttctcttgcttcttcatcttttagaaataacatttgttggccaggcggcggtggctcacacctgtaatcctagcattttgggaggccgagttgggtggatcatttgaggtcargagttcaagaccagcctggccaacatggtgaaaccccatctctactaaaaatacaaaaattagccaggcgtggtggtgtacgcctgtagtcctagctacttaggaggctgaggcgtgagaattgtttgaacctgggaggcagaggctgcagtgagccaaaatcgtgccactacactccagcctgggtgacagagcaagataccatctcaagaaaagaaataacatgtgttcttttattagaaactaatatgtgttaattttaagaagctggtaaaatacacagacctatgaagaataaaa

SEQ ID NO: 1100 - DNA, 601 bp, Human
tcaggagttcaagaccagcctggccaacatggtgaaaccccatctctactaaaaatacaaaaattagccaggcgtggtggtgtacgcctgtagtcctagctacttaggaggctgaggcgtgagaattgtttgaacctgggaggcagaggctgcagtgagccaaaatcgtgccactacactccagcctgggtgacagagcaagataccatctcaagaaaagaaataacatgtgttcttttattagaaactaatatgtgttaattttaagaagctggtaaaatacacagacctatgaagaatwaaaaaacccactggcaatctcagtatctagacttattttttaacattttggcatttttccttctgtctaaagttgtttaatgtttttgtaatgattcaagattaaaacctgtgtctgtattgctacttatggaggagtgcaaaatttggatataggtcacacagtgggtttaaattgatactgaaatgagcacctggtggtgtttgtggtccccgtctctctgactaacagtaactctcctgtttggcattgatacattgtcagctacaagatcctaaagtaaatctgagtctttttctt

SEQ ID NO: 1101 - DNA, 601 bp, Human
ggctgaggcgtgagaattgtttgaacctgggaggcagaggctgcagtgagccaaaatcgtgccactacactccagcctgggtgacagagcaagataccatctcaagaaaagaaataacatgtgttcttttattagaaactaatatgtgttaattttaagaagctggtaaaatacacagacctatgaagaataaaaaaacccactggcaatctcagtatctagacttattttttaacattttggcatttttccttctgtctaaagttgtttaatgtttttgtaatgattcaagattaaaacytgtgtctgtattgctacttatggaggagtgcaaaatttggatataggtcacacagtgggtttaaattgatactgaaatgagcacctggtggtgtttgtggtccccgtctctctgactaacagtaactctcctgtttggcattgatacattgtcagctacaagatcctaaagtaaatctgagtctttttcttccatctccagtaaagaagagaacatttaatgctgttaaataaaaaaattggggagtatatagagaagtacccattttttttgttagtttggatggtagctgcagtttgg

SEQ ID NO: 1102 - DNA, 601 bp, Human
tctcagtatctagacttattttttaacattttggcatttttccttctgtctaaagttgtttaatgtttttgtaatgattcaagattaaaacctgtgtctgtattgctacttatggaggagtgcaaaatttggatataggtcacacagtgggtttaaattgatactgaaatgagcacctggtggtgtttgtggtccccgtctctctgactaacagtaactctcctgtttggcattgatacattgtcagctacaagatcctaaagtaaatctgagtctttttcttccatctccagtaaagaaragaacatttaatgctgttaaataaaaaaattggggagtatatagagaagtacccattttttttgttagtttggatggtagctgcagtttggaatactagattttacattgttgccttaagagatgtattttggagggctcccttagtcttacagtttcacttaccttctgcattcaggaccctaggtatcaagagagggcaaagggtattgttggacaaaataggcaactatatagagctaagtactttatgtttcaaatgtttgaaagattccaaaaaccacatctctgtttccttgag

SEQ ID NO: 1103 - DNA, 601 bp, Human
gtgtttgtggtccccgtctctctgactaacagtaactctcctgtttggcattgatacattgtcagctacaagatcctaaagtaaatctgagtctttttcttccatctccagtaaagaagagaacatttaatgctgttaaataaaaaaattggggagtatatagagaagtacccattttttttgttagtttggatggtagctgcagtttggaatactagattttacattgttgccttaagagatgtattttggagggctcccttagtcttacagtttcacttaccttctgcattcaggaccytaggtatcaagagagggcaaagggtattgttggacaaaataggcaactatatagagctaagtactttatgtttcaaatgtttgaaagattccaaaaaccacatctctgtttccttgagatgacaagtaatttttctggattgagtaactgaatttattgagtagctagactcagagtcgaggccatttggaaacagttgcttgtatttttgttcagtgatggtttctagcatgtgcagtcacttggaaggctaactatgctcctttctacagctgaccccacgtcagaaagcaaggaaga

SEQ ID NO: 1104 - DNA, 601 bp, Human
tcctgtttggcattgatacattgtcagctacaagatcctaaagtaaatctgagtctttttcttccatctccagtaaagaagagaacatttaatgctgttaaataaaaaaattggggagtatatagagaagtacccattttttttgttagtttggatggtagctgcagtttggaatactagattttacattgttgccttaagagatgtattttggagggctcccttagtcttacagtttcacttaccttctgcattcaggaccctaggtatcaagagagggcaaagggtattgttggacaawataggcaactatatagagctaagtactttatgtttcaaatgtttgaaagattccaaaaaccacatctctgtttccttgagatgacaagtaatttttctggattgagtaactgaatttattgagtagctagactcagagtcgaggccatttggaaacagttgcttgtatttttgttcagtgatggtttctagcatgtgcagtcacttggaaggctaactatgctcctttctacagctgaccccacgtcagaaagcaaggaagatcagtggatgggggtcaccgtccagagccaaggtccag

SEQ ID NO: 1105 - DNA, 601 bp, Human
agtaaatctgagtctttttcttccatctccagtaaagaagagaacatttaatgctgttaaataaaaaaattggggagtatatagagaagtacccattttttttgttagtttggatggtagctgcagtttggaatactagattttacattgttgccttaagagatgtattttggagggctcccttagtcttacagtttcacttaccttctgcattcaggaccctaggtatcaagagagggcaaagggtattgttggacaaaataggcaactatatagagctaagtactttatgtttcaaatktttgaaagattccaaaaaccacatctctgtttccttgagatgacaagtaatttttctggattgagtaactgaatttattgagtagctagactcagagtcgaggccatttggaaacagttgcttgtatttttgttcagtgatggtttctagcatgtgcagtcacttggaaggctaactatgctcctttctacagctgaccccacgtcagaaagcaaggaagatcagtggatgggggtcaccgtccagagccaaggtccagggggcaaggtcgtggtaagtgtagagacacatgttcatcct

SEQ ID NO: 1106 - DNA, 601 bp, Human
tttgttagtttggatggtagctgcagtttggaatactagattttacattgttgccttaagagatgtattttggagggctcccttagtcttacagtttcacttaccttctgcattcaggaccctaggtatcaagagagggcaaagggtattgttggacaaaataggcaactatatagagctaagtactttatgtttcaaatgtttgaaagattccaaaaaccacatctctgtttccttgagatgacaagtaatttttctggattgagtaactgaatttattgagtagctagactcagagtcraggccatttggaaacagttgcttgtatttttgttcagtgatggtttctagcatgtgcagtcacttggaaggctaactatgctcctttctacagctgaccccacgtcagaaagcaaggaagatcagtggatgggggtcaccgtccagagccaaggtccagggggcaaggtcgtggtaagtgtagagacacatgttcatcctatactgttggactgctggttatgtgccagcaccaggcttacagcaggggacagcagggagcatacattctagcgaacttactgctttaaagcaggaatgg

SEQ ID NO: 1107 - DNA, 601 bp, Human
gacatttctctctgtatatgttattttcaaaggccatgctttgctaataattcagtagagttagaagggcagattacagacgaattggggaattttgaggtataatttcagatatgtgaggaaaagtcgtttgattattgtgatgtgagtaaatggagatgtagagaggtaaagaagaaaatggcccacattttttgactgtgtatgtatagaaaatgctatatcataaaagacaacctaactctcatccatgatgaagagaactgcatctgatttggaaataagccatttttgagaaatktattaataataagtcacataacactttcactcatcagggaaaacttaggaaaatggtcccttttccattcaacaatttgttttaattgtggttctaaatgactcttgaacacctttctctgtgtgcaatcttcaagggtaatttccctttgcccccacctccaccccaacagaatcttcatgtacagtatttcccaggttattttgacctaactgaaataacatgttgaatttagttttattttagcatgaataaatgctttatatagtaaaacaaaacaaaaatatccaccaattatgt

SEQ ID NO: 1108 - DNA, 601 bp, Human
agaaatgtattaataataagtcacataacactttcactcatcagggaaaacttaggaaaatggtcccttttccattcaacaatttgttttaattgtggttctaaatgactcttgaacacctttctctgtgtgcaatcttcaagggtaatttccctttgcccccacctccaccccaacagaatcttcatgtacagtatttcccaggttattttgacctaactgaaataacatgttgaatttagttttattttagcatgaataaatgctttatatagtaaaacaaaacaaaaatatccaccarttatgtatattttaattcatggaaaatatggtttacctgctttataaacctgacctaaaatgtcgccatttaaagccatatagtgatttgggcttactatatgaaatcttatgttttaaattactaattgtaagaatttttaaaagatgaaatcttggttaaagtgatctaaagaaaagatcaatatgtctcacttttacactgcaaaaaaaagacaaattgaggcaggattacagagaatgtaaaatatatatatcaagttcatgtcatttaaaaattggttctctgtagattttgtta

SEQ ID NO: 1109 - DNA, 601 bp, Human
cttgaacacctttctctgtgtgcaatcttcaagggtaatttccctttgcccccacctccaccccaacagaatcttcatgtacagtatttcccaggttattttgacctaactgaaataacatgttgaatttagttttattttagcatgaataaatgctttatatagtaaaacaaaacaaaaatatccaccaattatgtatattttaattcatggaaaatatggtttacctgctttataaacctgacctaaaatgtcgccatttaaagccatatagtgatttgggcttactatatgaaatctyatgttttaaattactaattgtaagaatttttaaaagatgaaatcttggttaaagtgatctaaagaaaagatcaatatgtctcacttttacactgcaaaaaaaagacaaattgaggcaggattacagagaatgtaaaatatatatatcaagttcatgtcatttaaaaattggttctctgtagattttgttaactaagcaaaccttccatttttcatctagtttcatggcattataaagatagttcatgaaaatgcatgggacagtttttaatgactcaaacaaatttctttcccataaaaa

SEQ ID NO: 1110 - DNA, 601 bp, Human
aagtggcaagtcaagacctccaggtcctccctctgtgattgtggttctccaaggattagccctgcttctggattgggaccccatgtcacagggccccacagatggataaaagcttcccagcggaggttgagcaggactgctaaaacggctttcaggacacccagactgtgtctaagggccaattcttaactcctaaggcttgtttgcatgactaatgggtgtcctaagttattcatgtacattatggtaattacacaaaggcttttaaaagctttaattcttggtatgagttgacaaaaasaataattactgtgcatttcttggaaaaaatgtaaaaaaaagtctaaacccaaatagtaacctgtttaaaaaaaaaaaaaaaagtgaagaaaagtacccagatgttaggatattactggaagaatggaaagtaaaaaacgaaaaaacaggtatagatacatgaataatttcaagcaatgtgctagtaaacacgcactaataagttgttcaggccgggcctggtggctcacgcctgtaatcccaacacttcgggaggctgaggcaggcggattacttgaggccaggagttcaagaccagcct

SEQ ID NO: 1111 - DNA, 601 bp, Human
cccatgtcacagggccccacagatggataaaagcttcccagcggaggttgagcaggactgctaaaacggctttcaggacacccagactgtgtctaagggccaattcttaactcctaaggcttgtttgcatgactaatgggtgtcctaagttattcatgtacattatggtaattacacaaaggcttttaaaagctttaattcttggtatgagttgacaaaaacaataattactgtgcatttcttggaaaaaatgtaaaaaaaagtctaaacccaaatagtaacctgtttaaaaaaaaaaaagaaagtgaagaaaagtacccagatgttaggatattactggaagaatggaaagtaaaaaacgaaaaaacaggtatagatacatgaataatttcaagcaatgtgctagtaaacacgcactaataagttgttcaggccgggcctggtggctcacgcctgtaatcccaacacttcgggaggctgaggcaggcggattacttgaggccaggagttcaagaccagcctggccaatgcagcaaaaccccttctctactaaaaatacaaaaatattagccaggcgtggtggtacacatctgtagtccca

SEQ ID NO: 1112 - DNA, 601 bp, Human
atgtacattatggtaattacacaaaggcttttaaaagctttaattcttggtatgagttgacaaaaacaataattactgtgcatttcttggaaaaaatgtaaaaaaaagtctaaacccaaatagtaacctgtttaaaaaaaaaaaaaaaagtgaagaaaagtacccagatgttaggatattactggaagaatggaaagtaaaaaacgaaaaaacaggtatagatacatgaataatttcaagcaatgtgctagtaaacacgcactaataagttgttcaggccgggcctggtggctcacgcctrtaatcccaacacttcgggaggctgaggcaggcggattacttgaggccaggagttcaagaccagcctggccaatgcagcaaaaccccttctctactaaaaatacaaaaatattagccaggcgtggtggtacacatctgtagtcccagctactcaggagcctgaggtaggagaatcatttgagcctgggaggttgaggttgcagtaagctgtgattgcagcactgccctccagtctgggcaacagagcaggaccttacctcagaatgtttcatttagggattacttatgattaaaatacttg

SEQ ID NO: 1113 - DNA, 601 bp, Human
taagttggtccaaaacaatgaaatgctatctatggtgtattaatgatgttagcatttgtttttgtctgattaccaaagagttgatgcctcttaccaagcttaattactttttcttcaattttattttattcctgtaaaaatactggtcattaaattacagcagaaccctgtaacatgcactcaattatgcttccagtcaggttatatattctctgtgtatatgatgtaacataaccaaattattcctggacaattcagtatctagcttgatctccttttaccatagttccaatattaaaayagggtggaaattgattcttaagatgtatgaatacttcaaaattcaagttatacataggtgcttttagttaaaagtcttaatatccatagaaagcagtaaattagctagccccaggactttgtccttgtgtcacatctgaactctgtcactcatattacgaatgtgatagctggtgggagggtcaagaggagagaggggtgggaagccagaggaagaggtaatgatggagttaccaatgtcataggcctaaaatatatggattgatgtgaggggctctatatattttgtttttctaggttt

SEQ ID NO: 1114 - DNA, 601 bp, Human
cttggtttttaaaaaatgttataattgagtcataaattctggagttgagggcctttctattatatgtctttgtatccttagtacctagactggtgttgctggtatgttagctgttggttcacggctctttcccctcattatgtttttaggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattrcagtaaaaaatattggagatattaatcaagatggctacccaggtagataatagattatgaaatggctatgatttatagattatttgattgtttaaataatagcgctgctgggcacagtggctcacgcctgtaatcccagcactttgggaggctgaggtgggcggatcacctgaggtcgggagttcgagaccagcctgaccaacatggagaaactaaaaatacaaattaactgggtgtggtggcacatgcctgtaataccagctactcccagctttggaaagctgaggcaggagaattgct

SEQ ID NO: 1115 - DNA, 601 bp, Human
cagtacaaagaacatacagaaggaaaccccctataattcaccatgcattattaaactccaagatcttgatttctattttattttctgtgattggaccatgtatatttaacaaaattaagaccataattgtgcataattttgtaacctgcttttgtctctttaggatacatagtagacttttcctatgtcactgagtacttttccaaaatgaagttaacaactgtctgtgaggcatcttctgacaggttcagagcttatttaaccaactgccttgctctcactggatggttacgttgcttcrcaatttttttttttgctcccatgatataaaaagctgtggaaaacattcttacttttgtttatatccttgattatttccttattataaattcctggatgtgaaattgatatatgtgcttcaagacttttgattcggtttcgccaagatgacctcccaaaatggtgcgacatttcccatccgtggtgtttgagtctccctttaaccagcgctttcatcactgctggaaatcaccattaaaaattggaggctttttttggtttgttttttaattttcaaaaagtagcagatttatttttttta

SEQ ID NO: 1116 - DNA, 601 bp, Human
tctttaggatacatagtagacttttcctatgtcactgagtacttttccaaaatgaagttaacaactgtctgtgaggcatcttctgacaggttcagagcttatttaaccaactgccttgctctcactggatggttacgttgcttcgcaatttttttttttgctcccatgatataaaaagctgtggaaaacattcttacttttgtttatatccttgattatttccttattataaattcctggatgtgaaattgatatatgtgcttcaagacttttgattcggtttcgccaagatgacctcccraaatggtgcgacatttcccatccgtggtgtttgagtctccctttaaccagcgctttcatcactgctggaaatcaccattaaaaattggaggctttttttggtttgttttttaattttcaaaaagtagcagatttattttttttaaagttaataatatagaattatagaaaatccagtacgttattcccatcttccacaaaacttgtgtgcatttctctacttttagggtatcatcaaaaggctacactgtaacttctgctgtctaatctggtttttatttaatcttgggctatctctcct

SEQ ID NO: 1117 - DNA, 601 bp, Human
gtggaaaacattcttacttttgtttatatccttgattatttccttattataaattcctggatgtgaaattgatatatgtgcttcaagacttttgattcggtttcgccaagatgacctcccaaaatggtgcgacatttcccatccgtggtgtttgagtctccctttaaccagcgctttcatcactgctggaaatcaccattaaaaattggaggctttttttggtttgttttttaattttcaaaaagtagcagatttattttttttaaagttaataatatagaattatagaaaatccagtacrttattcccatcttccacaaaacttgtgtgcatttctctacttttagggtatcatcaaaaggctacactgtaacttctgctgtctaatctggtttttatttaatcttgggctatctctccttgtcaatacaatagatgacttaactttagtcagttaaatgtttgcccctgtctatgtgtaactgatattttaatatccttactttcctgtcctcataagtaggttgactgtcaaccctgtacacttgttccctctttacttgcagatagtgtgaaagtagaattcaacaaccctttgata

SEQ ID NO: 1118 - DNA, 601 bp, Human
ttgtgtgttgtatgtttaaaaaacaaaatatgttctaggcagaaatgtcttaaaattctacagtatgtaaaatactatatctgtggcaactgtgccttttaaatatgctctcaaaacttaagaatgtatctagttagtatcttagaacctagcagctgtctaaatgtaaaataaaaatagaatggtaaacaataaaggaaaatggaaaaacagggaatgtgggcagtatttgaccctttattggaccctaccttcactgtgaatggacttgtgctctagcctaccaacagattgattccasaagttcgagctagctgtttgggatttggaatgcattttcttgtagaaacactgttctccagaatggctgggtttaccacaagcccatcagagtcagcctaactgaatccacgtggtaatgaaaccccaggccccattctgagttctggtggggagcaatggaggtgggcctcctcacccactcatacccctcaacccaccgcatacctgcatttcttgtgcctgtggcagcagttgggccacagacccgtggagacccctgtggctgctgggagcagggcagccaaaacatacgaaaaga

SEQ ID NO: 1119 - DNA, 601 bp, Human
attccagaagttcgagctagctgtttgggatttggaatgcattttcttgtagaaacactgttctccagaatggctgggtttaccacaagcccatcagagtcagcctaactgaatccacgtggtaatgaaaccccaggccccattctgagttctggtggggagcaatggaggtgggcctcctcacccactcatacccctcaacccaccgcatacctgcatttcttgtgcctgtggcagcagttgggccacagacccgtggagacccctgtggctgctgggagcagggcagccaaaacatacraaaagatgttttcagatggtgaaccagagtagggcgtggaattggattccagcttctcaagtgtttgcggggttgcagtaggcagcgcagagatgggaagaagtttaaaagtttaagtttttgcttgcagagatatcgtgggggtagaaaagttgtcaatcctggcaataggaaggcaaagactgaaggttgtgggtgggagactccgagggaggctgaagagaagggcaagtgtttgtacaatggagactcccaagttcaggattgcctgtattaattcacatactgtagacacgctga

SEQ ID NO: 1120 - DNA, 601 bp, Human
gttgtcaatcctggcaataggaaggcaaagactgaaggttgtgggtgggagactccgagggaggctgaagagaagggcaagtgtttgtacaatggagactcccaagttcaggattgcctgtattaattcacatactgtagacacgctgatcatgagcatctcaggtattaggtgtttgttggtgtaattcttccagagggtatgttggcaagactactcgtaattaaaaatgcacatattctttgactccaaaattctgctgctgggaatttatcccacagataaactcaagtgtgtgcayagatgatgtttgtgaaagcagaaagctcaacaacgtgaatgtctaccgattaggtactggttaaataaaggatgttacactgatacagtgtaacgccatcaggtgtgaaaaacagtgaactagatctatgtgtatatacaggacaagacctctgaaatggatgagaaaaagccacatacagaacaatggcaattaagttcccatttagttgaaattatacatatattttaatatttaattttagataattttaactgacgtgtctggaagaacatacaaggctacttgggtgttcgggtg

SEQ ID NO: 1121 - DNA, 601 bp, Human
aggttgtgggtgggagactccgagggaggctgaagagaagggcaagtgtttgtacaatggagactcccaagttcaggattgcctgtattaattcacatactgtagacacgctgatcatgagcatctcaggtattaggtgtttgttggtgtaattcttccagagggtatgttggcaagactactcgtaattaaaaatgcacatattctttgactccaaaattctgctgctgggaatttatcccacagataaactcaagtgtgtgcacagatgatgtttgtgaaagcagaaagctcaacaacktgaatgtctaccgattaggtactggttaaataaaggatgttacactgatacagtgtaacgccatcaggtgtgaaaaacagtgaactagatctatgtgtatatacaggacaagacctctgaaatggatgagaaaaagccacatacagaacaatggcaattaagttcccatttagttgaaattatacatatattttaatatttaattttagataattttaactgacgtgtctggaagaacatacaaggctacttgggtgttcgggtgggaatggagacaaaatatttactttaacccccaca

SEQ ID NO: 1122 - DNA, 601 bp, Human
atgaggctctgcattgtatacatttatatctattaacagttattttcttcagcaatgggggaaaacgtcacgtgtattttttttcctgtgtttttaagctgtgctgggcagctaaggatgctctctagtatgtgaattagactcacattcaaggtaacagaggctgagcttgtttttcactccttttgtcttcagatcccggcctgtgattaatattcagaaaaccatcacagtaactcctaacagaattgacctccgccagaaaacagcgtgtggggcgcctagtgggatatggtgagcrtccctctgtcttggtgggatccccctcagtttcccacctccacttcatgatgactctattgtcctgaggagccacagggaagatgacaggagtgctgggcaaagggaagagggtctgtcaagtgtttttataacatgttgatcatcaatgggcattggggggattggagagctagggaacatgttgggttttttccactgcaataatggatcttttaagaaatatgtgtttgattttattcagcctccaggttaaatcctgttttgaatatactgctaaccccgctggttataatccttc

SEQ ID NO: 1123 - DNA, 601 bp, Human
taaggactagggtttgcaatggtgaatcctctcacacgtcacagctctgttcttagctgtactctaattcttctttaactttatatgaagttttatataacactaatgaatgtatccactaagacaacagaatgaagatactgacctgtgataaagttcagtgaattatgaaaagggacagtttaaataaatgtactgtctttaattttttttaagtcccccttcacctgattctcagtgtcataagctcagttagccttcatctttccagatttcgagctgtctgcaggtggtttctccrtctccccttctgtggggtcgtctcctgctgtgtggtctctccatgggacctgcagaccttgcacgaagcattcttagagtggatggattatgacttcgtgcacagggggagctgtggccttttgctttgctttttgatgcagccggcattttgtcgagtgtagaaagcaattctttgtgtggcttttaatgacaagaaaatgtatactgtgactcttcaggatctatcatcctttcagtatcatttgtgttatttttacccaaatgccataccttacactagcccacttggataatgggc

SEQ ID NO: 1124 - DNA, 601 bp, Human
tgacctgtgataaagttcagtgaattatgaaaagggacagtttaaataaatgtactgtctttaattttttttaagtcccccttcacctgattctcagtgtcataagctcagttagccttcatctttccagatttcgagctgtctgcaggtggtttctccgtctccccttctgtggggtcgtctcctgctgtgtggtctctccatgggacctgcagaccttgcacgaagcattcttagagtggatggattatgacttcgtgcacagggggagctgtggccttttgctttgctttttgatgcrgccggcattttgtcgagtgtagaaagcaattctttgtgtggcttttaatgacaagaaaatgtatactgtgactcttcaggatctatcatcctttcagtatcatttgtgttatttttacccaaatgccataccttacactagcccacttggataatgggccctttgccagtgtttggaatgaattagagagacaaggagaaaacagtgattctttgactaggcagccagagaaaaaggggaaacatttttattctgttctgatggccattttttcaaaccactctcagtttgactgtagat

SEQ ID NO: 1125 - DNA, 601 bp, Human
aattatgaaaagggacagtttaaataaatgtactgtctttaattttttttaagtcccccttcacctgattctcagtgtcataagctcagttagccttcatctttccagatttcgagctgtctgcaggtggtttctccgtctccccttctgtggggtcgtctcctgctgtgtggtctctccatgggacctgcagaccttgcacgaagcattcttagagtggatggattatgacttcgtgcacagggggagctgtggccttttgctttgctttttgatgcagccggcattttgtcgagtgtakaaagcaattctttgtgtggcttttaatgacaagaaaatgtatactgtgactcttcaggatctatcatcctttcagtatcatttgtgttatttttacccaaatgccataccttacactagcccacttggataatgggccctttgccagtgtttggaatgaattagagagacaaggagaaaacagtgattctttgactaggcagccagagaaaaaggggaaacatttttattctgttctgatggccattttttcaaaccactctcagtttgactgtagatgtgaaatatcatcagagcactc

SEQ ID NO: 1126 - DNA, 601 bp, Human
tttatctttattattatttttttgagaaagttttgctcttgttgcccaggctggagtgcaatggcatgaattcagctcactgtaacctctgcctcctgggttcaagcgattctcctgcctcagcctcccgagtagctgggattacaggcatgcgccaccaagcccagctaatttttgtatttttagtagagacaggatttcaccatgttggtcaggctggtctcaaactcctgatttcgggtgatccacccaccttggcctcccagagtgctgggatgccaggcagaattcactgtgcccrtcctcttttttatttgttaaggtaaaggtctcatcctactgtcgaaagacttctccatctctaaaatatattattcctctgtttagacaactatcctttatcagtgcttcttaaaactttaatacgtataagaatcatctggtgatgctgttattaataaagcagattctgcttccgtaggtgtgactgggcctgaggttctgcatcctcacaggccctcaggagatgctgctgttctagagatctttcccagatagcaaaggcacgaggccacttgaataagcattgactggtttaaag

SEQ ID NO: 1127 - DNA, 601 bp, Human
gacaggatttcaccatgttggtcaggctggtctcaaactcctgatttcgggtgatccacccaccttggcctcccagagtgctgggatgccaggcagaattcactgtgcccatcctcttttttatttgttaaggtaaaggtctcatcctactgtcgaaagacttctccatctctaaaatatattattcctctgtttagacaactatcctttatcagtgcttcttaaaactttaatacgtataagaatcatctggtgatgctgttattaataaagcagattctgcttccgtaggtgtgactgrgcctgaggttctgcatcctcacaggccctcaggagatgctgctgttctagagatctttcccagatagcaaaggcacgaggccacttgaataagcattgactggtttaaagggagaaaatcagtttaggtgctcgggggagtgttgggttcctctgcttatcgttagtattctgtgggttcatgaacttcagccagaaactgattcttaataactgctgctgctgaaaggttttaacttattcttgagctcccccaggtggcacaatgaaaatttaactttgaaacattgttaacagcaaa

SEQ ID NO: 1128 - DNA, 601 bp, Human
ccagagcgtattttccttcttcatttttggccattataacctatcgagactataaatggtagagcttatattctaacactgtttctcctttagctgtacatagaaagaaaaatacattgtgttttacttaccattgagaatactgaaatgtagaaagcagtgtgttgctagtcagaacattaaaatcaaggaatatcaaaattcagcaaagcaaaaaagtattattagcatacagtagtcatttagtgcctaatatagcctaagtcatctttggaagaaaaatgtgtattagatggcctgygggatacctcatatgaggtggggtctgtttgctaggggtttaggatggttaaggtgcaaggttagcccgggcagctatgacagcttgatttggcattatgttcttgctttcaaaatctaattgatgatgaacgggtgtggtggctcatgcctgtaatcccagaacttcgggaggccgaggcgggcaggtcacttgaggttaggagtttgagaccagcctggccaacatggtgaaaccccgtctctagtgaaaatacaaaagttagcgggtatgatggagcatgcctgtaatcacagctac

SEQ ID NO: 1129 - DNA, 601 bp, Human
attagatggcctgtgggatacctcatatgaggtggggtctgtttgctaggggtttaggatggttaaggtgcaaggttagcccgggcagctatgacagcttgatttggcattatgttcttgctttcaaaatctaattgatgatgaacgggtgtggtggctcatgcctgtaatcccagaacttcgggaggccgaggcgggcaggtcacttgaggttaggagtttgagaccagcctggccaacatggtgaaaccccgtctctagtgaaaatacaaaagttagcgggtatgatggagcatgcctrtaatcacagctactcaggaggctgaggcaggagaatgccttaaacccggcaggtggagttgcagtgagccgagatggcaccactgcactccagcctgggcaaaaagagtaagactctatctccaaaaaaaaaaaaaaaaaaaaacaactaattgatgatgagtgtctgtccactatggggctgctggtactggtgccttactgaggcagctttgcagaagtgagtcctcactgtctcaggagctgatgcttacatctgcatattgtcaatcatttttgtcaccaaatatagttccttata

SEQ ID NO: 1130 - DNA, 601 bp, Human
ctccagcctgggcaaaaagagtaagactctatctccaaaaaaaaaaaaaaaaaaaaacaactaattgatgatgagtgtctgtccactatggggctgctggtactggtgccttactgaggcagctttgcagaagtgagtcctcactgtctcaggagctgatgcttacatctgcatattgtcaatcatttttgtcaccaaatatagttccttatatttctgtatacttttatgtacttttattattatcatgttaatattacttgtgtacattcccagctccatagctagagatgattttctrtttatcggtgtgattatcaagaacccattggcatggtgctagtatgctgtttgcttacctgaccttaagctctctgtttcgtcatctctacaatggagatcataataatagtatctttttagaggcctgttgtgaggattaaatgagttaagatatgtaaatcgagtattataatcgttggtatcatcattattattgatacttcttatagtagccctatgaagttagaatggtggtatctccacgttacctatgatgaaacttggactctgaaaggttaagtgacttgctagctaagta

SEQ ID NO: 1131 - DNA, 601 bp, Human
atctccaaaaaaaaaaaaaaaaaaaaacaactaattgatgatgagtgtctgtccactatggggctgctggtactggtgccttactgaggcagctttgcagaagtgagtcctcactgtctcaggagctgatgcttacatctgcatattgtcaatcatttttgtcaccaaatatagttccttatatttctgtatacttttatgtacttttattattatcatgttaatattacttgtgtacattcccagctccatagctagagatgattttctatttatcggtgtgattatcaagaacccattrgcatggtgctagtatgctgtttgcttacctgaccttaagctctctgtttcgtcatctctacaatggagatcataataatagtatctttttagaggcctgttgtgaggattaaatgagttaagatatgtaaatcgagtattataatcgttggtatcatcattattattgatacttcttatagtagccctatgaagttagaatggtggtatctccacgttacctatgatgaaacttggactctgaaaggttaagtgacttgctagctaagtaaggggtagagctgcgtttcaaacccaaatc

SEQ ID NO: 1132 - DNA, 601 bp, Human
tacttttatgtacttttattattatcatgttaatattacttgtgtacattcccagctccatagctagagatgattttctatttatcggtgtgattatcaagaacccattggcatggtgctagtatgctgtttgcttacctgaccttaagctctctgtttcgtcatctctacaatggagatcataataatagtatctttttagaggcctgttgtgaggattaaatgagttaagatatgtaaatcgagtattataatcgttggtatcatcattattattgatacttcttatagtagccctatraagttagaatggtggtatctccacgttacctatgatgaaacttggactctgaaaggttaagtgacttgctagctaagtaaggggtagagctgcgtttcaaacccaaatctgtgtggctgctgggtcacactcttctataccacactgcctccatgccctggtcaaagtgttcttcaaacacaattttactaaaggacagaatggaaatttgatgtgtggcaaagtacatttaaagcttgaattctgcattggtaattgtcacacagggaaatgaactgtgtggaatagccagtcacctac

SEQ ID NO: 1133 - DNA, 601 bp, Human
tctcggggtaagtgtttgtgtttagcataacaaatcaatgtttgaaagaaccatttacaatcctcattaaaactggtgttttttaatttgacagagttgctaaaccttcccaggtgtattttggaggtacagttgttggcgagcaagctatgaaatctgaagatgaagtgggaagtttaatagagtatgaattcagggtaagttggagcagttggtcttttcattataccaaaagctgacatatactaggtatggtcttgagtatgtcattttaataaatcagcaatattaataagcattrtaagtaaatcatgagttaaaaattagtttgccagcttttaaagaacatactggcttatagtaaaaattttatcctccaggatggagaacaattgtcactgttcagaatccagttcagtttagaatgcgttatgatttattccttcctcctttataaggtcatctttctcactgcttgtggttgaaagaatattaatgtatgcctacctttcacaagcccagtttttgtggtgaatgtagatttggtatatgcctgtaggaaaggcagtgactggctctgaaccatttcaaagtaggcaat

SEQ ID NO: 1134 - DNA, 601 bp, Human
tgcacccagccccaggatacatttgcctgagacaaatgctgtactgggcaagctgctgcgataagtggtatcaaccagcactgtcccggtctctccaggacatatcaacaggcatcataagggactttcaaataaaccacaccttccctaaggatcctttctctgcatctataaaggcagcaggtatagctttctataactgtaaatcagcaactctgaaaatcactgagatttcagagctagacagagaacactttagagggaagggactaacattaatgaagccttaataaaatgtctrcagcttactagatactttatactctatcattcaaacttcagaagaatgccaagggtaaacattgtactcattttacaaacaaggaagcagactcagagaggggatataatttgagaccctcaattgaaacctgtaattgtctgacttcagggcttctgttctttgactctgtggcacttggtccccttaaagtccccaaatctcaaattgagataagaaaactgaatccaaggaaaggtatctccccgtcagggtcacccgaccagcaagtagagctgagaccagaccttgggtctgatg

SEQ ID NO: 1135 - DNA, 601 bp, Human
caaatgctgtactgggcaagctgctgcgataagtggtatcaaccagcactgtcccggtctctccaggacatatcaacaggcatcataagggactttcaaataaaccacaccttccctaaggatcctttctctgcatctataaaggcagcaggtatagctttctataactgtaaatcagcaactctgaaaatcactgagatttcagagctagacagagaacactttagagggaagggactaacattaatgaagccttaataaaatgtctgcagcttactagatactttatactctatcattyaaacttcagaagaatgccaagggtaaacattgtactcattttacaaacaaggaagcagactcagagaggggatataatttgagaccctcaattgaaacctgtaattgtctgacttcagggcttctgttctttgactctgtggcacttggtccccttaaagtccccaaatctcaaattgagataagaaaactgaatccaaggaaaggtatctccccgtcagggtcacccgaccagcaagtagagctgagaccagaccttgggtctgatgtctcctcttcaagtgctgtcttcttctggaag

SEQ ID NO: 1136 - DNA, 601 bp, Human
tagaagtattgaagcacagtgtagacatagcagcatccagggttcaatatggacatagaatatttgactgaaaacacttctcagaagttaaatgctccccctgagttttgtttccctttactttacattctcttaactcagaaatatcagaaacttcaaaccagtggatctctaatcagtgtagtttacaaaatcatgttcacaataatcaccaggtctttagcatgctttgaaaaatagttcctggtatcacaaaagttcatttgcattctaaacccatgtaactgagttgttggaattrccagaagcagctttttaggtttctgagtaaacaccatttctatttaattgatatttgcaaactatcctatgtttagagtttaagcttctcagcagcaggagcaacttaagcgctaagctgcctctgagtgggtccagggtctagtttgttcatatacctttttgtagaagatggcaccaagccatttcaggaaatgttattgtttatgagggtctttagtgtgatatcctaagaaaaaggtaaaatggtgtccatcagtcatgcagccctatccctatttttgtatttcacaacatcttt

SEQ ID NO: 1137 - DNA, 601 bp, Human
agaagtattgaagcacagtgtagacatagcagcatccagggttcaatatggacatagaatatttgactgaaaacacttctcagaagttaaatgctccccctgagttttgtttccctttactttacattctcttaactcagaaatatcagaaacttcaaaccagtggatctctaatcagtgtagtttacaaaatcatgttcacaataatcaccaggtctttagcatgctttgaaaaatagttcctggtatcacaaaagttcatttgcattctaaacccatgtaactgagttgttggaattgycagaagcagctttttaggtttctgagtaaacaccatttctatttaattgatatttgcaaactatcctatgtttagagtttaagcttctcagcagcaggagcaacttaagcgctaagctgcctctgagtgggtccagggtctagtttgttcatatacctttttgtagaagatggcaccaagccatttcaggaaatgttattgtttatgagggtctttagtgtgatatcctaagaaaaaggtaaaatggtgtccatcagtcatgcagccctatccctatttttgtatttcacaacatcttta

SEQ ID NO: 1138 - DNA, 601 bp, Human
tcctatgtttagagtttaagcttctcagcagcaggagcaacttaagcgctaagctgcctctgagtgggtccagggtctagtttgttcatatacctttttgtagaagatggcaccaagccatttcaggaaatgttattgtttatgagggtctttagtgtgatatcctaagaaaaaggtaaaatggtgtccatcagtcatgcagccctatccctatttttgtatttcacaacatctttaaagtctgaatgaggaatgttggctacttttgcctaaactggcccttttctttccattgctgaawattaattaaaagaaagtataggccaggtgaggtggctcatacttatgatacccacactttgggaggtcaaagcaggaggatcacctgaagccagcactttgtgaacaacatagaccctgtctcaacaaaaaaatttttaaaaaaattagctgtgagtggtggcatgcgcctgtagtcccagctacttgggaggcagctgaggtgggaggatcacttgagcctgggaggttgaggctgcagtgacccatggtcacaccacttgcactccaacctgggcaacagagtgagaccctgtctcca

SEQ ID NO: 1139 - DNA, 601 bp, Human
tgtagtaatgctgctttcttttctgccctgtaggttcgagtgactgtgtttccctcaaagactgtagctcagtattcgggagtaccttggtggatcatcctagtggctattctcgctgggatcttgatgcttgctttattagtgtttatactatggaaggtaagtcatatctggcatttgaatttcataacaaactttatttcatgttttaaaaaatgggaatcagcactgatagtacgttttctttttcattgcttccttttttctaacattatgaaactcttttgacatagcaaatttsaggaaaattttaccatgaacacctgtatatttaccgaatattttgtatttaaagtatattatttgtacacaataagtttcttcatttgtctctcacacataatttagcatgtttagcaaataacaaatttagattttattactttagcattttcttcacctaagatataagtctggatctaagccaaattgttagggtgtagtaataatctgaatgtgtatccctgctaatttcagtttctgtgaagaatgttcatagcagccattggtgttggttatgcttacagctagatttggaata

SEQ ID NO: 1140 - DNA, 601 bp, Human
tgtgaagagaggctacttcgaagtctttatcctttatgattaatttcactgcagaaatactaacattttgattatagtagcattaggtatgcagtgcattactcattttaaaggacaaaaattttggattctcaaacatgtccggtctggagggttctgtatgaaccatcaaccccctaggatcagactatccttttcttttcattggatccaaaaatataatacataagggttcaagatagtcttacttgcaaatattgagcatctgtttttgctttattttttttgactgacttttgcraatttgagataattttctgatgtcttctagacatgggattgaagctcatgacaaaactcctcctggtatggagttttagccagttttacctctaatgtttacctcgggcagtaggttcctctggcacacatagccagtcaatataaaacattttttcaaggagatgccttgaagaaaaaaaaattttttttgagactgggtctctcgctctgtcacccaggctggattgcagtggtgtgatcatggctcactgcagccttgacctcctgggctcaagcaatcctcccacctcggcctcct

SEQ ID NO: 1141 - DNA, 601 bp, Human
tcaaacatgtccggtctggagggttctgtatgaaccatcaaccccctaggatcagactatccttttcttttcattggatccaaaaatataatacataagggttcaagatagtcttacttgcaaatattgagcatctgtttttgctttattttttttgactgacttttgcaaatttgagataattttctgatgtcttctagacatgggattgaagctcatgacaaaactcctcctggtatggagttttagccagttttacctctaatgtttacctcgggcagtaggttcctctggcacacayagccagtcaatataaaacattttttcaaggagatgccttgaagaaaaaaaaattttttttgagactgggtctctcgctctgtcacccaggctggattgcagtggtgtgatcatggctcactgcagccttgacctcctgggctcaagcaatcctcccacctcggcctcctgagtagctgggactacgtgccaccacatctagctagtttttaaattttttttcataaaggtgaggccttgctgtgttgcccagactggtcttcaactcctgggctcaagcaatcctcctgccttggccttc

SEQ ID NO: 1142 - DNA, 601 bp, Human
cttgaagaaaaaaaaattttttttgagactgggtctctcgctctgtcacccaggctggattgcagtggtgtgatcatggctcactgcagccttgacctcctgggctcaagcaatcctcccacctcggcctcctgagtagctgggactacgtgccaccacatctagctagtttttaaattttttttcataaaggtgaggccttgctgtgttgcccagactggtcttcaactcctgggctcaagcaatcctcctgccttggccttccaaattgttgtaattacagatgtgagccattgcaccyggccttgaaaattattttgatatcaaaaactaaagttggggtttgatatttgaggatgatgttgtgttttctggaagaggtcataaggatggtctttttcagagcattggcagcctttaatgagggtgagacagcagtggatttaaagttagaaacctaagctgtatataatcttggtcaaatcattccatctccctggggcctctgtttgcctcgtctgttaaataagttgattggattattagatgatttcattattttgggagtttttgttttgtttttgtttttttgaagctctga

SEQ ID NO: 1143 - DNA, 601 bp, Human
gtcccagctactagggaggctgaggcaggagaatggtgtgaacctgggaggtggagcttgcagtgagccaagatcgtgccactgcactccagcctgggcaacagagtgagactctgtctcaaaaaaaggaaagaatgttgccaagttggaggcaggaccaggcctcttggctcctggtttattcttcttcccaccctatttactagcacatattattgaaagctgcccaacaaaactctatactgatggaaatgttctggagctgcagcatccagtatggtagccattagtcatgtgtggyggttaggcacgtggaatatggctggttcacttgaggcacagagttttaaatgtaatttaaattaatttcaatctgaatagcctcacggagccagcagctcccatatattgtacaaagtgaatctaggcttttaccttcatgagttgctggactaggaatcagagtttttcaggagattttatttgaccaggttaaattttataaaagacagttccatggccttatgaactagataaaagtaaataggaaaagttctctatcactgaacgaaggaaattatagtagaaagtggaattatac

SEQ ID NO: 1144 - DNA, 601 bp, Human
aaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttrtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacct

SEQ ID NO: 1145 - DNA, 601 bp, Human
agtgaaggcttggagtctccatcctgggggctgagggaaggacagcaggagggacaggaggggaggtatgtctgtctactcgaccctgatttctcagggagacagaacagccaagggcctggggtccccagacttctggccagctgcctctctggggcgaggaagggcctgggtccctgaggggaggagatgtgacagcgggagaggatagtggacaggagcaggtgtgcccagaggggtccccaggggttgggatgggggccaggggagctctgagcctgtgggtgggtgggcatggcctgtgtgtgtgtgtgtgtgtgtgtgtgtgtgtgtgtgtgtccctgtgggggggaaactgcctgtgctgcagtgtgatggcattcagggtggcagtcacacactccagggacctgctggtacataaagtcggggcagcctggtggggtccgggccgcctggagagtaggtgtcctgagcgctgggcccagcccatcgtgatacatctaatgataaacacaaattcctaacttttatgggaaatctcgttgtttctaacattggctcctacttttaaaactttctaaacaaatgaagccaaaca

SEQ ID NO: 1146 - DNA, 601 bp, Human
gaataggagcgaaggaggctgtgtctagaggaaagaggagacacccacccaggactgaggcacccagaggatgcactgaggccccagaggtgtagtcaagagggttataggaatttggagaagagaggcactgctgacgtgtcacttgctctctgagtgtcactagtggacaaatcactggagccagctcctaccacttgaattttgtctgttagagggggtcctgctggtggcttgaaatagaccacgacagaaatgtttacaccacagaaattggcaaacgctacacgtcaagcaccasagaccagagccgttgttatttttttatttaattcaatgtatatgtagaaacatgctctcactctgtcgtcccggtgaaatgcagtgatgccatcgtggctcactgcagcctcaacttcccaggctcaagcaatcctcccaccttagcctcccatgtagctaggaccacaggcatgcaccaccatgcctggctaattaaaaacaatttttttgtagagacagtctcactatgttacccaggctggtctcaaactcctgagcttaagcaatcttcctacctcggcttcccaaagtgctggga

SEQ ID NO: 1147 - DNA, 601 bp, Human
agccaaagggaaatctagagttttacttcattcgttactgaggacccactgtgtgccaggtgtgccgggtgctagggctaccgtgataaacaagacaccattcccttcaccctagaaggggctcagaggacagacaggccatgtggcagtggtctcgccgtgaggcacaagctgtgatggaggaggtacctgaaaagggtgctaggtgcagctcatcaaaggtaatggggaaggctgaggaccgtctggctggacctgaggaggcagcaggccagggggtggccagggtgtgccagcaccragtgtgccagtgccactgtctcagtccccaccttctgtccttctggcttgagtgggaagtcccaggtttgaaatcacagcttgtttctagctgtgctacctggggcagatcacatacccctggcctctgtaaaatagggaacggctgggtgcagtggctcacgcctataattcccagcactttgggaggccaaggtgggaggatctcctgaacccaggaatatgagaccatcctgagcaacatagggagcccctgtctctacataaaataaaaaattagctgggctacttgggaggctga

SEQ ID NO: 1148 - DNA, 601 bp, Human
gtcaggagatcgagaccatcctggctaacacggtgaaaccctgtctctactaaaaatacaaaaaattagccgggcgtggtggcgggcgcctgtagtctcagctactccagaggctgaggtgggagaatggcgtgaacacgggtggtggagcttgcagtgagccaggatcacgccactgcactccagcctgggcaacagagcgagactctgtctcaaaataaataaataaataacataaggagggaatccccatctctccaggtgaaggtgcaggtgggaaagtgcttgcctttgctgagcrcctccccattcatgtgcccacatctgtccccccagcaaaccgctgcaagaaggccccagtgaagagctgcacggagtgtgtccgtgtggataaggactgcgcctactgcacagacgaggtgaggacctggcccgggttggtgtggaacaggcaagggtcgggaatagctggtggaaatgaatctagggttggggcagccagggaatgggtgctgcccccagtgaccccctgtccttctggccagatgttcagggaccggcgctgcaacacccaggcggagctgctggccgcgggctgcca

SEQ ID NO: 1149 - DNA, 601 bp, Human
cttctacggctgggcacggtggctcatgcctgtaatcccagcactttgggagaccagggcgggcagatcacctgaggtcagaagttcaagaccagcctgggcaacatggcaaaaccccatctctactaaaaaatacaaaaattggctgggcgcggtggttcacgcctgtaatcctagcactttgggaggccaaggcgggtggatcacgaggtcaggagatcgagaccatcctggctaacacggtgaaaccccgtctctactaaaaatacaaaagattagccaggcgtgatggtgggcaccrgtagtcccagctactcgggaggctgaggcaggagaatggcgtgaacccgggaggcggagcttgcaatgagccaggattgcgccactgcactccagcctgggcgacagaatgagactctgtctcaacaaaaaaaaaaaaaaaaaaaaaattagccaggtgtggtggtgggcgcctgtaattccagctacttgggaggctgaggcaggagaatcacttgaacccaggaggcagaggttgcagtgagccaagatcgtgcataccgcacaccagcctgggtgataaagcgagacttggtctcaa

SEQ ID NO: 1150 - DNA, 601 bp, Human
agcttgcaatgagccaggattgcgccactgcactccagcctgggcgacagaatgagactctgtctcaacaaaaaaaaaaaaaaaaaaaaaattagccaggtgtggtggtgggcgcctgtaattccagctacttgggaggctgaggcaggagaatcacttgaacccaggaggcagaggttgcagtgagccaagatcgtgcataccgcacaccagcctgggtgataaagcgagacttggtctcaaaaaaaaaaaaaaaaaattctccttctagttgaaacgagccaggggcactggggtctgyggcgtcttccccctgtgacactctctctccctcccacctctgcccaggctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacggtgggcactgggaagggtgctgccagcctaggccaggggtgagcacttctgggcaagggcctgagctgccccctggcctgc

SEQ ID NO: 1151 - DNA, 601 bp, Human
ttgcaatgagccaggattgcgccactgcactccagcctgggcgacagaatgagactctgtctcaacaaaaaaaaaaaaaaaaaaaaaattagccaggtgtggtggtgggcgcctgtaattccagctacttgggaggctgaggcaggagaatcacttgaacccaggaggcagaggttgcagtgagccaagatcgtgcataccgcacaccagcctgggtgataaagcgagacttggtctcaaaaaaaaaaaaaaaaaattctccttctagttgaaacgagccaggggcactggggtctgcggygtcttccccctgtgacactctctctccctcccacctctgcccaggctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacggtgggcactgggaagggtgctgccagcctaggccaggggtgagcacttctgggcaagggcctgagctgccccctggcctgctct

SEQ ID NO: 1152 - DNA, 601 bp, Human
caatgagccaggattgcgccactgcactccagcctgggcgacagaatgagactctgtctcaacaaaaaaaaaaaaaaaaaaaaaattagccaggtgtggtggtgggcgcctgtaattccagctacttgggaggctgaggcaggagaatcacttgaacccaggaggcagaggttgcagtgagccaagatcgtgcataccgcacaccagcctgggtgataaagcgagacttggtctcaaaaaaaaaaaaaaaaaattctccttctagttgaaacgagccaggggcactggggtctgcggcgtsttccccctgtgacactctctctccctcccacctctgcccaggctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacggtgggcactgggaagggtgctgccagcctaggccaggggtgagcacttctgggcaagggcctgagctgccccctggcctgctctggt

SEQ ID NO: 1153 - DNA, 601 bp, Human
aaaatgggacagcaggccaggcgaggtggctcacacctgtaatcccagcactttgggaggccgaggtgggtggatcacctgaggtcaggagttcaagaccagcctggccaacatggtgaaatcccatctctactaaaaatacaaaaaagtagctgggcgtggtggtgcatgcctgtaatcccagctactcgggaggctgaggcagaattgcttgcacctagaaggcggaggttgccgtgagctgagatcgcgccactgcactccagcctgggcaagaagagcgaaactctgtcttgaaaawaaataaaataaaataggccaggcgcggtggcttacgcctgtaatttcagcactttgggaggccgaggtgggcggatcacaaggtcaggagatcgagaccatcctggctaacatggtgaaatcccgtctactaaaaatacaaaaaattagccgggcgtagtggcgggtgcctgtagtcccagctactcaggaggctgaggcaggagaatggcgtgaacccaagaggcagagcttgcagtgagccaagatcgcgccactgcactccagcctgggcgacaaggcgagactccgtctcaaaaaa

SEQ ID NO: 1154 - DNA, 601 bp, Human
tcccatctctactaaaaatacaaaaaagtagctgggcgtggtggtgcatgcctgtaatcccagctactcgggaggctgaggcagaattgcttgcacctagaaggcggaggttgccgtgagctgagatcgcgccactgcactccagcctgggcaagaagagcgaaactctgtcttgaaaataaataaaataaaataggccaggcgcggtggcttacgcctgtaatttcagcactttgggaggccgaggtgggcggatcacaaggtcaggagatcgagaccatcctggctaacatggtgaaaycccgtctactaaaaatacaaaaaattagccgggcgtagtggcgggtgcctgtagtcccagctactcaggaggctgaggcaggagaatggcgtgaacccaagaggcagagcttgcagtgagccaagatcgcgccactgcactccagcctgggcgacaaggcgagactccgtctcaaaaaaaaaaataaaataattaaattaaattaaattaaatgggacagcaaaagccccagctttcctcctgggctgtttcggggaatgaccagttcctccttcaggagtggccagacctgcaactgct

SEQ ID NO: 1155 - DNA, 601 bp, Human
aagaagagcgaaactctgtcttgaaaataaataaaataaaataggccaggcgcggtggcttacgcctgtaatttcagcactttgggaggccgaggtgggcggatcacaaggtcaggagatcgagaccatcctggctaacatggtgaaatcccgtctactaaaaatacaaaaaattagccgggcgtagtggcgggtgcctgtagtcccagctactcaggaggctgaggcaggagaatggcgtgaacccaagaggcagagcttgcagtgagccaagatcgcgccactgcactccagcctgggmgacaaggcgagactccgtctcaaaaaaaaaaataaaataattaaattaaattaaattaaatgggacagcaaaagccccagctttcctcctgggctgtttcggggaatgaccagttcctccttcaggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgt

SEQ ID NO: 1156 - DNA, 601 bp, Human
caacctctgcctcccaggttcaagcaattctcctgcctcagcctcccaagaagctgggattacaggggcccaccaccaagcccagctaatttttgtatttttagtggaaatagagtttcaccatgttggccaggctggtcttgaactcctgagctcaagtgatcctcccgcctcggcctcccaaagtgtgggattacaggtgtgagccaccacgcccggctgacagttttatttcttttttcttttctttttttttttttttttttgagacggagtcttgctctgtcaccaggctggagtkcagtggcgtgatctcggctcactgcaacctctgcctcccgggttcaagtgattctcctgcctcagcctcctgagtaactgggactacaggcatgcgccaccatgaccagctaatttttgtatttttagtagagacgaggtttctccatgttggccaggatggtctcagtctcttgaccttgtgatctgcccgcctcagcctcccaaagtgctgggattacaggcgtgagccaccttgcctggacttatttcttaccttctaatgcttatacatcttatttctttttctgaccttattgca

SEQ ID NO: 1157 - DNA, 601 bp, Human
cttgtgatctgcccgcctcagcctcccaaagtgctgggattacaggcgtgagccaccttgcctggacttatttcttaccttctaatgcttatacatcttatttctttttctgaccttattgcattggcagggacccattagaggttcttagccaggggagcaggagccacatgattggatttgttttgagataattactcaggctgcagagtggaaggtaggtaggatggaggcagagatggagggaaggagattccaggaaagtgaggaagagatgacttctaccccaggctagcggcaycctggctcccacagctctgctcccacaggccctccctgccaggtgggcagcctggactacaggcacagatgtagctctcatctcccttccttgtccctctctgcagaccgaggacgctgctccatgggccagtgtgtgtgtgagcctggttggacaggcccaagctgtgactgtcccctcagcaatgccacctgcatcgacagcaatggggtaggcctgggcataagacagacagtgtctgtcagcaccacccaccctctccagagagaaccctatggagagaggagagggagcaggcag

SEQ ID NO: 1158 - DNA, 601 bp, Human
gcctcccaaagtgctgggattacaggcgtgagccaccttgcctggacttatttcttaccttctaatgcttatacatcttatttctttttctgaccttattgcattggcagggacccattagaggttcttagccaggggagcaggagccacatgattggatttgttttgagataattactcaggctgcagagtggaaggtaggtaggatggaggcagagatggagggaaggagattccaggaaagtgaggaagagatgacttctaccccaggctagcggcatcctggctcccacagctctgytcccacaggccctccctgccaggtgggcagcctggactacaggcacagatgtagctctcatctcccttccttgtccctctctgcagaccgaggacgctgctccatgggccagtgtgtgtgtgagcctggttggacaggcccaagctgtgactgtcccctcagcaatgccacctgcatcgacagcaatggggtaggcctgggcataagacagacagtgtctgtcagcaccacccaccctctccagagagaaccctatggagagaggagagggagcaggcagggatggggcacagctggctc

SEQ ID NO: 1159 - DNA, 601 bp, Human
tcgacagcaatggggtaggcctgggcataagacagacagtgtctgtcagcaccacccaccctctccagagagaaccctatggagagaggagagggagcaggcagggatggggcacagctggctcactggtgccccctcctaccccagggcatctgtaatggacgtggccactgtgagtgtggccgctgccactgccaccagcagtcgctctacacggacaccatctgcgagatcaactactcggcggtgaggctaagacctacgaggtgtgggcgtgggaacagggcaggcacagggcagkgtgggcaggaggggctaagcctgatgccacaggagctggccaagggcaagaggtttggggagcgggggtctggcagaggcccacccaacacagtgcctgtctgccccgcctttccccgccaagatccacccgggcctctgcgaggacctacgctcctgcgtgcagtgccaggcgtggggcaccggcgagaagaaggggcgcacgtgtgaggaatgcaacttcaaggtcaagatggtggacgagcttaagagaggtaggggcaggggctgagggttggggttgctgagagcctaggcagcg

SEQ ID NO: 1160 - DNA, 601 bp, Human
gagcttaagagaggtaggggcaggggctgagggttggggttgctgagagcctaggcagcgggcatccaacggggcaagggtgtcatcacctggacgggggcttgcagtctgggctaaggtcacacagtccggacaggaactccagagctgggagggaccacagaacccagatagaggacaccgaatcccagaaaagggtaaaagcctgagcaggaggcacagaacccaggcggtgggacacagtctggcccaggaagggaccaagagtcttggtgggaggcacctgacttgggcaggggcmtgcacccagcaggggtacatggtcacgctgtggagacacgcagcctcccctcctcgagatcagatacgttttctggaccctgagttcctgggtgatgtccaggtcagggaagtgggggaggtaggtttctaggctctgatgctcctgagcaggggagcccccaccacacccgttcctgtgcctggtgagagcacggctttgcaaggacttccactcttccccaggaggccctgccgtgggtgaggcagatcccagagtaggggccccctcaccagaccctgggtcctctggggcggaggg

SEQ ID NO: 1161 - DNA, 601 bp, Human
ggaagggaccaagagtcttggtgggaggcacctgacttgggcaggggcatgcacccagcaggggtacatggtcacgctgtggagacacgcagcctcccctcctcgagatcagatacgttttctggaccctgagttcctgggtgatgtccaggtcagggaagtgggggaggtaggtttctaggctctgatgctcctgagcaggggagcccccaccacacccgttcctgtgcctggtgagagcacggctttgcaaggacttccactcttccccaggaggccctgccgtgggtgaggcagatcscagagtaggggccccctcaccagaccctgggtcctctggggcggaggggtgtggctggggtgccctgctgactggctgtgggtacagccgaggaggtggtggtgcgctgctccttccgggacgaggatgacgactgcacctacagctacaccatggaaggtgacggcgcccctgggcccaacagcactgtcctggtgcacaagaagaagggtgagctggtggggccgggcgcagggagggggcgtgtggccagagctcggtggggaggacaggcaccacctccccctgcctcctcctctc

SEQ ID NO: 1162 - DNA, 601 bp, Human
ttgcatcctcataagggccagccccttgctcctctctatctagaaaaagggttggccaaggcatcacaccgtggacatctgacccctcctcccacctgtgccggaagccacaggcctcaggcctgttcctgctctcctccagccctggggctgaaggctccatctctggtcctgcccgtgactggcctccctcctctgcctggcccttccaggatgtctgctggacactttgttccagaaccacttttttttttcttgggacagagtcttgctctgccacccaggctggagtgcaatggcrccatcttggctcactgcaaccgctgcctcccaggttgaagtgattctcctgcctcagcctcccgagtagctgggattacaggcactcgccaccacgcccagctaatttttctatctttagtagagatggggtttcgccatgttggccaggctggtctcgaactcctgacctcaggtgatccacctgcctcagcctcccaaagtgctgggattacaggcacaagccactgcgcccggcccctcatctttttctggaaggattttccgtttcgctcctgtgcccttcccagagggcaatgca

SEQ ID NO: 1163 - DNA, 601 bp, Human
tgaggctccattgctgccagggactcaggccaagagggctcgctcttttttttttttttttttttttgagacagagtttcgctcttgttgcccaggctggagtgcaatggcacaatctcagctcaccgcaacctccacctctcgggttcaagcgattctgctgcctcagcctccctagtagctgggattacaggcatgtgccaccacgcatgtctaattttgtgtttttagtagagacggggtttctccatgttggtcaggctggtctggaactcccgacctcaggtgatccgcccgcctyggcctcccaaagtgctgggattacaggcgtgagccaccgcgcccggcccaagagggctctttcttccttcatgggccagggacctgcccagaccattcctgtcccctcctacaactcaggatccacagggtagccaaacctcttggagataaactccccctatatgccccagtccagggggctttgggtttcttgagctgggatcgaagaccccatgtccccaggccagactccccaagggctgtcacaatttgccaagcagcaggagcaacccttcaaggcagggagtgccatggctgg

SEQ ID NO: 1164 - DNA, 601 bp, Human
ggttttgccatgttggccaggctggtcttaaactcctgatctcaagtgatccgcccccctcggcttcccaaagtgcagggattacaggtgtaagccagtgcacctggcctttctagtttttaaatgttggcaaccaatccataattaaaaacaaaggcggggcatggtggctcacacctgtaatcccagcactttgggaggctaaggtgggagaatcacttaaacccaggagttcaagaccagcctaggcaacgtggtgagaccatgtctatacatataatttaaacattagctgggcatrgtagtgcatacttgtggacccagctacttggaaggctgaggcaggaagatcacttgaggccaggaggttgaggctacagtgagccatgttcatgccactgtacttcagcctaggcaacagagtaagaccctgtctaaaaaaataataataattaattttttaaaaatcaaacaaaaaaacaaagaaacaaaacctggctcagtgcagtagctcatgcatgtaatcccaacactgtgggagggcacagtgggaggatcacttgagcccaggagttgcaggccagcttgggcaacatagtaa

SEQ ID NO: 1165 - DNA, 601 bp, Human
gcatggtggctcacacctgtaatcccagcactttgggaggctaaggtgggagaatcacttaaacccaggagttcaagaccagcctaggcaacgtggtgagaccatgtctatacatataatttaaacattagctgggcatggtagtgcatacttgtggacccagctacttggaaggctgaggcaggaagatcacttgaggccaggaggttgaggctacagtgagccatgttcatgccactgtacttcagcctaggcaacagagtaagaccctgtctaaaaaaataataataattaatttttwaaaaatcaaacaaaaaaacaaagaaacaaaacctggctcagtgcagtagctcatgcatgtaatcccaacactgtgggagggcacagtgggaggatcacttgagcccaggagttgcaggccagcttgggcaacatagtaagaccctgtctctattttaaaaaaataataataataataaaggccaggcgaggtggcgtatgcctgtaatcctagcactgtgggaggccaaggcaggtggatcgcctgaggtcacgagttcgagaccagcctggccaacatggtgaaaccctgtctctacta

SEQ ID NO: 1166 - DNA, 601 bp, Human
ggtgggcaggtctgagttgaatgcgctgggtagagcgccctgggtgttgaagtgggtctctggcgccccctggtggtgaagggggatctgagtggttgcccggccccaacctgacccgttagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaggcggggggctgagggycacgacaggtggatgggcggtctggcaccagcactcacagaagaggtgggccgtccgaggccagggccccctgagagagagcagacagtggaacctagcacaggtggtcagagggaaacccggtctgtgctgggaaagagggaagacccattcctgagtttatcagacatttgccctccttcctagaatggggccccctcccacccccgcatgggagatacccccacctgctctgccctagtcctgacgtgtgcacatggcagatctctcagcccctccctcgggcctcatctgtgcaaa

SEQ ID NO: 1167 - DNA, 601 bp, Human
ctctggcgccccctggtggtgaagggggatctgagtggttgcccggccccaacctgacccgttagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaggcggggggctgagggtcacgacaggtggatgggcggtctggcaccagcactcacagaagaggtgggccgtccraggccagggccccctgagagagagcagacagtggaacctagcacaggtggtcagagggaaacccggtctgtgctgggaaagagggaagacccattcctgagtttatcagacatttgccctccttcctagaatggggccccctcccacccccgcatgggagatacccccacctgctctgccctagtcctgacgtgtgcacatggcagatctctcagcccctccctcgggcctcatctgtgcaaagaggacagtaagggcagaggtcagaggagggacaggcagcttgggtgcctgctgctc

SEQ ID NO: 1168 - DNA, 601 bp, Human
tcttagggtgagaggaaagttaccggatttagcaaacagaaatacaggaggttctgaatttcagatagcactttaaaagattattttgtacattgagaggccgaggcaggtggactgcttgaggtcaggagttcaagaccagcctggctaacatggtgaaaccgtttctactaaaaattagacaggcatggtggctcatgcctgtagtcccagctagtcaggaggctgaggcaggagaatcacttgaacccagaaggcgcaggttgcagtgaaccgagatcgtgttaccgcactccagacwgggtgacagagccagactccgtctaaaaataaataaataaaaaggattattttatacattattttatctagcagcccgagatcagaggtgcctagcagaacagttatttctccagtcctggaagggaggcagggtgggcaacccctatgcgtgcccttgccttgtgtggaggcaccgtggatatatgggtagaggtgacatcgaggccaacttgagtccagccctggctctgccacttactcagcagagtcccttggaggactggtgacatatgtccacgccagtcatgctgacgctcag

SEQ ID NO: 1169 - DNA, 601 bp, Human
agcactttaaaagattattttgtacattgagaggccgaggcaggtggactgcttgaggtcaggagttcaagaccagcctggctaacatggtgaaaccgtttctactaaaaattagacaggcatggtggctcatgcctgtagtcccagctagtcaggaggctgaggcaggagaatcacttgaacccagaaggcgcaggttgcagtgaaccgagatcgtgttaccgcactccagacagggtgacagagccagactccgtctaaaaataaataaataaaaaggattattttatacattattttrtctagcagcccgagatcagaggtgcctagcagaacagttatttctccagtcctggaagggaggcagggtgggcaacccctatgcgtgcccttgccttgtgtggaggcaccgtggatatatgggtagaggtgacatcgaggccaacttgagtccagccctggctctgccacttactcagcagagtcccttggaggactggtgacatatgtccacgccagtcatgctgacgctcagggctccgcaggtggcaattcagcagtggctggctttgccttgcttccccagcccctgggtgccatc

SEQ ID NO: 1170 - DNA, 601 bp, Human
ccagactccgtctaaaaataaataaataaaaaggattattttatacattattttatctagcagcccgagatcagaggtgcctagcagaacagttatttctccagtcctggaagggaggcagggtgggcaacccctatgcgtgcccttgccttgtgtggaggcaccgtggatatatgggtagaggtgacatcgaggccaacttgagtccagccctggctctgccacttactcagcagagtcccttggaggactggtgacatatgtccacgccagtcatgctgacgctcagggctccgcaggyggcaattcagcagtggctggctttgccttgcttccccagcccctgggtgccatccaggggatgcacggccgtcctgctgtgtcaggggtggtgttgggaccaggctgggacctgggtgaccctctgaagcactctctctgccccaggacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacct

SEQ ID NO: 1171 - DNA, 601 bp, Human
gctcagcttgggcttaaggagccattttgaggggttcaggtggagcgcagctggtgtgactctggaaccccagctcagctgcttctaacactacctgcgaagcgctcggtggcttgcggaacggtccctgggaggcgggcaggggcaagattcctctctccattgtacaaacgggaaactgagtctcggagaggttaagtaaagcaagggagacctcacagctggtgacagagcccagacttcccccaggtctctggcgggtccgggggtctctcctccccagctgtgccgaggctgcacycgctcatctggaaaggcttcagccgcgcaagggtttcacctgccgcggccttcccgctccggccgtgcgcatctacccccgcccccaacacacaccccgggatcccgggagctggagacgggctcccctcgcagagcctacggccttcccccgcctggccctgctcggcccggcgccccccggcggtgccaacgcggcccttcgttgttcccaaggctgcggctggaagttcgagcccctgctgggggaggagctggacctgcggcgcgtcacgtggcggctgcccccggagctcatccc

SEQ ID NO: 1172 - DNA, 601 bp, Human
cagagggtgggtgaccaggaatgtgcagggcccagcctgccccacggggcccgggtctggggcaggcctgaccaagggaccctgctctccccctgcagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccsagggactactccaccctcacctccgtctcctcccacggtgagtgacctcagccaaccctgcctctcccactaacccttcctctcttccagctcctggagcctcgggcttctgtctgctgtccccaccgcccattctccaacatacacacacgcatgcacacatgcacgcacacacgtgcacacgcatgcacacatgtacacagacatgcatgcgcacacgtacacacatgcatgcacactccctgctcctctcactcttgttttgtcctgccctaggcctccctcccatctgggaacacg

SEQ ID NO: 1173 - DNA, 601 bp, Human
tatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggtgagtgacctcagccaaccctgcctctcccactaacccttcctctcttccagctcctggagcctcgggcttctgtctgctgtccccaccgcccattctccaacatacacacacgcatgcacacatgcacgcacacacgtgcacactcatgcacacatgtacacagacatgcatgcgcacacgtacacacatgcatgcacactccctgctcctctcactcttgttttgtcctgccctaggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccaggtagtacaggggtggccatcctgtctccacagctgtcctgctccatctg

SEQ ID NO: 1174 - DNA, 601 bp, Human
agctgagggagggaggtcagggggcagcactgtgactcccactgagaccctagcccctgcatctctggctgactgcggcctcctgtccccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgaggcatggtggctgccaggctgcggggtgcagccctgcaaggcctggccccagtgwgacacatagggtacctcagctgtgtcaggaacccacccaagtcccttgagcgctaaagcccccatccagcctgagagggtctcccaccccattctccaccccacttctttgcctcccctcttctgaggtctcacccacctccctgggcctctctcctggtcattctctgctaggttttgcctaacaaggcccctttgggctgggatcctagggcctctgctggcctgagatgcctttgggggaacaaggaagtggcacttccctgggcaggcacattcaaagcagcatgaccaggatgca

SEQ ID NO: 1175 - DNA, 601 bp, Human
tttccttcacccccacccctcctcgggccgtgcctccttctggcaccaccctctgactggcctatctgcccaccccaggacccttcccgcagctgggcagccgtgccgggctcttccagcacccgctgcaaagcgagtacagcagcatcaccaccacccacaccagcgccaccgagcccttcctagtgggtgagcactgagggctaggggatcccggctctcctgggacagggagctagcagagggagaagggcagaccccaagccaggtcatctaatgcctcctcctccacagatgggcygaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtc

SEQ ID NO: 1176 - DNA, 601 bp, Human
cacaccagcgccaccgagcccttcctagtgggtgagcactgagggctaggggatcccggctctcctgggacagggagctagcagagggagaagggcagaccccaagccaggtcatctaatgcctcctcctccacagatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccaygtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgctaggccctgccttgcccattcttctggggcctgagaggtgctcccctagggtaggggagcggtt

SEQ ID NO: 1177 - DNA, 601 bp, Human
gaggtttcggtgtgatagtctctcttcctcttctcataaaaccactagtcttactcccacgacaacccattaacttattaacctgtttatccactaatccatgaacggattaacccattcatcaaggaaaagccccagtcacctcttaaaggccccacctctcaatactgccacataggggattacatttatacatgagttttggagaagacaaacattcacgtcataacaggcagcttcacccaagtctgctcctcaagtctgtgggttttctctctgcttctggaaggtgaagcccagkcctgggcaagtattcttttgcagcatcctgaaatatgaccttagcttctaaatgtgtaaaatggagataataatcacacccaccatcacgggatggttgtaagactgaataagttacaatgtgtaaagcatttagaaaaggaatttgcacagagtaagcattcagtagatgataggtactaccccacaaccaccgttatcattattatcaccatcattattatcatcttcattttcatcaccttcattatggccatcattccattcctcagctcagaagccttctatggctccccattgc

SEQ ID NO: 1178 - DNA, 601 bp, Human
acataggggattacatttatacatgagttttggagaagacaaacattcacgtcataacaggcagcttcacccaagtctgctcctcaagtctgtgggttttctctctgcttctggaaggtgaagcccaggcctgggcaagtattcttttgcagcatcctgaaatatgaccttagcttctaaatgtgtaaaatggagataataatcacacccaccatcacgggatggttgtaagactgaataagttacaatgtgtaaagcatttagaaaaggaatttgcacagagtaagcattcagtagatgwtaggtactaccccacaaccaccgttatcattattatcaccatcattattatcatcttcattttcatcaccttcattatggccatcattccattcctcagctcagaagccttctatggctccccattgcttataaaatcaagtcctaactttccccagcatgaaacttctaccaccgtcacctatctctcagggtttcctaaacatactctgaacaagtttcctcactctgccactgtgacccagaaagctatctgttctccttctcccagactctgcctcatctttcaaggcctggttcc

SEQ ID NO: 1179 - DNA, 601 bp, Human
tattatcaccatcattattatcatcttcattttcatcaccttcattatggccatcattccattcctcagctcagaagccttctatggctccccattgcttataaaatcaagtcctaactttccccagcatgaaacttctaccaccgtcacctatctctcagggtttcctaaacatactctgaacaagtttcctcactctgccactgtgacccagaaagctatctgttctccttctcccagactctgcctcatctttcaaggcctggttccaggatcccttcctccaggaagccttccctgrttgccctattccaccatacaccttttttctcggacttcatgtcatggtgcctatattccaagggctctgagccatgtacccctttatatagttaccactatttactgagtgcctactgtataccagctactgtgttggatgctctagatgtagaacctctaattatcaccatcgattcctgggtagtaggcattatttattcatcttacacagatgagaaaatggaggcccacagtggttaaataactagcccaagattgcacagctagtagggctagtggaaagtagaggtggaatttg

SEQ ID NO: 1180 - DNA, 601 bp, Human
caccttcattatggccatcattccattcctcagctcagaagccttctatggctccccattgcttataaaatcaagtcctaactttccccagcatgaaacttctaccaccgtcacctatctctcagggtttcctaaacatactctgaacaagtttcctcactctgccactgtgacccagaaagctatctgttctccttctcccagactctgcctcatctttcaaggcctggttccaggatcccttcctccaggaagccttccctgattgccctattccaccatacaccttttttctcggacytcatgtcatggtgcctatattccaagggctctgagccatgtacccctttatatagttaccactatttactgagtgcctactgtataccagctactgtgttggatgctctagatgtagaacctctaattatcaccatcgattcctgggtagtaggcattatttattcatcttacacagatgagaaaatggaggcccacagtggttaaataactagcccaagattgcacagctagtagggctagtggaaagtagaggtggaatttgaactcaaatcctgcagtaactctaccattctgcctt

SEQ ID NO: 1181 - DNA, 601 bp, Human
gtacccctttatatagttaccactatttactgagtgcctactgtataccagctactgtgttggatgctctagatgtagaacctctaattatcaccatcgattcctgggtagtaggcattatttattcatcttacacagatgagaaaatggaggcccacagtggttaaataactagcccaagattgcacagctagtagggctagtggaaagtagaggtggaatttgaactcaaatcctgcagtaactctaccattctgccttgctcttctttgtagcagtagataagttttcatggatacayacctcatccttttgattagattaagggcccctggagtgtcagtgttcattcatttgtttgatcattcattcattcaacaaacatttcttgagtccccactgtgtgccaggcccagaggttccccagcccaaggcctggcacacagtgggccttcagttagaccttgttgattgactgcgcttttccttgtctgggcagcggaactggaccagtatgtcttccaggactcccagctggagggcctgagcaaggacattttcagtaagtttgtggtgggtggggaggtcttggctcagcctg

SEQ ID NO: 1182 - DNA, 601 bp, Human
acacagatgagaaaatggaggcccacagtggttaaataactagcccaagattgcacagctagtagggctagtggaaagtagaggtggaatttgaactcaaatcctgcagtaactctaccattctgccttgctcttctttgtagcagtagataagttttcatggatacatacctcatccttttgattagattaagggcccctggagtgtcagtgttcattcatttgtttgatcattcattcattcaacaaacatttcttgagtccccactgtgtgccaggcccagaggttccccagcccaargcctggcacacagtgggccttcagttagaccttgttgattgactgcgcttttccttgtctgggcagcggaactggaccagtatgtcttccaggactcccagctggagggcctgagcaaggacattttcagtaagtttgtggtgggtggggaggtcttggctcagcctgcatttcctgccttgttccctggggggtgccctaatacctgacgaccattcattgatgggcagtcagacccctctccccaaggtgggtacaatagagactcaccttgggctttcattgattgtgtgagttggt

SEQ ID NO: 1183 - DNA, 601 bp, Human
cttgagtccccactgtgtgccaggcccagaggttccccagcccaaggcctggcacacagtgggccttcagttagaccttgttgattgactgcgcttttccttgtctgggcagcggaactggaccagtatgtcttccaggactcccagctggagggcctgagcaaggacattttcagtaagtttgtggtgggtggggaggtcttggctcagcctgcatttcctgccttgttccctggggggtgccctaatacctgacgaccattcattgatgggcagtcagacccctctccccaaggtgggkacaatagagactcaccttgggctttcattgattgtgtgagttggtctctggtttttctcaaagtagagcacataggaccagatgaagtgatcggtgagagtatggagatgccagcagaagttgggcagaaaagtcagaaaagacgtgagtgagcccctccctgatccaacctagccttgcttgagacctggcctttccttgactccaaagcctgctgtgggtccaacttgcttccctcgctaagtcctgtctggttgggaggccctttaaaagccaacaggagccttaaaatgtacatct

SEQ ID NO: 1184 - DNA, 601 bp, Human
cagattcccagtatgttagggggcttggagagagtgggctttctccctcttgggaggtggataaggagttgacactaaggcagggactgtcaggaactggacctcacctctccccaaccctatcagtgtcactcacctctgccccagccagttttatccttggggcccccgtcagctcaatccctggcagagaacatgcctcagaaggaaacacatccgtgcgagcatcaggagggaatctccaccaattagagcattcacctgccagccttattcgttcatcagctcttcatggagcccsttctctgtgccaactgctctgctaggtgctaagaattccatcagggcaggacagaaacagctactgctcttagggaaattagggccctttaggggggtcagacattaatcaaataagcaaaagcagaatcgcaaacacaggtgctatgcaagatcccacctcactgcctttgtctcttgcagtgcctttctccagttcctcgttgagctgcctgaatctccctgagggacccatccagtttgtccccaccatctccactctgccccatgggctctggcaaatctctgaggctggaacagg

SEQ ID NO: 1185 - DNA, 601 bp, Human
gttgacactaaggcagggactgtcaggaactggacctcacctctccccaaccctatcagtgtcactcacctctgccccagccagttttatccttggggcccccgtcagctcaatccctggcagagaacatgcctcagaaggaaacacatccgtgcgagcatcaggagggaatctccaccaattagagcattcacctgccagccttattcgttcatcagctcttcatggagcccgttctctgtgccaactgctctgctaggtgctaagaattccatcagggcaggacagaaacagctactgmtcttagggaaattagggccctttaggggggtcagacattaatcaaataagcaaaagcagaatcgcaaacacaggtgctatgcaagatcccacctcactgcctttgtctcttgcagtgcctttctccagttcctcgttgagctgcctgaatctccctgagggacccatccagtttgtccccaccatctccactctgccccatgggctctggcaaatctctgaggctggaacaggggtctccagtatattcatctaccatggtgagtgcggggcctggctccccgaccacctctccctccta

SEQ ID NO: 1186 - DNA, 601 bp, Human
tggacctcacctctccccaaccctatcagtgtcactcacctctgccccagccagttttatccttggggcccccgtcagctcaatccctggcagagaacatgcctcagaaggaaacacatccgtgcgagcatcaggagggaatctccaccaattagagcattcacctgccagccttattcgttcatcagctcttcatggagcccgttctctgtgccaactgctctgctaggtgctaagaattccatcagggcaggacagaaacagctactgctcttagggaaattagggccctttagggggrtcagacattaatcaaataagcaaaagcagaatcgcaaacacaggtgctatgcaagatcccacctcactgcctttgtctcttgcagtgcctttctccagttcctcgttgagctgcctgaatctccctgagggacccatccagtttgtccccaccatctccactctgccccatgggctctggcaaatctctgaggctggaacaggggtctccagtatattcatctaccatggtgagtgcggggcctggctccccgaccacctctccctcctacctgactgctccctgacctcatcctcccca

SEQ ID NO: 1187 - DNA, 601 bp, Human
gacagaaacagctactgctcttagggaaattagggccctttaggggggtcagacattaatcaaataagcaaaagcagaatcgcaaacacaggtgctatgcaagatcccacctcactgcctttgtctcttgcagtgcctttctccagttcctcgttgagctgcctgaatctccctgagggacccatccagtttgtccccaccatctccactctgccccatgggctctggcaaatctctgaggctggaacaggggtctccagtatattcatctaccatggtgagtgcggggcctggctccccraccacctctccctcctacctgactgctccctgacctcatcctccccatactccatgcacttggcagtggtgccctagcaccttctcatgatcctccctccccagcacaactttctctgtccctatttcccaaaaatcaaagcagaagagcagagattcctgaggtggtctgggtgcatgaccaagagtggttgtgtggccttccatatgttgctttccccttctgacccttagtttttccttattttttttaaatgtttttgtttttaaattgcaacatcaatacatgctcactaataag

SEQ ID NO: 1188 - DNA, 601 bp, Human
agattcctgaggtggtctgggtgcatgaccaagagtggttgtgtggccttccatatgttgctttccccttctgacccttagtttttccttattttttttaaatgtttttgtttttaaattgcaacatcaatacatgctcactaataagctaatgacaagtgatgtttacaagaattcactgtctctctcactcttttagtatactgatgtgaatagtttggtgtgcatccttgcatagctttctctgatttgtcttgtttcctaatcagtaaaatggtccctactgacccaccacactgakgggttgtgacttgtctcagggaaggtgtgttttggctgtcagggatgagaccaggaggatgcttccactcaagtccagagcatccattcctggttgcaagacagtttcagtataacgcactggtatctcagaagcagagaagcagttcctgatgtctaggaaaatgagcactgaccacacagcaggaagagtgcaatagtagtacctgccctaagttccttatgagctaattgcacccatttcacagattggaaaagcaaggttccaggagctagatgtaactccagagctctttcttca

SEQ ID NO: 1189 - DNA, 601 bp, Human
agtggttgtgtggccttccatatgttgctttccccttctgacccttagtttttccttattttttttaaatgtttttgtttttaaattgcaacatcaatacatgctcactaataagctaatgacaagtgatgtttacaagaattcactgtctctctcactcttttagtatactgatgtgaatagtttggtgtgcatccttgcatagctttctctgatttgtcttgtttcctaatcagtaaaatggtccctactgacccaccacactgaggggttgtgacttgtctcagggaaggtgtgtttkggctgtcagggatgagaccaggaggatgcttccactcaagtccagagcatccattcctggttgcaagacagtttcagtataacgcactggtatctcagaagcagagaagcagttcctgatgtctaggaaaatgagcactgaccacacagcaggaagagtgcaatagtagtacctgccctaagttccttatgagctaattgcacccatttcacagattggaaaagcaaggttccaggagctagatgtaactccagagctctttcttcagctctgtcctgaaatatcttcctttggaagttc

SEQ ID NO: 1190 - DNA, 601 bp, Human
acaagtgatgtttacaagaattcactgtctctctcactcttttagtatactgatgtgaatagtttggtgtgcatccttgcatagctttctctgatttgtcttgtttcctaatcagtaaaatggtccctactgacccaccacactgaggggttgtgacttgtctcagggaaggtgtgttttggctgtcagggatgagaccaggaggatgcttccactcaagtccagagcatccattcctggttgcaagacagtttcagtataacgcactggtatctcagaagcagagaagcagttcctgatrtctaggaaaatgagcactgaccacacagcaggaagagtgcaatagtagtacctgccctaagttccttatgagctaattgcacccatttcacagattggaaaagcaaggttccaggagctagatgtaactccagagctctttcttcagctctgtcctgaaatatcttcctttggaagttctactctcttctctccagacttcctgagctccacagcccagtttggagtaggggtgacccaagtgcatttctggaatcaatacctggttattctcacaccactctccacccccaatgtaggt

SEQ ID NO: 1191 - DNA, 601 bp, Human
tgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacaggtaaggacccttagggcctgtgagaggtactagaagcaggatcgaggccctggggaaggaattgtctcaaataagatccacaagcaaagctgcctgtagggacaacaggtcatgtttaggggtcagtcgggacaggragggtctccagggagtggaggcatggttgtgggggaatggacagctagagaatccacatcccatccaaatacagccatcagccttcagctgcttgttacccagcagaaaagccagacaatgtggtcagatcttttgaagttgaaaaccctgatttttacatagatattgtgattttttaatttttattttattatttatttattgttgagatggagtctcactctgttgcccaggctagagtgcagtggtgcgatctcagatcactgcaacctccgccctacaggttcaagtgattctcc

SEQ ID NO: 1192 - DNA, 601 bp, Human
gattctcctgcctcagcctccggagcagctggaattacaggtgtgcaccgtcacacccagccaatttttgtaatttcagtagagacaagtttaaccatgttggccaggctggtctcgaactcctgatctcaagtgatccacctgcctcgacctcccaaagtgctgggattacaggtgtgagccactgcacccagcctgatattgcgattttcttttttaaacatgagtgaaatttttaaaagtacagttggccaaagaaagacatatttgagttagatacagcctcaggccgctatcttayaacctccatcttgggaaactcagcccatgaaggctgtaaggactaagtggcccagagggaggggggtccccaggggtaaccctcaccctaaatctggcacctgcttctccatctccagagcacaagacgtcccccacccaatgcccggcagctggagaggtctccaacaagcttccaaaatggcctggtgagtgatgcgggatctctctgccctgggtggtggagatggaagcccatatctggcttcacattgctcattcacttgacacttattcaaccccttctttgttggctcacaca

SEQ ID NO: 1193 - DNA, 601 bp, Human
tgtggaaatgagtgaactaatgaatgagtggtgggtgactgaatgaagcaaatgatgaagactgtatgggggccagatgtggtggctcacacctgtaatcccagcactttgggaggccaaggcggaacgattgcttgagcccaggagctcaagaccagcctgggcaaaatagtgagaacttatctccacaaaaaaacaaaaaagaaaaattagccaggcatggcagtgggcgcctgtagtccccagctactcaggaggctgaggtgggaggattgcttgagcctgtgaggttgaagctgtsgtggaccatgattgtgccattgcacgccagcctgggcgacatagtgagaccccatctctacaaaaaaatcaaaaaattatctgggcatggtgtcacatgtctgtggtcccagctacttgggaggtggagtcaggaggatcgcatgagcccaggaggttgaggttgcagcgagctgtgatcacaccactgcattccagcctgggcaaaaaagccagaccctgtctcaaaacaaaacaaaacaaacaaacaaaaaaactgtgtggggaacagatgtaaatgatggtggcagtgctggccttg

SEQ ID NO: 1194 - DNA, 601 bp, Human
tgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacgscttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccggga

SEQ ID NO: 1195 - DNA, 601 bp, Human
ggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacytgaagcggctgcagccagggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcaggtggggtgaggggcttgggg

SEQ ID NO: 1196 - DNA, 601 bp, Human
accgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccrgggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcaggtggggtgaggggcttggggaagagacatccttgtgt

SEQ ID NO: 1197 - DNA, 601 bp, Human
gctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcaggtggggtgaggggcttggggaagagacatccttgtgttgggcattaactgcggtcttggtgccaagcccagtgctctgtggggtctcttttagtatgcagagcagccgggtggggcagaatggattstctccatttttaagatgaggatgttgaggctcagagaggggcagccacttgccacacagcaagtgagaggcaatggcattctcccagtcaatatttgaaggcccgccatgtgccagtcactggggtatgtctagaatctgagactgacctgggctcaaatttgttttattctttccaccccctgagcacgccaccgttttcttatgctaagagtaaagccatggcctccccttggactctctgcctccattctctcctcttccactccattttgtattcagcaaccagaccaatcttctc

SEQ ID NO: 1198 - DNA, 601 bp, Human
accgttttcttatgctaagagtaaagccatggcctccccttggactctctgcctccattctctcctcttccactccattttgtattcagcaaccagaccaatcttctcagaacttgaatctgattgtatcccatccctgcttacaatccttcagggacactccaccactgtcaggatgaaggctaaattccttaatttggtttcattaagtcggtctgcaatctgcttgagcatttcagcttaatcgccagaggattgcttccatatttccccctaaacatactttacccaagctgtaagrtcctacataattgtgccaataatttagcagtgagcttcctggtagccgaagcaaaaagggaaagaaaaccactgtgtgagttgtgagaaagtaggaatcaataaaggctggagtggtcatggaaggctttctgggaaaggtagaggttgagctaaggaaagaaagtattttaataggtaggaggacccttcatggagctgcccttccattaaggtctagcctggtcaccgtgcctgggtctgaggccctccctccacagggctgccttgagcgacacagtggcgctgtgggagtccctgc

SEQ ID NO: 1199 - DNA, 601 bp, Human
tctcaagtttgtcatgggcatttccagtgccccctgtcctctgggacaccccatgccctctttctgggcaatggctaaccagagtctctcactgcactcgctgcccaggcggagcctctagaattgaaaactttgctgcattcaaaacctgccatcatgtgcccaagtcttagctaaagccatggagaacctctccccttctaggagttaacaaggatgccttgtgcacctagtaacagaagtgacacctactgccaccctttgaggcatttaggacaactgttgtcccaaatttatagayggcagagctaaggtccagaaggcagacaaaacttgattacagaacaagttaactgtctttcattcattccttcatcacacattgtttgagcgcctcttaagtgctgtctgggataggtactggtaagtgcctaatctgaggctcatttccatgaaagatacagtcctgagatcttttatttttatttttattatttcttaaagacagggtctcgctgtgcctaccaggctagaatacagtagtgcgatcatagcttactgtagcttcggaactcctgagctcaagcgatcctcctgcctc

SEQ ID NO: 1200 - DNA, 601 bp, Human
cctaagaggctggggtggaagggaagaggaggggcctcagacaggacctgacttctgtgccttgtctctgccccaccctggggctgaatgaggggctgtgactgtgactggaggtcttacccttgctctttgcctcctaggctgggccctgtctcaggcccccaggctttccccaaactggtgcggatcctcacggccttttcctccctgcagcatctggagtgagtatagactctgggaccccttcctctcaacatctgggtgcagtgctgtgatcatagctcactgcagcctcgaattmctggcctcaagtagtcctcctgcctcagcctcctgagtagctgggaccacaggtgcatgctacagtgcccagcaacctctgggttttgacaaccccaaatcctgcccccaaggcacctgcagaaagaaaagccctcactttgtccctttttttctctcttccgcctactgcatcctcaatgtggctggcacatgagtgatgagatgacgccacatcagatgggaatccccagtgacaaaaaaagttgtagatcctttcgtgacctttgaaactcctttcctcacaacctcatttgctgct

SEQ ID NO: 1201 - DNA, 601 bp, Human
ttttctttttttcagacaaggtctcgctctgtcacccagggtggagtgcagtggtgtaatcatggctcactgcagcctcaatctcctaggctcaagcaatcctcccatctcaaccttctgagtagctgggacaggtgcatgccaccacgtcccgctaatttttgtatttttttgtagagacgtggtttcaccacgttgcccaggctggtcttgaacttctgagctcaagccatcctcctgcctctgcctcccaaagtactgggattacaggcatgagtcactgtgcctggttcaatgggatttttttttttttttttttgacacggagtctcgctctgtagcccaggctggagtgcagtggtacgatctatttattgcaaacttcacctcctgggttcaagcaattctcacacctcagcctcccaagtagctggaattacaggcatgcaccactacacccaactaatttttgtatttttagtagagacggggtttcaccaggttggccaggctggtcttgaactcctgacctcaagtgatccgcccacctcagcctcccaaagtgctgggattaccggcatgagccaccacgcccagttca

SEQ ID NO: 1202 - DNA, 601 bp, Human
ctctgcctcccaaagtactgggattacaggcatgagtcactgtgcctggttcaatgggatttttttttttttttttttgacacggagtctcgctctgtagcccaggctggagtgcagtggtacgatctatttattgcaaacttcacctcctgggttcaagcaattctcacacctcagcctcccaagtagctggaattacaggcatgcaccactacacccaactaatttttgtatttttagtagagacggggtttcaccaggttggccaggctggtcttgaactcctgacctcaagtgatcygcccacctcagcctcccaaagtgctgggattaccggcatgagccaccacgcccagttcaacatgattttttactgaacctagaggatatcaaaatcttcccacactccccctcacaaccaaggtcttagaatggccaaataatttaccggaatttacttagcaatttccttaattgtaggactgtgggacttctccagtaatttctagtgtcctaggtaacactgtaagctagatttcttctccttagtccttccgtccccctctttcttacccgccaccccacttaagtatttattgag

SEQ ID NO: 1203 - DNA, 601 bp, Human
ttattgcaaacttcacctcctgggttcaagcaattctcacacctcagcctcccaagtagctggaattacaggcatgcaccactacacccaactaatttttgtatttttagtagagacggggtttcaccaggttggccaggctggtcttgaactcctgacctcaagtgatccgcccacctcagcctcccaaagtgctgggattaccggcatgagccaccacgcccagttcaacatgattttttactgaacctagaggatatcaaaatcttcccacactccccctcacaaccaaggtcttagratggccaaataatttaccggaatttacttagcaatttccttaattgtaggactgtgggacttctccagtaatttctagtgtcctaggtaacactgtaagctagatttcttctccttagtccttccgtccccctctttcttacccgccaccccacttaagtatttattgagcacctactatgtgcctggcagtgctctaggcacagggatacagtaatgagcaaaacagacacagccctgctccatgtgaagcccacaacccggcagaaaggattacacagccattaaacaaataatgcca

SEQ ID NO: 1204 - DNA, 601 bp, Human
ctgggttcaagcaattctcacacctcagcctcccaagtagctggaattacaggcatgcaccactacacccaactaatttttgtatttttagtagagacggggtttcaccaggttggccaggctggtcttgaactcctgacctcaagtgatccgcccacctcagcctcccaaagtgctgggattaccggcatgagccaccacgcccagttcaacatgattttttactgaacctagaggatatcaaaatcttcccacactccccctcacaaccaaggtcttagaatggccaaataatttaccrgaatttacttagcaatttccttaattgtaggactgtgggacttctccagtaatttctagtgtcctaggtaacactgtaagctagatttcttctccttagtccttccgtccccctctttcttacccgccaccccacttaagtatttattgagcacctactatgtgcctggcagtgctctaggcacagggatacagtaatgagcaaaacagacacagccctgctccatgtgaagcccacaacccggcagaaaggattacacagccattaaacaaataatgccaacacttatttcattatagt

SEQ ID NO: 1205 - DNA, 601 bp, Human
taagctagatttcttctccttagtccttccgtccccctctttcttacccgccaccccacttaagtatttattgagcacctactatgtgcctggcagtgctctaggcacagggatacagtaatgagcaaaacagacacagccctgctccatgtgaagcccacaacccggcagaaaggattacacagccattaaacaaataatgccaacacttatttcattatagtgctgaaaagtggcgcagagggaaaagaggggatgttgtaaagtcatgggacaggtgggggcaggagggtgcactctccctcccatccacctcctcatccctgccctcccacttggccacaggacctaacagtatcctcctgtttaccgagaggtagcttaagtctgtcgacagcgccattcacagcctatgacccagaactctccttgaggtcaaagtgaggcatgcaagtttggtcctgagccctccccctcactgtgtccccgcagtctgtcccagaacaacatcactgacctgggtgcctacaaactcgccgaggccctgccttcgctcgctgcatccctgctcaggctaaggtgagtggggccccggataccg

SEQ ID NO: 1206 - DNA, 601 bp, Human
tatttattgagcacctactatgtgcctggcagtgctctaggcacagggatacagtaatgagcaaaacagacacagccctgctccatgtgaagcccacaacccggcagaaaggattacacagccattaaacaaataatgccaacacttatttcattatagtgctgaaaagtggcgcagagggaaaagaggggatgttgtaaagtcatgggacaggtgggggcaggagggtgcactctccctcccatccacctcctcatccctgccctcccacttggccacaggacctaacagtatcctcctrtttaccgagaggtagcttaagtctgtcgacagcgccattcacagcctatgacccagaactctccttgaggtcaaagtgaggcatgcaagtttggtcctgagccctccccctcactgtgtccccgcagtctgtcccagaacaacatcactgacctgggtgcctacaaactcgccgaggccctgccttcgctcgctgcatccctgctcaggctaaggtgagtggggccccggataccggtcaggtgctgagctggggggctgcagagcgcagggaacccacatcgtgctggctgcaggggac

SEQ ID NO: 1207 - DNA, 601 bp, Human
tttatttatttatttatttggagatggggtctcacccaggttgtagtgcaggggtgcaatgatggctcactacagcctcgactacctggactgaagcgaacctcccacctcagccttccaagtagctgggtcctataccctcctgagccttgttaatttcttcccagcatgatcactgttttacaatattttatttatgtaggtgcttacttcttgctatgcaaagaaactcagaagcaaaaatagaatctgtctggttcataattgtgctaaaaactagagatacaagtatgaactagasagatgtcgttcttgcttttgagtttctttgcgtagtaggaattaggcacatacataaataaaatattgtaaaacagtgattcatgctgggaaggaaactaacaagccccaggagggtacaggacttctggggagatgattcttccgtgggaagctctaggggaaaaggactctaggaagaaagaacagcaggtgcaaaggccctaagtgggaaaaggggctgtgttttaagggtcagaagggccactgtggctgtgtgtagtgaatgagggacagaggctgggcaatggtggaagtaggg

SEQ ID NO: 1208 - DNA, 601 bp, Human
ttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtayttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaacgggacactaatggggcggtgagaggggaacagactggaagcacagcttcatttcctgtgtcttttttcactacattataa

SEQ ID NO: 1209 - DNA, 601 bp, Human
gtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccrggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaacgggacactaatggggcggtgagaggggaacagactggaagcacagcttcatttcctgtgtcttttttcactacattataaatgtctctttaatgtcacaggcaggtccagggtttgagttcatac

SEQ ID NO: 1210 - DNA, 601 bp, Human
tcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaaygggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagctt

SEQ ID NO: 1211 - DNA, 601 bp, Human
caggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaacrggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagcttg

SEQ ID NO: 1212 - DNA, 601 bp, Human
cttttcataacctagccttagaagtcacacagtattacttctgctacatatatatgttttaagaggcagggtctcactctgtcgcccagtctggaatgcagtggtatgatcacggctcactgcagcctcaacctcctgggctaagtgatcctcccacctcagcctcccgaatagctgggactacaggtgtgagtcaccaagcccagttaatctttagttttatttttgtagagccagggtctcactatgttgcccaggcaggtcttgaactcctggcctcaagtgattctcctgcctcagmctcccaaagtgctgggattacaggtgtgaaccaccacacccagcccacttctgccatattctgttggccagtgtgacaaggattgctactgtcctacccaccctcctttcaccacatgtgcacatgcacgtgtgtgcacgtacacacacatacacacacacgcgtgcacacaccagagcccaccttggctcaagtcctcttttctgagaggacttttctttgtggcttcctaaaattcagtggaaaattaattgtttggggatgagaaaggttgaagcaccaaaagcttaccaaggggaa

SEQ ID NO: 1213 - DNA, 601 bp, Human
gtgtgcacgtacacacacatacacacacacgcgtgcacacaccagagcccaccttggctcaagtcctcttttctgagaggacttttctttgtggcttcctaaaattcagtggaaaattaattgtttggggatgagaaaggttgaagcaccaaaagcttaccaaggggaatgtttgcctctgcctctgacacacagctctgtcctgggagtgagctggtttttagcggagacggagtcccaccttggctgcagggagtccgaaagggacttggaagctccgctttctacccagcgagctgcyggcacgactgttgcttttcactcgggcatagtctgctcagaagccccaattcaagacatcttagcttactcctggtggcagtgggagctgcctgttcagctccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcag

SEQ ID NO: 1214 - DNA, 601 bp, Human
tgggagctgcctgttcagctccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcagcttgtaaatagctcaggtgtcaccctgcaagggatccctgcacttgcagactctacagaggccatgggcctcctgtgtgtgyggctacaggagtgagcactgaggtgtgctctgatcatccactgtgccatgtgccaggtttttggtctgacccactgcttttggtctgtgtgatgatgaaatgaggtcagagcctgcagttattaacactaacgatttgttaatgatagctactgtttattattttatttaatttttttgagacagagttttcactcttattgcccacgctggagtgcagcggcatgatctcggctcactgcaacctctgcctcctgggttcaagcaattctcccacctcagcctcccaagtagctgggat

SEQ ID NO: 1215 - DNA, 601 bp, Human
ccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcagcttgtaaatagctcaggtgtcaccctgcaagggatccctgcacttgcagactctacagaggccatgggcctcctgtgtgtgcggctacaggagtgagcactraggtgtgctctgatcatccactgtgccatgtgccaggtttttggtctgacccactgcttttggtctgtgtgatgatgaaatgaggtcagagcctgcagttattaacactaacgatttgttaatgatagctactgtttattattttatttaatttttttgagacagagttttcactcttattgcccacgctggagtgcagcggcatgatctcggctcactgcaacctctgcctcctgggttcaagcaattctcccacctcagcctcccaagtagctgggattacaggcatgcaccaccacg

SEQ ID NO: 1216 - DNA, 601 bp, Human
ttgtaaatagctcaggtgtcaccctgcaagggatccctgcacttgcagactctacagaggccatgggcctcctgtgtgtgcggctacaggagtgagcactgaggtgtgctctgatcatccactgtgccatgtgccaggtttttggtctgacccactgcttttggtctgtgtgatgatgaaatgaggtcagagcctgcagttattaacactaacgatttgttaatgatagctactgtttattattttatttaatttttttgagacagagttttcactcttattgcccacgctggagtgcagyggcatgatctcggctcactgcaacctctgcctcctgggttcaagcaattctcccacctcagcctcccaagtagctgggattacaggcatgcaccaccacgcctggctaatttttgtatttttagtagagatggagtttcaccatgttggccaggctggtaatctgcctgccttggcctcccaaagtgctgggattacaggggtgagccaccgcacccggccactactgtttatttaatgagcagatacatgcaaagcccttatcacagtgcaagggaaattcaaagcgctcagaaagtat

SEQ ID NO: 1217 - DNA, 601 bp, Human
gggattacaggcatgcaccaccacgcctggctaatttttgtatttttagtagagatggagtttcaccatgttggccaggctggtaatctgcctgccttggcctcccaaagtgctgggattacaggggtgagccaccgcacccggccactactgtttatttaatgagcagatacatgcaaagcccttatcacagtgcaagggaaattcaaagcgctcagaaagtattagctcaataagtgatgactgtgtgccagacactgtgctaaactcctactcaagagggataagagtctaggggcargtggcagagactctagaacgagattgcctgggctcaacgcccacctcaccacttacttatgcaagctagttctctgtgcctcagtctcctcatttgtaaaatgggcataaccacagcaccttctttataggattatgtgaaggtgtggtgagctaatacgttaagaattggagctcaataacatgttggctgtcattattacatatatctgtgtttcattcttgcctctggctgggaatgttcttcccagctctccatatggctgatttctcatccttcgggacttgccccattctccaa

SEQ ID NO: 1218 - DNA, 601 bp, Human
caccttctttataggattatgtgaaggtgtggtgagctaatacgttaagaattggagctcaataacatgttggctgtcattattacatatatctgtgtttcattcttgcctctggctgggaatgttcttcccagctctccatatggctgatttctcatccttcgggacttgccccattctccaaccccatcactagttttatctttttcacttatttatgcagtctgctcttgtcctaggacatgagctccaggagggcgggaaacatctcgctttgtacactgctgtgccctctgtaccyagcaaggcgcctgtgtataataggtgctcaataacataaaatgaacaaataatcctcacctaacggtttcattcattctacaaatacatactgacagcacagtcatgaataagatgttcctgccctggtgagtcttatattttagcaaattaaaaaaactctttggacagggctgccaggtgaggttggccagtctgtacactgcacaaaggcacctgggacaagggggaacatgggggctgcaaaccagtctgggttctgcttgccaaactgggagtcctggtgtggagccttttaacc

SEQ ID NO: 1219 - DNA, 601 bp, Human
ggcagggcttggcaacacctcccaccttgcccggaaaaatgctttgcaacctacaggaaggcactagccacagccaagttactcagcagccccacttggctctttctcccaggatgcagcatcatctccatggcctggccccctggcacgtccccgtttcccactgccttctctgtgtgcctagccgggtgccagtgtctctgtagcacctcgtgttcccatgcccaacccctctgcagccccctcaagccctgctctgattccaagcctcatctcccagctcactatcctttccgcaaayttcactgaacatctcgcagaacttgtatgttaaacatgtgacatgtattgttgtttgacagggtgctattgacatttggggtaggacaattcttggaggtggggtggctgttctgggcactgagcatttagcagcatctctggctccaggccactaaatgccagtagcacccctggccactggaacaactaaaaatgccctcctaccctatttccaaggtcgacctaagggggcggaactgtttccattgagacccatgcatcgtataggataagaaactgaggttcttatcatttaata

SEQ ID NO: 1220 - DNA, 601 bp, Human
acacctgctggccagcagcctgaagcagaatcctttactcagattcagccgcacagatgctcactgcagagatctccaaggcctgtggtcatccttgagcccatctcagatttgtgtggatagggtgttagagaacatggaatcagctggatagagtggttcatgcttgtaatcccagcactttgggaggctggggtgggaggatcacttgaggccaggagtttgagaccagcctgggcaacacagtgagactctgtctctataaaaaatttaaaaattagccaggcatagtgtagtctcrgctacttggaaggctgaggcaggaggattgcgtgagcccagcagttcaaggctgcagtgaactatgactgtgcccctgcacccagcctgggtgacagagaccctgtctcaaaaaaaagagaagatggaatcactcggtgaggacctcactcctctcccagtcctgtgaccacaaaccgcatccccgacagtcccagccaggcgctagtctggctgtagctgccctcttgtgtgcagatctccagtctgaatgggctacacgtggaatttactaacactccggttttcattgtgtttatct

SEQ ID NO: 1221 - DNA, 601 bp, Human
tggatagggtgttagagaacatggaatcagctggatagagtggttcatgcttgtaatcccagcactttgggaggctggggtgggaggatcacttgaggccaggagtttgagaccagcctgggcaacacagtgagactctgtctctataaaaaatttaaaaattagccaggcatagtgtagtctcagctacttggaaggctgaggcaggaggattgcgtgagcccagcagttcaaggctgcagtgaactatgactgtgcccctgcacccagcctgggtgacagagaccctgtctcaaaaaaragagaagatggaatcactcggtgaggacctcactcctctcccagtcctgtgaccacaaaccgcatccccgacagtcccagccaggcgctagtctggctgtagctgccctcttgtgtgcagatctccagtctgaatgggctacacgtggaatttactaacactccggttttcattgtgtttatctgtagggttaccttctatttatagcaagtgatgccaagtttccatttctggtagtaatatagtttttcttttccaagtcgctcacacctgtaatcccaacactttgggaggctaagg

SEQ ID NO: 1222 - DNA, 601 bp, Human
tgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcggrcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagt

SEQ ID NO: 1223 - DNA, 601 bp, Human
caaggaacagtgacagtcaattgctaattggcatgaatcatgcagtttgaagctttcttgaactgtctcctgggaggtgtttgtctcttctctcaatctagagcaaccttctgaacattttcaacactgtcaaaaataagtaataataacaaaaaaggaaattgcataagaagattagcaacaattaccatttttcagtacaaatcaaaacagcaacaaaattcaggctcactgtttaaaagtaaagataaatacctctttgggtgtaatttctatgacagtccagcaacatcaatttaayaccttttacatctcaacctttgtttaaaattattttgctctgggaatctgaaatttcaggataaattagcaaatctggtgaaaaagcaaatggccatttttatttttagtgtttttgtttctgtttcatgtaggggttctgtctgagcagacagctaagagcaaaagaagtagggtcaggcacaggtagggtgactcaggtgagttggcccagttcctgggaggagaaaactaggaagaatggggaataagtggggcttgcttcataaatgtgagagggctaggaaaaaaaaattcacca

SEQ ID NO: 1224 - DNA, 601 bp, Human
gattctgcatttctaaccagctcccatgggcagggcagcttccaattcttgttcaggggccacattccaaaaggcctctctgaaatggtagaaattctctgaggacctgattaaggctaggccctaattgggcatcctccaggatccattcccaagctcccaattccacaagaccagtagagctggttttattttggtctaccagtgacaaggaacagtgacagtcaattgctaattggcatgaatcatgcagtttgaagctttcttgaactgtctcctgggaggtgtttgtctcttctckcaatctagagcaaccttctgaacattttcaacactgtcaaaaataagtaataataacaaaaaaggaaattgcataagaagattagcaacaattaccatttttcagtacaaatcaaaacagcaacaaaattcaggctcactgtttaaaagtaaagataaatacctctttgggtgtaatttctatgacagtccagcaacatcaatttaataccttttacatctcaacctttgtttaaaattattttgctctgggaatctgaaatttcaggataaattagcaaatctggtgaaaaagcaaatg

SEQ ID NO: 1225 - DNA, 601 bp, Human
ttcgagcagggccctcgccgaggcaggacagggccacattcggaagtgagagttctctgagtcccgcacagagcgagtctctgtccccagcccccaaggcagctgccctggtgggtgagtcaggccaggcccggagacttcccgagagcgagggagggacagcagcgcctccatcacagggaagtgtccctgcgggaggccctggccctgattgggcgccggggcggagcggcctttgctctttgcgtggtcgcgggggtataacagcggcgcgcgtggctcgcagaccggggagacgggmgggcgcacagccggcgcggaggccccacagccccgccgggacccgaggccaagcgaggggctgccagtgtcccgggacccaccgcgtccgccccagccccgggtccccgcgcccaccccatggcgacggacgcggcgctacgccggcttctgaggctgcaccgcacggagatcgcggtggccgtggacagcgccttcccactgctgcacgcgctggctgaccacgacgtggtccccgaggacaagtttcaggtgggctccccgcccgccccccgctgcccccaggccctgtgagccaggg

SEQ ID NO: 1226 - DNA, 601 bp, Human
ggggctgtgggggtctcctctgggtactagacccacacactggaccagcctctcagctccctcctgcctgaaggctgagctccccggagctggtgaagtaggcgggcgggtctcatttcccttttactgatgagaaaccagagcccggcaaagggactacccagcactggaccgccccctccacgccctcccaccgcgggcccctgcccaccggcactcacccccactgagaggggaggccaggctgcccccagctcccccattcaggctctcaactgaaggccaagccccccaagaagcyggagagcagcgcagagcagcagcgccttccactcgggaacggtgagcggggcccagtgggagcgcctcccttctccctggccaggggcaaggggtcaggggtcagagcagggcctgccctctgagaccctgtcctaggggctggggacgtgctggcctggtgtgtcattccaagggcctaagctgcaccaccagacccaggaaggggacaccttgggtctaagcatgatcttgccagtcgcccctgcccccactgcaccctggttctgggacccccttctcaggcaccttctctgcccgt

SEQ ID NO: 1227 - DNA, 601 bp, Human
cctgcccccactgcaccctggttctgggacccccttctcaggcaccttctctgcccgtccactccctatccttcaggaccagcctagacatagcttcctccagaaaatcatccctggcccccagctgcatgcaggctgaacccttcctgtccccttctccttccttcccagggcactggactccagagaccccctatctccctgagggcagagcctaggaactctgtgtccctcccggcacaatacagggcccatgtcatgggggggtgggtctggtcattggtcatgccttcctatccaytgtgccagctctgctgacactgccaccccccagcacacgcacacttgggtgcacacacgaacacacacattctcatgtctctgcacttacctgtgggctgtctgcacatggcagggctgggtcccctccttggcctgccctggctggaaggaaagggctctgcagcccagtgctgcctgcttctggcatagagtatgtgcttgggaacagtcttccccacgggtgaccccaatgggtgttccctttcccagggattcagaccatgtcagcttcagtccagagagctgtggccatgtcctc

SEQ ID NO: 1228 - DNA, 601 bp, Human
cttctctgcccgtccactccctatccttcaggaccagcctagacatagcttcctccagaaaatcatccctggcccccagctgcatgcaggctgaacccttcctgtccccttctccttccttcccagggcactggactccagagaccccctatctccctgagggcagagcctaggaactctgtgtccctcccggcacaatacagggcccatgtcatgggggggtgggtctggtcattggtcatgccttcctatccattgtgccagctctgctgacactgccaccccccagcacacgcacacwtgggtgcacacacgaacacacacattctcatgtctctgcacttacctgtgggctgtctgcacatggcagggctgggtcccctccttggcctgccctggctggaaggaaagggctctgcagcccagtgctgcctgcttctggcatagagtatgtgcttgggaacagtcttccccacgggtgaccccaatgggtgttccctttcccagggattcagaccatgtcagcttcagtccagagagctgtggccatgtcctccggggacgtcccgggagcccgaggggccgtggaggggatcctcat

SEQ ID NO: 1229 - DNA, 601 bp, Human
tgtgccagctctgctgacactgccaccccccagcacacgcacacttgggtgcacacacgaacacacacattctcatgtctctgcacttacctgtgggctgtctgcacatggcagggctgggtcccctccttggcctgccctggctggaaggaaagggctctgcagcccagtgctgcctgcttctggcatagagtatgtgcttgggaacagtcttccccacgggtgaccccaatgggtgttccctttcccagggattcagaccatgtcagcttcagtccagagagctgtggccatgtcctcyggggacgtcccgggagcccgaggggccgtggaggggatcctcatccagcaggtgtttgagtcaggtagacgctgtggcggggagatggggctgatggggagacccaggctccaagatggaaggaggaccacgcccctttgcatcctggtggtcccacagcagaccggactgttgctcaggtagccagagtttctgcctgtggttctgctgactttggaggaggagggtgagcactgaagtctccctgtcgggggaccttctgcaaggccagcggtccaggcccacatccccacccgggat

SEQ ID NO: 1230 - DNA, 601 bp, Human
gcggtccaggcccacatccccacccgggatgtacagcactccccagtcacctccatccatgtgcatgggccctcctgggccatggggttgcatccttagaaagttctgcctgtgctgctgagaccctccagggtatcggcattcttcaaccaggacagcctgtagcatagcgtccttgccccccataccctggccagcctgcagcatcctcgcccgccattccctggccagccgctgaccccatgcaatcaccagtgccatctgaccagggcacagcagggccgctggtggcagacccacygtgccatcggggcattccatctcaagtccctgacacggtgtctcctcggtgctggacatgggctgggaacaccaagcacagccagggccctggtcttgcacctctggatggtcccaaggcccactgtgttacttcctaaggctgttggttaaattggcacaaactgggaggcttgaaatgacagaaatgccaacatcgaggtgtctcggggccacactccctctggaggctccagggaagaatccttccttgtgtctcccagctgctggtcattatgggggtacccctgtgctccttgtt

SEQ ID NO: 1231 - DNA, 601 bp, Human
ttcctgataatacgcaatggtaatagtttaaatgagtcagagaaagtgaggtcttctcaggctcttaagagcatggcgtttggtccaggctgtacccgctgctctcagctgggcccgtgggtgggccgggcgcccctgctatagccaggaggtcaaggatccactgggaatgccatgctcatctttcgtccccagcatggtttcttaatggggtagaagcagtgtggggggtgcctgccgtggtgggttacagatcttgaccacttggcaccaggggctctgtggggccctggcacttagsagtgacaggagccagtcctgccctgcaggagcacccgggctggtgggcgtctgggggattgttagaatgagtgaggtcattgccgtgcaggaccagcctagcctggctgtctggggggattctggaggaagtggtacctgggagacccctgaaggcacagcaggcaccatccaggcagggcacaaggacggtgggggctgcaggtggaggattcagcaggcgctgaggtcgggagagacctccctgggcctggccccactgccctgtgaggaagggttcatgtggttggtgtacagttcc

SEQ ID NO: 1232 - DNA, 601 bp, Human
gggtgggccgggcgcccctgctatagccaggaggtcaaggatccactgggaatgccatgctcatctttcgtccccagcatggtttcttaatggggtagaagcagtgtggggggtgcctgccgtggtgggttacagatcttgaccacttggcaccaggggctctgtggggccctggcacttagcagtgacaggagccagtcctgccctgcaggagcacccgggctggtgggcgtctgggggattgttagaatgagtgaggtcattgccgtgcaggaccagcctagcctggctgtctgggggsattctggaggaagtggtacctgggagacccctgaaggcacagcaggcaccatccaggcagggcacaaggacggtgggggctgcaggtggaggattcagcaggcgctgaggtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaattt

SEQ ID NO: 1233 - DNA, 601 bp, Human
caggggctctgtggggccctggcacttagcagtgacaggagccagtcctgccctgcaggagcacccgggctggtgggcgtctgggggattgttagaatgagtgaggtcattgccgtgcaggaccagcctagcctggctgtctggggggattctggaggaagtggtacctgggagacccctgaaggcacagcaggcaccatccaggcagggcacaaggacggtgggggctgcaggtggaggattcagcaggcgctgaggtcgggagagacctccctgggcctggccccactgccctgtgagraagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaaga

SEQ ID NO: 1234 - DNA, 601 bp, Human
ttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccaggtgagcctgcacctctgccagcgcaaccaggccaccccggttcacggccgcctccacccactgaccctgaagggaagccaccccaagcctctcccatccaagatggaarggggttctgagtcaggtcactgggccgtggggccggggcctggggttttcccaccctgccacctgcctcccggtctggccacacctgctgcccagcctggacagctgggcccctgagggcagcaaagcagaacagaggcccagggcgaagatgccaccctgtccaagctcatcccaggctgcagcccacgcccccatgggtagccggcccccacccccaagccccaccccagagtcccactccagacagggctggggagcacagaggccacagagctgtgccccccagggcaggtgggag

SEQ ID NO: 1235 - DNA, 601 bp, Human
tgacggctgccctcgggccttccacctggcctgcctgtcccctccgctccgggagatccccaggtgagcctgcacctctgccagcgcaaccaggccaccccggttcacggccgcctccacccactgaccctgaagggaagccaccccaagcctctcccatccaagatggaaaggggttctgagtcaggtcactgggccgtggggccggggcctggggttttcccaccctgccacctgcctcccggtctggccacacctgctgcccagcctggacagctgggcccctgagggcagcaaagcagaacagaggcccagggcgaagatgccaccctgtccaagctcatcccaggctgcagcccacgcccccatgggtagccggcccccacccccaagccccaccccagagtcccactccagacagggctggggagcacagaggccacagagctgtgccccccagggcaggtgggagtttgtccaccaatgcacaggacgccgggcttagtgggggcgggaggcctcctctgcgttcacatcccggtgctccttccccacggcccaccgagccctgcccccattccaaccccacaggacgtggcag

SEQ ID NO: 1236 - DNA, 601 bp, Human
agggccaccccacgaagggtaaatgtccccctgctgggctctcccttcctgtgtctctgcccatctctctgctgtgcctcggttccccctctgtgaaaagacatggtcggagccctggagctccacccgtgggtttggggatctgtcacccgctgtcttgttctgcatgtctctgactggtggacacacgagcagtgggacctggaggtgctccagctgcctgcaggcaacagtccaggaggtgcagccccgggcagaggagccccggccccaggagccacccgtggagaccccggtatgrccacgccccctcctagccgggccacccctcctgtccacatggccacgccccctcctaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgagggta

SEQ ID NO: 1237 - DNA, 601 bp, Human
tctgcccatctctctgctgtgcctcggttccccctctgtgaaaagacatggtcggagccctggagctccacccgtgggtttggggatctgtcacccgctgtcttgttctgcatgtctctgactggtggacacacgagcagtgggacctggaggtgctccagctgcctgcaggcaacagtccaggaggtgcagccccgggcagaggagccccggccccaggagccacccgtggagaccccggtatggccacgccccctcctagccgggccacccctcctgtccacatggccacgccccctcmtaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgagggtagtaggtctactgtgcacagacccagtgttccctctgacagccctgagggccaggg

SEQ ID NO: 1238 - DNA, 601 bp, Human
ctgctgtgcctcggttccccctctgtgaaaagacatggtcggagccctggagctccacccgtgggtttggggatctgtcacccgctgtcttgttctgcatgtctctgactggtggacacacgagcagtgggacctggaggtgctccagctgcctgcaggcaacagtccaggaggtgcagccccgggcagaggagccccggccccaggagccacccgtggagaccccggtatggccacgccccctcctagccgggccacccctcctgtccacatggccacgccccctcctaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgagggtagtaggtctactgtgcacagacccagtgttccctctgacagccctgagggccagggggccccccgtgtg

SEQ ID NO: 1239 - DNA, 601 bp, Human
tggccacgccccctcctagccgggccacccctcctgtccacatggccacgccccctcctaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgaggrtagtaggtctactgtgcacagacccagtgttccctctgacagccctgagggccagggggccccccgtgtgtagacgggggaggagggaggaccacagagccaggaagtgccacagcctttcccactcagtgtggacgccttccaccatgccagccctccgcccccaccatgccaggcctctgcccccaccctgctgccctgggtttcagggtcccagcagtcactgactcctgggtggtgccgggcaggcgcccgctgcccctctgatgctgacccttgggttccagctccccccggggc

SEQ ID NO: 1240 - DNA, 601 bp, Human
ggaccacagagccaggaagtgccacagcctttcccactcagtgtggacgccttccaccatgccagccctccgcccccaccatgccaggcctctgcccccaccctgctgccctgggtttcagggtcccagcagtcactgactcctgggtggtgccgggcaggcgcccgctgcccctctgatgctgacccttgggttccagctccccccggggcttaggtcggcgggagaggaggtaagaggtccacctggggaacccctagccggcatggacacgactcttgtctacaagcacctgccggcyccgccttctgcagccccgctgccagggctggactcctcggccctgcaccccctactgtgtgtgggtcctgagggtcagcaggtgagcggggagtgggggtcagggtgggctcttcaaggagcccaggacctacggggcggatgaattcacctgaaacaggaggagagggaggccaggcgagaaaggctccgggaggcacagggcctggggctgtggggggagcgtggggggctgcggggggaaggggacgctcctagacctccactccagctcctggccctgggcattactgctcccccc

SEQ ID NO: 1241 - DNA, 601 bp, Human
ggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcaggtgagcggggagtgggggtcagggtgggctcttcaaggagcccaggacctacggggcggatgaattcacctgaaacaggaggagagggaggccaggcgagaaaggctccgggaggcacagggcctggggctgtggggrgagcgtggggggctgcggggggaaggggacgctcctagacctccactccagctcctggccctgggcattactgctccccccacaaggcaggacaatgaagggggggatgtcccagcacacgtgggagccctcccctccctgcctcaattcccttccctgcacccctgtgggcaccgcctttcaggagactcccgcactcagccccaaaggaggccaggcccgccaagcaggagagaggtgcgggcgccaggcttgcaggcagcagcctgagggtgcttgggtcgcccctgcctcctgggg

SEQ ID NO: 1242 - DNA, 601 bp, Human
gctccactggcccatgctctttcccagctgtgcctccgccccgtatacaccgtgtgggtgacaggccaccccggcgtggtactccccaggagggtgacagcctaccccagcgtggtactccccgggcaggtgacaggcttccccggcatgcaggctctggcctggcatggcacaagcctcagacccagccctgcccttggggcttttgtggaacagtggcgtggcccacagctgtcactgtccccttccttctagaagcctccctcctcacaccacccatctggagtcaggagcccagccrggcatatacgcagatgcccctccctaaccccaggcagctttcctgcaactgctcccgcagcgggtacctcgtcattaacctcctgggttctgtctctgaacagcagagacctctttcttgtcatcgtgatgtgaaatgtaacgccatgtcagaggaaaagttctggctggccttggcctcccccctcagcctgcccccttcctccagggtggttggacgtggccccagaccccatcctgagcagctctcccaccccctgggagcatccttaggaccggggagcatccaggggctttcccc

SEQ ID NO: 1243 - DNA, 601 bp, Human
tcactgtccccttccttctagaagcctccctcctcacaccacccatctggagtcaggagcccagccgggcatatacgcagatgcccctccctaaccccaggcagctttcctgcaactgctcccgcagcgggtacctcgtcattaacctcctgggttctgtctctgaacagcagagacctctttcttgtcatcgtgatgtgaaatgtaacgccatgtcagaggaaaagttctggctggccttggcctcccccctcagcctgcccccttcctccagggtggttggacgtggccccagaccccrtcctgagcagctctcccaccccctgggagcatccttaggaccggggagcatccaggggctttcccctccagaccgggcagcccctccctcagccatgcagggctgccgggcctcgcagcgccagtgttcacccgagtggaggagctgggatgtggctgtttggggccacaaatggggaattccacagggttcaatgtaatatggtctcctctctgctgggggtgcctgcctggggaccttctcccactctggtcgctcacctatagtgtgggctggccctggtggtgcttgtcgggggcg

SEQ ID NO: 1244 - DNA, 601 bp, Human
cccggctaatttttttttttttgagacggagtgtcactctgtcacccaggctggagtgcagtggcatgatctcagctcactgcaacctccacctcccgggttcaagtgattctcctacctcagcctcccgagtagctgggactacaggagtgtgccaccacgctcagctaatttttgtatttttaatagagacagggtttcaccatattggccaggctggtcttgaactcctgacctcatgatctgcccacctctgcctcccaaagtgctgggattgcaggtgtgagccactgtgcctggyctcttttttttttttttttttgtatttttagtagagacggggtttctccatgttggtcaggctggtctcgaattctcgacctcaggtgatctgcccgcctcggcctcccaaagtgctgggattacaggcatgagccaccgcgcccggcctcctctctgcatttcaaggtgttgagggtggagtggttcatacaactgacccttggggaaaaaataaagcatcaactcttgtcttccctttgttcttgctgtagttttcagtgcccatcagcccacatgtgccctgcccttataccttcac

SEQ ID NO: 1245 - DNA, 601 bp, Human
ttgaaggctatctgccattgccacccattgccactccctgaagctggtgggcacagtgtctctcacaatagtagctcagggtacacgctatgaagaggaggagccaagactctaatcttggcactcttgattctgaagcctgatcaatactaatcattaatgacctattgcttcttttcaaatatttataatgttgatggagatgagggaaatggaacagaaatgcaaggtgcgggagggtagacaactttagttctgcaaatcaatttaggacatgtgctcctctccacatttcctttctttttttttttttttttttttgagacagagtttcgctctcgttgcccaggctggagtgcaatggcatgatctcggctcaccacaacctctgcctctcaggttcaaacgattctcctgcctcagcctcccgagtagctgggattacaagcatgcggcaccacgcccggctaatttttttttttttgagacggagtgtcactctgtcacccaggctggagtgcagtggcatgatctcagctcactgcaacctccacctcccgggttcaagtgattctcctacctcagcctcccgagtagctgg

SEQ ID NO: 1246 - DNA, 601 bp, Human
ccacgagctttggaactagaatgacccttcaaaattgtcagagttggccgggtgtggtggctcacgcctgtaatcccagtactttgggaggccgaggcaggctgatcacctgaggtcaggagtttgagaccagcctggccaacatagtgaaaccctgtctctactaaaaatacaaaaattagccgggcatggtggcatgcacctgtaatcccagctactcgggaggctgagacaggagaatcgtttgaacccaggaggcagaggttgcagtgagccgagatcaccccattgcactccagcytgggcaacgagagcgaaactccatctcaaaaaaaaagaagaaaaaaagtccgggcatggtggctgaagcctgtaatcccagcactttgggaggccaaggcgggtggatcacctgaagttgggagttcgagaccaccctgaccaacatggagaaacctcgtctctactaaaaatacaaaattagccgggtgtggtggcacatgcctgtaatcccagctacgcgggaggctgtggcaggagaatcgcttgaacccgggaggcagaagttgcggtgagccagtgattgtgccattgcactcca

SEQ ID NO: 1247 - DNA, 601 bp, Human
caatgactggttttcacaaccagtcaatgctgtcaggagtaaatgtaataaatacgagtaacggttagcatggtcccagccaaatacataacaaacgctcttgaaacaatgctataattttaaaaaataattttgttgttttgagacagggtctcattctgttgcccagctggagtgcagcagcatgatcacagctcactgtagccttgatctccagggctcaagcaatcctctcccctcagccaccctagtagctgggactgcgggtgtgcaacaccatgcctggctaattaaaaaaaawttttttataggctgggcatggtggctcacacctgtaatcccagcactttgggaggccaagggattacaggcgtgagcctctgtgtctggcccataatatttttttagcctgcaggatgtttaagtagtgccaatgggatcactacttataggaggggaaatcagcaggagtgggcacaggaaggagttgagctgattcaggcccaatgacagcattcgccaacaccccacgagctttggaactagaatgacccttcaaaattgtcagagttggccgggtgtggtggctcacgcctgtaat

SEQ ID NO: 1248 - DNA, 601 bp, Human
gcaacctccacttcccgggttcaagagattctcctgcttcaatttcccaagtagctgggattacaggtatgagccaccatgcctggcaccctcttcttgctaaagcccatgaatatttctccagccccacctaattgtatcttgcagcagcagcaggagctgcagcgcccacttcctcctgtgcatgctctttaacgcatgctcttccttgagtcccgggccatcagaccccctgggttccctcctccctctctggacactcctctgtctccttctcagacttacctcctgtaggagtcamctaaatgcttttgctccctagggctctatcctgggcctcttatttcacaggtcccgggacctcatccactttccccaaacccctgtctcccattcagatctctcttgtggaagcggggagagccactcccaactgttctttggatatttccgcctaaagcacccaagcccttcaagctcaacaggtccagagctgaactgctgatctcccgcctctccccagcacctgctgcacggcctgagttccaggcagtggaggccatcacaggcacccaactccaacctctcccctggccccaca

SEQ ID NO: 1249 - DNA, 601 bp, Human
ccctatcttggcctgaatcaatttatgtcactgtcaccaataacctccccttcttttttctttcttcctttctttctctatttttttttttattttgttgagatggagtcttgctctgtcacccaggctggagtgcagtagtggcgcaagctcagctcagtgcaacctccacttcccgggttcaagagattctcctgcttcaatttcccaagtagctgggattacaggtatgagccaccatgcctggcaccctcttcttgctaaagcccatgaatatttctccagccccacctaattgtaycttgcagcagcagcaggagctgcagcgcccacttcctcctgtgcatgctctttaacgcatgctcttccttgagtcccgggccatcagaccccctgggttccctcctccctctctggacactcctctgtctccttctcagacttacctcctgtaggagtcacctaaatgcttttgctccctagggctctatcctgggcctcttatttcacaggtcccgggacctcatccactttccccaaacccctgtctcccattcagatctctcttgtggaagcggggagagccactcccaactgttct

SEQ ID NO: 1250 - DNA, 601 bp, Human
tgaccctatcttggcctgaatcaatttatgtcactgtcaccaataacctccccttcttttttctttcttcctttctttctctatttttttttttattttgttgagatggagtcttgctctgtcacccaggctggagtgcagtagtggcgcaagctcagctcagtgcaacctccacttcccgggttcaagagattctcctgcttcaatttcccaagtagctgggattacaggtatgagccaccatgcctggcaccctcttcttgctaaagcccatgaatatttctccagccccacctaattktatcttgcagcagcagcaggagctgcagcgcccacttcctcctgtgcatgctctttaacgcatgctcttccttgagtcccgggccatcagaccccctgggttccctcctccctctctggacactcctctgtctccttctcagacttacctcctgtaggagtcacctaaatgcttttgctccctagggctctatcctgggcctcttatttcacaggtcccgggacctcatccactttccccaaacccctgtctcccattcagatctctcttgtggaagcggggagagccactcccaactgt

SEQ ID NO: 1251 - DNA, 601 bp, Human
ctagcatctatttctagccttctccattccatcaaactcccagaccccccacacttccttcagcaggtgacgtaatctcttacttcaggaagagaggcagcccactgttatgctataatcccacaccaactttcttttccctttccccatttgaccctggaagaggtttccttccttcaccctgacactgggccagtcaccctcccaccccctgaggcatcacagggactctctgctggctcatccccccatttccccacaacatcattttcaacctactacatgttcttccacattgaartaatcttcccttgaccctcatctcttttctgtgatcaccttttctctttttcctcttatagtcaaacatgtttttttttttcctttctattcctcaaattcctttttaccacaaacctgttgaaagagctgtctacattagctgcatccaatttttcatctccattcataccttaccccattgcattctggcttctgaccctatcttggcctgaatcaatttatgtcactgtcaccaataacctccccttcttttttctttcttcctttctttctctatttttttttttattttgttgag

SEQ ID NO: 1252 - DNA, 601 bp, Human
ccccgtagggggcagccactgcaatgtctggaaggagtaacagaaaggaagtggctgattgttattcagcctccctagatgactgtaaaactttcctgagcttctctgggaacatcccaggagactaggaaaggggtgcaaagtgtgggtgaaggaggcactgccctaccctccaggagttaacaatcaggtgggagagggacctgccaagtaggattgttataaaaacagtgacaactctcactgtctattgaggaaaatatatcctgaaaattaagcatcattattcccttttctaaatttttttttttttgagatggagtctcgctctgttgtcctggctggagtgcagtggtgcgatctcggctcactgcaacctctgcctcccccgttaaagtgattcttgtgcctcagcctcttcagtagctgggattacaggcgcctaccaccatgcccggctaatttttgtattttcagtagagacggggtttcaccacattggccaggctgatctcgaactcctgacctcaagtgatctgcccaccttgggctcccaaagtgctgggattacaggtgtgagccaccgtgcccaagccccttt

SEQ ID NO: 1253 - DNA, 601 bp, Human
aaaataaatatatacttatgtgagtgtgagtcaatattgaaaaaaagactggaaggaaatccaccaaatgttaacagaggttcctgttaacatttggttcctaaaccttttttgtttttctggtttttgtaatagagttttggaattctgtgccattagcaagtattcctcctccaaattaaaaaaaaaataaaaaattacatctttgacagcaaagcagaagagaagagggactctcagggagggagatgagagagccaaggctccagtgcctcccaggtcccgggtactgttcccaggrtgggggccatacctcgacattgcttagggcccgcatgtagtgggcgccctggggcaggtgcacggccagctctgcttcataggccccctcgccctcgttggctgcgtccatctgcagctccaggacattatctgccccaactaggagcggggagcccgtcctgtggggaaagaggagtgaagccagggagcctgggtctgggcccaggatgtgggaaaagaggggactaaggtgtggagcaggtatgataggcagaaagggccagggtcgggcagaatgggaggcctcctcacacgctgg

SEQ ID NO: 1254 - DNA, 601 bp, Human
tctgcctcaacctcccgagtagctctgactataggcgtgcgccaccatgcccgggtaatttttgtatttttagtagagacggggttttgctatgttggccaggctggtcttgaactcctgacctcgtgatccatccgtctcggcctcccagagtgctgggattacaggcgtgagccaccgcaccaggccaccattattatttctattttacctggaagcccactgggtaaaggggctcagagagggaaagtcactcacccaaggacatgtggcaagggagtgtgaggaccaagattctggmccagaactatgtggctctaaaacctcacccctaaaatctggttattcatgtggagacccggtaccacgacccagcagcctcacctgggcgttcttcttcatggggttgcccagctcacacagcaccaccctggtctcattctccttcttctgattacagatgagtctctcaaagcccttcaggaaggcagttccaagaaagaaattacagagcatcatatatatatatttaagctcccttggaaggtctggaaagatttgtgtgccaaggtagggaggggggggtttcttggggtggggt

SEQ ID NO: 1255 - DNA, 601 bp, Human
cagccctgccctgaatgtggcctccagtcttcaccctccaagatcaccactattctttttctttttttttttttccgagacggagtctcactctgtcacccaggctggagtgcagtggcatgatctcggctcactgcaacctccacctcccaggttcaagtgatttttctgcctcaacctcccgagtagctctgactataggcgtgcgccaccatgcccgggtaatttttgtatttttagtagagacggggttttgctatgttggccaggctggtcttgaactcctgacctcgtgatccayccgtctcggcctcccagagtgctgggattacaggcgtgagccaccgcaccaggccaccattattatttctattttacctggaagcccactgggtaaaggggctcagagagggaaagtcactcacccaaggacatgtggcaagggagtgtgaggaccaagattctggcccagaactatgtggctctaaaacctcacccctaaaatctggttattcatgtggagacccggtaccacgacccagcagcctcacctgggcgttcttcttcatggggttgcccagctcacacagcaccaccctgg

SEQ ID NO: 1256 - DNA, 601 bp, Human
tagagatggggtttcaccatgttggccaggctggtctccaactcctgacctccagtgatccttctgccttggcctcgcaacgtgctgggattacaggtgtgagccaccgcgcctggcctcgaaagacccttctgtatggaagggacctgaggggctctgcacgggggtcagacgggggaagggtggtgggtaggcacgctcgccaggtcagtacctccgtatctgcagctggaaggacacagactccccagcctcttccagattccccacgctcaccaacatcgcgattcctatctgggasatgaggagggccaaggtcactgcccaagtgccccacttaggacagccctgccctgaatgtggcctccagtcttcaccctccaagatcaccactattctttttctttttttttttttccgagacggagtctcactctgtcacccaggctggagtgcagtggcatgatctcggctcactgcaacctccacctcccaggttcaagtgatttttctgcctcaacctcccgagtagctctgactataggcgtgcgccaccatgcccgggtaatttttgtatttttagtagagacggggttttgct

SEQ ID NO: 1257 - DNA, 601 bp, Human
ctcagctcactgcaacctccacctcccaggttcggttcaagctattctcctgcctcagcctcccgagtagctgggattgtaggtgcgcaccaccatgcccagctaatttttatatttttagtagagatggggtttcaccatgttggccaggctggtctccaactcctgacctccagtgatccttctgccttggcctcgcaacgtgctgggattacaggtgtgagccaccgcgcctggcctcgaaagacccttctgtatggaagggacctgaggggctctgcacgggggtcagacgggggargggtggtgggtaggcacgctcgccaggtcagtacctccgtatctgcagctggaaggacacagactccccagcctcttccagattccccacgctcaccaacatcgcgattcctatctgggagatgaggagggccaaggtcactgcccaagtgccccacttaggacagccctgccctgaatgtggcctccagtcttcaccctccaagatcaccactattctttttctttttttttttttccgagacggagtctcactctgtcacccaggctggagtgcagtggcatgatctcggctcactgc

SEQ ID NO: 1258 - DNA, 601 bp, Human
tttttttttttcttttgagatagaatctcgcactgtcgcccaggctggaaggctggagtgcagtggcccaatctcagctcactgcaacctccacctcccaggttcggttcaagctattctcctgcctcagcctcccgagtagctgggattgtaggtgcgcaccaccatgcccagctaatttttatatttttagtagagatggggtttcaccatgttggccaggctggtctccaactcctgacctccagtgatccttctgccttggcctcgcaacgtgctgggattacaggtgtgagccacygcgcctggcctcgaaagacccttctgtatggaagggacctgaggggctctgcacgggggtcagacgggggaagggtggtgggtaggcacgctcgccaggtcagtacctccgtatctgcagctggaaggacacagactccccagcctcttccagattccccacgctcaccaacatcgcgattcctatctgggagatgaggagggccaaggtcactgcccaagtgccccacttaggacagccctgccctgaatgtggcctccagtcttcaccctccaagatcaccactattctttttctttt

SEQ ID NO: 1259 - DNA, 601 bp, Human
aaagggaaccaggcttcttcaaagacctttttttttttcttttgagatagaatctcgcactgtcgcccaggctggaaggctggagtgcagtggcccaatctcagctcactgcaacctccacctcccaggttcggttcaagctattctcctgcctcagcctcccgagtagctgggattgtaggtgcgcaccaccatgcccagctaatttttatatttttagtagagatggggtttcaccatgttggccaggctggtctccaactcctgacctccagtgatccttctgccttggcctcgcaaygtgctgggattacaggtgtgagccaccgcgcctggcctcgaaagacccttctgtatggaagggacctgaggggctctgcacgggggtcagacgggggaagggtggtgggtaggcacgctcgccaggtcagtacctccgtatctgcagctggaaggacacagactccccagcctcttccagattccccacgctcaccaacatcgcgattcctatctgggagatgaggagggccaaggtcactgcccaagtgccccacttaggacagccctgccctgaatgtggcctccagtcttcaccctc

SEQ ID NO: 1260 - DNA, 601 bp, Human
taaaaagtgcaagtgtctttcagctcaccccagacacaagccagcatgctcctccatgttcacttgaagtgctcccagggaccaagcgtggcccacagaggcccacagcacacccggacccctctccctcctcccatcccctctgccccgtgggtcccggggaggccgggccagagaccagagagcctgctcactacgagaactggatcctgaagcctcgagggctgctcgggctctggcaggaagatctgtctgcgatcccgcttgtgatgggccgggtgaatgggggaggggctggggmtgggcagcccccagtccacctgggggggcaaaggagtggtcaggcccaggtctcccccgaaccccagcccacagaggtgccccggtggttggtctggggccgccttcccaggtctttcttccacccagctcttaccttgagagggttgacaggaggctgtgggaagcactgaaggcccccctggggctgtatatccaggatgtagagcaggtcggagggctgggactgtcccggaaggtggatgctgaggtgaagaccattcacagtcccagggccattgttgtggagctgaaggggtgg

SEQ ID NO: 1261 - DNA, 601 bp, Human
tccttgggcctcttgcctcactcaaggggaagggcagggctaggaagaagtgcatcttgtccttgagaccagccaggaattcctgaaggcaggacttacaccctctataccctctatatcctctgaatctttttggtggcaggggtgtctaaaggcctcagaatttcaggtgctatcctttccagtggtatgtgtctggaagggttcccaggagaatgacatttttgtgtttgttttgccttttttgctctactagagaaagacattctatttttttctttttttttgagatggaggctcrctctgttgcccaagctggagtgcagtggtgtgatctcggctcactgcaacctccgcctcctgggttcatgcaattctactgcctcagcctcccgagtagctgagattacaggcatgtgtcaacacgcccggctaattttggtatttttagtagagatggggtttcaccatgttggccaggctggtctcgaactcttgacctcaggtgatctaaacgctttggcctcccaaagtgctgggattacaggtgtgagccaccccactggaccgagaatgacattctaatagtggagacatagac

SEQ ID NO: 1262 - DNA, 601 bp, Human
tccaaaacattccttcggtcatctcttctctggccccaaaaggaggcagcatgctcagcatcagggctcagtctctttattaggcagcaggagggggggtagcccagctctgttgggagggaaacgacaccaagaggacccaatggaacagctccaacccaaagcttggaggcaacttgttggagaaggggcggtgcaggtagcacgcccaaccctcctgctagaatagtgtaggctgcaccatcactccccctcttcatcatcttcttccaggggtggccggttccgcttgaagaagccracctgggggtacacgggggccaaggtcagggtatacagatgatttgctggccccagagcacatgtgaggaagtatgctagctatgagcacctccctggaccagcgcagaacatgaagcccactgtactcacaaatggatgccttttgacatttagagataatgcatggaacgaattgttgggtttttgttttttctcccctgagtttttatttttttcttttttttagagggagtctcactctgtcacccaggctgtagtgtagtggctcgatctcggctcagtgcagcctccacctccc

SEQ ID NO: 1263 - DNA, 601 bp, Human
gtttcttgaaagtggaaactcttacctgacccaaaaggtcatagcccagctcctcggcgatggccgaggctgcttccgggcccccggggatctccgctgcccattcattgacaaattgccttttcgcttttgcactgttcagtgcacaccaagcgcaaaagaggacgaaagcagtgcactgcagactccaggctcttcgctccatagctcacacactcgcttgaacaagagtgggaagggaagaggaaaaagaagcaagataggagaaaagccagacagactcccccttcccaccctcggrctctagaccactcctggctcctggttgctctgcgaagagctaggaggcgcgagaggagaggctgggcggcggcgagcgctcagtgaagcgcttcggtctccaggctgagtggagccccagcccttcccagccagaatggaaatgagtgtttacacgtcaaatcgacgaaagccatctcttgacgtcagatctacctggactaagatccgaatggtattcccggcggggcggagaagcggctaaaataagcagccagggattaggaaaaggaaggaactgtttgctgggatcagttaagtc

SEQ ID NO: 1264 - DNA, 601 bp, Human
gcttgagtgtatctcaagttccctgaacaagcgtggagggatttttcttccaaaccgcgcgggaacggatttcaattctagagcggccaacagtaagcataagccctacccagctgcagcggcttccttctgcttggctgcgcccagcctaaacagtaaataatgcaagctttctctctctccaagcgcgacaggggcgagggctggagcagctccttgctctttgctactctgggctctggagagtgcaacctggggctcccacttggaagaccgcgctccagtcccgccagtcccctgrggccccagaaagtttcttgaaagtggaaactcttacctgacccaaaaggtcatagcccagctcctcggcgatggccgaggctgcttccgggcccccggggatctccgctgcccattcattgacaaattgccttttcgcttttgcactgttcagtgcacaccaagcgcaaaagaggacgaaagcagtgcactgcagactccaggctcttcgctccatagctcacacactcgcttgaacaagagtgggaagggaagaggaaaaagaagcaagataggagaaaagccagacagactccccctt

SEQ ID NO: 1265 - DNA, 601 bp, Human
tagactagaagtcacactccctagggtcccctcggaatcgctcagctataagcagtctcccacttaatgtcttgacgcccacccacctccaaccagctacctatcgaccaagccttcacttggacaggcaacaataagctgaaattcccgggaaaacgattacgtacttggctgaagaacaagaaagaaatagatcccttccccatagtcagttcggcatctcgaccctgcagtgggactggccgggcaaagttatgaagcttggactttataagttcccagtgaaaagccggagctcccyagagagtcgcggggatagatggtcccgtgtctttcacccaccatttctccccccagcttcccaggctactccgcggcctcccaacctcctggtcgcgagtcccagcagctggcactcttccaatgccctgggcgtgcccttacaggctgccagggcggacagccccaagcctgcttagccccttgcatcaggacttggatctgatgctgccatattgaaaagaaggcaacagccggctcctgacgcagaccgcctcagtcccgggggatggagcgcactgcttctcccgggggcgcttgg

SEQ ID NO: 1266 - DNA, 601 bp, Human
tctagcaagagcaggcgaattccccagagggttcggtctacagaatcgccaacgcccccgccgattactcatccgtgactccagcggcgtctcaaccaccacctccagaaaaaacgcgccaaaatgttttacaactgcctcctcccacgcttcaatgcagaccaacttcccaagcagggggcgagggcttgattccgagccaaggaaaggaaagctctagactagaagtcacactccctagggtcccctcggaatcgctcagctataagcagtctcccacttaatgtcttgacgcccaccyacctccaaccagctacctatcgaccaagccttcacttggacaggcaacaataagctgaaattcccgggaaaacgattacgtacttggctgaagaacaagaaagaaatagatcccttccccatagtcagttcggcatctcgaccctgcagtgggactggccgggcaaagttatgaagcttggactttataagttcccagtgaaaagccggagctccctagagagtcgcggggatagatggtcccgtgtctttcacccaccatttctccccccagcttcccaggctactccgcggcctccca

SEQ ID NO: 1267 - DNA, 601 bp, Human
attagccactattagtgatcgtttgattttccactaattcaaggctttcagaaaagaacatgctacatttagggcagttgtcccactttagagggtttgtacttctccgggtatctattgacatctttggttcatttaggactatattcattattcttttgagctagtctccctttactcagtactaaatttgaggctaccaaatcctctaggtaaccctgcatttttaaaattaagaaacaaacagttgacaacagtatattacagaagaaacgtgttctttaaattggtgattctcatygcccagagaattttaaaatagagaagcttaggccctgctccaagcctgaatctcagtgaatcttcctataagctgtggatggaactggggagagaaatcagcagccgcagaaaaagatcaccagtgcttagctctgttttctctgctgtcaactggtttttcttcttgtcactaccttaatccaagctttatcctgaggcaataaggtacccaatatagtaatgctaaattagtgtaattttagtaatattaaacaaaaagagaaataagcagaaccaggaacgtgctatcagccttcta

SEQ ID NO: 1268 - DNA, 601 bp, Human
tctcataaacactagctccttatacagcaaaaccaaatagaaataatagacttttttttcagttatactgaaatgttattgaaagtaaggcccatgtatttctttgagcccacattggtattaaagtgtttggtacataataggtacctaataaaaggttgttgattgactgtattgtcaaacatttttattagtgctgccctctcattttaaatattcactttcatgctcttagactgaatttgtgagtgtacatataaaattaactttagatatatatgtaattatataattaaactgygtatatatgtgtaaaattaactttggctcaaccaattcaacccaatcttgttattattatgtgccattataattttatggaaagaaattagaaataatacagataaacaatcttggtcacaataaaaaaaaaaccacatttgcaaaatgcttctgtttttattagaaatcataaagaaagcagataagctagagtattggtttgaagacaaatgtacaacacttacacgatcatcatcagataatctcttagtgatatgaaaggcactccttcgagaccttctggggtggtttttatgtt

SEQ ID NO: 1269 - DNA, 601 bp, Human
attttttacaaagttatacctgtgctggagaatgaattcttagcattttttcataatgtcttgagattccacccctcccccaccaaatcagctatcaaggggatgtataaagagtagaatgggccatcttcattgtcatgagatactttgagtaagaataacagttaggtatgctctattctgtccaattttctcctatgaaagtgagaaggcaggtcagtttgagttctatgtgcattaatgggcatgcagtttgggcatgcatttaggcaaagaaggaaatctctcttctgcttagccyggggactaagcctagccagagtgctagaagttattctgcttttcagagcccacacacgatgagccctctcccttgaagtgagtaagggaagacctcagtggacaagaaacttctgtaataaggtccagggcctctgatttggtctcccacatcaagcaataacttgacaaaaaagagctagcagtgggtgtagatgagctatacggtcactgtccgtggtcctaatacagcattgtcaggatgttgttgtttcttttacattcgaacactggtgacccaggccattcccattccctaccc

SEQ ID NO: 1270 - DNA, 601 bp, Human
gtatttaatatgagacacagatcctgggtgatgaatgagcactactgaccacgcacacttaccattaattcagtctcatgtattatgcaaagagatctgacaatacgaaaattacctgccccatatttacagcataatactattatacttgaagccctgagagagtgaggggctgccttgtagttatattcattatgagataattctatactcttatttttcttggcaatatgactatttcctaccccaaacacatcttttctgctgtatgcatgatgacaattcagtgtgtggtggaatrttgttaatgtgagagtactcatgaatcagctccaaaaataaaaaccgaaaaataatttgcaactgaaggataaaaccatccactaagactgccctcaattttcaattaaaaatatactgcaaacctattaaaaataatgggaagaacctgaaagctagaaattagtcactatgatttatttttaaagtgcttgtattttcaagcttaattgttttggcttaaaatacctcaatgcttggaatgctgcctatcatctgagttgatctctggaagctgactgctagggaataagtactaatc

SEQ ID NO: 1271 - DNA, 601 bp, Human
tttcatttgactacagattaaactggcacctcagtgagaagaagggattgcccactggggagatgaatatttcctctattacagtaaagtgcacctttagggggaggagaagcagtcagtgaaatgataattccctaaattatttacattgtggttacagtggaagcaaaagttcagtctgctttcatcagcaaatggaccataatactcatttttatattgaggtttcagggctccatggctgaaaatttgtctgcttttatggattgagtcaacaagccaagagactgctgttataatrcttttatagattaatttctctgtctttacatacaacaggtagaaattgcaaatattttataaagtaagaatggtgctgtatccatgcaaatttgaaactccctcccctgtgcttcgacctctgcttaaaagtatttaatatgagacacagatcctgggtgatgaatgagcactactgaccacgcacacttaccattaattcagtctcatgtattatgcaaagagatctgacaatacgaaaattacctgccccatatttacagcataatactattatacttgaagccctgagagagtgagg

SEQ ID NO: 1272 - DNA, 601 bp, Human
gattgttggccaaagtcagagaagaaggcctctatgtcagttgcaggaacaattttagactgtagttgttaagagtatggactctggagtcgtgaattatagtcccaccactagcagccatggattttggcaaattattctactttccaatatctctgtttttccatctgttaaatgggcataattactatttctacaacacagacaatcatgagaacaaaatgaattaattcatatcaaacattttagaatagtgtttgtcacacaggaaatgcacaagtgttaactgataagtctcttstgctgcaatgagcaaatacttaagatagtggcaagaggcccggtgcggtggctcatgcctgtaatcccagcactttgggaggccaaggcgggtggatcacctgaggtcaggagttcgagaccagactgaccaatgtgacaaaaccccatctctattaaaaatacaaaaattagctgggcatggtggcgggcatctgtaatccaagctactccagaggctgaggcaggagaatcgcttgaagccaggagacagagattgcagtgagctgagatcatgccattgcactccagcctgggcaac

SEQ ID NO: 1273 - DNA, 601 bp, Human
aaagttgagagtaaggccaaatgaacccccagagtgctgctcttctcccgattgtcccaaatggacatcacttgaaaagatgaatcacctgtgctccttctctttgaactacatggctttgaagaattttatccctaaatttctttcatttataataacatgctcaaccctttcatctatggaagctctatttgatagtcgatgttttcatctccccccaaatcctgattctccattgccacattgagctctcattatattgcctggtgcatagtcattcatgaatgttttagaatttttmttctaaaggaaaaagcagaacctggaatgctcaggagactgtgattgcctcaggaattgcaatgtgattgcctatttttaagtatgagtgatttagggggtaagtgtctgtgagaggagattcagggttttccttttaaaatacattttctgatagtcagagtgtgggactgtacaggagataagtacagggtagcaagggaacacagatataagcacatttctaagcatgtgagacagagacagtaaaagaatgccaggtacccggtgaaagggtcaataagaaatctataaataacca

SEQ ID NO: 1274 - DNA, 601 bp, Human
aggtccagcttgggcagggctgccgtcatcctggtatcttgctggtaaagaaaaacaacgaagcattgataaaattatcatttgcttgctacaaaatgggcacttcagttccaacctggagacccatctttctttttccttgggtcactctactctttagaagaagccaattcagtgaaatgagaaaacaaagttgagagtaaggccaaatgaacccccagagtgctgctcttctcccgattgtcccaaatggacatcacttgaaaagatgaatcacctgtgctccttctctttgaactayatggctttgaagaattttatccctaaatttctttcatttataataacatgctcaaccctttcatctatggaagctctatttgatagtcgatgttttcatctccccccaaatcctgattctccattgccacattgagctctcattatattgcctggtgcatagtcattcatgaatgttttagaatttttcttctaaaggaaaaagcagaacctggaatgctcaggagactgtgattgcctcaggaattgcaatgtgattgcctatttttaagtatgagtgatttagggggtaagtgtctgt

SEQ ID NO: 1275 - DNA, 601 bp, Human
ttggctcagaaaattgacttgtctctgctgctcccatcggatgatattattcttgtcatgttgatttctcactgaaagaaggtctacctcagttactaaatgagaagctgtgatcattatcatcatcatcatcaccacagcaaacacttacttaacttttttgtgtaccagtgtccaagccatatatatgtgtatgtccaagccaaatatccttgtcacacatgttatttaagccatatatatacatatgcacacatatacatatatggcttaaataacaagtgtgacaagaatattttamccagaataagggtagtatttaaatatcttgtggaataatttttaaacaaatcaatttgtttaaatgccagatatacagatatagatatagataaataatctacctcattaagttagaggtattaaatgagtttatatgtatatatatattaagtgagatatatatatatatataaaacctcactttaacccctaactcaatgaagtattatatatgttatataatacttattatatatatatataaactcacttaatacctctctctctctctctctctccctctctctctctatatata

SEQ ID NO: 1276 - DNA, 601 bp, Human
ttcaaaaatgcatttagagccaggcgcagtggctcatgcctttaataccaacactttgggaggccgaggtgggtggatcacttgaggccaggagttcaagaccagcctggccaacatggagaaaccccatctttactaaaaatacaaaaattagtcaggcatgctggcacgcacctataatcccagctactcaggaggctgaggcacaagaaatgcttgaacctgggaggcagaggttgcagtgagctaagattgcaaccactgcactccagcctgggcaacagagcaagactctgtctcaaaaaaaaaaaaaaaaatgcatttagaaaaaaaatcggccaggtgcggtggctcacgcctgtaatcccagcactttgggaggccgaggcgggcggatcacgaggtcaagagatcgagaccatcctggctaacatgatgaaaccctgtctccactaaaaatacaaaaaaaaaaaaaaaaaaaaaaaaaattagccgggcgtagtggcgggttcctgtagtcctagctactcaggaggctgaggcaggagaatggcatgaacccgggaggcggagcttgcagtgagccgagatcgcgccactg

SEQ ID NO: 1277 - DNA, 601 bp, Human
acccccaaggggaatcatttttcatcaggacaatgtaggtgcggtagctctttgtgctttccaacaggctgtcacccgtcatcagacttatgaattcaagagccaggaaggcaaaaacaatctggacagattacaggcagctacctggttatttctggcttcaggctcataatacaataaagtgcacagccttagattttcacacttatttactatggagcaaaggtaaaatgatatgaaattgatatgatcagtgaaagttgtatttgtaaaaaagaaattgttcaaaaatgcatttagrgccaggcgcagtggctcatgcctttaataccaacactttgggaggccgaggtgggtggatcacttgaggccaggagttcaagaccagcctggccaacatggagaaaccccatctttactaaaaatacaaaaattagtcaggcatgctggcacgcacctataatcccagctactcaggaggctgaggcacaagaaatgcttgaacctgggaggcagaggttgcagtgagctaagattgcaaccactgcactccagcctgggcaacagagcaagactctgtctcaaaaaaaaaaaaaaaaat

SEQ ID NO: 1278 - DNA, 601 bp, Human
agcattcttatgcctgagaaacaaaataaacaaagacacacaaaggttgatgtcagtatgtacatggacaaaagcccaatactcttactatttgtatttttaaaggattttaagagtcaaaaaccaggtaactactagatagatgtccccaatttctgtaacccagctactgacaccacagaaggaaggaacatgttgctgcccccataagcttttttgtcgcactttagagataatactatgcaataccatgcactgtgtaggcagctgtgatgtttttttttttttttttttttttggkcccactcaaggctctcttcccagcaaaagctctgggcattgagtctgaagtggagcagcatccttggatgagaggaagtggccgtgattgttgtcaattacaaaatgtttgccctccctcccaccccaactaaatgacagaccagctttcagaaagaccctccaagcagccctctggtgatgcacctcctcatggctgtcccacaaatggctgtggcccagtctacgccacacaaggactctggacaggaaacatgtagcttcaaaagatctagtcacaacaggaaactaacaaataggg

SEQ ID NO: 1279 - DNA, 601 bp, Human
aatagcatccgtcacaatgccatccagcattcttatgcctgagaaacaaaataaacaaagacacacaaaggttgatgtcagtatgtacatggacaaaagcccaatactcttactatttgtatttttaaaggattttaagagtcaaaaaccaggtaactactagatagatgtccccaatttctgtaacccagctactgacaccacagaaggaaggaacatgttgctgcccccataagcttttttgtcgcactttagagataatactatgcaataccatgcactgtgtaggcagctgtgatgtttttttttttttttttttttttggtcccactcaaggctctcttcccagcaaaagctctgggcattgagtctgaagtggagcagcatccttggatgagaggaagtggccgtgattgttgtcaattacaaaatgtttgccctccctcccaccccaactaaatgacagaccagctttcagaaagaccctccaagcagccctctggtgatgcacctcctcatggctgtcccacaaatggctgtggcccagtctacgccacacaaggactctggacaggaaacatgtagcttcaaaagatctagt

SEQ ID NO: 1280 - DNA, 601 bp, Human
tatttttatcatctgcgacagggcaggtcagactatatccctgctgttaaaggatcagcaagtacaagggtgataaagcccctacaaccctgagatctcctttaaggctgtttccagggaggcatcagacaagcagaaaagacatttggagtctccgctgtgtgtaatgacaggtttggtggcttctcaaggctgggtttaaaaatgacagaggggaagatcatcttggcagaagtgtcattatccctggagagaaaactttctgatggatgccagcctttcaagtgagtaagtgtgagtkctcccaactgagacatcaagcttaagcgaatcagtcgtaccaaaggtcagttaggggaatcatttcacatgcatgccacgctctcctaactaagcagagagaattagacaaaagcaacatacgattctctggtcggtgtaatctccgctgctgtaagaggtggccagtgtggaggagcacttctcagcgtaccagggggataggccttgctgggaggcactgctgatggagatggtgtagatgctgtctgtgtagccatcacagtcacaattatctccctgacgccccccgtttcccgaa

SEQ ID NO: 1281 - DNA, 601 bp, Human
tgacatttggctgcctcttcagcccaaggatatgaagacatcctggccttagccatttgaactacttgcacaaaaaatgcttaatatgtagtttgcactcactgttgaactagatttgatacctgtgagttggtgtccacatttacactttgaggaaaacgatgggtctttaaaatggaaagtgtgctggacttagttctgggttcaaattctctaactgctacttaatagatttgtcctcgggcaagtcatttggctccccatctgtaaaatgcgatttatattttctgactcatatgcragacttacccgagatgttctctgtgaaagtagttttacataattttcttgcaagtaaggaattaccctggctaactttagggtaatgaagagattgctgagatgaagggaagaaactgaaaagacttcctgtctgccttaaggaccacggcgctgctggttgggccaagggattactaacaagacacccacccaggctccagcaccgaagttctagctcgagatttcgatgtgtgggagggaggtgtaaaaaaataatttgttctattatcacctccattggcttcctgcttggagttgc

SEQ ID NO: 1282 - DNA, 601 bp, Human
actgtgtgttaaaattacagaaggatgtcaaagaatgttagtaaacagaatgaaaaagaaatgagaaatgctttcggtttgtttcatgactaaaactgtttaaaaaagtcatattaaataagatatctctccaaacattaagctacatctaaatagctattgcagaataatcataagcatgcctttaagatgtgactctggcagaatgtcacaccaaagttggtctgagcatttaagtatctttgtgaatatgattgattttgttggctgaataggttagatggctggctgcatgcagacwtgggaacacctggatttgtcccacagtctgtcacattgtttatataagtgtttttccccctcttatagtatggctgaagcctaatctttctttttgaatattatctacgtaaccaagtggtcagggcttgaaacactctacttttcccttacttctactaagaaggggtacaattctttagggccctaattaatgatgaaatcaaccttaaaagtgcttcaaaatgtttaaaagtaagcttgtgttttttcatcctctcattcacacttaccatgtctgtaattctcaaagtccaagtac

SEQ ID NO: 1283 - DNA, 601 bp, Human
aaaaaaaaaaaaagttatttaggcgtataattctacactgctgatatttattacacttttgtcacagaagaactcagagccaaaacattattcatttatattctcacctacagagaatgttggagaaatgatgcaaaaataaataattaagctatatttggcttttttctaacttttgctctgtacttgcatttttgtgactgtgtgttaaaattacagaaggatgtcaaagaatgttagtaaacagaatgaaaaagaaatgagaaatgctttcggtttgtttcatgactaaaactgtttwaaaaagtcatattaaataagatatctctccaaacattaagctacatctaaatagctattgcagaataatcataagcatgcctttaagatgtgactctggcagaatgtcacaccaaagttggtctgagcatttaagtatctttgtgaatatgattgattttgttggctgaataggttagatggctggctgcatgcagacatgggaacacctggatttgtcccacagtctgtcacattgtttatataagtgtttttccccctcttatagtatggctgaagcctaatctttctttttgaatat

SEQ ID NO: 1284 - DNA, 601 bp, Human
cgggaggctgaggcaggagaagcgcttgaacccaggaggcagaggttgcagtgagccgagactgtgccactgcaactccagcctgggtgacagagcaagactccgtctcaaaaaaaaaaaaaaaagttatttaggcgtataattctacactgctgatatttattacacttttgtcacagaagaactcagagccaaaacattattcatttatattctcacctacagagaatgttggagaaatgatgcaaaaataaataattaagctatatttggcttttttctaacttttgctctgtacttkcatttttgtgactgtgtgttaaaattacagaaggatgtcaaagaatgttagtaaacagaatgaaaaagaaatgagaaatgctttcggtttgtttcatgactaaaactgtttaaaaaagtcatattaaataagatatctctccaaacattaagctacatctaaatagctattgcagaataatcataagcatgcctttaagatgtgactctggcagaatgtcacaccaaagttggtctgagcatttaagtatctttgtgaatatgattgattttgttggctgaataggttagatggctggct

SEQ ID NO: 1285 - DNA, 601 bp, Human
agaaaaccaaacactgaatgttctcactcataagtgggagttgaacagtgggaacatatgggcacagggaggggaacatcacacaatgggcctgtcagggagtagggggcaaggggagggatagcattaggagaaatatctaatgtagatgatgggttgatgggtgcagcaaaccaccatggcatgtgtatacctatgtaacaaacctgcacactctgtacatgtactccagaacttaaagtataataaaaaactaaataaaagaggtctataaagttcaatgacaaaaaataaataaataagaggtctataaattcagttacaaaaagttgcatatttgggggaatagtcataattttcaaggctcaacaattataaataatgtgttaaaatctaaaatatctttaaaaatttagaagtgtaaggtcagattttgcagacttgacatgaaataaatcccaccttggtaaatagattttcttagtttcctgatggtgaaattgagttgaagaatagaggccaaattcaagaacaggcccagatgctaagaacattctttttttgctctatgagagaaggacattttacaacttccatttct

SEQ ID NO: 1286 - DNA, 601 bp, Human
aaccaacacaggaacagaaaaccaaacactgaatgttctcactcataagtgggagttgaacagtgggaacatatgggcacagggaggggaacatcacacaatgggcctgtcagggagtagggggcaaggggagggatagcattaggagaaatatctaatgtagatgatgggttgatgggtgcagcaaaccaccatggcatgtgtatacctatgtaacaaacctgcacactctgtacatgtactccagaacttaaagtataataaaaaactaaataaaagaggtctataaagttcaatgacmaaaaataaataaataagaggtctataaattcagttacaaaaagttgcatatttgggggaatagtcataattttcaaggctcaacaattataaataatgtgttaaaatctaaaatatctttaaaaatttagaagtgtaaggtcagattttgcagacttgacatgaaataaatcccaccttggtaaatagattttcttagtttcctgatggtgaaattgagttgaagaatagaggccaaattcaagaacaggcccagatgctaagaacattctttttttgctctatgagagaaggacatttt

SEQ ID NO: 1287 - DNA, 601 bp, Human
aaatggatacacgaatgtctatccttcctaggttatagggattataggttaatgagacaatgtggaaaatgcttaaaaacaaagtacagtacaaatgttagatatatgtgattgggcataaagataacttttttttccatttgttatctgtcataagtggagaaaattcatgttaggaaatttaatacttttgaattcattaattgtgatttctaagttctggataaaatattgaatgaaaaaaatacagttttatcctatggaaaagaatagtttaccactatcacttcttatcctcccyatccatgtttgacttatttcctgcttggaagttgggtacagcttcactgactacattgtctaccccagttcaaaagagagcatgccaagaacagagccacacagacctcccctggatccaccatcttctccacccctcttctgtcattctgaacagtgttgtaggacgtgtacacacgaggctgcttcatatgctctggctgagaagaggtcccgtgcaaaatcagcttccagttcacaattcttccttcattttgaattcttccagactaacaaataagcatacctacatttagtatgt

SEQ ID NO: 1288 - DNA, 601 bp, Human
aaagggaagaaggttcattatttatggccaggcaagctagttgcaaccctaccacaggaacgctgcctgccgcttgagaggcaatgaggggaggggagagagttcaagactgggagccacatggacttgggcttcaaccctcatttgcctaccctctggggtacctttaacaacctttttaatctccctcaacttcacctgtcaggtggaataagagtacctccatttgtggtggttttgaagactagatgagactgtataggtaagtactcagtacatggtggttttctttacttgtcarcctgctgtcatggaatccattttgggaagcagaggatatcaaaatatctaacaagtcatatagaaggcacccactggttgcggtagcatgggtgtgccttcctggaggcactggctttcagaactacccttttagccactgagctgtaagaagtggtcaggggagagactgaggtgctaggctggggaggagggagctggagagctcagagaagccaaccttggccaactgctgtggaagtgtttcaatattccaacactgacaaggttaacctgcttcccagactgtgaagaaaagtac

SEQ ID NO: 1289 - DNA, 601 bp, Human
aatatttccaacttgggaccacacacttattttaattttcctcattcagaatgtccaccagagcttgaagcagccggtcgtctctgtgcttgtaaggtttagtgttataaaaaacatcaacatagtcattatacagactgtcttcagagtctttaagctgggaaggtttgttcagcttttccagggcttcgtagaagttttcataagggatgttgagctttgcacttggggacttctttggtgattgctttggcggtgagtttttactgaaagcactttgcaggagtcgcagcatggcctsggaaggggctccctcctccaactcatccctccggccccctacgctgctgctgctggggcttttggacaccagggtgttctccttagggttctcttgtgtgggctgctcctaaaacatagaatgccatccacaaagggaagaaggttcattatttatggccaggcaagctagttgcaaccctaccacaggaacgctgcctgccgcttgagaggcaatgaggggaggggagagagttcaagactgggagccacatggacttgggcttcaaccctcatttgcctaccctctggggtaccttta

SEQ ID NO: 1290 - DNA, 601 bp, Human
tattataagcataagaattcatgacaaaacaaccacttcagacacaggcaaaatcgcagggtaaggaagaagcatgaatatttccaacttgggaccacacacttattttaattttcctcattcagaatgtccaccagagcttgaagcagccggtcgtctctgtgcttgtaaggtttagtgttataaaaaacatcaacatagtcattatacagactgtcttcagagtctttaagctgggaaggtttgttcagcttttccagggcttcgtagaagttttcataagggatgttgagctttgcasttggggacttctttggtgattgctttggcggtgagtttttactgaaagcactttgcaggagtcgcagcatggcctgggaaggggctccctcctccaactcatccctccggccccctacgctgctgctgctggggcttttggacaccagggtgttctccttagggttctcttgtgtgggctgctcctaaaacatagaatgccatccacaaagggaagaaggttcattatttatggccaggcaagctagttgcaaccctaccacaggaacgctgcctgccgcttgagaggcaatgaggggag

SEQ ID NO: 1291 - DNA, 601 bp, Human
ttttagtatcaaggaataaacattcagtttcaaatacttagaacacgctgttctaatgaacacagttggaaaaaaacaaaaacaaaacttctcttggtttctccctattatgagtatttttctattattacattaggtctccatgtgataagtggtttcctgttactgctgaaaaaaattgtgactaggaatttgccaagtcccaagtgtaagtttttttttttctgggaaagtggtatatatcatttctcccaacatttattttgtggctgagaaaggagacaggtatagaaaactttcagaaggagaaacagaggaaagaccaggcatgcagcacgagtcataaccacctctggatccacggacgcctctggcaccacagacacagtgcaccaggcaaagaatgttcgaaaattgctcaaaccagagcattcagatttcaagatctgtttctagatctaaataatccagcttttgaccaacatgaccagattttgactacaggaatgagtggcactttggaatagaaagatctagggaatgagtcttacagtgaactccttcattaggcctaccaaatactttcttggcatcaaaattt

SEQ ID NO: 1292 - DNA, 601 bp, Human
ggcctgccagtttctgcttctgatttgaagcttaggagcaatttggtgagaatttggacactatcagtgataggattggagaagaacttttagtatcaaggaataaacattcagtttcaaatacttagaacacgctgttctaatgaacacagttggaaaaaaacaaaaacaaaacttctcttggtttctccctattatgagtatttttctattattacattaggtctccatgtgataagtggtttcctgttactgctgaaaaaaattgtgactaggaatttgccaagtcccaagtgtaagtttttttttttctgggaaagtggtatatatcatttctcccaacatttattttgtggctgagaaaggagacaggtatagaaaactttcagaaggagaaacagaggaaagaccaggcatgcagcacgagtcataaccacctctggatccacggacgcctctggcaccacagacacagtgcaccaggcaaagaatgttcgaaaattgctcaaaccagagcattcagatttcaagatctgtttctagatctaaataatccagcttttgaccaacatgaccagattttgactacaggaatgagtgg

SEQ ID NO: 1293 - DNA, 601 bp, Human
gtgcctgctctaggtaacatggagcagggtgccatggggactgagagtcatctaatcaggcagctgctactcagctccagctaactgttgccatgagcaaagatgggtccgagaatgaggttttatgtgaaacatcatattttcaataaccactcatattttaaaaacattctgcataccaaacaaaatctacctgagggacaattaaggtccatggcctgccagtttctgcttctgatttgaagcttaggagcaatttggtgagaatttggacactatcagtgataggattggagaagawcttttagtatcaaggaataaacattcagtttcaaatacttagaacacgctgttctaatgaacacagttggaaaaaaacaaaaacaaaacttctcttggtttctccctattatgagtatttttctattattacattaggtctccatgtgataagtggtttcctgttactgctgaaaaaaattgtgactaggaatttgccaagtcccaagtgtaagtttttttttttctgggaaagtggtatatatcatttctcccaacatttattttgtggctgagaaaggagacaggtatagaaaacttt

SEQ ID NO: 1294 - DNA, 601 bp, Human
aggagaacattctctaagcattacgggcattgctctgcaaacaccctctacacaaattcaaatggtagaagagcaggtgaaaatttgtgttaccaaccatacttcaagccaaagcaaatgacagactctagtgttcttttcatgaaccagttcaatgccatgaattaccttatgaagttcaaacttcatggaaaaattgcaaacagcaaactcagtgggagaaagccagcattgtaggtgactggagactttgtaagcatattgagagaaggaagccagaaggttagtaataaatgaattrgtattagtgatcatccaggtgaggtgagattacataagcaaactcataattattattgtacagatcctgcctaacagaagatgcgggtagtttgtttttcctaatgcatttacactttgtacacattcgcttagtgtaggagtgggcaaaatcaaatgcctattggatactgcccagcaaggaatcaagtgcctgctctaggtaacatggagcagggtgccatggggactgagagtcatctaatcaggcagctgctactcagctccagctaactgttgccatgagcaaagatgggtccga

SEQ ID NO: 1295 - DNA, 601 bp, Human
agtgctaactccagtctttgcccccagcacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatgggtatgccagcagggcagctgggtgctccggccctgtcacgggccagggccctggaggccttgcagttcagctgcttgccaagaacatagtgggtgagggggtgycaggagatgctggccacgttgcaggggcccaaggtgtagtcaggagacacagtgcacagagagctggtcttggtaggcctgggaggtgccgggctcgtgctgggcacctccgggcaagctttgtgacttagaggtgtggggccactggtcaccctcggtggctcagaggctgtggctccatggctcatgagcgcctcctgtgtcccagacctgagaccatgcgtatgtcccgaggcggctgctccggtctcttgcggtgtggaaagggaacgacctacgagggcggtgtccgagagcctg

SEQ ID NO: 1296 - DNA, 601 bp, Human
ttgcccccagcacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatgggtatgccagcagggcagctgggtgctccggccctgtcacgggccagggccctggaggccttgcagttcagctgcttgccaagaacatagtgggtgagggggtgccaggagatgctggccaygttgcaggggcccaaggtgtagtcaggagacacagtgcacagagagctggtcttggtaggcctgggaggtgccgggctcgtgctgggcacctccgggcaagctttgtgacttagaggtgtggggccactggtcaccctcggtggctcagaggctgtggctccatggctcatgagcgcctcctgtgtcccagacctgagaccatgcgtatgtcccgaggcggctgctccggtctcttgcggtgtggaaagggaacgacctacgagggcggtgtccgagagcctgccttggccttctggcca

SEQ ID NO: 1297 - DNA, 601 bp, Human
ccctgatggagctggatgcagctgtggggaccctgatgacagccataggggacctggggctgcttgaagagacgctggtcatcttcactgcagacaatgggtatgccagcagggcagctgggtgctccggccctgtcacgggccagggccctggaggccttgcagttcagctgcttgccaagaacatagtgggtgagggggtgccaggagatgctggccacgttgcaggggcccaaggtgtagtcaggagacacagtgcacagagagctggtcttggtaggcctgggaggtgccgggctcrtgctgggcacctccgggcaagctttgtgacttagaggtgtggggccactggtcaccctcggtggctcagaggctgtggctccatggctcatgagcgcctcctgtgtcccagacctgagaccatgcgtatgtcccgaggcggctgctccggtctcttgcggtgtggaaagggaacgacctacgagggcggtgtccgagagcctgccttggccttctggccaggtcatatcgctcccggtcagtccgcaggccctctccttggaaccctggccccaccaccccaaccttgatggcgaactga

SEQ ID NO: 1298 - DNA, 601 bp, Human
tgtgtcccagacctgagaccatgcgtatgtcccgaggcggctgctccggtctcttgcggtgtggaaagggaacgacctacgagggcggtgtccgagagcctgccttggccttctggccaggtcatatcgctcccggtcagtccgcaggccctctccttggaaccctggccccaccaccccaaccttgatggcgaactgagtgactgaccagcctcctgcccccaggcgtgacccacgagctggccagctccctggacctgctgcctaccctggcagccctggctggggccccactgcccartgtcaccttggatggctttgacctcagccccctgctgctgggcacaggcaaggtagggccggtgacccctgatcccagatccttggcccctgtcctggccttcccctggggtgagtgtgggcagtgcctgagagtctgtgcctcagtgcctcctgcactgagtggcatccaagtggcgccacctctcaggttcctgggtgggcaagaagcggtgcacgtccagggcctcccaccagggctggcagccccaggtatgtgcagtgcttggggcctgtcccgccccgtgacccctgactctgc

SEQ ID NO: 1299 - DNA, 601 bp, Human
acccacgagctggccagctccctggacctgctgcctaccctggcagccctggctggggccccactgcccaatgtcaccttggatggctttgacctcagccccctgctgctgggcacaggcaaggtagggccggtgacccctgatcccagatccttggcccctgtcctggccttcccctggggtgagtgtgggcagtgcctgagagtctgtgcctcagtgcctcctgcactgagtggcatccaagtggcgccacctctcaggttcctgggtgggcaagaagcggtgcacgtccagggcctcmcaccagggctggcagccccaggtatgtgcagtgcttggggcctgtcccgccccgtgacccctgactctgcccccagagccctcggcagtctctcttcttctacccgtcctacccagacgaggtccgtggggtttttgctgtgcggactggaaagtacaaggctcacttcttcacccagggtaacccctccccgtggatgcctccccccgacctgctgacccctccccggagccctagatccctggcccctcctctcgcccttgccctgtgcacagaattggccccctccccaggctctgc

SEQ ID NO: 1300 - DNA, 601 bp, Human
gccctggctggggccccactgcccaatgtcaccttggatggctttgacctcagccccctgctgctgggcacaggcaaggtagggccggtgacccctgatcccagatccttggcccctgtcctggccttcccctggggtgagtgtgggcagtgcctgagagtctgtgcctcagtgcctcctgcactgagtggcatccaagtggcgccacctctcaggttcctgggtgggcaagaagcggtgcacgtccagggcctcccaccagggctggcagccccaggtatgtgcagtgcttggggcctgycccgccccgtgacccctgactctgcccccagagccctcggcagtctctcttcttctacccgtcctacccagacgaggtccgtggggtttttgctgtgcggactggaaagtacaaggctcacttcttcacccagggtaacccctccccgtggatgcctccccccgacctgctgacccctccccggagccctagatccctggcccctcctctcgcccttgccctgtgcacagaattggccccctccccaggctctgcccacagtgataccactgcagaccctgcctgccacgcctccagctc

SEQ ID NO: 1301 - DNA, 601 bp, Human
gcaaggtagggccggtgacccctgatcccagatccttggcccctgtcctggccttcccctggggtgagtgtgggcagtgcctgagagtctgtgcctcagtgcctcctgcactgagtggcatccaagtggcgccacctctcaggttcctgggtgggcaagaagcggtgcacgtccagggcctcccaccagggctggcagccccaggtatgtgcagtgcttggggcctgtcccgccccgtgacccctgactctgcccccagagccctcggcagtctctcttcttctacccgtcctacccagaygaggtccgtggggtttttgctgtgcggactggaaagtacaaggctcacttcttcacccagggtaacccctccccgtggatgcctccccccgacctgctgacccctccccggagccctagatccctggcccctcctctcgcccttgccctgtgcacagaattggccccctccccaggctctgcccacagtgataccactgcagaccctgcctgccacgcctccagctctctgactgctcatgagcccccgctgctctatgacctgtccaaggaccctggtgagaactacaacctgctgggg

SEQ ID NO: 1302 - DNA, 601 bp, Human
agatccttggcccctgtcctggccttcccctggggtgagtgtgggcagtgcctgagagtctgtgcctcagtgcctcctgcactgagtggcatccaagtggcgccacctctcaggttcctgggtgggcaagaagcggtgcacgtccagggcctcccaccagggctggcagccccaggtatgtgcagtgcttggggcctgtcccgccccgtgacccctgactctgcccccagagccctcggcagtctctcttcttctacccgtcctacccagacgaggtccgtggggtttttgctgtgcggastggaaagtacaaggctcacttcttcacccagggtaacccctccccgtggatgcctccccccgacctgctgacccctccccggagccctagatccctggcccctcctctcgcccttgccctgtgcacagaattggccccctccccaggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgct

SEQ ID NO: 1303 - DNA, 601 bp, Human
ctacctccccccgttgtcttcttaaggcccatctcccccagaaatgcaggctgtgcccttgtatccacccagtctggttgtctgtctcctctgcctgggccttccgggctggcctcacctttccacataggcctcctagtcacctggacccacaggtcatgagcagaggccatggctcatggctgtgatagcgaccccccagaacaatcctgggacaatcctggttcccacagcactcaccgaaagtgttgactccaagctcaccagcaggaaccccaggagcagcagagccctcatggcrtccgtccgttggtccagctgcctatccaggagtccagatcaataggactggccaaaggtcttggaaatagagattggtcaagctgccctcctgagcctggtggggcacaggctgtttgtggaaagccaagtggagcaacttccttggtcaccccttgagggccggaaagttgggagtttgtgggtgggggtgaaatgaagagctgggctcctcctctcttttctagatagtgggactggaagcagaagaagggacattcttatgctctgggtcctgtggagatcaggaggttaaggagat

SEQ ID NO: 1304 - DNA, 601 bp, Human
cactgtccctcagggtctggtcaggaaaaggacagaccctcaaaaaggtcgctgtgcattgaaaacactttctgctctaaaagttgggttcagggccgggcgcggtggctcaagcctgtaatcccagcactttgggaggccaaggcgggcagatcacgaggtcaggagatcaagaccatcctggctaatacagtgaaaccccctctctactaaaaatacaaaaaaattagctgggggtggtggcaggtgcctgtagtcccagctactcgggaggccgaggcaggagaatggtgtgaacccrggaggcggagcttgcagtgagccgagatcgcgccactgcactccagcctgggtgacagagtgagactccatcttaaagaaaaaaaaaaaaacttgggttcaggagtcagatagctggagtagactcctgactccacaacctgctagctgtgtgaccttgggtaagtcttcagtcccaaggccaggaagagcacttgccacaaagtaggcacttaataatacttgttgaatgttgaagtcactgttaaccactctgatctgagccttggtttccttatctgtaaaacggcagtaataatag

SEQ ID NO: 1305 - DNA, 601 bp, Human
ctccacctctaggcagcgacccccatggaggcacgggttggtgcggcaggcttggggagggaacgcagtgagccacccctgggcctaaagacccccccagagagctctccttcccggcacaccacccggcctcctgccagcctgtcttcctgacgctcctccctggcccgttcccaaccatctgctcaccctggctggccagccgctggcagtgggcatcaggacccttgcactggcatctggccacagctgcttgctcagttctataccatatctcattcttgtggaaaaaccggagaasctgaggctcaaagcacttctctggggacaaagagggatagtggtctcaggagagtctaggaccatgccaagtctccgagtatccagcaacctattctgtaggcccagggttgcccctgtcccccagcaccccgcccaggtcctccacatctcctcacctttctggcagtggtttccagtgaggtgttgtggacagagacagtgggggccgcttggcatgttcacacaggtccctcctttctggcaggggctgtgtttgctgcagtggtctgagagatggacatggtggaaggaagagcag

SEQ ID NO: 1306 - DNA, 601 bp, Human
tcagcacccagcagggggcgatgaggctgccggcgcagaaactgtggccccagtacagcgcggcgatgtaggggtgcgccccgcgtagcgccaccagcccgccaacgacgcgggtcatcgaagacagactcttgcggagccgctgcccgcagctcagtgggccgttcctggtcagggaaggcggctgctcccgcttcgccggcaaggctgtggaggagcaggggctgaggacggggagcccgcggccggctggccggaatctagctcgcccggcgccctctcggctcctccttccccccccacttcctaacctcccggggtctgggactgaggcggggtccgggtcgtgggctgaggcttcggcggtgccggctgcgcgggcatgagtgggacatgaagcctaggggacaccggggtcggaggcgccgcctgggttggggtctggcactgtgccaggtcgcagtactcccagctcagccggtcgcggttcagcacgaagcaccacgggcggatgtcgttgtccgggttcctgtagccacacgacggggcgccgttagagcgccgggagcccggagccctggggcggaggggtcacccagcc

SEQ ID NO: 1307 - DNA, 601 bp, Human
gccgcggcccctggggcggctctgggcgggcgggtactcgccggtcctgcaggcagtgagcggccgtcagcacccagcagggggcgatgaggctgccggcgcagaaactgtggccccagtacagcgcggcgatgtaggggtgcgccccgcgtagcgccaccagcccgccaacgacgcgggtcatcgaagacagactcttgcggagccgctgcccgcagctcagtgggccgttcctggtcagggaaggcggctgctcccgcttcgccggcaaggctgtggaggagcaggggctgaggacggrgagcccgcggccggctggccggaatctagctcgcccggcgccctctcggctcctccttccccccccacttcctaacctcccggggtctgggactgaggcggggtccgggtcgtgggctgaggcttcggcggtgccggctgcgcgggcatgagtgggacatgaagcctaggggacaccggggtcggaggcgccgcctgggttggggtctggcactgtgccaggtcgcagtactcccagctcagccggtcgcggttcagcacgaagcaccacgggcggatgtcgttgtccgggttcctgtag

SEQ ID NO: 1308 - DNA, 601 bp, Human
ggcacaccggctgaacgtaaggcgacaggagcgcgcagctgccgtccgcatcctcctgaaggcgcaacagagctaacccgggcggagaggagcgtgaggcggggacgccggggccccaagctctcttcccgtccccgcggggcgcccccacgcacccaggtcgtgctggtagctgacgggcgagaaggcctcgtgcaagcggtaggagcgcacggccaacgtctggcacggctcacagctgtggttacggcgttcctggccgagcaccaccgtcagatcctcgggtgcgggcctgcggggrgggtaggggagaggcagcgctctcagacctggccacaagcgttctggggaagccccctgctcccgaaccccaatcccgtgttccagcttcctccccgggagctccggaggggcgtggaaagaagggtggggcgggagaaggtagggcacgggttcgggtgcagcgtggaagctgcgctgggagacggaggagccgcggcccctggggcggctctgggcgggcgggtactcgccggtcctgcaggcagtgagcggccgtcagcacccagcagggggcgatgaggctgccggcgcagaaact

SEQ ID NO: 1309 - DNA, 601 bp, Human
ctctcagattcagaataattttgcatgtttccatgcagcccccatttcttcctaccctttctcttccagataagttggcttaaaagtaggtaagaggactagttagaggtcgcagagaaactctggaatgagggtccacttagccataaattaggtgccaggaaattgaggccacaatactcaggagcctggttttgcctgagcatgcaactgaaatcctgtctgttcacccactaatgatccagagttggggaggtaaataaacagtgctcttgggagtaggttccttttctttatttgytatgtaggtaactattcaattattttctatttaaaaaagtttctgggaccaatcaggtcagcctgtgagcccctctagcatcagagggaaggaatctcctgcttcccccgctgactgcttacccagtcttcatcagagcagaagggccagtctgaatctttgcaggcagattgatgtctttccacaacccttgggccacgcacgcctcctccttcagctagaaagtcaccttcaccactatctgcagtctttaaagattcattcacatacacaaaagagagcaacagcaatgttagccag

SEQ ID NO: 1310 - DNA, 601 bp, Human
ttcatcaatcaaccctttcatcctgcagccagaagggcatttgtagttctgaaagtgaagggagaaaattacagtaaggatctatctctcagattcagaataattttgcatgtttccatgcagcccccatttcttcctaccctttctcttccagataagttggcttaaaagtaggtaagaggactagttagaggtcgcagagaaactctggaatgagggtccacttagccataaattaggtgccaggaaattgaggccacaatactcaggagcctggttttgcctgagcatgcaactgaartcctgtctgttcacccactaatgatccagagttggggaggtaaataaacagtgctcttgggagtaggttccttttctttatttgctatgtaggtaactattcaattattttctatttaaaaaagtttctgggaccaatcaggtcagcctgtgagcccctctagcatcagagggaaggaatctcctgcttcccccgctgactgcttacccagtcttcatcagagcagaagggccagtctgaatctttgcaggcagattgatgtctttccacaacccttgggccacgcacgcctcctccttc

SEQ ID NO: 1311 - DNA, 601 bp, Human
ggtgctattccctctcaaaggaaacgctaattaaatgatccttggtgaaactcaggctgagggctcagaggtgtggtgatgtaatgggctttggaattagacagggactgaacatttgcttttgaaatttactatctatgtaccgttggaaaatttacttaatatctctgaattttttttcttcaactgtggagtgaggaaaataatacctacttttaggtagatgatggatataacacttttctctgcatatagtagacactcagtgcataactatcgccttccttttccctctactcaraaacaaggacatctgggaccacagccacatacttacctccagtcgtttcatatcaaccaactgagctctaacatttttctgcagaagctggatatgctgtactttttctatgactttgcgcttcaggacttcaattctgcttctcagatcctctgacactcggttgtaggtattatcacggtctgaaatcgaaaatatggttattgaagtagctgctgagtgatttgtctgtaattgccagcaaaaaagaaaggaagaaaggaaggaaggagaaagaaagaaagaaagaaagaaagaaag

SEQ ID NO: 1312 - DNA, 601 bp, Human
ctgtgtggtactctctccttgtccctggacttacatttcctgacacctcttcaaatgtgccccagtctgggttgttaggcctcgcgttcccagagcctgggctatctggcctaaaacttccagattcagagtgccattgtccagtactaccagatacagagctctcagaggtccagtgcccagcacttccgcgttcagagctgccaggattccaggttccggtactaccaggtctagggctcccagggttttggtttccagtacttccagttccagagctcccagagttccagcttccagyacttccaggtccagagctcccaggtttccaggttgcagtccctccagtcccagagctcccagggtttcggtttccagtacttccaggtccagagctcccagagttccagcttccagcactgctagggttcctggggctttccgtctctgatccggttccataagaggtggagcctcctcgagtaatctcatttccaccaggtctctctaactccattctcatctgcggcatgtctgttaatgccttccactctgggggtaccttctgaagctggctcttaaaatttccgggaaccaagtc

SEQ ID NO: 1313 - DNA, 601 bp, Human
ccaccaagagagcttgatatgactgtatatagtatagtcataaagaacctgaacttgaccatatacttatgtcatgtggaaaatttctcatagcttcagatagattatatctggagtgaagaatcctgccacctatgtatctggcatagtgtgagtcctcataaatgcttactggtttgaagggcaacaaaatagtgaacagagtgaaaatccccactaagatcctgggtccagaaaaagatgggaaacctgtttagctcacccgtgagcccatagttaaaactctttagacaacaggttktttccgtttacagagaacaataatattgggtggtgagcatctgtgtgggggttggggtgggataggggatacggggagagtggagaaaaagggggcacagggttaatgtgaagtccaggatccccctctacatttaaagttggtttaagttggctttaattaatagcaactcttaagataatcagaattttcttaaccttttagccttactgttgaaaagccctgtgatcttgtacaaatcatttgcttcttggatagtaatttcttttactaaaatgtgggcttttgactagatgaatg

SEQ ID NO: 1314 - DNA, 601 bp, Human
ggggcttctctcagctgcctagtctaaggtgcagggagtttgagactcacagggtttaataagagaaaattctcagctagagcagctgaacttaaatagactaggcaagacagctggttataagactaaactacccagaatgcatgacattcatctgtggtggcagacgaaacattttttattatattatttcttgggtatgtatgacaactcttaattgtggcaactcagaaactacaaacacaaacttcacagaaaatgtgaggattttacaattggctgttgtcatctatgaccttcyctgggacttgggcacccggccatttcactctgactacatcatgtcaccaaacatctgatggtcttgccttttaattctcttttcgaggactgagagggagggtagcatggtagttaagagtgcaggcttcccgcattcaaaatcggttgcttactagctgtgtggctttgagcaagttactcaccctctctgtgcttcaaggtccttgtctgcaaaatgtgaaaaatatttcctgcctcataaggttgccctaaggattaaatgaatgaatgggtatgatgcttagaacagtgattggca

SEQ ID NO: 1315 - DNA, 601 bp, Human
gctgaacttaaatagactaggcaagacagctggttataagactaaactacccagaatgcatgacattcatctgtggtggcagacgaaacattttttattatattatttcttgggtatgtatgacaactcttaattgtggcaactcagaaactacaaacacaaacttcacagaaaatgtgaggattttacaattggctgttgtcatctatgaccttctctgggacttgggcacccggccatttcactctgactacatcatgtcaccaaacatctgatggtcttgccttttaattctcttttygaggactgagagggagggtagcatggtagttaagagtgcaggcttcccgcattcaaaatcggttgcttactagctgtgtggctttgagcaagttactcaccctctctgtgcttcaaggtccttgtctgcaaaatgtgaaaaatatttcctgcctcataaggttgccctaaggattaaatgaatgaatgggtatgatgcttagaacagtgattggcatccagtatgtgccctcgaggcctcttaattattactggcttgctcatagtgcatgttctttgtgggctaactctagcgtcaata

SEQ ID NO: 1316 - DNA, 601 bp, Human
ggtagttaagagtgcaggcttcccgcattcaaaatcggttgcttactagctgtgtggctttgagcaagttactcaccctctctgtgcttcaaggtccttgtctgcaaaatgtgaaaaatatttcctgcctcataaggttgccctaaggattaaatgaatgaatgggtatgatgcttagaacagtgattggcatccagtatgtgccctcgaggcctcttaattattactggcttgctcatagtgcatgttctttgtgggctaactctagcgtcaataaaaatgttaagactgagttgcagcygggcatggtggctcatgcctgtaatcccagcattctaggaggctgaggcaggaggatcgcttgagcccaggagttcgagaccagcctgggcaacatagtgtgatcttgtatctataaaaataaacaaaattagcttggtgtggtggcgcctgtagtccccagccacttggaggggtgaggtgagaggattgcttgagcccgggatggtccaggctgcagtgagccatgatcgtgccactgcactccagcctgggcgacagagtgagaccctgtctcacaacaacaacaacaacaacaaaa

SEQ ID NO: 1317 - DNA, 601 bp, Human
tgagttgcagccgggcatggtggctcatgcctgtaatcccagcattctaggaggctgaggcaggaggatcgcttgagcccaggagttcgagaccagcctgggcaacatagtgtgatcttgtatctataaaaataaacaaaattagcttggtgtggtggcgcctgtagtccccagccacttggaggggtgaggtgagaggattgcttgagcccgggatggtccaggctgcagtgagccatgatcgtgccactgcactccagcctgggcgacagagtgagaccctgtctcacaacaacaacarcaacaacaaaaaggctgagctgcaccatgcttgacccagtttcttaaaattgttgtcaaagcttcattcactccatggtgctatagagcacaagattttatttggtgagatggtgctttcatgaattcccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaa

SEQ ID NO: 1318 - DNA, 601 bp, Human
cgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcktccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggc

SEQ ID NO: 1319 - DNA, 601 bp, Human
agacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtytaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttc

SEQ ID NO: 1320 - DNA, 601 bp, Human
ggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggamatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctttctcatatgattgtgcacatacttgagactgttttgaatttgggggatggctaaaac

SEQ ID NO: 1321 - DNA, 601 bp, Human
cgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggtgaggctctcctgccccatctccttgggctgcccgtgcttcgtgctttggactaccgcccmgcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatgattcctctctgttcccttcctgtctctctctgtctccctctgctcaccttggggtttctctgactgcatcttgtccccttctctgtcgatctctctctcgggggtcggggggtgctgtctcccagggcg

SEQ ID NO: 1322 - DNA, 601 bp, Human
acgctgccactgccgcttcctctataaagggacctgagcgtccgggcccaggggctccgcacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatgrttcctctctgttcccttcctgtctctctctgtctccctctgctcaccttggggtttctctgactgcatcttgtccccttctctgtcgatctctctctcgggggtcggggggtgctgtctcccagggcgggaggtctgtcttccgccgcgtgccccgccccgctcactgtctctctctctctctctctttctctgcaggttctccccatgacaccacctgaacgtctcttcctcccaagggtgtgtggcaccaccctacacctcctccttctggggctgctgctggttctgctgcctgggg

SEQ ID NO: 1323 - DNA, 601 bp, Human
acctgctgcctggatccccggcctgcctgggcctgggccttggtgggtttggttttggtttccttctctgtctctgactctccatctgtcagtctcattgtctctgtcacacattctctgtttctgccatgattcctctctgttcccttcctgtctctctctgtctccctctgctcaccttggggtttctctgactgcatcttgtccccttctctgtcgatctctctctcgggggtcggggggtgctgtctcccagggcgggaggtctgtcttccgccgcgtgccccgccccgctcactgcctctctctctctctctctttctctgcaggttctccccatgacaccacctgaacgtctcttcctcccaagggtgtgtggcaccaccctacacctcctccttctggggctgctgctggttctgctgcctggggcccaggtgaggcagcaggagaatgggggctgctggggtggctcagccaaaccttgagccctagagcccccctcaactctgttctcccctaggggctccctggtgttggcctcacaccttcagctgcccagactgcccgtcagcaccccaagatgcatcttgcccacagc

SEQ ID NO: 1324 - DNA, 601 bp, Human
tgactctccatctgtcagtctcattgtctctgtcacacattctctgtttctgccatgattcctctctgttcccttcctgtctctctctgtctccctctgctcaccttggggtttctctgactgcatcttgtccccttctctgtcgatctctctctcgggggtcggggggtgctgtctcccagggcgggaggtctgtcttccgccgcgtgccccgccccgctcactgtctctctctctctctctctttctctgcaggttctccccatgacaccacctgaacgtctcttcctcccaagggtgygtggcaccaccctacacctcctccttctggggctgctgctggttctgctgcctggggcccaggtgaggcagcaggagaatgggggctgctggggtggctcagccaaaccttgagccctagagcccccctcaactctgttctcccctaggggctccctggtgttggcctcacaccttcagctgcccagactgcccgtcagcaccccaagatgcatcttgcccacagcaccctcaaacctgctgctcacctcattggtaaacatccacctgacctcccagacatgtccccaccagctctcct

SEQ ID NO: 1325 - DNA, 601 bp, Human
gttctccctgattcttgtttaccctccttaaaatctactgggggaaggaagtgataacaacacattgcattaaactgtatattttaagccttctttaaatgaggagcacatattttgttcctctgtctaaaggagttttaagtatttgagaagataaagtctccatcttggtccctgaaaccctccacccctgaaaaaatccacagaatcattcaagagttttcaaatatatttcctattgtgaaatagtttactgaaataagatcttcccagaagcccagtatgtgaagcagataaaagytgagccactgtggggcagagtgtgctaatctccgaacccagatggcccctaaagagcccctcaaagctccaggactctccagagaagtctgaaagcctttggaaagtcaccgaggttggttgtaaagacacctagcatccagtcttcattccatcctgattctaccattaataagtttcgtgtgtaatcccagccctttgggaggccaaggcaggcagatcatgaagtcaggagttcgagaccagcctgaccaaaatgatgaaaccccgtctctactaaaaatacaaaaaaattagctgg

SEQ ID NO: 1326 - DNA, 601 bp, Human
caccttccacacacaacctcagggtgttggttattctttccttctgagaagagatattccttcatcgatggttttcagaggttggaagagacattgacagacgaagaagtgtaggaggtaacacgatgacgtgccaagaactccttgctgaccaggccatgcatagccaggatcttgaggaatccatggcgaaaattttggccgatgaaggcgtagatgatggggttgaggcagctatggagaaatcccagaatctcagtggcatccagggcccggccgatgttgttgcggcgctcacagstctcctggatcacctgggtcctcatgagggtgtctgccagcaggaccaggttgtagggcagccagcaaagcaggaagatgaggacgacagcaaagatgaccctcatggctcggtgcttctgccccatgtgggccttaaacagtgtacgcagggtgaatccatagcagaacagcatgacaaacagcggcacgatgaagccaaaggtgtgaggcaggatccgcaacaccatccgccattttgctgtgtcatttcccaggacctcatagcaaactggactggaattgtttggatggtaagcct

SEQ ID NO: 1327 - DNA, 601 bp, Human
atctccctttcccgcccctggtcccggcagcccccagctccttctcccagtgacccagagccaatgtaagtatgaggccagaggtcagacgtgaagctcctccaagaaccggcgcggggagagctcagttaatgggacccacgtgggcgatgctgctccagcatcagctccaggcgctgcgggccctcgtcctccacccgactccgggcgtctgagacccaaagagcaggttgtgcgggggcgggaacgaggcgatgctgtctttggaggccctgagaaactgaggttgcacaggagcgcrgctctgtcctcgaaacggcctcagtcgggtccctcctactaagtctggcctgggtccggcctgcacaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccggtgagcaggcggcgtcggggaaggaggcac

SEQ ID NO: 1328 - DNA, 601 bp, Human
ctgcgtgtgaggctggaggcagggagtaagtgatctggagatcccatcttccaagaaggcaaagacagaaagtgggagttgcagcgatccaggaaaacagagaagcaaagtgaaagtaggaaggagatgtaaaggtgactcagaagtcaggtgaggggaccacatggaacaggagggggtgggtgacccgtgagagcagacagctaagggaagaaaacataggatgctggagagctggtttggttggaataacacggaagacacccgtgaaagacaagaagcacactggcccgcaggagaygaggaggaatgaggatggcaaatagtgaatttttttttttttttttttgagatggagtcttgctttgttgcccaggctggagtgcagtggcgcgatcttggctcactgcaacctccacctcctgggttcacgccattctcctgcctcagcctcccgagtagctgggactacaggcaccccccaccacacccggctaattttttatattttttttagtagagatggagtttcaccgtattagccaggatggtctcgatctcctgacctcgtgatccgccctccttggcctctcaaagtgct

SEQ ID NO: 1329 - DNA, 601 bp, Human
cagaaagtgggagttgcagcgatccaggaaaacagagaagcaaagtgaaagtaggaaggagatgtaaaggtgactcagaagtcaggtgaggggaccacatggaacaggagggggtgggtgacccgtgagagcagacagctaagggaagaaaacataggatgctggagagctggtttggttggaataacacggaagacacccgtgaaagacaagaagcacactggcccgcaggagacgaggaggaatgaggatggcaaatagtgaatttttttttttttttttttgagatggagtcttgctytgttgcccaggctggagtgcagtggcgcgatcttggctcactgcaacctccacctcctgggttcacgccattctcctgcctcagcctcccgagtagctgggactacaggcaccccccaccacacccggctaattttttatattttttttagtagagatggagtttcaccgtattagccaggatggtctcgatctcctgacctcgtgatccgccctccttggcctctcaaagtgctgggattacaggcttgagccaccacgcccggcccaaatagtgaatttttaaccatgggtaatgagt

SEQ ID NO: 1330 - DNA, 601 bp, Human
aaacagagaagcaaagtgaaagtaggaaggagatgtaaaggtgactcagaagtcaggtgaggggaccacatggaacaggagggggtgggtgacccgtgagagcagacagctaagggaagaaaacataggatgctggagagctggtttggttggaataacacggaagacacccgtgaaagacaagaagcacactggcccgcaggagacgaggaggaatgaggatggcaaatagtgaatttttttttttttttttttgagatggagtcttgctttgttgcccaggctggagtgcagtggcgcsatcttggctcactgcaacctccacctcctgggttcacgccattctcctgcctcagcctcccgagtagctgggactacaggcaccccccaccacacccggctaattttttatattttttttagtagagatggagtttcaccgtattagccaggatggtctcgatctcctgacctcgtgatccgccctccttggcctctcaaagtgctgggattacaggcttgagccaccacgcccggcccaaatagtgaatttttaaccatgggtaatgagtaaaagagagatgaatccagagatgagtga

SEQ ID NO: 1331 - DNA, 601 bp, Human
aagaagcacactggcccgcaggagacgaggaggaatgaggatggcaaatagtgaatttttttttttttttttttgagatggagtcttgctttgttgcccaggctggagtgcagtggcgcgatcttggctcactgcaacctccacctcctgggttcacgccattctcctgcctcagcctcccgagtagctgggactacaggcaccccccaccacacccggctaattttttatattttttttagtagagatggagtttcaccgtattagccaggatggtctcgatctcctgacctcgtgatcygccctccttggcctctcaaagtgctgggattacaggcttgagccaccacgcccggcccaaatagtgaatttttaaccatgggtaatgagtaaaagagagatgaatccagagatgagtgagggcagtagggatggaacatcaaatctatgactttgagacaggtgagtgtaaatgcagaaaagacccagaataagtccatagatacagattatgatagtaaatccagaaagatgaggtttaaaaaaaaaaaagcaaatgtagaatcttttgaggacaggtgaaggcgtggcaggtgaggtt

SEQ ID NO: 1332 - DNA, 601 bp, Human
agcaaatgtagaatcttttgaggacaggtgaaggcgtggcaggtgaggtttaagatgtgaaattaatcaaagcaatctgtagtagacagtaggtgtaggtgtataggtgactaagatttcatcaccttaattaaggtgatttttttccaaccatagatattgatgaagtaaggccaggtaggggaagatgagtgaaggagcaagaaatggtggcaaacaggaggtttttatctacaggcaaaggatgagggctgaaataagagaaagcaggagtgcaaagttggcaaagatgggataaacrtgtctggtggataatcaaatgaggcaaagccagagataaaagcaacagtgcatggctgaaaacatggaatacggctaaccacagggagatgaggacaagaggcgggcataggaccagacagagccgtgaggccaattgtcttgatgtctccccagcccgcctgccaggagacaatgctttggacatgttccagaagcatcgagagaaggaactgaaagacagacagcagatctactggtgaccacccaccccttaaactaaccccgccaccactgtcccaccccttccctgcccctgccc

SEQ ID NO: 1333 - DNA, 601 bp, Human
gtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacatatatcctcctttcaccgcccaccaaagagaaggttcgccagtgctggcaggatgatgagttgttcagctaccagttcctcaatggtgccaaccccatgctgttgagacgctcgacctctctgccctccaggctagtgctgccctcrgggatggaagagcttcaggctcaactggagaaagaacttcaggtacctctccttcccctgcctggcactgttctctccttagtagtgtggtgagaacggacagagagaatccaaactgagtcagaggaaggctgcagtactgcattgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctg

SEQ ID NO: 1334 - DNA, 601 bp, Human
gcaagaagagaccttatcatatctggtcaactcagagaggccttgagaatgaaaacgcagaagctgggttcagggagggttatatacctgaacccctggggtagattttggagaagggatatgcaggctgtggtacatatatcctcctttcaccgcccaccaaagagaaggttcgccagtgctggcaggatgatgagttgttcagctaccagttcctcaatggtgccaaccccatgctgttgagacgctcgacctctctgccctccaggctagtgctgccctcggggatggaagagcttcrggctcaactggagaaagaacttcaggtacctctccttcccctgcctggcactgttctctccttagtagtgtggtgagaacggacagagagaatccaaactgagtcagaggaaggctgcagtactgcattgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggac

SEQ ID NO: 1335 - DNA, 601 bp, Human
ggaagctctctggaatatttggcagaggacgtgagatttgaatagggaatgaaagagcatttgctgagctgataggagccaaaaccagagcgcagaccattcgggaatgatcagaaaggggcctggccatttgacaggtggtcagtttacaatgcctgtgatgccaactggattgagcaggcctggttccaaacccagatctgccaccacatccacacacaagacatctaccctcaccagactgtttcttcactttaagatgagaggaactggaccaggggctctagttctcccaacaggrctccggtactgatgcaggagaatggcaagaagctagactaaatctcttgccctttgccccggccccctgggggtagactttgaactctaaaaatggatacatccctcctgtccccagaatggttccctgtttgaagctgacttcatccttctggatggaattccagccaacgtgatccgaggagagaagcaatacctggctgcccccctcgttatgctgaagatggagcccaatgggaagctgcagcccatggtcatccaggtaagggccccagacctctcccacaacgttgcactctgt

SEQ ID NO: 1336 - DNA, 601 bp, Human
cctgtccccagaatggttccctgtttgaagctgacttcatccttctggatggaattccagccaacgtgatccgaggagagaagcaatacctggctgcccccctcgttatgctgaagatggagcccaatgggaagctgcagcccatggtcatccaggtaagggccccagacctctcccacaacgttgcactctgttcacctcaacctctgctcccagggacccaacccccagctcttggctcccaaaccccatcctcactcagtgagacttgtcttcatgtcactatttgcctgtaccctcrtctcccctgcctcatccaactagaattactttttcaagagtcaaaatggcctcttggagttctcatcctgtatccaatggtcctcacacttcagtgtgcatcagaatcacctgaatgcctgttgaaatgcagatttctggatcccatgaccagactttctgattcagtatgtctggggtgggaactaagagtttgcgtttttataagttccaaagtgatgctgacactaccagttcaggactacactttcagaatcactatctcatctctcagtggcctctggctctgaaccctcgccat

SEQ ID NO: 1337 - DNA, 601 bp, Human
actagaattactttttcaagagtcaaaatggcctcttggagttctcatcctgtatccaatggtcctcacacttcagtgtgcatcagaatcacctgaatgcctgttgaaatgcagatttctggatcccatgaccagactttctgattcagtatgtctggggtgggaactaagagtttgcgtttttataagttccaaagtgatgctgacactaccagttcaggactacactttcagaatcactatctcatctctcagtggcctctggctctgaaccctcgccatctcttgaatatcttttctygcaatttcttttttttttttgagacagaatctcactgtgtcactcaggctggaatacagttgtgtgatcttggctcactgcaacctgcgcctcctgggttcaagcaattctcccacctcagtccctccagtagctgggaccacaggcatgtgccaccatgtgggcctggctaatttttgtattttttgtagagatggggtttcgccatattgcccaggctggtcttgaacttctgggctcaagtaatctgcctgcctcggcctcccaaagtgctgggattacagctgtgagccactgcac

SEQ ID NO: 1338 - DNA, 601 bp, Human
tcttgaatatcttttctcgcaatttcttttttttttttgagacagaatctcactgtgtcactcaggctggaatacagttgtgtgatcttggctcactgcaacctgcgcctcctgggttcaagcaattctcccacctcagtccctccagtagctgggaccacaggcatgtgccaccatgtgggcctggctaatttttgtattttttgtagagatggggtttcgccatattgcccaggctggtcttgaacttctgggctcaagtaatctgcctgcctcggcctcccaaagtgctgggattacrgctgtgagccactgcacctggccttctctcactattcttaacagtcaggtgacaagaactgtcaataatcttacacctcctacttctccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtca

SEQ ID NO: 1339 - DNA, 601 bp, Human
ttgaatatcttttctcgcaatttcttttttttttttgagacagaatctcactgtgtcactcaggctggaatacagttgtgtgatcttggctcactgcaacctgcgcctcctgggttcaagcaattctcccacctcagtccctccagtagctgggaccacaggcatgtgccaccatgtgggcctggctaatttttgtattttttgtagagatggggtttcgccatattgcccaggctggtcttgaacttctgggctcaagtaatctgcctgcctcggcctcccaaagtgctgggattacagstgtgagccactgcacctggccttctctcactattcttaacagtcaggtgacaagaactgtcaataatcttacacctcctacttctccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtcatc

SEQ ID NO: 1340 - DNA, 601 bp, Human
ccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtcatctctgtttccccaagaatgctgactataatgtcatatacggaatgggagttcaataatttctctttctcccagattcagcctcccarccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaaggtacttattaatctattaaatcacatatccctcagaccccagagagaggaacagccccatatcaaaagatattgcagcagcaaaaactctttgtagcaatttgt

SEQ ID NO: 1341 - DNA, 601 bp, Human
taatttctctttctcccagattcagcctcccaaccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaaggtacttattaatctattaaatcacatatccctcagaccccagagagaggaacagccccatatcaaaagataytgcagcagcaaaaactctttgtagcaatttgtgagtgaagaggagactgtctcaatatcttgagatgttgattttaattaagtttattaagtttagtcacttaacattatataggaatcctctgaaattctcagagatctgacagtctagcagtgcgctcacagtagggcttgaacactgctagtaaaacaaaagccatattcctaccttagatctagtatttagccagaaaaacaagtgatgcccataagaaccaaccagagaacagtatctggtactagagtttgaaatcacaaggga

SEQ ID NO: 1342 - DNA, 601 bp, Human
ctgaaattctcagagatctgacagtctagcagtgcgctcacagtagggcttgaacactgctagtaaaacaaaagccatattcctaccttagatctagtatttagccagaaaaacaagtgatgcccataagaaccaaccagagaacagtatctggtactagagtttgaaatcacaagggacagcctataacagtatagtattgatgaagaatgtttctacccaattgaggagtcagctaagtagaaacagaccaaaaggcaaggaagaacagccagcaagccgctcatacctgcccaacagyaaggtggatagagatgtatgttagcatggtaatgacaggaatgaaaaggaaagaatctaaaacgtagtgaagggaggaaatggtagctgcagcgtgcctgggtgcaagagagagaaaagccagaagtccaagcttctgccacacctgtaagtccctggggcaggtgtgttatactgacctagaaatactgtggttttaagagctgggtgtggtggttcacgcctgtaatcccagtgctttgggtggccaaagcagtatgattgcttaagaccaggagttcaagaccagcctgggcaacac

SEQ ID NO: 1343 - DNA, 601 bp, Human
gacagtctagcagtgcgctcacagtagggcttgaacactgctagtaaaacaaaagccatattcctaccttagatctagtatttagccagaaaaacaagtgatgcccataagaaccaaccagagaacagtatctggtactagagtttgaaatcacaagggacagcctataacagtatagtattgatgaagaatgtttctacccaattgaggagtcagctaagtagaaacagaccaaaaggcaaggaagaacagccagcaagccgctcatacctgcccaacagtaaggtggatagagatgtaygttagcatggtaatgacaggaatgaaaaggaaagaatctaaaacgtagtgaagggaggaaatggtagctgcagcgtgcctgggtgcaagagagagaaaagccagaagtccaagcttctgccacacctgtaagtccctggggcaggtgtgttatactgacctagaaatactgtggttttaagagctgggtgtggtggttcacgcctgtaatcccagtgctttgggtggccaaagcagtatgattgcttaagaccaggagttcaagaccagcctgggcaacacagcaagtcccggtctctaa

SEQ ID NO: 1344 - DNA, 601 bp, Human
ggtgtgttatactgacctagaaatactgtggttttaagagctgggtgtggtggttcacgcctgtaatcccagtgctttgggtggccaaagcagtatgattgcttaagaccaggagttcaagaccagcctgggcaacacagcaagtcccggtctctaaataaaaagaaagaaagaaagaaatactgtaattttataaaacagtgagttccatatatattgctgggagaaggcaaaataagacctgtgcttgcttaagaaaatgttcttaaaatcttgatgatactttatatacagggaacttggcagagggagcacaaaaatgatacaagcttacaaaccagagtaattgtcagaaacagtaaagttagaagaaaccagagtcagcaaaaatgaggtgtttggttttaggtacatggagtttgatgtattggcaagatatgcaagtatgtcctgggtaaaaacaaccaaattgtgtttcagctgggggcctccaccaagaccccccaagcctggccagtatagctgtgccgcctctggaattttccccttcggtaacatagacaagatggagaccagtctgatgaatggaatcttggatttc

SEQ ID NO: 1345 - DNA, 601 bp, Human
gggcctccaccaagaccccccaagcctggccagtatagctgtgccgcctctggaattttccccttcggtaacatagacaagatggagaccagtctgatgaatggaatcttggatttcattcatctcatgctgtctcctgcttccccatcctctgctccacacgaacaagtgaagcctctattcacacttacaattccttttcctagttcagtcctctccgtgtctccactcaccacagtaatgccatgccccagcggacagctgagttgctggcagatgcacacaagggtcaagcctgcasatgtcttaacagtggcctatgcaggctctgactttggattgctggggtcttagtcctgaaccccggcctcaataatttccagatgtcctcacatgttccatcgtgaggttattaaaggttaaaatgacttaatggtgtgacacaagctaaatgctacaaaaaacattagttcttgcaaatttttttttttcagagacaagttctcactctgtcacccaggctggagtccagtggcgtaatcataactcactgcagcttcaaactcctgggctgaagcgatcctctaacctcagccttcag

SEQ ID NO: 1346 - DNA, 601 bp, Human
taatttccagatgtcctcacatgttccatcgtgaggttattaaaggttaaaatgacttaatggtgtgacacaagctaaatgctacaaaaaacattagttcttgcaaatttttttttttcagagacaagttctcactctgtcacccaggctggagtccagtggcgtaatcataactcactgcagcttcaaactcctgggctgaagcgatcctctaacctcagccttcagagtagctgggactacaggtgtgcaccaccatgcctggctaattttttttattttttgtagagacagggtttcrctatgtggcccaagctagtctcaaattcctgggctcaagcgatcctcctgcctcagcctcccaagtaacctggattgcaggcacatgccgccacacccagctagttcttgcaattattattattaaggactgtttatccttaggcatcctttctcctcatgtggactttggcctttccgtgacatttggcatctttcatgaatcttctgaaaagcttcaggttaatgtgagctgctttggtatcttaacaccaaaggtgtcattggggtcattgccagtgtccagcatcaacaattcaga

SEQ ID NO: 1347 - DNA, 601 bp, Human
cacttcagatctaggctgtgaataccatcctctgcctctgtgagacaactacagacatttactggggagcccttatggcgaatcctgggaatgtggcaaacctccttaccctggagggagcctctccctggggaatctgcaccaccctacccttccaggaccaaactctctctagttcttctcagtacagtcccttaggctcctagcagtttgggctactacaacaaaacactagctgggcacagtggctcacgcttgtaatcccagcactttgggaggctgaggtgggtggatcacgagstcaggagttcgagaccagcctggccaacatagtgaaacccgtctctactaaaaatacaaaaattagccaggcgtcgtggcacgcacctgtaatcccagctactcgggaggctgaggcaggagaatcgcttgaacttgggaggcggaggttgcagtgagctgagatcacgccattgcactccagcctgggcaacagagcgaaactccgtctcaaaaaaataaaataaaaaaaaccacacaccatagactgggtggcttataaacaacagaaatgtattcctcacagttctggaggctgaaa

SEQ ID NO: 1348 - DNA, 601 bp, Human
taaatagagacaggctcttgctctgtcacctgactaccagcaatcctcctgccttggcctcccaaagtgctgggattacaggcatgagtcaccgaccacgcatccctcaattggtttttttttttttttgagacagactctcgttgtgtcgcccaggctggagtgcagtggcgggatctcagctcgctgcaagctctgcctcccgggttcacgccattctcctgcctcagcctcccgagtacctgggactacaggtgcccgccaccacacctggctaacttttcgtatttttagtagagasggggtttcaccgtgttagccaggatggtctcgatctcctgacctcgtgatccgcccatcttggcctccccaagtgctgggactacaggcgtgagccaccgcgcccggccgcatccctcaattcttaaccactttttgaggcaagggatatttggtcactcagaacttttcagcccccaatccttccataacaataattattacttacttattgagcatttattacagaccaggtgattttgatacatcatctcatttataatgtaggtatcgtccatattttacaggtgaaaaaaactga

SEQ ID NO: 1349 - DNA, 601 bp, Human
aaattgttgaacccaacgactgttgcctgttcaaaagttaaatttaaaattcctcccagactaggtaggggattgggcccagaagctgagaccaggctcacttgaataaatggggtaaatgactaggaattttactattccttacaggtctctcattatcttgtctttgctcccatttttatatttgcagtttaattagacacttcagaattttgatcacctaatgttgatttcagatgtaaaagtcaagagaagactctaaaaatagcaaagatgcttttgagccagaatgccttcatcktcagatcacttaatttggttctcatgggtaagtgctgctttttatcttagctcttatagaagcaagctgtgatgccatcctcactgagagcactggcaggaagtcgcaaactcatttccctgactagaggacccagtaccaccctgcctagtgtcaggagttaagtggaaagcaaataggaaacctacactagtagtttagattcaatgtagattcctgtcctgttgttaattttaggaaaacaaatgagtgacttaaggcaataataatcaggactatcctcgccataatttgaagagt

SEQ ID NO: 1350 - DNA, 601 bp, Human
cgcctgtagtcccagctacttgggaggctgaggcaggagaatggcatgaacctgggaggcggagcttgcagtgagccgagatcgagccgctgcactccagcctgacagagcaagactctgtctcaaaaaaaaaaaaaaaaaaaatctcgtgtgcgtgtgtgtgtgtgtgtgtgtgtgtgtgtgtgtgtgtgtgtgtgtgttttgaggcatagtttcactctgttgcccaggctggagtgcagggtgtgagctcagctcactgcagcctccacctcctgggttcaagcgattctcctgcctyagcctcccaagtagacgggattacaggcacccgccaccatgcccggctaatttttgtatttttagtagagacaaggtttcaccatgttggccatgctggtctcacattgctgacctcaagtgatccaccgccttggcctcccagaatgctggggttacaggtatgagccactgtgtccagccattttttttttttttagacagagtctccctctgtcacccaggctggaatgcagtgagcgatctcacctcactgcagcctccgcctcctgggttcgagctattctcctgccttagcctc

SEQ ID NO: 1351 - DNA, 601 bp, Human
ggttcaagcgattctcctgccttagcctcccaagtagacgggattacaggcacccgccaccatgcccggctaatttttgtatttttagtagagacaaggtttcaccatgttggccatgctggtctcacattgctgacctcaagtgatccaccgccttggcctcccagaatgctggggttacaggtatgagccactgtgtccagccattttttttttttttagacagagtctccctctgtcacccaggctggaatgcagtgagcgatctcacctcactgcagcctccgcctcctgggttcgmgctattctcctgccttagcctcccaagtagttgggactgcaggtgtgcaccaccacacccagctaattttttgtatttttagtagagacagggttttgccgtgttggccaggctgatctcgaatcctgaccttgtgtgatccacccacctcggcctcccaaagtgctgggattacagacgtgagccacgacgcccggccccagatatatttttaagtggaaaaagcagggcagaacagggaccgtacatattgttgttagtgtcagctcccaaatggatcttattttatctcagatcaca

SEQ ID NO: 1352 - DNA, 601 bp, Human
aggctggaatgcagtgagcgatctcacctcactgcagcctccgcctcctgggttcgagctattctcctgccttagcctcccaagtagttgggactgcaggtgtgcaccaccacacccagctaattttttgtatttttagtagagacagggttttgccgtgttggccaggctgatctcgaatcctgaccttgtgtgatccacccacctcggcctcccaaagtgctgggattacagacgtgagccacgacgcccggccccagatatatttttaagtggaaaaagcagggcagaacagggaccrtacatattgttgttagtgtcagctcccaaatggatcttattttatctcagatcacagtccttgcaccatgtgctgctggcaccaatgtagagtaaaaaccatctatgtgggcatttttttggcacaagaaaaatctcaatctgataccaataaatgtgtgttaaagaatgtcagacttagagtaatcattgcaagttgagcccagataaaactattgcctctctaatgtgttttcttccttctagtgtatatcagcctcgtgtttggtatttcatatgattcgcctggtaagagatgttt

SEQ ID NO: 1353 - DNA, 601 bp, Human
atatggggagaggtgatcttttctctctctctgtctctccctctcccttttcctatctacctctccttctctctgcgtttcttattcagagccttaaaaagccaaagacaaaacaccatcacacatccatttttaattcagttgaatactttaataatccaaatctattttgacaaagcttgtatgtgtcatcaaagccaatttctacaggtcagaacctcacatacaaaataattcttgtgtatgggttaggcaatgatttctctaattcagtcagtctgaatgtttaaaagtcctgttrtctgaggacaggaatccaaaggtctattgaccatattgatggtttatgttcacttttctttactctggtgggacaccagaaagctgcctggcctagtctgggacaggcctgggtccatagtctggtttggtcactaaccagcttgacacttggcacggacctcagcccctaagctaatgcctctgctgaggggttgctgcaaggattcgtgacataatggatggagtcctgcttgtcttttgtcttcccacacctaccaatcgcccttagaagtcattgctttgatccagcagccccttg

SEQ ID NO: 1354 - DNA, 601 bp, Human
accaatcgcccttagaagtcattgctttgatccagcagccccttggagtgtccttttgatggttatttatttggcctagagctgctgctgctactgcttattgactgagccagtgggagacctcttgtgagtttctcttcggtgcctgctaaaaagtttttctctgcattgagtggtcacatgtatcatccaactaactgaagcttggtagatgagatatctgcattgtccctgaaatagcccaggtctgacttaggactggatcatctagtcttagccagagagggagggggtctcaggraaggcattcataattgtcccatagaggaagggagatctgaggcttccaccatgagggcccaagtttcattcattcatttactcatccggcaattttttttttttttttgagacggagtctcactgtgtcaccaaggctggagtgcactggtacgatcttggctcactgcaagctccacctcccgggttcacgccattctcctgcctcagcctcccaagtagctgggactacaggcgcccgccaccacgcccagctaattttttgtatttttagtagagacggggtttcaccatgttagcc

SEQ ID NO: 1355 - DNA, 601 bp, Human
gtaaatgtggctggacctggtaggagtttgtgggtctgggtcttctgagtgtgatggaagcctgtggaacccaaggcttaacagagcatcctggctgggctgttaaaaatagaccacaggggcaaagatgggagttaggagaccaactaagacacaatccagggtggcagtcacttaagaggcagtaacaaattatatgattattatcatttttcttttaatatcgacatggattataatcagtactctaggaaaaggagcaaaaatgggtgaaaaataagtttatgtggcctaaggactrtgtggagtgtcattaaatctgtttcaatcatgtctcgtttgtgttcaccccataagcaactaactctatgttttagattatgattcctaaaataagagactgttgcttattaggatattgactactctataagaggaaaaactgtagttaataggcatcttcttcataaggaaaattagcctttaaatccagaaaaaaaaataagctactagtataatctaagcaacagatggtggtggcttggaccttgatagtagaggggtaatgagtagtgagaggccatcaaattctgcatatatt

SEQ ID NO: 1356 - DNA, 601 bp, Human
tcaagtgtaaagtagacacacactgtccatgagagaagataatcttgtaaaaatgacgtcacagagacttttattcctctttgaagacttttatctcatttgtaaaatgaaggcgctagactagatgtcatggttataaaatatgtgtgtgtgcaggtgtatattaaaagtgcatgtaggtgtagttttctgataaattacttgctccagatgacttataaatcctttttcttaccaagcctgtgataaatctaaccctgtttgagatttgaagacaaatcccaaaagagattaaggcctrcctctaaatgaaattctcagtcttactgattttttgcttatgtttacagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcaggtatgttcatttttttaaattcatgttttgagtattcatgcttttactctgagggcaagcctatttaaagaaaagaatctga

SEQ ID NO: 1357 - DNA, 601 bp, Human
tgtatgatctggtagagtcacttttatattgtcataccaaaaaacaatcagatactactcgatgagatcagaaatcttgaaatggaaacgcttttgtttcagggagtcaggattaaattcagcactgtgtgccctttgtgtggccattgctgaagccaaatgccagaagaggtggagttgcttgagacagtggtatacagtggcattaaggggtgaaaaggtggaagcagcgaggttgggtgcagttcatggatgtgatctggcatcagctctcgctcatagatgaaaggaacccttgccmgggtgtacgagaaaatcactgatgaaggctgaacacctttctgttacacagacatcagaacaataaacagtgtgatcccaaaccttcttcccctttggagtgagaacaatcaagcctcggaactccctgctgattgttttctcaggaagtagccaagtttccacctgttttaccaaaagtgagaagctatgcaagtctccctcaaagaagcccttctaaatgtcccaaccgcagtgttaggggaaagaggtcccaatccataccccaagagagggttcttggatcttgcgcaagaaagaa

SEQ ID NO: 1358 - DNA, 601 bp, Human
atctttaatgttctgatttaccagaataaaaataaggtaggatctataaagaaattactttagttgtaaaccaaaataaaattctaagccccccaaccaactgaatggatccctcctctcagccaagggccgagtaaagtaaagtaaacctgaaacactagttcaggccatgatgggagtgagtggtccagacgtgcctcacgggaccttcctacctttggaattcaggcacagctggccagcactaatattaaaacagaaaccttaagactgacaaaaagatgctttgtagcactaatamcagcatgatggatagcaggccctaaaagaaaccaaagtgttttaccccaaaatacatttctttgacatattttgaaatggccctgcaaagctgtctcttgcagggaaaatctgctttctataaagaacccccttcccagtccaggtgttcttcctgatccaagagagaattcactaagagtctggcacttttttaagtccagtaagaaacatttacagtctgttctctctgaagcctgctaccagaggcttcatctgcgtaataggaaccgtggcctccgcaaccctttgtcttaaccca

SEQ ID NO: 1359 - DNA, 601 bp, Human
acgggaccttcctacctttggaattcaggcacagctggccagcactaatattaaaacagaaaccttaagactgacaaaaagatgctttgtagcactaataccagcatgatggatagcaggccctaaaagaaaccaaagtgttttaccccaaaatacatttctttgacatattttgaaatggccctgcaaagctgtctcttgcagggaaaatctgctttctataaagaacccccttcccagtccaggtgttcttcctgatccaagagagaattcactaagagtctggcacttttttaagtcyagtaagaaacatttacagtctgttctctctgaagcctgctaccagaggcttcatctgcgtaataggaaccgtggcctccgcaaccctttgtcttaacccagatgcttccttttattaattccaagtttttaatcagaaaatctttgaatctacctatgacctggaagcccccccacttcgaattgtcccacctttccagattgaaccagtgtacatcttacatgcattgattgatgccttatgtctccctaaaatgtataaaaccaagctgcaccctgaccaagggttctcgggatctcc

SEQ ID NO: 1360 - DNA, 601 bp, Human
cgggaccttcctacctttggaattcaggcacagctggccagcactaatattaaaacagaaaccttaagactgacaaaaagatgctttgtagcactaataccagcatgatggatagcaggccctaaaagaaaccaaagtgttttaccccaaaatacatttctttgacatattttgaaatggccctgcaaagctgtctcttgcagggaaaatctgctttctataaagaacccccttcccagtccaggtgttcttcctgatccaagagagaattcactaagagtctggcacttttttaagtccrgtaagaaacatttacagtctgttctctctgaagcctgctaccagaggcttcatctgcgtaataggaaccgtggcctccgcaaccctttgtcttaacccagatgcttccttttattaattccaagtttttaatcagaaaatctttgaatctacctatgacctggaagcccccccacttcgaattgtcccacctttccagattgaaccagtgtacatcttacatgcattgattgatgccttatgtctccctaaaatgtataaaaccaagctgcaccctgaccaagggttctcgggatctcct

SEQ ID NO: 1361 - DNA, 601 bp, Human
gactatagctctttcaaaaatataaatccaaaataaatgtgcatgtctttgttctaacaccagctatctgacactaactagttgtccaatgattccattcatttctgatactaccccaggttagcacagaccccacaggttaaaggctcagtcccacaaaactgcctgcccccacttcagatgccagccacaagtcatgggtgacaaggttccctgcacttccacctgacttggctacaaattcaggagttcccatgacctccctttaggtttgataatttgctaaaatgactcacagaastcaggaaagtgttatggcttatgattaccattttattataaaggaattgatggacagccattgaagaggtgcacaggacaaggtctgaaagggtcccaagtgcaggagcttctgtccctggggagtcaggtgtaccaccctctctgtacattcatctgttcatgaatttggggactccccaacccttggtgttcacagtttgtattgggtttcattatgtatgtgtgattgattaaattactggctgcaggattgaactcagtctccagcccactcccctccttggatagaggtcaaatg

SEQ ID NO: 1362 - DNA, 601 bp, Human
tccctttaggtttgataatttgctaaaatgactcacagaactcaggaaagtgttatggcttatgattaccattttattataaaggaattgatggacagccattgaagaggtgcacaggacaaggtctgaaagggtcccaagtgcaggagcttctgtccctggggagtcaggtgtaccaccctctctgtacattcatctgttcatgaatttggggactccccaacccttggtgttcacagtttgtattgggtttcattatgtatgtgtgattgattaaattactggctgcaggattgaactsagtctccagcccactcccctccttggatagaggtcaaatgggggagctggaagttccaaccgtctgatcatgtggttagtttttctagggaccagccctcatcctgaagctatccacaccctgccccatcacctcacaagcataaactcatatgtggcccctaaaagaggcttgttaacaaaagacactcctaacgttcaggaaattccacaggtttttgaagctctgctccaggaactagggacaaagactggatatatatgtatattttattatatcattgattttacatacaaacga

SEQ ID NO: 1363 - DNA, 601 bp, Human
tgccacccccctgctcccatacacagtgcttgtctcttgctatttaacttcaggggcttctccagctgggtgcgggaccctggctgtgggggaaggaaggggacccttggggatagctcagctcctcactccacctccctcccccgaggtgctacaaacacagttaagagtgggaggcttcggcccccaggagaggagagagcatgagctccaggcagccccaaagatagggtcccatccccaatgtccggagatgcttctgacctgtccagtcatgcagccaagggagggacaaacccatactcaaacccagggctctgcctccagcctggggctcccagaggcctcgcagcaacttcacttcatagatggctctccaaggggacccttctgtccccacttactccacaagcctcctgatgagcacgcaacacagggctgcctcccccggtatatgggccccactccacagaggtcaggagggggctcccgcctgtcccaccccatatcccgtaccctctccgggcacccaggctatccacccatcccttctccacctctccgggttgggggcccagcacacagagcccagggaagcccc

SEQ ID NO: 1364 - DNA, 601 bp, Human
cagagagatgctgctggggacagggactggtgcctgctctctctctgcctacactgcctgccctgagcgctcgggggtagttcagcttttagccctccctacagccccatgaggaggctctagtatgcctcctttttgccaaatgaggagactaagaaacgggtcaacctctcacccaggcgagaagggcatagagctgggatttgaacctggtcaggtgcagttcggggcccctgctgccatcaggggtatatggtggctggggcagggtggtaaagcaggagctcgggagcccatggtkcatccaacttgacctctgaactcaatggggcctatgtcccctcgtcctctctggccacctccacctgccacccccctgctcccatacacagtgcttgtctcttgctatttaacttcaggggcttctccagctgggtgcgggaccctggctgtgggggaaggaaggggacccttggggatagctcagctcctcactccacctccctcccccgaggtgctacaaacacagttaagagtgggaggcttcggcccccaggagaggagagagcatgagctccaggcagccccaaagatagggtcc

SEQ ID NO: 1365 - DNA, 601 bp, Human
agccatctgattttcagagagatgctgctggggacagggactggtgcctgctctctctctgcctacactgcctgccctgagcgctcgggggtagttcagcttttagccctccctacagccccatgaggaggctctagtatgcctcctttttgccaaatgaggagactaagaaacgggtcaacctctcacccaggcgagaagggcatagagctgggatttgaacctggtcaggtgcagttcggggcccctgctgccatcaggggtatatggtggctggggcagggtggtaaagcaggagctygggagcccatggtgcatccaacttgacctctgaactcaatggggcctatgtcccctcgtcctctctggccacctccacctgccacccccctgctcccatacacagtgcttgtctcttgctatttaacttcaggggcttctccagctgggtgcgggaccctggctgtgggggaaggaaggggacccttggggatagctcagctcctcactccacctccctcccccgaggtgctacaaacacagttaagagtgggaggcttcggcccccaggagaggagagagcatgagctccaggcagccc

SEQ ID NO: 1366 - DNA, 601 bp, Human
gggagcgcctggcagtcactgaggctgcaccctcattctgcaatggggaagctgtgcctcagggaggccaaggaacccacttaaggttgcacggtgaggagaagcccagcctcgggtgacagcaagtggagcccaggacctcgagtttgagcaccccctcctgggtcctcaggcacacccacacgtgccctgtcgttcatgactctgaaactggtcacacccacggatgcctacgtccccaccacagccctgcaaggtgggtcttgctgccccatttgatccatgccagaactgaagcccrgagcggctgaccccagccatctgattttcagagagatgctgctggggacagggactggtgcctgctctctctctgcctacactgcctgccctgagcgctcgggggtagttcagcttttagccctccctacagccccatgaggaggctctagtatgcctcctttttgccaaatgaggagactaagaaacgggtcaacctctcacccaggcgagaagggcatagagctgggatttgaacctggtcaggtgcagttcggggcccctgctgccatcaggggtatatggtggctggggcagggtg

SEQ ID NO: 1367 - DNA, 601 bp, Human
caggatgaccccatgcccaggacaggaactgcagagagccccagtgtgtgaggaaggtgctgagggacaaaggggtgcaaggtcaaaggaaggttaggggtaaaccacaggcccagcctagaggcagccgggcaggaggagaaagcgccatctggagtctgcttcccgccgcctggagctcagaggtgcagcgatgctcggagagggcagagtccacgggaggatggtgtgggggtgccagaggggcacagagctgagggagcgcctggcagtcactgaggctgcaccctcattctgcaayggggaagctgtgcctcagggaggccaaggaacccacttaaggttgcacggtgaggagaagcccagcctcgggtgacagcaagtggagcccaggacctcgagtttgagcaccccctcctgggtcctcaggcacacccacacgtgccctgtcgttcatgactctgaaactggtcacacccacggatgcctacgtccccaccacagccctgcaaggtgggtcttgctgccccatttgatccatgccagaactgaagcccggagcggctgaccccagccatctgattttcagagagatgctgct

SEQ ID NO: 1368 - DNA, 601 bp, Human
cctttccctgggtcccctacagatcctgccatccttcaagcccatttcaaacgggccctcatgcctttttccatgaagccttccctgatttccgtgatggagggcgagggcttcctcttctgagcgccttgctcctccctctaggctggcagcagcagggccggcgttgaccaggggctggcccaccagcacactcgctccagggactgctgagcacagggccgggcacacagtcggtgctcaataaatgtagtgaaatgaatgagtgtggtcagaggcctcagtacggcaaaaaaaaaaagcagagctctttaggtggccctggattgtctcgtggcttacatcagagccagcatggagcagggacacacaccctggccccaagagccatgggttccatctcctaaggcagatgtcacaggagtgagagtcagaggcccacgcactgtcaaagctgcaaaggctctctgagcaagcacagtcccttgttctacatttgagaacactgaggtcccgaagtgggaaagacttgctgaaggttacatcaggagcccagcacagagctgggatcagaacccaactccacgccgctctgccaccc

SEQ ID NO: 1369 - DNA, 601 bp, Human
gcggctccaaactcgagctctcactccccttcccttctctctcttgagcctctcactggctccagccctcagcttcccagggtctttctccagctcagccccaagcctccacgtccctcccgatggtctgcaggaccccctcacaggggatgctcctggacccggcaaaaacccagctcatccccagctcttctcctgtctgactttcagttctgggacaactgtacccttcctattccaggtgacctttgcccccatacctagccagtcaggactctcctcagacagcaggacactccartgactacttgttgtctcttccccaccctcaccaggccagcctcgtgccgttccagcccagacaacggcaccaccccatctgcaggctctcacctgccttccctgaagcccgcctccaaccacccacatccctgcccaggaacctgcagtggccctgttgcaatcaaagcctaaattcccattttcgaggctttctgggaccggaatgaggtcagcccacccttccagaccctgccctcacaggagcaggtgcatgtacccaggccaaagcacacacacaccgcacctacctgcctgcaca

SEQ ID NO: 1370 - DNA, 601 bp, Human
aagtagctgcccccaccctctgcaggggctgggtgtgcggaggggaatgagaaagtgagcacatggtcacttcgggaagataaggggactgcttccaggagaggtgtttggagcaggcaaagggggaggcagggagatgaggagggagcttccagggaaagatgagggtagcctcagtcagaggggcagggggagaggggagaggagcaggtgagtcaagagatgtggaggaggtggaacatccttccctccctcctgctcttccatctcgagagcttccaaggctcctgagcgttgggcwtttcccccgctgttcccccttctccagcggctccaaactcgagctctcactccccttcccttctctctcttgagcctctcactggctccagccctcagcttcccagggtctttctccagctcagccccaagcctccacgtccctcccgatggtctgcaggaccccctcacaggggatgctcctggacccggcaaaaacccagctcatccccagctcttctcctgtctgactttcagttctgggacaactgtacccttcctattccaggtgacctttgcccccatacctagccagtcagga

SEQ ID NO: 1371 - DNA, 601 bp, Human
agccaaccgtggaagctcccgtgaggcaagaccacaactgtcgcagcggaaatgggaaagaaaagtagctgcccccaccctctgcaggggctgggtgtgcggaggggaatgagaaagtgagcacatggtcacttcgggaagataaggggactgcttccaggagaggtgtttggagcaggcaaagggggaggcagggagatgaggagggagcttccagggaaagatgagggtagcctcagtcagaggggcagggggagaggggagaggagcaggtgagtcaagagatgtggaggaggtggarcatccttccctccctcctgctcttccatctcgagagcttccaaggctcctgagcgttgggcatttcccccgctgttcccccttctccagcggctccaaactcgagctctcactccccttcccttctctctcttgagcctctcactggctccagccctcagcttcccagggtctttctccagctcagccccaagcctccacgtccctcccgatggtctgcaggaccccctcacaggggatgctcctggacccggcaaaaacccagctcatccccagctcttctcctgtctgactttcagtt

SEQ ID NO: 1372 - DNA, 601 bp, Human
acctgcctggaagctccctggaggcagggccaggttggtcacccagattataccccagggaggaaagagacatgaaatctctaagccagccctgtcagagggaggctcaaaagttttcccggagtgcctattatgcactggccactggccagtgctttatttatttactttttttttttgagacaaagacttgcttctcagggaacctctagccaaccgtggaagctcccgtgaggcaagaccacaactgtcgcagcggaaatgggaaagaaaagtagctgcccccaccctctgcaggggmtgggtgtgcggaggggaatgagaaagtgagcacatggtcacttcgggaagataaggggactgcttccaggagaggtgtttggagcaggcaaagggggaggcagggagatgaggagggagcttccagggaaagatgagggtagcctcagtcagaggggcagggggagaggggagaggagcaggtgagtcaagagatgtggaggaggtggaacatccttccctccctcctgctcttccatctcgagagcttccaaggctcctgagcgttgggcatttcccccgctgttcccccttctccagc

SEQ ID NO: 1373 - DNA, 601 bp, Human
ttattcatcgtttattgactgattcatgttttcctctatctctcttcacaaacacacacagagtcacgtaagctcactaaggacaggtatttttgtgttttgttcattgctaggtccacaattcctagaacagtgcctggcacatagtaggcatctggccaaaaaaaattcttgaacaaacaagtgatggaataaatatagacagagctaaagtcagcaggtagaggggcttccagagggctctgaggctagcccctgcctctgcccctcactgtccctcgagggagctgaggcaatggtstgaaggcatcaggacgcgaactcggaaaagcagaaaagcagataggagctctgacccaaacactgaagagccctagaggacaggggaaactgaggcacagagggctgcagtagcctttacggaggaccttgtccacactcgtactcccctacctgcctggaagctccctggaggcagggccaggttggtcacccagattataccccagggaggaaagagacatgaaatctctaagccagccctgtcagagggaggctcaaaagttttcccggagtgcctattatgcactggccactggcc

SEQ ID NO: 1374 - DNA, 601 bp, Human
ttccttcaagtttctgctcaactgcagcctcctttgagaggtcttctttgactagactacataaagaagcacccgtcgtggccaggcgtgtggctcatgcctgtaatcccagcactttgggaggtcgaggcagacgaatcacctgaggtcaagagtttgagaccagcctgaccaacatggtgaaaccctgtctctactaaaaatacaaaaattagccgggcaaggtggtgggtgcctgtagtcccagctactcgggagtctaagacaggagaattgcttgaacctggaggcggagtttgcrgtgaaccgagatggcaccactgcactccagcctggacgacagagtaagactctgtctcaaagaaaaaaataaaagaagcaccctttgttactcaccacccccctacattttcatcatagcattatttattcatcgtttattgactgattcatgttttcctctatctctcttcacaaacacacacagagtcacgtaagctcactaaggacaggtatttttgtgttttgttcattgctaggtccacaattcctagaacagtgcctggcacatagtaggcatctggccaaaaaaaattcttga

SEQ ID NO: 1375 - DNA, 601 bp, Human
ggcagggacagaaagtagcacaagcctgtggcttggagaggcgtgtgtgtgtgtgtgtgtgtgtgtgtgtgtgtgtgcgcattcatgcatgcatgccagggcaggggtccaggacagagggtgaggcaggaggtggacacctggtctctggccccatccccttctgggaagaggctttagcagggccttagccatctctccatagggaaagcagagctgttcagatgtcagggtcctcaccattcaccgctgcagatgcccaagaggtagccaggggcaggaggaggatgaggaggggcasacgccaggacagagcaggggccgccattacatccacagggtggagccgaggaaggaagccctggtgggagaggagaaagagagagcacacgtaaatacacatcccaggcctcgctgcccctagaggcaggctgggcccgccccctcagtgtgcatggtctgcactcctcggtgccagctcagtccagccccagggcctttgcacctgctaatcccaccaccctacacatgctcacacccttccttcaagtttctgctcaactgcagcctcctttgagaggtcttctttgactagactaca

SEQ ID NO: 1376 - DNA, 601 bp, Human
gaactgggaagtgcctgccgggcaagatgaggtgtgagtgctgactgtaggtgcccacagcccccccaagacacgcccactgcccctgcacctggcacccacacctgccagaggaggaggtgggtaactctggcaagcggagaagggattcatggacccacttcagagaggaggaaatggagctccagagcctgcaagttcctacaggcaaactaaggcaaggcagggacagaaagtagcacaagcctgtggcttggagaggcgtgtgtgtgtgtgtgtgtgtgtgtgtgtgtgtgtgcgcattcatgcatgcatgccagggcaggggtccaggacagagggtgaggcaggaggtggacacctggtctctggccccatccccttctgggaagaggctttagcagggccttagccatctctccatagggaaagcagagctgttcagatgtcagggtcctcaccattcaccgctgcagatgcccaagaggtagccaggggcaggaggaggatgaggaggggcagacgccaggacagagcaggggccgccattacatccacagggtggagccgaggaaggaagccctggtgggagaggagaaag

SEQ ID NO: 1377 - DNA, 601 bp, Human
gcatgtgaactgggaagtgcctgccgggcaagatgaggtgtgagtgctgactgtaggtgcccacagcccccccaagacacgcccactgcccctgcacctggcacccacacctgccagaggaggaggtgggtaactctggcaagcggagaagggattcatggacccacttcagagaggaggaaatggagctccagagcctgcaagttcctacaggcaaactaaggcaaggcagggacagaaagtagcacaagcctgtggcttggagaggcgtgtgtgtgtgtgtgtgtgtgtgtgtgtgtgygtgcgcattcatgcatgcatgccagggcaggggtccaggacagagggtgaggcaggaggtggacacctggtctctggccccatccccttctgggaagaggctttagcagggccttagccatctctccatagggaaagcagagctgttcagatgtcagggtcctcaccattcaccgctgcagatgcccaagaggtagccaggggcaggaggaggatgaggaggggcagacgccaggacagagcaggggccgccattacatccacagggtggagccgaggaaggaagccctggtgggagagg

SEQ ID NO: 1378 - DNA, 601 bp, Human
ctgggccccaactcctgtgattcaaaaagtctgtgggtcccattagtccaagattctgtaaacgttgactccttggagtccagtgcataggatccagaatatgagatcccaccatcctaagattctgcagtgtggccagtggactcaccgtctgtccggccaggcatggacttggcaggaagtgtcctgcagagccccatcttggctccagacacaggagatgttggctctcgagttgtagaagcatgtgaactgggaagtgcctgccgggcaagatgaggtgtgagtgctgactgtaggygcccacagcccccccaagacacgcccactgcccctgcacctggcacccacacctgccagaggaggaggtgggtaactctggcaagcggagaagggattcatggacccacttcagagaggaggaaatggagctccagagcctgcaagttcctacaggcaaactaaggcaaggcagggacagaaagtagcacaagcctgtggcttggagaggcgtgtgtgtgtgtgtgtgtgtgtgtgtgtgtgtgtgcgcattcatgcatgcatgccagggcaggggtccaggacagagggtgaggcagga

SEQ ID NO: 1379 - DNA, 601 bp, Human
cccacctagagccctccaaagctccatgaggcttaggatgaagatagatccttaattaggccttcagagccgtgtggaatcaccacccacccagaagccagggcccgaacctgccttacccctccatctccctccccattttcccccaccccacaccctatggaatccacctgggcccagccacctctctgtggtcttcctcttctccctgaccccatcaagcctacctggggtcagtccctcactcactggccgcctggatgtttacatcacagtgacatctctctcccatccaccaggyacccaaaccactcccaggttccctgtccccacagctgcctacagggtctctcaaaatccgagcttatccaaaaagcttggggaccctcctttctccccacttcctctctgcttgcctctagagtggagtccagccttggcatagcaggcttgcagctcagtgtccccaaactaccctgtccagttcatccccagcccctccactgcagcctggactccacccaggttctagaagtctaaatagctgactcccaaattctcttaaacgatcccttgattccaggcctgggccccaactcct

SEQ ID NO: 1380 - DNA, 601 bp, Human
ctgcagccacccaagtcgtggccacagagccaggtgtccctgcactctcaggggccctggtccaaacccaagcctccaggtgatcttgcaagcagggagcacgcaggagacccaccctcccgggcacagctgcagctacccaagttgtggctgtggacccaggcatccctgcactctcagggtctgggaagatccccccttgcctccgcaggctcagagctgtctgttcccactgcttggcctctcccctgcttctggcacccgatctgatcctggaggcacagtcggggctacgcactcygtggatccagtgtgagtcggggacaagcgggacccctgccccttccgaggtagccaggagctctcctggggcagctgcagctgcccaagccaggacccaggcatctctactgcccccacaagctcaggggtgtctgctcccactgtctggcctcctcctgctccagtgcccactccaatctcagagcgggaccaagcccaggcactaccacagcctggcacgctcgaggcagcactgactcactggccccagctgcctcggccccctctggactttaggcaccaatgagcacagggggat

SEQ ID NO: 1381 - DNA, 601 bp, Human
ccaggaggctttgacagacaataatttgatgtacactcatatggacatggccatatgccctgcaagaggcagcctaatgcaacggtgagaagcctgaactgggagcccgcaggcctgggttcaatcccagctgtgtacttcctggctgtgtgaccttgggcagagaccatacctctctgagcctcagtgtcttcattggtaagaaggggacagtgctgatgttgacccatggggctgtaggtgaaggccgcagctgcccatccggagtggccgctgctaaaactctggctgcagccgggargcgtagctggggtctcctgctccacggagcaggtaggagccctgccctcccaggcagggctgcagctgcctaagtcttggctgtggacccaggcctcctggtgctgttgggggctgggatcaggcaagagccccgctctcctgggcgcagctgcagccacccaagtcgtggccacagagccaggtgtccctgcactctcaggggccctggtccaaacccaagcctccaggtgatcttgcaagcagggagcacgcaggagacccaccctcccgggcacagctgcagctacccaagttgtgg

SEQ ID NO: 1382 - DNA, 601 bp, Human
gccgcccaggaggctttgacagacaataatttgatgtacactcatatggacatggccatatgccctgcaagaggcagcctaatgcaacggtgagaagcctgaactgggagcccgcaggcctgggttcaatcccagctgtgtacttcctggctgtgtgaccttgggcagagaccatacctctctgagcctcagtgtcttcattggtaagaaggggacagtgctgatgttgacccatggggctgtaggtgaaggccgcagctgcccatccggagtggccgctgctaaaactctggctgcagcsgggaggcgtagctggggtctcctgctccacggagcaggtaggagccctgccctcccaggcagggctgcagctgcctaagtcttggctgtggacccaggcctcctggtgctgttgggggctgggatcaggcaagagccccgctctcctgggcgcagctgcagccacccaagtcgtggccacagagccaggtgtccctgcactctcaggggccctggtccaaacccaagcctccaggtgatcttgcaagcagggagcacgcaggagacccaccctcccgggcacagctgcagctacccaagt

SEQ ID NO: 1383 - DNA, 601 bp, Human
gttacaggaggcatgcaagctggtaagcccccacaaaggtacagttctggaactatacctgtttaacattttttagtgtgaaaggccctcccctcccctatctctccccatccctacgccttgaattttctggaagaaaatggccaggtattgagcattttcctatgagcagtcactgctcagatgccttagcccctcaatgcacacagcatccatcccatggtatgggtgggaagcctgaggcttgggctggtcaagggacctgcgccaggtcatgcagatgaacagcaggggagcccargtttaaacccaggccctctgtgtccccctacagggtgactgcatctccgagtcctggcttgtcatgcctgacagagggctgccgagtgagcagcttaaggcatcctgccactgtgcagctgccaaccctacagcccggcagccctgcgggaggaagctctagtgcaggcctcttaggatctggggtccaggatgctgatttcagggccgggaccttgggcaccgtccctctggtctgcataagacccactatgggcaaaccttaaacctgatcgttggaattccccaaactggccagttc

SEQ ID NO: 1384 - DNA, 601 bp, Human
gccttcagggtgctcacagcccagtgaaagagacagacctacaatcaggcagtaacaacccaggacatacattcccagaaagaggaggtacaaagggctaggggagtctaggaaggcctcctggaggaagtgactttcaactaagcctcgaaacgtgagtgggaattttccaggtgtaaagggccttccaggcagtgggatcggcatgtgcaagggctcagaggcagggataggcaaggtgggtttggagagttggcctttggctgtagcagaaatataggcctcaagaggaggagtgccrgggaggaggcccagggctggatcctgagcggccttgaatgccagaggaaggagccaggacgtcatcccgagaacagcgggcggtgaggtgatcagatgtgggtgtggaagctgccggggagaaaggctggagcagggaagatcccagaggaggtggaaggaaggaggtgcccagccctgccccagccccaccctggcttcctcactcacggttctcaaagggcttgaagtcctggatggccatcaccctccatcgcaccccctcacggcacagcaccctcagggtgacgatgtcaactgt

SEQ ID NO: 1385 - DNA, 601 bp, Human
ccacgtggacaacttggagggagatgggggccatcaggcgaactggagacaagagggggtacgggagagcagtcagccatgacctccacctcccactttgtacctgccactcctccctcctggcacatgctaccacctcccctaccccccgacccaaagccccaggacccgctccctcactgcctccaggcctctctcaatgatcacctcttgagagaagccttccctgaccactcaccactctgcatcccccttgcctgtttcacttttattcccagtgcttatcatcacctgacctacraaatatatggtttggtttctttactcattttctgtctcccccagcagactgtgagctccttgagggcagggacttggttgtctgctgtgtccttggcacctggaagattacctggcacttgattcagtagctgctggatgaatgactcacggcagcttttctctgcacttacaattgacctgagagctttccatggatcatctcatttattttaagtgtgatgattataacactgtgattctgaagttaaatgaatctcagtttctatacttctaagactctatagaaccacataagtga

SEQ ID NO: 1386 - DNA, 601 bp, Human
ccccgctgcagtctagtctccacaggaccagaaagtgggacgtctccgcacacctctcccaccctgggtcactctttttgcctcctcctgctccccagacacatagcagcatcctgcctttgccgtggcaggtctttctaattttgcaaaacttctccccagatctttgcaggtcagctccttctggacacccaggtgtccaaggggccttccctggtcacctgagtctgaagtagcctgtgccagtcactgtcaaattccttgccccgttgggttttcttgatggaacttatcactatcygggtgcctcactatcccagaccctgtcgctacatctgctgactgactgcctgcctgccctgccccagtctgagattcctgagagtggaagtttgctgagctcaccctccgctctctccccatcattcagcgcatagtaggtgctcagcaaatatttattgagtgagcagttgagtgaatgaagaaatgagtgtaagtgaatgaataagcaacaggcccgcacggatgtggagcagatgggctttgacacgtggagggttggcttccctggcctctgaaagcccatggggctgggcagctg

SEQ ID NO: 1387 - DNA, 601 bp, Human
tcctgcttctgcttgagagtcagcaggggggcctcctgggtcggagacaggactgtcagcgcccacctcacctcccatggcagggccaggaggctgagcatcacagaacccccccccaacccctgccagctgcacccccacttccttgccacccaaagctccctcactacccagttgctggggcctcaaaccccagggtcatcccctaaagcccaagtcatcagctaatcagctggttccacctccagaacctggttccacctccacagccattccagaaccatccccctctctccccgcygcactcaccccaggcctgagctgccgccctctcccaagcctgcagctggtctctggttcccacccgtgccccgctgcagtctagtctccacaggaccagaaagtgggacgtctccgcacacctctcccaccctgggtcactctttttgcctcctcctgctccccagacacatagcagcatcctgcctttgccgtggcaggtctttctaattttgcaaaacttctccccagatctttgcaggtcagctccttctggacacccaggtgtccaaggggccttccctggtcacctgagtctgaa

SEQ ID NO: 1388 - DNA, 601 bp, Human
ggtgtctggggtgagcgtctccaggcagatccattcctgcttctgcttgagagtcagcaggggggcctcctgggtcggagacaggactgtcagcgcccacctcacctcccatggcagggccaggaggctgagcatcacagaacccccccccaacccctgccagctgcacccccacttccttgccacccaaagctccctcactacccagttgctggggcctcaaaccccagggtcatcccctaaagcccaagtcatcagctaatcagctggttccacctccagaacctggttccacctccayagccattccagaaccatccccctctctccccgctgcactcaccccaggcctgagctgccgccctctcccaagcctgcagctggtctctggttcccacccgtgccccgctgcagtctagtctccacaggaccagaaagtgggacgtctccgcacacctctcccaccctgggtcactctttttgcctcctcctgctccccagacacatagcagcatcctgcctttgccgtggcaggtctttctaattttgcaaaacttctccccagatctttgcaggtcagctccttctggacacccaggtg

SEQ ID NO: 1389 - DNA, 601 bp, Human
ccagccgccccctcctgcctgagccccctctcacccttgccgcccaccagtacctgcaggctttgtcctgaaggccaggggctggctccaggggctccaggtcgtgaactcgccttgcagaggcttgacccgcacctgaaactcatactgggtgtctggggtgagcgtctccaggcagatccattcctgcttctgcttgagagtcagcaggggggcctcctgggtcggagacaggactgtcagcgcccacctcacctcccatggcagggccaggaggctgagcatcacagaacccccccccaacccctgccagctgcacccccacttccttgccacccaaagctccctcactacccagttgctggggcctcaaaccccagggtcatcccctaaagcccaagtcatcagctaatcagctggttccacctccagaacctggttccacctccacagccattccagaaccatccccctctctccccgctgcactcaccccaggcctgagctgccgccctctcccaagcctgcagctggtctctggttcccacccgtgccccgctgcagtctagtctccacaggaccagaaagtgggacgtctccg

SEQ ID NO: 1390 - DNA, 601 bp, Human
tccagccgccccctcctgcctgagccccctctcacccttgccgcccaccagtacctgcaggctttgtcctgaaggccaggggctggctccaggggctccaggtcgtgaactcgccttgcagaggcttgacccgcacctgaaactcatactgggtgtctggggtgagcgtctccaggcagatccattcctgcttctgcttgagagtcagcaggggggcctcctgggtcggagacaggactgtcagcgcccacctcacctcccatggcagggccaggaggctgagcatcacagaacccccccycaacccctgccagctgcacccccacttccttgccacccaaagctccctcactacccagttgctggggcctcaaaccccagggtcatcccctaaagcccaagtcatcagctaatcagctggttccacctccagaacctggttccacctccacagccattccagaaccatccccctctctccccgctgcactcaccccaggcctgagctgccgccctctcccaagcctgcagctggtctctggttcccacccgtgccccgctgcagtctagtctccacaggaccagaaagtgggacgtctcc

SEQ ID NO: 1391 - DNA, 601 bp, Human
ttacagcaagtgagggatggagctgactgctataccctcaccccaggcagggagagaatggagcagctcctcctccagccgccccctcctgcctgagccccctctcacccttgccgcccaccagtacctgcaggctttgtcctgaaggccaggggctggctccaggggctccaggtcgtgaactcgccttgcagaggcttgacccgcacctgaaactcatactgggtgtctggggtgagcgtctccaggcagatccattcctgcttctgcttgagagtcagcaggggggcctcctgggtcrgagacaggactgtcagcgcccacctcacctcccatggcagggccaggaggctgagcatcacagaacccccccccaacccctgccagctgcacccccacttccttgccacccaaagctccctcactacccagttgctggggcctcaaaccccagggtcatcccctaaagcccaagtcatcagctaatcagctggttccacctccagaacctggttccacctccacagccattccagaaccatccccctctctccccgctgcactcaccccaggcctgagctgccgccctctcccaagcctg

SEQ ID NO: 1392 - DNA, 601 bp, Human
cagcagacctgctgagggccaggctgccgggacatcacacgccttcctcacagcagctctgcctcacggtcactgtacccatttcacagatcaggccgagaggtgaaagcagccacccccagccccagaagaaaccaggagttggagatttcagggtggagaagagtgaaaacagcctttcgacccctccccaactcacaaggcccatggcaagccccgtcccctcactgaacccctgttcctgtctgaaaagcgagccccctgcagggttacagcaagtgagggatggagctgactgctrtaccctcaccccaggcagggagagaatggagcagctcctcctccagccgccccctcctgcctgagccccctctcacccttgccgcccaccagtacctgcaggctttgtcctgaaggccaggggctggctccaggggctccaggtcgtgaactcgccttgcagaggcttgacccgcacctgaaactcatactgggtgtctggggtgagcgtctccaggcagatccattcctgcttctgcttgagagtcagcaggggggcctcctgggtcggagacaggactgtcagcgcccacctcacctc

SEQ ID NO: 1393 - DNA, 601 bp, Human
tgcttgggcttgaactcgaaatgtggtgcgatgagggacaggcgcccagcagacctgctgagggccaggctgccgggacatcacacgccttcctcacagcagctctgcctcacggtcactgtacccatttcacagatcaggccgagaggtgaaagcagccacccccagccccagaagaaaccaggagttggagatttcagggtggagaagagtgaaaacagcctttcgacccctccccaactcacaaggcccatggcaagccccgtcccctcactgaacccctgttcctgtctgaaaagcragccccctgcagggttacagcaagtgagggatggagctgactgctataccctcaccccaggcagggagagaatggagcagctcctcctccagccgccccctcctgcctgagccccctctcacccttgccgcccaccagtacctgcaggctttgtcctgaaggccaggggctggctccaggggctccaggtcgtgaactcgccttgcagaggcttgacccgcacctgaaactcatactgggtgtctggggtgagcgtctccaggcagatccattcctgcttctgcttgagagtcagcaggg

SEQ ID NO: 1394 - DNA, 601 bp, Human
cacagggaaaggccaggttttggacagggaggactctttggagggtagacgaagcacgggtgtatcagagcagggggttcggtccagaatctgacctggcaaggtggcatgtgttcatgtaagtgtgtgtgtgtgtgtatgtgtgcttgtgtgcgtgtgtgtgcatgtgtgtgcatgtgtgtgcacgttggaggggtgggagcatgaaggaaggggaggagaaccttcttaccatggcccggtgttcctgcagttgatcagcaagtacactaagatgatgaagccaaaagccccgctgagrcccacgaggaggtggccgagccacggaatggtgtccttcccaagggctgcccaggggtgggagaaacagcaaggagaggggttagagaagtgccctcactcaccctgggtcggtcaccccaacacccccatccagggccctgccacgcaggcctgcgtctggggggctggggacagggttctgctaagcccatcctctgggaagccagatttcatgctaaaaagaaatgacacggtggcattctaagagctcctccagctccagacagatcccatgggcccccctggtgagcctacagcc

SEQ ID NO: 1395 - DNA, 601 bp, Human
ggaccggcggggacccagacacagagacagctgacatgtgcacacgggcatccccagtcctgagagcagtgttctggacagggccccggggctctccctggagggctgcacctcccaccttcccctcgggttggttccacagggtccccctgtggggatgcgacacagggaaaggccaggttttggacagggaggactctttggagggtagacgaagcacgggtgtatcagagcagggggttcggtccagaatctgacctggcaaggtggcatgtgttcatgtaagtgtgtgtgtgtgtgtatgtgtgcttgtgtgcgtgtgtgtgcatgtgtgtgcatgtgtgtgcacgttggaggggtgggagcatgaaggaaggggaggagaaccttcttaccatggcccggtgttcctgcagttgatcagcaagtacactaagatgatgaagccaaaagccccgctgaggcccacgaggaggtggccgagccacggaatggtgtccttcccaagggctgcccaggggtgggagaaacagcaaggagaggggttagagaagtgccctcactcaccctgggtcggtcaccccaacacccccatccaggg

SEQ ID NO: 1396 - DNA, 601 bp, Human
ctgcatgattgtctgccttcccccactgggccgtgagctgcctggagctggggcgcatgcatgcggcctgccactgtgttcccagctctttgagctgtacctggcatgcagctcgtactcagtgaatatgggaataagcgaatgacagacctagatggaccggcggggacccagacacagagacagctgacatgtgcacacgggcatccccagtcctgagagcagtgttctggacagggccccggggctctccctggagggctgcacctcccaccttcccctcgggttggttccacagggyccccctgtggggatgcgacacagggaaaggccaggttttggacagggaggactctttggagggtagacgaagcacgggtgtatcagagcagggggttcggtccagaatctgacctggcaaggtggcatgtgttcatgtaagtgtgtgtgtgtgtgtatgtgtgcttgtgtgcgtgtgtgtgcatgtgtgtgcatgtgtgtgcacgttggaggggtgggagcatgaaggaaggggaggagaaccttcttaccatggcccggtgttcctgcagttgatcagcaagtacactaagatgatgaa

SEQ ID NO: 1397 - DNA, 601 bp, Human
cccttcctcagggaaaccagccctggccacgccccagccaagtttcccctccctgttttctgctcctgatacagtcagcactcaggatccgtgggttctgcactcacggattcagccaatctctgatcaaaaatattcaggaaaaaaaaaccctcatagcaatacaataataaaaaataatacaaatttttaaaatacagcataacaactatttacatagcatttacatggtattaggtattataagtaatctaggagatgacctaaagtctctgggagggtgtgtgtaggttacacgcaratattctgctgtgttaaatcagggacttgaggccgggcgtgggggctcacacctgtaatcttagcattttgggaggccaaggcgagtggatcacctgaggtcaggagtttgaaaccagcttggccaacatggtgaaaccccgtctgtactaaaaatacaaaaacttagcagagcacggtggcgtgtgcctgtagtcccagctactcgggaggatgacgcaggagaatcgcttgaaccctggaggtggaggttgcagtgagtcgagattgcgccactgtactccagcctaggtgacagagt

SEQ ID NO: 1398 - DNA, 601 bp, Human
tgcctgggacactctccccatcccctccacaccccccatgggctcccactacagatttcaacagaatcatcccttcctcagggaaaccagccctggccacgccccagccaagtttcccctccctgttttctgctcctgatacagtcagcactcaggatccgtgggttctgcactcacggattcagccaatctctgatcaaaaatattcaggaaaaaaaaaccctcatagcaatacaataataaaaaataatacaaatttttaaaatacagcataacaactatttacatagcatttacatgktattaggtattataagtaatctaggagatgacctaaagtctctgggagggtgtgtgtaggttacacgcagatattctgctgtgttaaatcagggacttgaggccgggcgtgggggctcacacctgtaatcttagcattttgggaggccaaggcgagtggatcacctgaggtcaggagtttgaaaccagcttggccaacatggtgaaaccccgtctgtactaaaaatacaaaaacttagcagagcacggtggcgtgtgcctgtagtcccagctactcgggaggatgacgcaggagaatcgc

SEQ ID NO: 1399 - DNA, 601 bp, Human
ccaggtcctcaccacagcctgaggccccaggaagcatcactgccgccacaggcccaggctcaagttcagcctcctgccccacccacttctgtctccagccacaccagcgcccctgcactctgttcctggaagtttcttccctcctgcctgcccagggcctttgcacatgctgtttcctctgcctgggacactctccccatcccctccacaccccccatgggctcccactacagatttcaacagaatcatcccttcctcagggaaaccagccctggccacgccccagccaagtttcccctcyctgttttctgctcctgatacagtcagcactcaggatccgtgggttctgcactcacggattcagccaatctctgatcaaaaatattcaggaaaaaaaaaccctcatagcaatacaataataaaaaataatacaaatttttaaaatacagcataacaactatttacatagcatttacatggtattaggtattataagtaatctaggagatgacctaaagtctctgggagggtgtgtgtaggttacacgcagatattctgctgtgttaaatcagggacttgaggccgggcgtgggggctcaca

SEQ ID NO: 1400 - DNA, 601 bp, Human
ctggccagtcctggcatcagttaaaaggcaatggtagcccctgactcactgccttcccagtgctggggaaagtcgagtgaggtgacacagctaggcacgctttgcaaacctcttgggagaagcagggctctcatcagggggccacaacccccggtcagaagtgtcacctcctcaccgctttgccctccaccaggccacgctccacacagcagccagggctacagagggcgaagtggatcctgtcccacttctggggaaaccctccatgactgctcggcacacggcccaggtcctcaccacrgcctgaggccccaggaagcatcactgccgccacaggcccaggctcaagttcagcctcctgccccacccacttctgtctccagccacaccagcgcccctgcactctgttcctggaagtttcttccctcctgcctgcccagggcctttgcacatgctgtttcctctgcctgggacactctccccatcccctccacaccccccatgggctcccactacagatttcaacagaatcatcccttcctcagggaaaccagccctggccacgccccagccaagtttcccctccctgttttctgctcct

SEQ ID NO: 1401 - DNA, 601 bp, Human
tccaggacgagggtcaggagagcggcagtcactcctaactggctatgtgaccttgggcaagtcagctgacttctctggccagtcctggcatcagttaaaaggcaatggtagcccctgactcactgccttcccagtgctggggaaagtcgagtgaggtgacacagctaggcacgctttgcaaacctcttgggagaagcagggctctcatcagggggccacaacccccggtcagaagtgtcacctcctcaccgctttgccctccaccaggccacgctccacacagcagccagggctacagagrgcgaagtggatcctgtcccacttctggggaaaccctccatgactgctcggcacacggcccaggtcctcaccacagcctgaggccccaggaagcatcactgccgccacaggcccaggctcaagttcagcctcctgccccacccacttctgtctccagccacaccagcgcccctgcactctgttcctggaagtttcttccctcctgcctgcccagggcctttgcacatgctgtttcctctgcctgggacactctccccatcccctccacaccccccatgggctcccactacagatttcaaca

SEQ ID NO: 1402 - DNA, 601 bp, Human
ctgagtgcctggaagctgtgtacatcaccgtgaagaaagaggcaccatttttgatttgcccaaaggttccacacagctggtggaggccctcaagggccagggtgtactgcagcgcagtgagcggcctctgaagagtgttaaacaggagaatgacatggtggagaaagcactgaaggggcgcaagaacgacaaggaggagggcagtctggaggccactgaacccatgcctgggagaggacctctccctctacagggacatggtttccctgaaggcctgcagggagctgtgggcggaggggaygggtgggtggaggaatgcttgtcttcttgggaggaaagaggaaacggggctccgaacactgccgagaaccactgctccaggacgagggtcaggagagcggcagtcactcctaactggctatgtgaccttgggcaagtcagctgacttctctggccagtcctggcatcagttaaaaggcaatggtagcccctgactcactgccttcccagtgctggggaaagtcgagtgaggtgacacagctaggcacgctttgcaaacctcttgggagaagcagggctctcatcagggggccacaacccc

SEQ ID NO: 1403 - DNA, 601 bp, Human
tggcaaggagtgggaagacccgggttctagccctggccctggcactcactaactgtgtgaccctgggagggcccctgcacctctctgggcctcagtttccacaacagccacgtctctcctgacttccttgctgtcacccatcaggtcaccagggagacatcaggtaagcaaatggagatgtaaacacccaaaacgggtaagacacagactgcacagcagagtgggggacagcaggccctcctggtggtgtggcaggggcctcgggtgggtgagtttgggagccctgacaaccctctgtccygggaaccctcagcagctggactatggccccctaagcacaggggccaggcccaatgggctccccaggcctctgtgcccagcatggcgggtctcatggatctatttcagatgaattaatgaaccagcaacaaatgcccagttctcctctccagggagagtccctgaggctgagccagctgctccgcagacacacacacacacgcttacatgcatgcacacatgcacacacgtgcacacaccactcaattaaatccgccccctttctgcaaccaggagttatgtcacaaaagaaaaggctgag

SEQ ID NO: 1404 - DNA, 601 bp, Human
aacgtctcttgggggagctgatggtttcctgattcacctttcccccagttccctgcagtccccacccccaccccctccgcctcccatccccagagagaggaaagtgcccatcagagcacttctcagttgctcgggattccagagagccctggcaaggagtgggaagacccgggttctagccctggccctggcactcactaactgtgtgaccctgggagggcccctgcacctctctgggcctcagtttccacaacagccacgtctctcctgacttccttgctgtcacccatcaggtcaccarggagacatcaggtaagcaaatggagatgtaaacacccaaaacgggtaagacacagactgcacagcagagtgggggacagcaggccctcctggtggtgtggcaggggcctcgggtgggtgagtttgggagccctgacaaccctctgtcccgggaaccctcagcagctggactatggccccctaagcacaggggccaggcccaatgggctccccaggcctctgtgcccagcatggcgggtctcatggatctatttcagatgaattaatgaaccagcaacaaatgcccagttctcctctccag

SEQ ID NO: 1405 - DNA, 601 bp, Human
gctcggcgcagagcaggcagctgcctgcctcccaccctggccatctgtctacaccaagtgagttgggtcctgaccctggagttcttggagggacaagtaggcatcagtgttcaggggcaggcgagcattaagggccctgaactccccctgcccaggaggcctggaccaggggaaactgactccctccctggggccagcgtcagggacctcctccccagcctctcgcagcaccagctcagggggtggctgaaaatccaccaggtctgggactcctggggtgggaggccccaggggctggggrtcccagtctctggggactctttcttgcaaagaagggggcatcctctcttcaccggccccactgcccccaggggcagtgcttggggggctggggccaccgaggagactgggggagaagagcagcaggtcatccctggaggggaaggtgcagtaggcgtcgtcctcccctgacagaggctgcaggggttggggggaagaccctgtgggtgccccggccacaccctcatcagggtcttcctctgagtaggggtcgtaagtaaagtacacctggcaggcctctatctccaaggcatccgggagg

SEQ ID NO: 1406 - DNA, 601 bp, Human
ctccaggagaagcaaaaccggcacttgaagagtcagggaagtttgtcacctagatgagggggagcgcacagcagccccagggaatagcatgtgcaacagagggggtgtgagggagctctgagtggctcaggaggacggtagggaggattgcagaaggggatgtccccacacgacaccggaggtacaagtaccaggctgagaagtggggctgagggcagtgggacctgtgcaaggttttgaaccgagggggagcgtggccatatttgggttttggaaagcacgctcaggctgccctgtggasggggaggggagggaaggaggaggctggggcagaaaacccagggaagaggtcagggcagggagccctggagagccgcgaggactgatattggtgaatagctgcagggctggagaggagcgatgcttctgagcctaaattcgtgggatcctgtgattaacgagggagttggggagttactgcccccctgcaacacacacagttcctggctcgggcagcaggacccgggagcagcagtggaggtttggaaatggatggaccaagtgtgcaggactgggtgggggccatccgggtggagaagtc

SEQ ID NO: 1407 - DNA, 601 bp, Human
gtctacctttccaaggctcaacgcttgtggagccttgtccacaagcacctgctcccaagggcctccctccctgagttcaaacgcccaagacagagttgatctgattggctagttcaggcccagcctacctgattggacagagcttggtgccaaaccccctcataggctgctggtcagagcctgtgggggcgtgtggtcaggtgcccaatcagctgtgagcaaggcctgtaagtgcaggtgcctgagggctcccaggtcagagttagctgggactggggtcactgtcctgctggggtggaakgttgtttgagccattgcaacgtgatctgcctaggaaagatacgtggaggggtcggggtagggggttgagccccttgcaggagggggcatgccagacctaatgggcacgggactctgcctctctgtgtgaatgtcaggcgcagggagcccagacgaggtggtgccaggtaattaattcgttcatccagggtatacgacggggtgttgggcactgtgtctggggcagtgaaaaataatgaggccctgccctgtggagctgcccttctggaggccagtgtgccagtccctgagctgcagagga

SEQ ID NO: 1408 - DNA, 601 bp, Human
aagtgcaatatttccccaggcatagacttgtgggatatggccatgagctgatacctggacacagaataagacagacagtcctgactcctattagtgaaaaagatattccctttacaatccttttcctttctctcaaggaggaagtttgcatttggccctgggatgtcttcgacagctccccagcagcttctcatttcccctttaagagacaacaggtttaccgcaggcaatgaatatcaacactattttgttgcattgtacttattttgtacagttaccttttatttatagcgaaaatggkttttttcatttacagagtaacaaagatttttctttaaataaatgtatttcaacgaaaatgaactgacttaaagaaaaaatattaaggaaataatcacaaagatggtacacacggatcattaaaagatacggatgtatagatacatatgtcacaaatgattaagacttaaaaaatgtaaccctcccaagaagtgggagcctcccaaagtggagaaggcaaatacaatttccatttggggggataaggagaccgacttgcagagaggattagtaggttgccccagaacacacagcaaaggtg

SEQ ID NO: 1409 - DNA, 601 bp, Human
tggccagtataattacagtaataattaggcagttcagaaactgtctcttaaggataggatttatgaaacttcagtgaactcagtattttacatttacacatgtgactaaaatcatcaatatataattcttaatagaactcctagtttagtttactctttgtagttcactttaggaaacactagtaagtttctatctctatgtagtcaactgattatacaggttgtttctgttgagtgcctcccatatctcaggaactttttgtgagaactttacatgaattaactcatttaaacatctgcrtaagtaagtatagtttccttaagcaccaactgaaagccagtggtactgtccaccacattctggatgaggggctccatgaagcacatgggtctaaaaacagctcattgaccttcacctcataagttcttagaatatttcccagagcttaactatttttatcatcttcctcctcctcactgtcatctcataagtcaatagtaggatactttatcatctgtatttcaacagaaatgcaaacttttctggcattaatgtccattacaagaaaataaatgcttttcctatagattttcagaaaat

SEQ ID NO: 1410 - DNA, 601 bp, Human
aattataagatagaactatctaaaaatgtccagggagtatatggtgaacagtttcacagctgaaaagaagttgaggtagctacatattttgtagtaagactagaaagaaggaaatattattcctggttttagtttttgctgtgtcgctatgtgaacattggtcacccagcttttctgagccttacttttgaaaactgaggcaaacaacacttccggtgccccctctataggatcaataagataattcctgagaaaatacttttgcaagtaaggcatattaatgtaacagtggatcccaaayccttttgtgtcactctcaacaggatttatttttatatttgagcaattaactgcaagttgtaaaaattcatgttttgatcaaacagaaaggagtggtgttttaaaaaatgttattcctaaaaacttttctaattctttccctaattacaggcatatatattcagcattgatgaaaaagaactaaatatcttacatgaaatgaaaggtaaaaaggtaatatgtctctacctttagtatctctgtgggcttttgcgagtaaccctgcttttttctcaatgagtggatctggtttgttttggga

SEQ ID NO: 1411 - DNA, 601 bp, Human
atctaaaaatgtccagggagtatatggtgaacagtttcacagctgaaaagaagttgaggtagctacatattttgtagtaagactagaaagaaggaaatattattcctggttttagtttttgctgtgtcgctatgtgaacattggtcacccagcttttctgagccttacttttgaaaactgaggcaaacaacacttccggtgccccctctataggatcaataagataattcctgagaaaatacttttgcaagtaaggcatattaatgtaacagtggatcccaaacccttttgtgtcactctyaacaggatttatttttatatttgagcaattaactgcaagttgtaaaaattcatgttttgatcaaacagaaaggagtggtgttttaaaaaatgttattcctaaaaacttttctaattctttccctaattacaggcatatatattcagcattgatgaaaaagaactaaatatcttacatgaaatgaaaggtaaaaaggtaatatgtctctacctttagtatctctgtgggcttttgcgagtaaccctgcttttttctcaatgagtggatctggtttgttttgggacagcttggatcgtactt

SEQ ID NO: 1412 - DNA, 601 bp, Human
ttgctgtgtcgctatgtgaacattggtcacccagcttttctgagccttacttttgaaaactgaggcaaacaacacttccggtgccccctctataggatcaataagataattcctgagaaaatacttttgcaagtaaggcatattaatgtaacagtggatcccaaacccttttgtgtcactctcaacaggatttatttttatatttgagcaattaactgcaagttgtaaaaattcatgttttgatcaaacagaaaggagtggtgttttaaaaaatgttattcctaaaaacttttctaattcyttccctaattacaggcatatatattcagcattgatgaaaaagaactaaatatcttacatgaaatgaaaggtaaaaaggtaatatgtctctacctttagtatctctgtgggcttttgcgagtaaccctgcttttttctcaatgagtggatctggtttgttttgggacagcttggatcgtactttggagcttctgtctgtgctgtggacctcaatgcagatggcttctcagatctgctcgtgggagcacccatgcagagcaccatcagagaggaaggaagagtgtttgtgtacatcaactct

SEQ ID NO: 1413 - DNA, 601 bp, Human
cctagattcttggcgttaagtcaaaacaaaaaattggtggagtcttaatgaaatcttcttggcccgttctttgatttgaaaacaagagtgggcttgtgagaagaccagttcatttataatggcatagcatttttcagtcaggattcaacaaagtggactctgtttcaagaaagtatttgtaactatgttcagtcaatggtttcagagcatttagcaagttcttatattaagcatcagactaaactctacaatttaagaaagaaaacatctagtctcataaatggaagattctctaagtttrcaatatagagcagggaagttatttatgctttggtatttcctacactgtatttaacctacatttaatagtaaaagcaaattatctacacagtgatcattaaatctcatagtagtaatatcagataattttcttccatttctatctccaaaaatagtggtctttgtacttgctacatcctcgtgctgcaaatttctcttattttcctctttacgactaaacatccacatgtatacctaaagtaaagcaatatagaatcattttcccccattgaaatcttaatctcattaagaaaaaacagat

SEQ ID NO: 1414 - DNA, 601 bp, Human
taactcatcttcctccttcctagttatcagttgactaatctatgctccactgctgctggttccaaaggccagcttcaatcatgtcactcctcaactcagaaaccttcagtgtttagtattattccctaaattaagagtaaattttcctcgacaatcaagacgctacactataagactgcaatctgacatttttgtctcattcattatacataccattcattagagccaaattctttggaatttgttttgctgctagttttctctgtatatcaaaattatgcttatccttcaatagcctccwggcatgccatttcctttatgaaatgtcttctgttataattagattttttttttttgcatctcgatattgtaaagcagtttctacttctcagtcatttatatgcttgtgctaagccttccctataactgtgggcttattgaagaaagggaatgtgttttgtgcacacactgccttgccccttttcaccttttcgctctttgcacagtgtgttgtctttagtagaggctcaataaatatttgctaaattgaattatcaaaatgatttattggattttcaaagctagagatcatgagtttgac

SEQ ID NO: 1415 - DNA, 601 bp, Human
ctccactgctgctggttccaaaggccagcttcaatcatgtcactcctcaactcagaaaccttcagtgtttagtattattccctaaattaagagtaaattttcctcgacaatcaagacgctacactataagactgcaatctgacatttttgtctcattcattatacataccattcattagagccaaattctttggaatttgttttgctgctagttttctctgtatatcaaaattatgcttatccttcaatagcctcctggcatgccatttcctttatgaaatgtcttctgttataattagattttttttttttgcatctcgatattgtaaagcagtttctacttctcagtcatttatatgcttgtgctaagccttccctataactgtgggcttattgaagaaagggaatgtgttttgtgcacacactgccttgccccttttcaccttttcgctctttgcacagtgtgttgtctttagtagaggctcaataaatatttgctaaattgaattatcaaaatgatttattggattttcaaagctagagatcatgagtttgacaattttttatgtcctctgaggtctaatcatactattatgtgttg

SEQ ID NO: 1416 - DNA, 601 bp, Human
gttccaaaggccagcttcaatcatgtcactcctcaactcagaaaccttcagtgtttagtattattccctaaattaagagtaaattttcctcgacaatcaagacgctacactataagactgcaatctgacatttttgtctcattcattatacataccattcattagagccaaattctttggaatttgttttgctgctagttttctctgtatatcaaaattatgcttatccttcaatagcctcctggcatgccatttcctttatgaaatgtcttctgttataattagattttttttttttgcrtctcgatattgtaaagcagtttctacttctcagtcatttatatgcttgtgctaagccttccctataactgtgggcttattgaagaaagggaatgtgttttgtgcacacactgccttgccccttttcaccttttcgctctttgcacagtgtgttgtctttagtagaggctcaataaatatttgctaaattgaattatcaaaatgatttattggattttcaaagctagagatcatgagtttgacaattttttatgtcctctgaggtctaatcatactattatgtgttgacagactcaataaa

SEQ ID NO: 1417 - DNA, 601 bp, Human
ctcgatattgtaaagcagtttctacttctcagtcatttatatgcttgtgctaagccttccctataactgtgggcttattgaagaaagggaatgtgttttgtgcacacactgccttgccccttttcaccttttcgctctttgcacagtgtgttgtctttagtagaggctcaataaatatttgctaaattgaattatcaaaatgatttattggattttcaaagctagagatcatgagtttgacaattttttatgtcctctgaggtctaatcatactattatgtgttgacagactcaataaatrtttattgaattgaactgagatgtgtgtactaaagctcagtctgtagtttgtccaacttgtttgacacattagaaaaaatccatatccaattacaacagtaaatcgtgtaaagttgtcagggagtgttataatgacacgttttctctccctttctatctagggagcagtaatgaatgcaatggaaacaaacctcgttggaagtgacaaatatgctgcaagatttggggaatctatagttaatcttggcgacattgacaatgatggctttgaaggtaattaaaattatcaaattggtacttg

SEQ ID NO: 1418 - DNA, 601 bp, Human
agctgttacacccaccatttttctgttaaggaagatcctgatttcagaaataataaaatatgggcaggaaatgtgttatcatagactcattggaccacggtatttaactatcagtacaataaagacactgaccaaacccaacagaggctggctgcagagctggagcagggttctggaagcccctgctctgccaggcattccctacagctatgttgtggaggatctggggaattcaagaagagattctgagcaggccactgggaggcctggggacagtggctgtttacccactgatattgamgttttttattaattgaatagatggtagtgtggtaactgtgcatattgccatggatgtcagtcctgttgttgaaatccctgcatctactagcatttactgttaaaaatttgcttttatcaatctagttctaagtggtaagtaactgagtctgttaaaactgtgcataaaatggtgaataggtttaagaggagagtgtgcagtttcatggagttcagcacataagtatttgatacttatttttagggttcataattgtcttcttgataaggccattggcaattagtatacggtagttttagg

SEQ ID NO: 1419 - DNA, 601 bp, Human
atttcagaaataataaaatatgggcaggaaatgtgttatcatagactcattggaccacggtatttaactatcagtacaataaagacactgaccaaacccaacagaggctggctgcagagctggagcagggttctggaagcccctgctctgccaggcattccctacagctatgttgtggaggatctggggaattcaagaagagattctgagcaggccactgggaggcctggggacagtggctgtttacccactgatattgacgttttttattaattgaatagatggtagtgtggtaactgtkcatattgccatggatgtcagtcctgttgttgaaatccctgcatctactagcatttactgttaaaaatttgcttttatcaatctagttctaagtggtaagtaactgagtctgttaaaactgtgcataaaatggtgaataggtttaagaggagagtgtgcagtttcatggagttcagcacataagtatttgatacttatttttagggttcataattgtcttcttgataaggccattggcaattagtatacggtagttttaggctaaagctttctcagagattaaagtgctggggtactataa

SEQ ID NO: 1420 - DNA, 601 bp, Human
aatggtgaataggtttaagaggagagtgtgcagtttcatggagttcagcacataagtatttgatacttatttttagggttcataattgtcttcttgataaggccattggcaattagtatacggtagttttaggctaaagctttctcagagattaaagtgctggggtactataaattctcatctccttaatgtcttcttgtacctagataccacaatctactttaaatatataaaatgcattattctacataaaaagtcagttattgaatacatgcttccagtgaaccttcttaaacgtaaratagtgtaacttgttatacaagtattactgttctggattttttgtttactattttaaaactgaaagaaaaaaataggtgtatatacttttggttattacgattacacataatttttttaaaaaacatgtatgaatgggagcctctctgtaccccacccatcactagcttccccctacttcccttaccctcccaggaccccaggttgggcattggctcattttcataaataacctcatcccagacaggggtgagggaaggtgttgtggctgttttgtttaaattggagctgtaagagggat

SEQ ID NO: 1421 - DNA, 601 bp, Human
ttgagttcacatctcctgagagtttgtataaattcaggtcagcgctgctcctatgcagccatccagtgtcatagaaaagcaattcactgataactgatctctccattcagaagtgtgcagttttaatgtatagcaataagaaattgttatttatctattacaagcctggtttgattaaaaacaaaaaataaaatgttattatgcttgatgttacatctcataagtaaccagcaattctgtgatatttattgaacatttattttgggtcagatgtaccataccaggtacagaatatgtgccrtaataaatgaaaatgaagaaaatagtggcacccttttttatagctctaccatcaagtagaaaataaaattaatacttgaaaacataagccttatttcgtggcaagtttaagggttctacctaataaagacctatggataaaaccatgtttatgcattttgatttgtcatgtgtgttgtatgagacaacccaattctttcttttaaaaacacaaaatcactgtttagtaaaacacttattttgtctatgatttctctgtcttgttttaattgacacatttaaagaagaccattcactattt

SEQ ID NO: 1422 - DNA, 601 bp, Human
agtattcgtgtgtgtgtgtgtgtgtgtgtgtgtgtgtgtgtgtctgtgtgtgtgagagagaacctctttgacacagaacaggaattggtattaggaagggaaatttgggggtatgacctctgttgttaatgagtctatagagcatgggaatagcacaggatctggaccaggctgcagggtttaaatcccaggtccacaacatcctggctctgtcaccttgagcaggttataccttgtgcctcagtttcctcatctgtaaagttggagtcagagtatttatttaatatggtggttgtgagarttacttgggtaaatctgcacaaagtccatatcacagtgcctacattgtaaacatagtataagtgttggctgacatactaataattttgatttatactaaaagaatgaaataaaatgttcagataagaagtaaaagcaatcattaaatacctatgttctgtatattgtgtcccaaattaagttgcataggcttggaaaacatttattgtatatatttcaaaacatatctttctcatttgaataatgatagctagaactttattatataacagatccaagcgtaatccaggaagagtctgaa

SEQ ID NO: 1423 - DNA, 601 bp, Human
agcttaatatttataaacctgtatgtgaacatgaaattagatatgtggactagaaagtacatatctggctagggttgttcttgttaaaaagtcagcttttatcaaaagcctcagtcataggctccactaagtgattatagacatcttgttttacaaattcttatttagttattcatgttgggcaaggaagtaaatagagagcctgaagagacctaaggaggccagacatggtggtacacacctgtaatctcagctactcaggaggctgagctgggaagactgcttgaacccaggagttcarggccagcccaggtgccatagtgagacccccatctctaaaagacttgagagggagtaaagactatttcagaaaatctgtacagcataattttccctttgctcgcaaagtaaatttttttagtcacaaatgtcacctgttcatttcaagctggaaaaattttgtcacccttagaagtatttgatttaactaaaatgcagctttgttagtagatgtgccaaggcatgcctgggaaagctcattatttagctaaatcattgcttctctggtatattagtattcaaaaactacttcccactcaac

SEQ ID NO: 1424 - DNA, 601 bp, Human
taaagtttatgatatatcataatgggatgaatgttgtacatgaatagattcagagaaaagtggaaagaatcgtaagatgttagcatatattctctaattttctataaatagtgttttaggtagtcaaaggtgatacgtagttaagtatttatggctgaaaaataattctctttgactaatgatgatcattaatctgtgttgttttttatcctccagatgtagcagttggtgcttttcggtctgattctgctgtcttgctaaggtaagactgatatatttcactgcttaattgcaatttggyttaattgtaaaatgatgggaggtggtgtttaaaatcagcagtggtagtgacctcatgatgctcttttggtattctgaagcttaattattgatttttagggtatttttttcaccttacagagatataattaaatcatcaaagtcaatatttttagacatttaaataaaaagttattttgccctgtgcacagaaatgtaattagtatgtacacacataataagactcatgaaattacttggtgaatgtaaactgaaaaaacaaacgcatttctctccttaaggaaaaataattctgcaatta

SEQ ID NO: 1425 - DNA, 601 bp, Human
ataagtatttgctttgtcttccatgtatagtgtttggcccttttcaggaaaggagttttatttttttttaatctacgtgcttgtttttgttaattcatatggtggttattttccttagaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacggtaggaatattttcctttattcaaattattgtrtggcatttaactaaatttttaaaatatggcataattctgaagaagtgaactatatgtcggaatttttaaaaatacgaatttttaaaaacaaaaatagatttattcatttctttaaattgtttatattccctttaggatattgaactgaatattttaaaatatgcatttaatcacaacagtagattctcatataaaatgctgatgttctatttttaatgccttgccagtgaagaaagatatattactagagagaaatcataatgggagaagattgtatttacaagttagttattcagtgtc

SEQ ID NO: 1426 - DNA, 601 bp, Human
tatatacatatatccttgtatgcatataagagagagggatttttatttcctaaacaagaactaaataatattacttaatttttaggccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggtaagtactgtaaaccacaatagcatgatactacttggtattttacttaattttttaaaagtaartggtagaattcacttcactgatttggggtataagtcttaatatttaggctcctagttattttcagacttactctgtgcccctgctcagaatggcaagttcttgggtcttaagtccaaaggcatcagcctcctgttttccagtactaggagtaggaggaagctgtttgggtgcctttacattctcactgccgtagccagcacacgtctgatgttggaacagtatccccttgattgtggtccttgcacaagtaacattgatcctccatcctggactccagagttatagttctttattttaag

SEQ ID NO: 1427 - DNA, 601 bp, Human
ttacacctattgagattatagctattttgattaaataccttaaacacattctcacataccagacagaagaggaccattaaaatatgaaccttatggattccttgcctcatgatttttcaaggaattcagaccctggattaaatagggaatatatcaagataaatgaaagctacaagtccagaattttttttttgtggagaatctgtttgaatactagagtacacacatatatgtatatacacacacacatacacatacacatatatatacacacacatatatacacacatatatacatacttatatatacacatacatatatacacacatgcacacatatttatatcatatgtctatttatctcaaacatataaatagaaaatagttttcctagaaaagcaaatacttctgggatgatattcttttcaataaccatccttaaacatatgttacaaactttttatttccttcctgtccaaaacagttgtttcatttttcccattaggaagagaagcaaataaactgtgaagtcacagataactctggcgtggtacaacttgactgcagtattggctatatatatgtagatcatctctcaagg

SEQ ID NO: 1428 - DNA, 601 bp, Human
aggttgcatagaaaatattataaatattttagcttggggtaggtagctgagtgatgaaataaaactggttcttgaaatctttgagctttgtgtttatattcttggcaatgtttgctgttttaaagggggtggcatgtttacatcgaaatgggcatgtgcatgtgtcaatcagaattctgctccccctacacacccttcccgaaaacccccacccccaccgcaggtggtcctgtctgccaggcatgttacctctgctatacaaaaaggtgtttttggcaagagtctccactcaagttgtgaragcatttctaattttgtctagacttgcctgcgttcacattcagagacgtctttgtctctgaatgttacgtgtggatatgtgtgtactttaaaatagccacaaacccaacaacttccctgaatcttattgccaagggaggagtagctgatgcctttacaatggttcaattctacattccatagaacataaacttttaagaaaaaaattcagattataaaaaatgtacttaagattttttttaatgggctttcctggtctgtgttttacagatagatattagctttctcctggatgtgagct

SEQ ID NO: 1429 - DNA, 601 bp, Human
actagaaatatacccccatattctgaggggggggaattaggagaaccgtaaaactgtgttccattaattgtaagagaaaacttctcttacgtggtatgcttttaaaagaaccaaacaacatagttaaatgggagttactggcaatgttttagctcttgagctatgttaagtatttattagattagattagagtagacatgatgtgtcacgaatcaaactgtgtatttgaaatcaaaaacagaataaacagtttacaagtaataactctacaagatttaaaagtgagggtaatgacttccayagatatgtctcctagagtaaataggaaatcgttaatgactatttcatgagtgaagtttcaatatattttttaaaattcagaataaacgtcaagatggacttcattttacctaacacaacaacttggtcaccctctcatcctaaaaatctctataagtaaaactgattataaagatacgttaaggcagtacatgacttgctatacagtttaaaaaattatatgattgatgtgctttctttgatcattaagtcttgcaaaaacacttcttcaacctaaagagagtaatagatttgtttctaa

SEQ ID NO: 1430 - DNA, 601 bp, Human
taactctacaagatttaaaagtgagggtaatgacttccatagatatgtctcctagagtaaataggaaatcgttaatgactatttcatgagtgaagtttcaatatattttttaaaattcagaataaacgtcaagatggacttcattttacctaacacaacaacttggtcaccctctcatcctaaaaatctctataagtaaaactgattataaagatacgttaaggcagtacatgacttgctatacagtttaaaaaattatatgattgatgtgctttctttgatcattaagtcttgcaaaaayacttcttcaacctaaagagagtaatagatttgtttctaaactacctatttattctggtttttgtaccacctagaacataaatgttaaaaaatcttttaatctaataaatgtaactatttgttaaaaaaaaaaaaattcctctatctagcattagaagcaaatgataacagtttaaataatgagagaaattttctgccaaccttgtcctaaaaaatttttactaccatatctacttttatccccactcctcaaaaagcatttaagcaaacctctgagtatattaggtatacagggtatgta

SEQ ID NO: 1431 - DNA, 601 bp, Human
ttctttgaaccaaaagcactgtccaagcattcttatagaataatctatatttgtgagtaaatcttggattaggtataatattttgtaagacaatgcttttcaaaatgtgtattagaatcacttggggtacctatccagaatgcaaattccttggctttgccccaaatctgtggaaaaagaatgaccttgaaatcctgttgattctatgtatactccaatttttgttacactagttgatactaatgttgaaaaattttagttctccactttgaagtcccaagaaatgctctttaaaacccartgggagtttgtgctttgataaactaaaacagaaaccaaaccggactctagaatgtttatttattaatttacaattaatagttaaaaagtattttctactaaatgtataatgtagtgactggcactggagaaacttgcagtatataggatttctgtgtctagtcaactatgtagatattcttagaggtttaattgttgttaggcaaacagatgtttgtgatttagatatttaatggcatccagaagaccttgtctgtagtattgggcactgctaggtatctgttgctgacattttcctgct

SEQ ID NO: 1432 - DNA, 601 bp, Human
aatctatatttgtgagtaaatcttggattaggtataatattttgtaagacaatgcttttcaaaatgtgtattagaatcacttggggtacctatccagaatgcaaattccttggctttgccccaaatctgtggaaaaagaatgaccttgaaatcctgttgattctatgtatactccaatttttgttacactagttgatactaatgttgaaaaattttagttctccactttgaagtcccaagaaatgctctttaaaacccaatgggagtttgtgctttgataaactaaaacagaaaccaaacyggactctagaatgtttatttattaatttacaattaatagttaaaaagtattttctactaaatgtataatgtagtgactggcactggagaaacttgcagtatataggatttctgtgtctagtcaactatgtagatattcttagaggtttaattgttgttaggcaaacagatgtttgtgatttagatatttaatggcatccagaagaccttgtctgtagtattgggcactgctaggtatctgttgctgacattttcctgctgcaactgccctgtgcttttatggattagcaattaccacctg

SEQ ID NO: 1433 - DNA, 601 bp, Human
tgactgcaggtctgcaagtcatcttttttaatcgaggtattgggatgcatctctttctgacttactgtattggttttacagttaagctgccagttcagtaggctatattttggccccatttcccttttcaggaatcttcaatccccaaatttatcatcctcttatgcattttttgacaagtattgttaaaaaccttttgtgctttctcaaaacccaacaacatacttttcttctgaatgcatcagcatatagatcctgaataaaaatacatttttattcactttctcctgctgattatccycttagcacagagtgcttttgcgataacatcataggatttagaattacaatacctgagttttggtcataactcttgtcattttttaacttttatcttgggaacactaagaacacctgttagcatttcccttagctggtgaataccaaaatgttggcctacctcatgagaaccaaatgatatttttaaaatatgtaatgtaacatacaaatatatattgtttgtctcctaagactgtttctccaataaaccatcagcctgtactttttgttttcaacaataccaaaactagaaggttagaaa

SEQ ID NO: 1434 - DNA, 601 bp, Human
ggttatcaacactggcaatagtatggctcccaatgttagtgtggaaataatggtaccaaattcttttagcccccaaactgataagctgttcaacattttggatgtccaggtaaaaatgtatttcttccatctaacctttattgtgtgtcttaaatactaaaataaatgcaaaccaatcctttattcgagtaatgatgtgaaaatggataattgttaacttacttcagtcacactctaagctatgaattcaccatgcatttattgagttatgctttgaatattatacatttctttagaactrtagagttacagtgcaacttttacatttgatttaaataacagaactatattctaccatctccattgaataattattttaagatacattgttgtgtgatatggacctatagaggtaacttctattagtagaattcttcataaaacttgaaactactgtgcaaatatgaggattatagcctttttttaaggaagcactattcaaaccacttcttaagaaccgatattcttgcactgatggttccatcagaattgttttgagcttaacaggttgaagacaaaagtcaacaaatctactaaatag

SEQ ID NO: 1435 - DNA, 601 bp, Human
caacctgctgtaatttggctgggtttttgtgtttctgccacagacatttaatcactcccaaatctgtcaaaaaaatttctacaatttcagaggtacttgatatattttagcaaagataagctactggaacttttaaaaccaggttgctttttgctgttttttccagtgttgaaagataagatttctcttgctttctgtcttcatagactactactggagaatgccactttgaaaattatcaaagagtgtgtgcattagagcagcaaaagagtgcaatgcagaccttgaaaggcatagtccrgttcttgtccaagactgataagaggctattggtaagtttcagtttttcaggttgtagttcctgctttccaacagagaagtgagacacttaaaatcaagtcaatgggtttgagctgtcacttcaataataagagagaagacaagtttaggtagtattcttgcgtggaaggaacaagcatggttggaaagttgagatagacccagggtctatcccatatataaacatgttggccgggtgtgatggctcacgcctgtaatcccagcactttgggaggccgaggtgggcagatcacaaggtcag

SEQ ID NO: 1436 - DNA, 601 bp, Human
taagtgaaatggctttagaaattaacaggtaataaaggctaaaataggccaggcacagtggctcatgcctgtaatcccagcactttgggaggccaaggcaggaggatcacttgaggccaggagttcgagaccagttgtattcctaggtagatgtctggtgttatttctgaggtctctgttctgttccattggcctctgtatgtgttttggttagccttgtagtacagtttgaagtcgggtagcctgatgcctccagctttctttttgcttaggattgtcttgactatatgggctcttttayggttccataggaaatttaaagtagttttttctaattctgcgaagaaagtcaatggtagcttgatgggagtagccttgaatctgtaaattactttgggcagtatggccattttcacgatattgattcttcctatccatgagcatagaatatttttttccatttgtttgtgtcctcttatttccttgagcagtggtttgtagtgctccttgaagaggtccttcacatcccttgtaagttggattcctaggtattttattctgtttgtagtgaatgggaattcactcatgatttggctctctg

SEQ ID NO: 1437 - DNA, 601 bp, Human
tcttcacagacaaggaacagggaatagcggtcagcagatatcagtccatggatatgcaagaaaattttgtgacataaggctgtgacatccaaatgactagaaatatccttcactaattccaagagtcttgagcactggtccccttcatcatgatcaaaccttggaggggttagaggcatctgttccttcttttctgagtcagagaggaagctcacagttccctcagaatccttgacaacaatgggtctaagaggccggtcaaattcagaggcagagattttcctggttggtgttccagggrcactgttatctgcacgaggactctgctgcaagggacaagagcaagattcggtgtggcctctgataccttccttgcacacagggatggtgtgaactctctcagcaaaccatgcattgaccatttctctgcagaacagaacgtgcagacacattagatacttgaagaggaagggtgctatgcctgagagctcctaaacatcttctcatggtaaactgatgagataataatttgatatgttatagaaaataaaaacaagatggtttacttaagacatatgattttggccaggcacagtggttc

SEQ ID NO: 1438 - DNA, 601 bp, Human
ttgaagttacaatttattccatgcaaaatttggtttagcctctccatgatattaagacttggatctatgctgaaattattatataaatagcttgtaactcattactgcagcaaacaacagcttacatacttgttaaaagaatattcacaataaaagcataaagttaaatattatataaagttgcaaacattaaatatgtcatttttaacatggatctatcatcctcattaaactatactagggtaatgtgtttctaattatattaattattgattgactattaattattattaattaatattattataattaataataattaatagtattaattattgattgaaataaatatttagacagcatatcttatccacaatgtgatagagccttaaaaattcaaatcaattcaagagggagttatattaatggattatagacataataatggaattcaaagccaatccaggaaccatgttttcacaccaaatattctcaagtgccatgaacagaacaggagcctagatgtctattactcgatttaaaaagtatttgctatgttctgaagcaattataacaaggggagcaacacaggtgccaacct

SEQ ID NO: 1439 - DNA, 601 bp, Human
acttgaagttacaatttattccatgcaaaatttggtttagcctctccatgatattaagacttggatctatgctgaaattattatataaatagcttgtaactcattactgcagcaaacaacagcttacatacttgttaaaagaatattcacaataaaagcataaagttaaatattatataaagttgcaaacattaaatatgtcatttttaacatggatctatcatcctcattaaactatactagggtaatgtgtttctaattatattaattattgattgactattaattattattaattaatattattataattaataataattaatagtattaattattgattgaaataaatatttagacagcatatcttatccacaatgtgatagagccttaaaaattcaaatcaattcaagagggagttatattaatggattatagacataataatggaattcaaagccaatccaggaaccatgttttcacaccaaatattctcaagtgccatgaacagaacaggagcctagatgtctattactcgatttaaaaagtatttgctatgttctgaagcaattataacaaggggagcaacacaggtgccaac

SEQ ID NO: 1440 - DNA, 601 bp, Human
ccacttgaagttacaatttattccatgcaaaatttggtttagcctctccatgatattaagacttggatctatgctgaaattattatataaatagcttgtaactcattactgcagcaaacaacagcttacatacttgttaaaagaatattcacaataaaagcataaagttaaatattatataaagttgcaaacattaaatatgtcatttttaacatggatctatcatcctcattaaactatactagggtaatgtgtttctaattatattaattattgattgactattaattattattaattaatattattataattaataataattaatagtattaattattgattgaaataaatatttagacagcatatcttatccacaatgtgatagagccttaaaaattcaaatcaattcaagagggagttatattaatggattatagacataataatggaattcaaagccaatccaggaaccatgttttcacaccaaatattctcaagtgccatgaacagaacaggagcctagatgtctattactcgatttaaaaagtatttgctatgttctgaagcaattataacaaggggagcaacacaggtgcca

SEQ ID NO: 1441 - DNA, 601 bp, Human
caaagtatgaaatcaagagtaatatctacagttgacagagcaagaactaaaaccattatttaacaacacaagtgcaacccatacagtgacttaaaacagtgacagaatgattccagtaggataagagtaatggcaagtaacgtgtggtgtaagtcaaataaattctcatctcccaagttaatgaacattgtctaataagataaacaactaagcatggaaaataggaaatacaaatgactactagaaaaaataaagtattgagaaactgaatctgtactatctaaatttttaatcatctgcrtacattacttggataaaaatgtaacaatttttaaaaagtatttctatgcactttctttagtaatcagactgacctgatttctcttgttctccagcagtgaagtctcatagagctgagcattatgaagaacaataccacaaaatgccaaataagcagcaaagtcctaaaaaacagataatagacaaataaaaacggtacataaaacagtctagttacattgcctgaaatacagatcctcaaatatttacagttagaaagccaaaagaatagatgtttgttctacataaaattaggatgata

SEQ ID NO: 1442 - DNA, 601 bp, Human
gaaggggaactcaacaggatgcctaatataatggagtttggggagaggaggaaacaagaacatgaggctatactagagcaaagagttcaaggaaaaaaattcagaaacatcaggaaaaatgaaaagttctgtaacaaaggtagtatgaacaacatttacataattatagtgcttataaatagtttctttagaattgcaactttagaattaacctagacaaagcccaggaaaagttcatcatggttgtagaacagtatatattaccaatgtgggcaattgtaaaagaaaaagtccagatggraaaagcagggctaaggagcggtagttgggaaaaagagataaagagaacaggggatgctaagacacctgtcttacaaagtatgaaatcaagagtaatatctacagttgacagagcaagaactaaaaccattatttaacaacacaagtgcaacccatacagtgacttaaaacagtgacagaatgattccagtaggataagagtaatggcaagtaacgtgtggtgtaagtcaaataaattctcatctcccaagttaatgaacattgtctaataagataaacaactaagcatggaaaataggaa

SEQ ID NO: 1443 - DNA, 601 bp, Human
tttcttaagtagttaattgagaatgtgctgcaacaaaataaggaagtgagaaagaagtaggggatccaaaagatagtggaatctaagaaagcaatgaagaaaagttctatgatgacactagtgtagcaggcatagggctaaatagtgtagcttggaagaagaaaggttggagaacctcagtttggacctctgcaaacagaagcagaaggggaactcaacaggatgcctaatataatggagtttggggagaggaggaaacaagaacatgaggctatactagagcaaagagttcaaggaaaamaattcagaaacatcaggaaaaatgaaaagttctgtaacaaaggtagtatgaacaacatttacataattatagtgcttataaatagtttctttagaattgcaactttagaattaacctagacaaagcccaggaaaagttcatcatggttgtagaacagtatatattaccaatgtgggcaattgtaaaagaaaaagtccagatggaaaaagcagggctaaggagcggtagttgggaaaaagagataaagagaacaggggatgctaagacacctgtcttacaaagtatgaaatcaagagtaat

SEQ ID NO: 1444 - DNA, 601 bp, Human
aacatggatgctagttagaagacaaagcactacttctaaattctgagaaactgatttttcagtttagaattttatacccagccaaagtggcaggatgctacaatacatattttcatacatgcaaggactcagaaagtttactttaccaatgccctttcttaagtagttaattgagaatgtgctgcaacaaaataaggaagtgagaaagaagtaggggatccaaaagatagtggaatctaagaaagcaatgaagaaaagttctatgatgacactagtgtagcaggcatagggctaaatagtktagcttggaagaagaaaggttggagaacctcagtttggacctctgcaaacagaagcagaaggggaactcaacaggatgcctaatataatggagtttggggagaggaggaaacaagaacatgaggctatactagagcaaagagttcaaggaaaaaaattcagaaacatcaggaaaaatgaaaagttctgtaacaaaggtagtatgaacaacatttacataattatagtgcttataaatagtttctttagaattgcaactttagaattaacctagacaaagcccaggaaaagttcatcatgg

SEQ ID NO: 1445 - DNA, 601 bp, Human
ctgcaggaaggaagtggtgtgatcccatctgtttgtaaaaatggggactggatgaaaggatggcaagaatagaacagggagaacattgcagttaaagtcaatggaaggtcccatatcttattaacacagattctaaacagagaaaatagagggtagagaagatgaattatcaaagaaataatgaaaaaagaattacacagaagtaaacagtttgcttaaacctccaaagagatgaaccaacatacagataccagcatgatgaatgaaaaaaaatactgtgaaattaagttacaaaagcaawtataaataatctgaaaagcttatagacacatagacaaaaatagatataaataataatataaaaatacaaaatatgtattatatgccatgttatatatttatattgtagataataaatatagctacaaaagagctaagaataaggacaacatggatgctagttagaagacaaagcactacttctaaattctgagaaactgatttttcagtttagaattttatacccagccaaagtggcaggatgctacaatacatattttcatacatgcaaggactcagaaagtttactttaccaatgccc

SEQ ID NO: 1446 - DNA, 601 bp, Human
cagctggcctggctgtaactagcactctgtgacaacagtctatcttaccccagacacctgaaaatgtttcttcacattacaaaatcaatggactgaaatctaccagttagaacagcttagtggttttccactgttggtaaaaatatgggacttatggggaccattagtaatactcctactggctatgccttttggtttctatacaatttctagtaagaagaaatttttatacccaacccatccagaatgaggagtctggtctgcctgttcatagcaactaggtcaccagtattcctgaccatgaaaagtcagcacactgtaatgacaatatatttctccatgaagacagtgtagccattggtagaagcagcacacagacattcccatggtaactattttcaggaggttgggatggggacatgaacagaggtaaaaaaaggctgatgaagacaccctccaccctccacccctacctgtcttcaaccagaacagctcataccctgattagttttatatacatattcatacacatttgggtttgagagagggttctaagaccaaaatgaggtttaaaagtagtgcttatagaaatataagtttc

SEQ ID NO: 1447 - DNA, 601 bp, Human
gacagctggcctggctgtaactagcactctgtgacaacagtctatcttaccccagacacctgaaaatgtttcttcacattacaaaatcaatggactgaaatctaccagttagaacagcttagtggttttccactgttggtaaaaatatgggacttatggggaccattagtaatactcctactggctatgccttttggtttctatacaatttctagtaagaagaaatttttatacccaacccatccagaatgaggagtctggtctgcctgttcatagcaactaggtcaccagtattcctgamcatgaaaagtcagcacactgtaatgacaatatatttctccatgaagacagtgtagccattggtagaagcagcacacagacattcccatggtaactattttcaggaggttgggatggggacatgaacagaggtaaaaaaaggctgatgaagacaccctccaccctccacccctacctgtcttcaaccagaacagctcataccctgattagttttatatacatattcatacacatttgggtttgagagagggttctaagaccaaaatgaggtttaaaagtagtgcttatagaaatataagtt

SEQ ID NO: 1448 - DNA, 601 bp, Human
agacagctggcctggctgtaactagcactctgtgacaacagtctatcttaccccagacacctgaaaatgtttcttcacattacaaaatcaatggactgaaatctaccagttagaacagcttagtggttttccactgttggtaaaaatatgggacttatggggaccattagtaatactcctactggctatgccttttggtttctatacaatttctagtaagaagaaatttttatacccaacccatccagaatgaggagtctggtctgcctgttcatagcaactaggtcaccagtattcctgwccatgaaaagtcagcacactgtaatgacaatatatttctccatgaagacagtgtagccattggtagaagcagcacacagacattcccatggtaactattttcaggaggttgggatggggacatgaacagaggtaaaaaaaggctgatgaagacaccctccaccctccacccctacctgtcttcaaccagaacagctcataccctgattagttttatatacatattcatacacatttgggtttgagagagggttctaagaccaaaatgaggtttaaaagtagtgcttatagaaatataagt

SEQ ID NO: 1449 - DNA, 601 bp, Human
ttataactgattgaaaaatatgaaatagtatctatgaaaatactgattaccttttagcctactgagttctcatttgatattaatcagaattttgtattaaacaatgcattcatctgacacatatacacatcccaaatggttgagatgttgggtcatacagtatagtccttatatctaaatcaactaaaatttcttaatataaattaagtactgaataccttttattattctactttgccccaaaacataacttcggatatcatatgtagattataattgacctatacaagtgatagtgcaygctctctttcctattaatccacaaatgaacaacctattcttagggactaaaggaaaaagaaaacaaacaactacagcaaaaagaaatattccagaaacagtggttcataggttgagaagggagagaaagtgcataaagaaaaactgccttaggccaggggccctgattctactggcaaactcaagacagctggcctggctgtaactagcactctgtgacaacagtctatcttaccccagacacctgaaaatgtttcttcacattacaaaatcaatggactgaaatctaccagttagaaca

SEQ ID NO: 1450 - DNA, 601 bp, Human
agaatgattatatgaggactatttgtttttttctaggtgctgatggatttattagtttcaaaattttttacacttattgaaaattctcaagttttggcttttaacgcttaagtacattgattgttgttaaatcccaggtaaagaatcccttcttaaaaagatgtttcattcagtaatactttatgtgattattaaaataactgtgaaaattttaacaacatagagaaatacttttgaaattacattaaaggtgtggtggttcatgcctataatcccaacactttgggaggccaaggtgggyggatcacttgaggccaggaatttgagaccagactggccaacatggcaaaacccctactctactaaaaatacaaaaattagctggatgttgtgggcatgcctctgtcatcccaactactgggaaggctgaggcacaagaatttcttgaacctgggagaccaaggttgcagtgagctgcgatggtgagatcgtgccactgcactccagcctgaatgatacagcaatactctgtctcgaaaataagaaagaaaaaaaattttttaaatcacattaaaaagcagaacagcacattatgcccatg

SEQ ID NO: 1451 - DNA, 601 bp, Human
ttacaccccaccctttgctaattcctaaaatcctttaataggagaaaaggcccttccttgtaccacattgtcaaaataatagtctagtaatgagttttgatttaaatataaatacttaacaaagtaacaactttaagtcactgtggtcaatagtctctccatcttgatggaggacgacttaggaccgtaaatgtgagaaaagacaagagacaataaaataatctgtagcttatatttcttaaatcaaactggtcatgaaataactatttagccaatattatatcatgtgataaagacaagyagagaatacgtgcttttaccttgttaatgtatcagatgatttttctaattcctcacactccatgtgaaacacactagaaaaagaatcctaaaaacagacaacacaggctgagaaataagtttgacaaggtaatgaaaactatctagatacagacatacatgctatggaattgacaaaagaccccaatacttgtagtatatttttacttattcttggacaaaatagacccaagtactcattttatgacatcctcaaaactgcttcccatttaattaaaataaaagtttcgttcatataatt

SEQ ID NO: 1452 - DNA, 601 bp, Human
ccatgtgaaccccaaattccaggacatcagaaaactctctggttagacaatccatggtttatctcccttgactactcacttcatgcccaagtcagcagtcaaggcttaaagtcaggtctaccttctgagtcaaatgaattccccatctgcctccaagttacaccccaccctttgctaattcctaaaatcctttaataggagaaaaggcccttccttgtaccacattgtcaaaataatagtctagtaatgagttttgatttaaatataaatacttaacaaagtaacaactttaagtcactgtggtcaatagtctctccatcttgatggaggacgacttaggaccgtaaatgtgagaaaagacaagagacaataaaataatctgtagcttatatttcttaaatcaaactggtcatgaaataactatttagccaatattatatcatgtgataaagacaagtagagaatacgtgcttttaccttgttaatgtatcagatgatttttctaattcctcacactccatgtgaaacacactagaaaaagaatcctaaaaacagacaacacaggctgagaaataagtttgacaaggtaatgaaaactatc

SEQ ID NO: 1453 - DNA, 601 bp, Human
gtctaggatacttctgtacaactttccttccttcttcctctccttaactctgggtcagactttcgtgttggtctgatggctttcctggctccttccctctggttctcacagggtgttttctctaataaatttctgcacatttaatctaatcttggcatctgtttcttggaagacctggactaactcacacatctaaggctttttgtacaatgtgtatcaatgaactgtatatgagtgcattgttgggatgagagaattaggtacgtggagcttgaaaagataaatttctgtgctttagaaktaaatgggagtcactgcaggtaatgtaaaccaaagacaaataaaaaaaaaatcaaagagacatggaaataatagctaacacttactgaatgccagaaattttctgaagcattttatatacattatcttatttgattcttagtacaatcctactaccactacagatgaagaaactgaggctttgagagattaaataatttacatgaagtctcacagctagtaagcccagtatgtggtgcaacttaaatacttacatttaaatacaatcagtctgacttctacattcttctacactgtatcc

SEQ ID NO: 1454 - DNA, 601 bp, Human
ggtagcattagagaaatgaattcacagttggttcagaatttttaaaggagagacatcaggaatgaaaggtagagtattccaggcaggaaaaaacaaaacaaaacgaaacagtataaaacacattgctgacatggaagagttctatgtgtaactgggaaacactaaatagttacagattgtcaagaataaaatgatgatttcaggctgaaaatgttaggctaggacagatagtgaaagattttgaaagtgtaatacaaggaatatggatctcattcttttactgatgggaatattatagtgkcctttagaatgtgcctcagagctccaattgtagaaagagtagctgaccaatgtctcaagttgctgtgctctggaagccatcaacaagtttgcactgaggtcacctctaccagggttgatcccagagaaaaagactgagcacactagggacactaaagtaggcctaatcctgggaggcccagtattcttctcacagtaaatttcagctagaggacttcccagcagccttgccaaaccttccttagaactgttcagctgtctaggatacttctgtacaactttccttccttcttcctctcct

SEQ ID NO: 1455 - DNA, 601 bp, Human
gtttgtctggacatatatggccacccagaataaagaccacatttctcagccaccctagtggcttagtattgccatctggctaagttctagacaacaggatgtaagagtaaatgtctgtgatggcttctagtaaccttcctaagagacaggtgatacatgctgtctgtcccttctttcccagtcccccatcctactgtttaaaatgtggatataatgactggagctgcatccttgaccctgaaggaaagggccatatcctagggatgtaaggtagaaagtccaaaggtgtcttggtccccarggtctttgtggagcacagctacagcaccaagcctgagctggctacctctgggcttttacaggagagagtaataatactgtgttcttgtttaagctatttttattttgggttttcatgatccacagttaagcctaatcctaagtgatacggtgtaacaatgcaagcaccacacgtgtggagaagatggacaggtagcacctaaatggagtggaatagggaagaggtagcattagagaaatgaattcacagttggttcagaatttttaaaggagagacatcaggaatgaaaggtagagtatt

SEQ ID NO: 1456 - DNA, 601 bp, Human
aaactccgtatgttcccttgtggtgatgataaattcagcaaagagggtcaggttatgggaatttattctatctataagaacatgcttattttaattgtaatatcactaaagaagtaggaaaacctaacaatagtagacatttcaaaataaaatacagttggccctctgtacccacaagtccacgtctttggatacacccaactgcagtactgaaaataaaccaaagaaaaaaaacaaaaataaaaaataacataaatttaaacaatagtacaacataacaattatttaaatagcatttacrttgtattaggtattataagtaatatagagtggatgtgcataggttataggcaaatactacatcattttatacaagggactttagtgtctgcagattttggtatctgtaggggttcctggaactaatttcccaaggatactgagtgacaacagcatacatctcaggaaaaatgtccacttgttctaagtttccaaagttccaatgttttgctatcttctgtccttcccacccaacctgacccagctgcttcttgggacagtggtttcatatggcgtccttcagcgctagtgattccacaaa

SEQ ID NO: 1457 - DNA, 601 bp, Human
cagtctcttgcttaacagagtgaacatgaaagattaatctgatgccagggggtacagtgtcagtgcaagggatggaaaacagaatggaacatgttttttcatcaggaaactccgtatgttcccttgtggtgatgataaattcagcaaagagggtcaggttatgggaatttattctatctataagaacatgcttattttaattgtaatatcactaaagaagtaggaaaacctaacaatagtagacatttcaaaataaaatacagttggccctctgtacccacaagtccacgtctttggatamacccaactgcagtactgaaaataaaccaaagaaaaaaaacaaaaataaaaaataacataaatttaaacaatagtacaacataacaattatttaaatagcatttacgttgtattaggtattataagtaatatagagtggatgtgcataggttataggcaaatactacatcattttatacaagggactttagtgtctgcagattttggtatctgtaggggttcctggaactaatttcccaaggatactgagtgacaacagcatacatctcaggaaaaatgtccacttgttctaagtttccaa

SEQ ID NO: 1458 - DNA, 601 bp, Human
gtaacttattaatagacatttaaaaaggtgaaaaaagtacaaagaaaaatgtccagctacagctctcaatagatgttatgatctattttattctccttcctcagatgagggaaagcacagatcattcctaaacagtcaattctagagccagtccttcagttcaagaataactgtaagtacagatgtgatgggaaaacagccttctagcttcaagtctaaaattgggttacttactgtccagggaaatcttttatccttactgacatctgggatattaagtggttccatagtatttttgacrtactgagcatacatgtaattgattttgtttgcatcatgttccctgtgaaaataacagatatgagttccctctgtgcagttaaaaaaaagcatgggcaaacagttaaataaatgattaagggagaaaaataccagccttaaattataaggcatatatacttatttggaaaatgtagctttaaatgtgtttgatgatttacaactttgtcagttaccataatttaaatgttttgaaaaaacaaaatcccacaaatttccaacaagttttataagtgtgaatggccttattctcatcgcaaat

SEQ ID NO: 1459 - DNA, 601 bp, Human
caaataacaaaatcatccaaataacaaaatcaaggcagctgcctcaaagtgcaatgctttcctgaagaggtgagagaaaatactataattcaaatttttcagtgtctgagaactagatatttgtagctttgaggtcaagaaaaacagacatccattttcccagagctactcactatgacagattaccaattgcatcagttcaagccacacagaaactaatttttgcaaataaggcaaaaactctagcaatattatctaaggaatgtcattgacattatgtaggtaatagctaaattacttyaaaaatagtacggtaacttattaatagacatttaaaaaggtgaaaaaagtacaaagaaaaatgtccagctacagctctcaatagatgttatgatctattttattctccttcctcagatgagggaaagcacagatcattcctaaacagtcaattctagagccagtccttcagttcaagaataactgtaagtacagatgtgatgggaaaacagccttctagcttcaagtctaaaattgggttacttactgtccagggaaatcttttatccttactgacatctgggatattaagtggttccat

SEQ ID NO: 1460 - DNA, 601 bp, Human
cccaaataacaaaatcatccaaataacaaaatcaaggcagctgcctcaaagtgcaatgctttcctgaagaggtgagagaaaatactataattcaaatttttcagtgtctgagaactagatatttgtagctttgaggtcaagaaaaacagacatccattttcccagagctactcactatgacagattaccaattgcatcagttcaagccacacagaaactaatttttgcaaataaggcaaaaactctagcaatattatctaaggaatgtcattgacattatgtaggtaatagctaaattacttcaaaaatagtacggtaacttattaatagacatttaaaaaggtgaaaaaagtacaaagaaaaatgtccagctacagctctcaatagatgttatgatctattttattctccttcctcagatgagggaaagcacagatcattcctaaacagtcaattctagagccagtccttcagttcaagaataactgtaagtacagatgtgatgggaaaacagccttctagcttcaagtctaaaattgggttacttactgtccagggaaatcttttatccttactgacatctgggatattaagtggttcc

SEQ ID NO: 1461 - DNA, 601 bp, Human
aaactctcattcaataaaattatagtcaaatcttgcaattggaaaagtattcagacttttaaagttatatttatatatctaaatgttgctccattagggttttaattctaaatttaacctttaaaaagttatcatattttctttatttccaggttcctaggagaatgttaacagtccagacctttttcactacatcaaccacggatgattggcatataaaatcctacttaacctttacataactgcaataccaggaaacaaatatgtcaataaaaggaaacatcattcaatttttctgagmatgcattcttccatcattcctgaagtagaggtttttctataatcatgttaagaacataagctcctgagggcaggaatttctgctttgttcattgatttatcccaactgccaagaacagtggagtgctcaataaatattaaatgaataaataaatataacctataacctaaactacattcttaaaaaaagtcaacatccaggaaataagactctaaaacaatacacattatctacttaatatctcttatacagtctaccaaatttcaatacatcatcaatcattcttaaacaaaaaattct

SEQ ID NO: 1462 - DNA, 601 bp, Human
ccagcactctttccatgtcgtctaactcgctctcatttaccttcacataaagtgacaaaggggcctgatgcgtaacttcctccagccactccccgttcccagttattattccaaagaaatgttgctggggaaaagtgaagatgtgacttgatggggcaagctgccactctgccttccttcctatgataacttactagtaaataatgcattccttctggaatttaatttcacattttcaaaggccaaagacagcttgtagtaaatctttatacttataaaaaagcattttaaacagcataayatttataatatagttttccccttgacctccctaagaaataaaattttataacatttacttggtatcatattgtaaggcacccttggcagttttcttttattgcttatgttagagatctgatcagtgacaatctttaaaaaagatctcacagattcattagcctccacttttttctctgagaactgtagaagagttgactcaacagcccagcagggggttggcacgctggtttctaagcggctttaatgcacaattcaccagggtcaggagctgaccctcaaccttttagcttaggcacta

SEQ ID NO: 1463 - DNA, 601 bp, Human
acccgactaaagaaatcatttcttttcctttctttttatttacaaagaatttttctctccaaaatctacatttgcctacttttggctctgtcatcaagtagggtgatacaaaatgtatgccaagaaaagtctgattgtttcattttttatttttttcttacttgtctgacacagtgacaggatcacagaatgtgaattttgaacagatctgaaaagttattaagttcaactccacagaggtgagtaatgtgcccataagtgtggctgaagatgagtggcgctaacacaatgctgtgagtcygacccccagtccagcactctttccatgtcgtctaactcgctctcatttaccttcacataaagtgacaaaggggcctgatgcgtaacttcctccagccactccccgttcccagttattattccaaagaaatgttgctggggaaaagtgaagatgtgacttgatggggcaagctgccactctgccttccttcctatgataacttactagtaaataatgcattccttctggaatttaatttcacattttcaaaggccaaagacagcttgtagtaaatctttatacttataaaaaagcatttta

SEQ ID NO: 1464 - DNA, 601 bp, Human
accccacacaaaacccgactaaagaaatcatttcttttcctttctttttatttacaaagaatttttctctccaaaatctacatttgcctacttttggctctgtcatcaagtagggtgatacaaaatgtatgccaagaaaagtctgattgtttcattttttatttttttcttacttgtctgacacagtgacaggatcacagaatgtgaattttgaacagatctgaaaagttattaagttcaactccacagaggtgagtaatgtgcccataagtgtggctgaagatgagtggcgctaacacartgctgtgagtccgacccccagtccagcactctttccatgtcgtctaactcgctctcatttaccttcacataaagtgacaaaggggcctgatgcgtaacttcctccagccactccccgttcccagttattattccaaagaaatgttgctggggaaaagtgaagatgtgacttgatggggcaagctgccactctgccttccttcctatgataacttactagtaaataatgcattccttctggaatttaatttcacattttcaaaggccaaagacagcttgtagtaaatctttatacttataa

SEQ ID NO: 1465 - DNA, 601 bp, Human
tacagtcttatttccttgtgctcattataactaagcataatttacaattctctaactgggaaaaaacctggatactttaagtaatacaagcaatgtataccatggaagacaatgtacaattataaacaaatgaatagtgatattgccaagtgataaaatttaatatgaaaagtacaatgaagtagtagtcaaacttaagcgatataacattagaatacttatttatgccttggaattctactgcaacacacagatgagcagcttatctctccatgtattcacctatttaaaggtccaccctagtaatttattaaataaagccaaaataaattaacagagtaagataagatgacgtggtagtgacaatcaatgattcaaaaattcattaaggcctactcaaaaaaactctgcaggcatgcaggtctcccaaattttattgatagaaaggaactaaaataaggtgccatttggagcatcggaatgatgtaggtgtttagccagttcaaacaggctaacagaacaagtttgaaagtgtaagagacttagaaaattcattgtggaagtaaaaaacagaacattcttacagtgtacatgagaaggg

SEQ ID NO: 1466 - DNA, 601 bp, Human
tcacaggttccaggaattccttagtgtttctgatccactaaagactacttctctgttttctagtgctactaaaaagttttccttatttttgtctttcttcagtcaattattaaatctgtaatctttacattgtttttattatatagatcttcacttccataattctaaactataatatcttaattctatttttttctagttttcttccacctattactgcccttacaccctacagtcttatttccttgtgctcattataactaagcataatttacaattctctaactgggaaaaaacctgratactttaagtaatacaagcaatgtataccatggaagacaatgtacaattataaacaaatgaatagtgatattgccaagtgataaaatttaatatgaaaagtacaatgaagtagtagtcaaacttaagcgatataacattagaatacttatttatgccttggaattctactgcaacacacagatgagcagcttatctctccatgtattcacctatttaaaggtccacccgagtaatttattaaataaagccaaaataaattaacagagtaagataagatgacgtggtagtgacaatcaat

SEQ ID NO: 1467 - DNA, 601 bp, Human
taaaatgtgtctttacaaatgacgtatacttcacaggttccaggaattccttagtgtttctgatccactaaagactacttctctgttttctagtgctactaaaaagttttccttatttttgtctttcttcagtcaattattaaatctgtaatctttacattgtttttattatatagatcttcacttccataattctaaactataatatcttaattctatttttttctagttttcttccacctattactgcccttacaccctacagtcttatttccttgtgctcattataactaagcataayttacaattctctaactgggaaaaaacctggatactttaagtaatacaagcaatgtataccatggaagacaatgtacaattataaacaaatgaatagtgatattgccaagtgataaaatttaatatgaaaagtacaatgaagtagtagtcaaacttaagcgatataacattagaatacttatttatgccttggaattctactgcaacacacagatgagcagcttatctctccatgtattcacctatttaaaggtccacccgagtaatttattaaataaagccaaaataaattaacagagta

SEQ ID NO: 1468 - DNA, 601 bp, Human
ccatgttgtataaaatgtgtctttacaaatgacgtatacttcacaggttccaggaattccttagtgtttctgatccactaaagactacttctctgttttctagtgctactaaaaagttttccttatttttgtctttcttcagtcaattattaaatctgtaatctttacattgtttttattatatagatcttcacttccataattctaaactataatatcttaattctatttttttctagttttcttccacctattactgcccttacaccctacagtcttatttccttgtgctcattataastaagcataatttacaattctctaactgggaaaaaacctggatactttaagtaatacaagcaatgtataccatggaagacaatgtacaattataaacaaatgaatagtgatattgccaagtgataaaatttaatatgaaaagtacaatgaagtagtagtcaaacttaagcgatataacattagaatacttatttatgccttggaattctactgcaacacacagatgagcagcttatctctccatgtattcacctatttaaaggtccacccgagtaatttattaaataaagccaaaataaat

SEQ ID NO: 1469 - DNA, 601 bp, Human
ataatttgataattaggcttcttataaaactcttactagacaggtactttcagctaattctttttgggttttccatttaacactaatataatttgtaagttattttattttgcctcctttttttctgtgtctcatcttatttcaaccttgcctcccttctaattgctttggttagaatttctttgggcaatagttgtttttttttttttttaaataacaaattctttctcagttactcccatgaacaattctaaaatcctcttgagttagtattggttattaccaatttttatagaaattycccatttcaccaaatgttaattcctatttgctacactgtaatatcaagtatcttttaaaatgtctttgatatctgtacttacattccctctctcattactatttgtgtttctctcttaatatcctcattatccgttggaggttcatctattattattgtgtttgcccattatctcttatttcttctcatttcataagtttattttttcaattttttcttctactttctttcttctcatgtatatacttatttggggaaggcaacagagtgagaaagagaaaggtgctgtttttctaattt

SEQ ID NO: 1470 - DNA, 601 bp, Human
cagttgatccctatacctccttcccaatgacctccaggaggcctctaacttacaggtgaggcaggcatttttctattcccttaacatgaccagttggtgtatcatggtaaattttatttctctctctctttctagactgtcagtatcttgggcttagagttttatttatttttttcagctccacttcagctggcaaaacgcctagcatatagtaggaactaaaaaaatgttttccgaattaatgaaagaatgtagaattgcagctctgactgtaactagtttcccatgaagactataatastctattatcctttatttttcctggagcacaaaaggatttcatagagtctggaagacggttgcacattaagcccctttaccaccatcaatgttcactttctttacttttcatactataaatgatctggactctcctttttgctctttttgtttgtttatctactttaaacagtaaagacatctacatgcttatctatttgcaatagtgctgcagaagttactttatcaattattccatagtcaagggaaactttagacaagatataatgaatttggacactgcaagtaaaagccatatact

SEQ ID NO: 1471 - DNA, 601 bp, Human
tcattttacagatgaggaaactgaatctcagaaagttacatcatttgctcaaagccacttagctggtatgtgtaggtctaaaattcaatccccagctcagcctgccacaagggccactctcaactgccatattacctgtcagatcattgctatcagtgccctggttgcatcttgcttgcccacacctttgcttatgcttttccacaggtctgcactgctccccattgccttccctcccgcctcaccagttgatccctatacctccttcccaatgacctccaggaggcctctaacttacagrtgaggcaggcatttttctattcccttaacatgaccagttggtgtatcatggtaaattttatttctctctctctttctagactgtcagtatcttgggcttagagttttatttatttttttcagctccacttcagctggcaaaacgcctagcatatagtaggaactaaaaaaatgttttccgaattaatgaaagaatgtagaattgcagctctgactgtaactagtttcccatgaagactataatagtctattatcctttatttttcctggagcacaaaaggatttcatagagtctggaaga

SEQ ID NO: 1472 - DNA, 601 bp, Human
ttttgattctgcaaataattatgcaaataaaaatgactacttagaaataaaagttaaacacgtagtcaataaaaatggaagattacatcaacattaggataaatcttaactggttgttctatgagtttctgagcctagtggtctctgtgaggagtgacctcacagaggtcactttgatgacccagcctacctctgtgtaaacaaagtgttgttaaagtccttatcacttctgtctctgagtatataataacaaacttctaccatgtgcccactgtgggataggcattgtgctaaatacttyggtagacacatgatctccagtcttctcaatttattctgtgaggtagatgtgactattctcattttacagatgaggaaactgaatctcagaaagttacatcatttgctcaaagccacttagctggtatgtgtaggtctaaaattcaatccccagctcagcctgccacaagggccactctcaactgccatattacctgtcagatcattgctatcagtgccctggttgcatcttgcttgcccacacctttgcttatgcttttccacaggtctgcactgctccccattgccttccctcccgcct

SEQ ID NO: 1473 - DNA, 601 bp, Human
gttattgttgattatcatagtttttgtggactttaacacacacacccaaagattgtcttacacttttctcttaggaatgcttagtatgtcgaaataagcaaattaacccccacaaatataagctagagaagtaaacagaatttatatgagaactagtttcatgtagttcaaaatgtacattgctggcgttcaaaaaatcctagagtactattttcttccagactcggtcacgaattttagatcagttgagtccccaaagacaatttgtcctttggaagctaattggatttttgtacacttgccaagagaacgattttgatgcacatcagaattttgggtcaaacagatctcctttccttactgagaaaccagaagttaaacatacacacacacacacacacacacacacacacacacacacacacacacacacggttacatacaaaatagaatgcagaaaggaggcaactgacataagcagtctcaaatttcaaatctacacctctgtatccaacagaatcaaatttgcagaaaacttttgattctgcaaataattatgcaaataaaaatgactacttagaaataaaagttaaacacgtag

SEQ ID NO: 1474 - DNA, 601 bp, Human
gtccctaaacttcacccacctccaatgtgaccatttgcttggccatggctctctccactgcttcatacatctgcgtgttctggatccccaagccacaaaagatgacaaaagcttccagaaactgttcgtcatttcggttgaaaggcttaaccttgccagtattctcctccatcttattaacaagttggcaaacccctataacaatccgagaaattgagcaaatgttattgttgattatcatagtttttgtggactttaacacacacacccaaagattgtcttacacttttctcttaggaawgcttagtatgtcgaaataagcaaattaacccccacaaatataagctagagaagtaaacagaatttatatgagaactagtttcatgtagttcaaaatgtacattgctggcgttcaaaaaatcctagagtactattttcttccagactcggtcacgaattttagatcagttgagtccccaaagacaatttgtcctttggaagctaattggatttttgtacacttgccaagagaacgattttgatgcacatcagaattttgggtcaaacagatctcctttccttactgagaaaccagaagtta

SEQ ID NO: 1475 - DNA, 601 bp, Human
taattgaaactatatttgaaatatatatttgtgtgtatatgtgtacatatatatttgaaacagatttccactggtttatatattcaaagtcttttatataatactgtagcaaacctattagtataatatattcagcatagaaagtaaagggtaccatctggtatattttatataatatatgtctctctagctctttaaggttagttatgtacttaagagagattgagggaaatgttattatatcccaaacactgattttctctaatttcaactagataagaaatctccatgttacatcaaytgaataatttcaaggcagttagtgaaacatatatagaaaggactgaccctgttggagtcggctggtcctttgtgagaaagagtgttcctcggtcagtccctgggagccagtggtttcttcactcgctacctgcacattcagagtcacctgggggagcttggtagtcatacagattcccagcttctacccaagacttgctgaatcagaactttcagaagtagggtatataaatttatagtttgaaatagtttctcagatgattccaggagttaaaactcttcctgcttttcgttgatttta

SEQ ID NO: 1476 - DNA, 601 bp, Human
aagcagagttaattaaacatttttataagtatccatctaaatatttaccaaatttggttaaattaggtgtctgtaattagtaatttttaaaaagaaagaggataattaccgctaacgactgtagctctcttgtttcttcctctgctgctgaagcatgatacgacagaacctacagggtaggaaaagaagtccaggttacacaggagagaactaccacatgtagactagaacttcaagcttggaattctgctaagtcttcttggagagataattagactcctcagaatgccaaatcttgttygctgttttcttcaacagtgaaaaacccagatttagattccattgcttgttttggaaaacaaaaagttatactccctatgtttaaagaaaactcttgtaacttccagtctgacattattgctataacaaacacattatttataagccagcctagaaataacttttggctcaaactttggcagaaaatttattttgttttttttttttaagacaatattgactttagctatttctgcttgtgtacagaattaaagagaaaatctctgcataatctgacattttgatattaatatttggaaag

SEQ ID NO: 1477 - DNA, 601 bp, Human
agtttatacattgccaaatagcaattgaagcagcatgaagtcaagcctagggttctcttacaaacagatattcttaagtcaggctctgaagaagagaaatgtttgttgtggtagagagtggaacagacattattcagggaggaatgagatgtaaaagataaaaagtgaaaataagcacagcacatgcagattggcttgagcagaatgaagaatctgtttcagagatcagcaagaggcaatggttacagtcattataggagaataactaaagatttagaagccatgcagagaacatgaagagctttcaatatgaaatattcttagtcacaacagcttcatgatgttaacatcctctctagcattaacatttttatttcatcatcctaaaattatactgacaataatatctgaaagaaacaaaacagaagaggcactaaggaaggaaggccagccagaatgatggcaatgttcaagtttgatgttggccagaattagaataatagttattcaaccagaaaaggtaggatgatgaatcagacattaagaggaaatattttcctcatggataaaaacccaacaactggtaagaataaagatttct

SEQ ID NO: 1478 - DNA, 601 bp, Human
aatattcaacacaatacgattagctacagaagtaggccaaaaacaaggtttcttcattgtcggtagaaactgcttataaagaacttggtgggaaatcaatgcttccatatcctcccttttcaggtcattttattcctgttctattgctcagtttacaggaaattctgataacaaagaacactaatgtctcctaacctttttacccactgagttgccatattccaagcggaggatttctgtgtgcctaagattgaatgtgttcaccccaagcatactgcagcttcttacaccattttttcayatctgaatagagtctgtcaggaaggtgatggatgaatcttactgggagactaatcttactgagagacttttaagtaagatctataaactctctttgatatgtttagaaaatatgttgcagaaaattactggtgattaattaaagcagcaagaaaaaaaacaggaaaacccagaaatttaaactttggatatatctttttactaatcataaatgtacagatataattaaatatataataccatatattgtgaaacaatgaccaaaatgactctatgaaacataattcctaatggactactc

SEQ ID NO: 1479 - DNA, 601 bp, Human
gctgtattaaaggcatgtctccaattatgataggcaacattcttccgataattcttcttaacacttaaaatccatctgcaaagaacctttagggaataaaacataagtagtaacaataattgccaacatcttcacacatttactatgttccagacactacaaagcattcacatttagcctgatactccgatttggatcatcttacagacaagaaaactgacactcagagaggtaacttgctgaaggtcatattgttagttagggatggggccaaaattctaacttgagcaatttgactccrcagcctaccatgttaagtaccatgctaattaaattgatataaaacacaagacatccctaagaagggtatttttggcagggtagggcactgggtaggttttttttttttttaataaaaggtccatgtgtccatgtgccatttccatgtgtcaccaactaggagagtccaaaggttcacataggtatgaattcaccatttgagagccataaaagcggccactcccaagttcttcccatgctctcatgttgtatatccgtgaaggtatttagtgcaaggccctgggggtggactagtaacaag

SEQ ID NO: 1480 - DNA, 601 bp, Human
gagctgtattaaaggcatgtctccaattatgataggcaacattcttccgataattcttcttaacacttaaaatccatctgcaaagaacctttagggaataaaacataagtagtaacaataattgccaacatcttcacacatttactatgttccagacactacaaagcattcacatttagcctgatactccgatttggatcatcttacagacaagaaaactgacactcagagaggtaacttgctgaaggtcatattgttagttagggatggggccaaaattctaacttgagcaatttgactycacagcctaccatgttaagtaccatgctaattaaattgatataaaacacaagacatccctaagaagggtatttttggcagggtagggcactgggtaggttttttttttttttaataaaaggtccatgtgtccatgtgccatttccatgtgtcaccaactaggagagtccaaaggttcacataggtatgaattcaccatttgagagccataaaagcggccactcccaagttcttcccatgctctcatgttgtatatccgtgaaggtatttagtgcaaggccctgggggtggactagtaaca

SEQ ID NO: 1481 - DNA, 601 bp, Human
acccctaacttatcaatgaagcaagttcaggaactaggtggtttttgaggaattctactatggagcaggttgaatgtgaacaagagaaatgtgatactttttcttactttttcttaataaggcagtgttttcctcagaaggaaatatttatttgcccaaagactatttacgtgcaacatgaagttattttgaaggttttctaatatgccatatatatcatatatggaagaaaattagcaacgaagtagttttgccagattagtcctctttaattaacgaaatataacttattatgtaagtggcagcaaatattattttaaatcattgtgcaccttaaagtgaaattgaaagaatatgctataaattttactactaagcaacaaaatgtattagatatatgaatggctctaaaaagtacctgaattttgcctgcttttagagcagcaaacatgcactgagctgtattaaaggcatgtctccaattatgataggcaacattcttccgataattcttcttaacacttaaaatccatctgcaaagaacctttagggaataaaacataagtagtaacaataattgccaacatcttcacacatttac

SEQ ID NO: 1482 - DNA, 601 bp, Human
tgaccttccctaccccaaaataagtttacatgatttcttacactggttgagtatccctaatctgaaatccaaaatgcttccaaatctgaagctcttggagcaccaataagtctcaaaggaaatactcattggaatattttggatcttcagattaggtatattcaaccagtaagtataatgcaaatattccaaagtctgaaaaaaatctgaagtccaaaacacttcttgtcccatttcggataagggatactcaacctacacgtgtttgctaaggtaggaaaatactactattgtatttaawtgcacctcacttctttaataacaatcacttcttttagatttagccagttaaaatgtgcaccctatgaaagtagagacagagaataacattttaagaatttatttacaaaaagaaaaaggcagggaagctctgaattaaaaacagttatatgatggatgcctggaatcacttacctagaataactagtcgattcccactgaagttagaatctaaggacagagatatggataaaatttggcctggaaaggaacgaattacttgaacgttttctgcattgatcttccttttaaacagtctctg

SEQ ID NO: 1483 - DNA, 601 bp, Human
ttcccctcagtgctttacatacatacttctctatagtcacaaaggactaaccctagaatcctattcttcagggaattagttgtcctttgtcattcagaatgggatcaccacaaatgtcacttatcaacaggaaaagctgaaatgcctcaataaattaataatctgtccacctatagtaagtattgctaattcttaattattatgtgaaataatcataataaactttaaataattgtttttttcctcttttaattccctgcagattctgttcactctctgctatcagttgctgtgtccttarggaatgcagacaatgttaattcaagcaaaacaatagaaagaaaatgatttgaaatgaaaacttggctttaaaaagttacataatatactctcaagctaaatataggttattttttagtatctgctatgagtattatcattaatactgttccccttcattcgcaaaaaacacaagttaaaattatcatcagctgtattttcctagaactctcagtactctaaataggttttacaacaaacacaaaaatcatcattttgttattcctcacagagaactaggacagttttcagtgttgataat

SEQ ID NO: 1484 - DNA, 601 bp, Human
tttttttcccctcagtgctttacatacatacttctctatagtcacaaaggactaaccctagaatcctattcttcagggaattagttgtcctttgtcattcagaatgggatcaccacaaatgtcacttatcaacaggaaaagctgaaatgcctcaataaattaataatctgtccacctatagtaagtattgctaattcttaattattatgtgaaataatcataataaactttaaataattgtttttttcctcttttaattccctgcagattctgttcactctctgctatcagttgctgtgtmcttaaggaatgcagacaatgttaattcaagcaaaacaatagaaagaaaatgatttgaaatgaaaacttggctttaaaaagttacataatatactctcaagctaaatataggttattttttagtatctgctatgagtattatcattaatactgttccccttcattcgcaaaaaacacaagttaaaattatcatcagctgtattttcctagaactctcagtactctaaataggttttacaacaaacacaaaaatcatcattttgttattcctcacagagaactaggacagttttcagtgttg

SEQ ID NO: 1485 - DNA, 601 bp, Human
ttttttttcccctcagtgctttacatacatacttctctatagtcacaaaggactaaccctagaatcctattcttcagggaattagttgtcctttgtcattcagaatgggatcaccacaaatgtcacttatcaacaggaaaagctgaaatgcctcaataaattaataatctgtccacctatagtaagtattgctaattcttaattattatgtgaaataatcataataaactttaaataattgtttttttcctcttttaattccctgcagattctgttcactctctgctatcagttgctgtgwccttaaggaatgcagacaatgttaattcaagcaaaacaatagaaagaaaatgatttgaaatgaaaacttggctttaaaaagttacataatatactctcaagctaaatataggttattttttagtatctgctatgagtattatcattaatactgttccccttcattcgcaaaaaacacaagttaaaattatcatcagctgtattttcctagaactctcagtactctaaataggttttacaacaaacacaaaaatcatcattttgttattcctcacagagaactaggacagttttcagtgtt

SEQ ID NO: 1486 - DNA, 601 bp, Human
aggaaagagagaacaaatataatgtggtgaaggacattatattacctcttttcagtaatcttttttttcccctcagtgctttacatacatacttctctatagtcacaaaggactaaccctagaatcctattcttcagggaattagttgtcctttgtcattcagaatgggatcaccacaaatgtcacttatcaacaggaaaagctgaaatgcctcaataaattaataatctgtccacctatagtaagtattgctaattcttaattattatgtgaaataatcataataaactttaaataattgtttttttcctcttttaattccctgcagattctgttcactctctgctatcagttgctgtgtccttaaggaatgcagacaatgttaattcaagcaaaacaatagaaagaaaatgatttgaaatgaaaacttggctttaaaaagttacataatatactctcaagctaaatataggttattttttagtatctgctatgagtattatcattaatactgttccccttcattcgcaaaaaacacaagttaaaattatcatcagctgtattttcctagaactctcagtactctaaataggttttacaa

SEQ ID NO: 1487 - DNA, 601 bp, Human
agtactttacatgggaatatttatggtactcatagtttcctgggtctcctggctaagaaaattctactttaagtatcactcatttaccaacaaggaaagaaaaaaaaagaaaaatccctggaaaattcttggtttcctctactgaaaccacagggatgtaggaagaaataaaaatctttgaaactgctttaactttttttttttttttaaagttgaagtctgctttgtggtgtgtgtgtgaaagcaagattctgcagtcaatgactttttcccaggatgttttctttttctttttctttcttttttttttttggagaagatgacgtttctccagatgtttttggggtaattatttttaaataaacaaaggaaaaaatagttgagtgttttttttttcactctaaagcagggcaatatagcatcttagagcaatccatacactaataatacacatactaataatattatgttcagtgtagcacatgcttattctgatcttttggttgtgctgactgtggagaggcgtactatgtggcttgactctgtactatacatcttttcatatcagtgtcccctttcataattattctgtgtctgtgtg

SEQ ID NO: 1488 - DNA, 601 bp, Human
ttcacacatgattttgtgctgtgtgtagtgcccttttaagtctctcacatcctgctgaccctctattcccactgtgccagaccatgacttcagctcacttctgtcctctattagagcagagaagacagtcatgggatagaacaagttctcccaggacaaatatacagtgtgactgtggctaccaggagatttttctccccctgattgtattgcatctctaaccttgaaaaaaacacattcgttcgatcattttaccacttctaactaccaccctatttattatcttctactggacttattrccaaaactcccataacttccattcttgccaaccctctctctcagtgcacacatatacatatttcccagctctttcattttcatcaatggcaccatcactgttccagtttcttggaccagaagtcatatctccttccttcatgcttatatataactagctgctcattattaaattaaaaaatttttttctccttcagtctcttcctctctctagccagtatgtgatttttcagcttatacttgacttgctgtaacagctttctagttgagctctgtggttctaatttctacccattcacct

SEQ ID NO: 1489 - DNA, 601 bp, Human
gtccatctctgacagtagtattaggatgtccaatgcagaaatcagaccaatattttaaaaatagaaagccttagaaatctatagaaaatgaaagccccatgggggtgggaaactatattgccaccccagtcttcctatgtcaccaagaacaaacaacatccttggttctgcttcttagccatatatattactctgggctcaattctctaacaacctctttgtaaccttcaatcccatttagttctttacttcatcatttctcttcaaatcatcactattgctttcttctcccaatcaaccttttttttttttgccttctcattgtctataatcatattcaatgacataaatattcataatgatgattcatttcaccttttgacctcagaattctctgacctccttgacactactgattatctctttgcacataatgatggacagggctccgcttctttgttccacagctactaggttctactgggcacagtatttttgccactccctttattcaccacaggacaaagcaagatcttgaactcctatctgttgctaagaacattcccctgtgaaaatagctaaaacctgtagagcatttaac

SEQ ID NO: 1490 - DNA, 601 bp, Human
ttcatgcaagtaccaattagaaggtgttttgtcccagcctatctttaatacctctcacttctgccttagagctttctgaccccacaactggtgcccagaggaatgttctctgcactcatacttgttcatcctgaaagtgtcaaagagtgaaggcctgtggaccaccttggaccaggggggtacaaagacctagggacaactgcctttgtcttgccagtcaacagttctgggtcttatttcataagactcctcaaaagtgcctgggaagactaagcaccagtatgggtggacatctggatarctcatccctctactgcctttcctttcttccctgcttccttcccagttctgcattcctgctccctggggtcatattcacaaatagcctatatgcacactgactttcatctcaggttgtgtctccagggtaacctcagctgagacctctctaaagttgccatctttttgctttctagacaatcaaaggctcagtgaaaaataatgtgctcaaggttgatataaatggtagagctggcattcaagtatatcctcttcaacccatcacactgtcttaggataccaaagtactttaaaggcacac

SEQ ID NO: 1491 - DNA, 601 bp, Human
atgagagcctacaacatgtcaggtagtttgctttaattttttttagtttattatatttaatttttacaataaccttgtgcagggcatgcccatttacgacatcaaaaccctcaatcccacctcttactcatccactgatgtagtgtccagtttcatgcacgctttaacagacttcatgcaagtaccaattagaaggtgttttgtcccagcctatctttaatacctctcacttctgccttagagctttctgaccccacaactggtgcccagaggaatgttctctgcactcatacttgttcawcctgaaagtgtcaaagagtgaaggcctgtggaccaccttggaccaggggggtacaaagacctagggacaactgcctttgtcttgccagtcaacagttctgggtcttatttcataagactcctcaaaagtgcctgggaagactaagcaccagtatgggtggacatctggataactcatccctctactgcctttcctttcttccctgcttccttcccagttctgcattcctgctccctggggtcatattcacaaatagcctatatgcacactgactttcatctcaggttgtgtctccagggt

SEQ ID NO: 1492 - DNA, 601 bp, Human
accctttggctgagtgaagagaaaggaaaggatattatactcagttcattatatctctgagacagtcacaaataaagctttaaagcacgacaagcacaatcctccacctcatgtttctcatgacccttcacacgtgaatattaagcatagttttcactatttcttcataagaaaaagatgaagtttctgaaagcctctgttcataaaatttataggaaaggggtttgtgaattgtaaagctccatatacaagtgttggataatacaactgatttgttatttcttcctattactatctgaaygattattttactttgcatttaatttgttgaagatagagaagctacctaagactgaagaaatgtaatgtgggggaaaaaatgggtaaagtgagagaaatctgagggaaaaagaaaatagtaaagtgaaaataaaggtaataggacagataatctcatctattcttattgtttaaagtgttgtttatatttactgttgtcctaacctttcccaaattaattcttgcccttcttgtcttctttgctccttccatatttagtgagttggactatggatcaggtactgtgctcagcatcagaaaa

SEQ ID NO: 1493 - DNA, 601 bp, Human
actgaatttataaagctctcttttaaaattccacaacaataaattaggtacttactggactattaagaatcatcaggcactggtcaaaatgatggtgttccatgattgaatggcagtaaagctgggcaagtggatgttcacttctgaaagtattttgttgaagaaaggaaaaaagatcagtttccttaatatgccatttatcagtacatttttattactgtttaactacaaaagaggctacttcacaaaattaatcaactaacaattttctctccttttactgagaaaagtgtgagataayctctgggaaacaaatacaaagagtcaaattgttttcaaataccaatgtgaccattgccagagtaaagtatgaacaatttcattggttttaatactgattaaaatagaagtaaggagtaaagacaaaaaaattaatacctccaaacatggaaaaaaaccctctgaaatagttgtaccaattatatttttcaatttcaaaactgcaattgatataaaatctgaaacaaattcatgttagcttttcctctgaaataatgctcaggctgaaggtcagcttattcatgtgtgcctgcaaataaga

SEQ ID NO: 1494 - DNA, 601 bp, Human
gattccctgactcccctcattcccacacatgcgtcaaagatctcagctaggagttggaaacttatgattgctcaaatgcaggaaagtattttctagcttttagaaaggcagtttaatcatgaaaatgcataatcacagagacaactctaatgtatactcttattttagaatcaacaacttcaaagttctacataaatattcttctcctgccaaaatcaaataaaaagaaacaagagttacttgcttggcagtaactccttttcctgcccaactaagcttgaatgacggtataaaggagtcrtgaaatggtcagaagttgtggggagcaagggaaaggaggaaaagcaaatgatctatataatctttggacaacatggcttggaatgactgaccttgagatggctattagatttgtatatagtttcagagacacagtggtagataaacatcagaaataataggtattcttaattttcagcagtataagccaaaggagtagacttttctggctaccctttcagaaactgctccgtattctgataagcagttttgccaggacatttctgctttgaaatttctcaatatggatgtcaaaagtttg

SEQ ID NO: 1495 - DNA, 601 bp, Human
aaaggcattgtggttacaggtatttttcaaattcttggtaatttgataatccttattctgcaattatttttaataaactgaagtttactattaatatatattattttgtcttaacctcaaaatgctctaaaaaccaattaagtaggcacatgcagttacttctagatgtataacagtagatatctggcagatgtttttgtgttttttctatgtgtttttacttctcctaagagtaactacaaccatgaatgtgaattccttacagagggagagagactcatgttacaaggaaatcctgagwgtgattccctgactcccctcattcccacacatgcgtcaaagatctcagctaggagttggaaacttatgattgctcaaatgcaggaaagtattttctagcttttagaaaggcagtttaatcatgaaaatgcataatcacagagacaactctaatgtatactcttattttagaatcaacaacttcaaagttctacataaatattcttctcctgccaaaatcaaataaaaagaaacaagagttacttgcttggcagtaactccttttcctgcccaactaagcttgaatgacggtataaaggag

SEQ ID NO: 1496 - DNA, 601 bp, Human
tagaaaggcattgtggttacaggtatttttcaaattcttggtaatttgataatccttattctgcaattatttttaataaactgaagtttactattaatatatattattttgtcttaacctcaaaatgctctaaaaaccaattaagtaggcacatgcagttacttctagatgtataacagtagatatctggcagatgtttttgtgttttttctatgtgtttttacttctcctaagagtaactacaaccatgaatgtgaattccttacagagggagagagactcatgttacaaggaaatcctragagtgattccctgactcccctcattcccacacatgcgtcaaagatctcagctaggagttggaaacttatgattgctcaaatgcaggaaagtattttctagcttttagaaaggcagtttaatcatgaaaatgcataatcacagagacaactctaatgtatactcttattttagaatcaacaacttcaaagttctacataaatattcttctcctgccaaaatcaaataaaaagaaacaagagttacttgcttggcagtaactccttttcctgcccaactaagcttgaatgacggtataaag

SEQ ID NO: 1497 - DNA, 601 bp, Human
ttataaaaaatgaaaagtatgtttcataagggttcaaaggagagacccatgtggcctgtaaagcttagaaaggcattgtggttacaggtatttttcaaattcttggtaatttgataatccttattctgcaattatttttaataaactgaagtttactattaatatatattattttgtcttaacctcaaaatgctctaaaaaccaattaagtaggcacatgcagttacttctagatgtataacagtagatatctggcagatgtttttgtgttttttctatgtgtttttacttctcctaagartaactacaaccatgaatgtgaattccttacagagggagagagactcatgttacaaggaaatcctgagagtgattccctgactcccctcattcccacacatgcgtcaaagatctcagctaggagttggaaacttatgattgctcaaatgcaggaaagtattttctagcttttagaaaggcagtttaatcatgaaaatgcataatcacagagacaactctaatgtatactcttattttagaatcaacaacttcaaagttctacataaatattcttctcctgccaaaatcaaataaaaagaaa

SEQ ID NO: 1498 - DNA, 601 bp, Human
aaaacttacgtaataaaactgatagtatatgattataaaaaatgaaaagtatgtttcataagggttcaaaggagagacccatgtggcctgtaaagcttagaaaggcattgtggttacaggtatttttcaaattcttggtaatttgataatccttattctgcaattatttttaataaactgaagtttactattaatatatattattttgtcttaacctcaaaatgctctaaaaaccaattaagtaggcacatgcagttacttctagatgtataacagtagatatctggcagatgtttttgtrttttttctatgtgtttttacttctcctaagagtaactacaaccatgaatgtgaattccttacagagggagagagactcatgttacaaggaaatcctgagagtgattccctgactcccctcattcccacacatgcgtcaaagatctcagctaggagttggaaacttatgattgctcaaatgcaggaaagtattttctagcttttagaaaggcagtttaatcatgaaaatgcataatcacagagacaactctaatgtatactcttattttagaatcaacaacttcaaagttctacataaata

SEQ ID NO: 1499 - DNA, 601 bp, Human
aataatatttgttattattcagtgaatataataatatttggtgtacagtgaatacctctttatgtgcccagtattgttaagcattttgagaaggcataagacaaaaatttttcttttcgcagtgtttaatatctacctggagacacaagactcaagaaaaacttacgtaataaaactgatagtatatgattataaaaaatgaaaagtatgtttcataagggttcaaaggagagacccatgtggcctgtaaagcttagaaaggcattgtggttacaggtatttttcaaattcttggtaattygataatccttattctgcaattatttttaataaactgaagtttactattaatatatattattttgtcttaacctcaaaatgctctaaaaaccaattaagtaggcacatgcagttacttctagatgtataacagtagatatctggcagatgtttttgtgttttttctatgtgtttttacttctcctaagagtaactacaaccatgaatgtgaattccttacagagggagagagactcatgttacaaggaaatcctgagagtgattccctgactcccctcattcccacacatgcgtcaaagat

SEQ ID NO: 1500 - DNA, 601 bp, Human
tctgattttttttcccatcttagagcccactataaaatcatcatttacaaatctttaatacctcactttcccccttctatcatttgctttcgataaaacattaaacctcacctaatttttaactatagatcacaaattatggtaatttcaattcttgaatatttgttattttaagaaaaatgaaacagtatgagttaaaaatttgatgctgagaatgatttcaggtattttaagtgcatggcataataagatctataggtttcagtttatcatttatttcatggtaggggataaaaatatmtaaagttgtgaagtgcttctgaagtaaacaaagactaggtaaagtttaaaataaaataatatttgttattattcagtgaatataataatatttggtgtacagtgaatacctctttatgtgcccagtattgttaagcattttgagaaggcataagacaaaaatttttcttttcgcagtgtttaatatctacctggagacacaagactcaagaaaaacttacgtaataaaactgatagtatatgattataaaaaatgaaaagtatgtttcataagggttcaaaggagagacccatgtggcct

SEQ ID NO: 1501 - DNA, 601 bp, Human
ttccttccatgtctggaccctgacctcactgctctaccttttcagattttctttaagagaagtaaacattttgcagctatatcttacttccacaacatttataattccattttcagcacttccattacaatgaattaggaaaatgaataagggaaacctatagccatatattgatactctaccacattttaaaggtttttctagaacaaaggaacagttcattcacttggatttgcaaatgcatttcttttcaagtaaatattcaaatttactctttgtacaaccctctggagaaatctgrccgcttttaagatcatcatattgtaacaaataattgcaataaaaactaacagtgaggaaaaaatagtgagaaaattaactgggtaaaaaacttcagctttaaagatagtaaacctacttacaaaaacaactccttttgatgaggatcttccaaattgaattgattttttcttataagttcaaaaaattctcctcgcctcctacaatgtttaaaaaaaaattgttagttataatgagtacccagggtcttatccctttggtccacaaagactcatggactaaattttggtgaaaaaaaacc

SEQ ID NO: 1502 - DNA, 601 bp, Human
caacatcaggtatcatactgataaaagtcttatatcagaaattatagtaggtcatcctaattcactcaacacacatggtaacttctaaatgaaaagcctttgaatgattaatcatgtttttcagctttctcctttattgtttctgcatgttgaattatagttaggaaagttttctcactcctaggttatagaagaatccatctatatttttatttaatgcttgtatgatttaattctctacattgaactctatgcttcagttggaatttaagtctgtagagtagatccaattttgtctttytccatttggttatccacttatctctctctttcctccagtcactggaaatgttatctttattatacactatatgtcttatgcagttctagattttcagctgtgttccactggtctgccaccaatatcaaactgttttaatcatagagacttaatagtattccttccatgtctggaccctgacctcactgctctaccttttcagattttctttaagagaagtaaacattttgcagctatatcttacttccacaacatttataattccattttcagcacttccattacaatgaattaggaaaa

SEQ ID NO: 1503 - DNA, 601 bp, Human
gtaccacattttctttatctaatcaactgttgatggacagttaggttagttccatgactttgctattatataataaatggtgctgtgatgaacatataagtgtcttttttatatagtcatttatttttctttaggtagatacctagtagtgggattgctgggtagaatgttattttgactttttaattattgttattgtcactaagtaacatacccgttgttgaataggccagggttttgtaattgcagaaagatcacaagctgtcatcagcattgccctgttatggaaaaaagaaacccmaaactcctatttacttttgtgttattatataccctcagtaaatagttactaataaaaaaaagttaaaaccctctaaacaatggaaatggcagtttataaagaccaaagaaaaagaaacaatttatatgaaagtctaactaatacattgataacagagcatcattgtttcagtttccctttgaacttttggaatttgtcctcaaactgcctcatttagctccagattggcagactgaaaaattattaaccttgggtaaaatcttgcctgcttttattatttttgtcaccttagtattccat

SEQ ID NO: 1504 - DNA, 601 bp, Human
ttcttaatatatcttacaaatattatgtgcaaatgcatcttctaaaaagaaaagcctttgtatgtccaattatctgtttttaatactacttaaaaattccaaaaaaaattccatacttacttcagaagctacctttaagagtaaaaacttacttaaaaaaattttttttattttagatttagggggtatatgtgcatgtctggtatatatgtatattgtgtattggtggggactgggcttctagtatacccattacccaaacagtgaacattgtacccagtaggttgttcttcaccccttrttcttttcccacctttcccccttttggagtccccagtgtctattatttccatctttatgtccgtgtgtacctactgtttggctcccacttatgagtgagaatgtgcagtgtttgattttctgtttctgagttagttcattaaggataattggcctccagctccaatcatgttgctgcaaaggacatgacttgattctttttatgcctgcatagtattccatggtgcatatgtaccacattttctttatctaatcaactgttgatggacagttaggttagttccatgactttgctattata

SEQ ID NO: 1505 - DNA, 601 bp, Human
tgtgctaatgtagatgctctctttcttaatatatcttacaaatattatgtgcaaatgcatcttctaaaaagaaaagcctttgtatgtccaattatctgtttttaatactacttaaaaattccaaaaaaaattccatacttacttcagaagctacctttaagagtaaaaacttacttaaaaaaattttttttattttagatttagggggtatatgtgcatgtctggtatatatgtatattgtgtattggtggggactgggcttctagtatacccattacccaaacagtgaacattgtacccrgtaggttgttcttcaccccttgttcttttcccacctttcccccttttggagtccccagtgtctattatttccatctttatgtccgtgtgtacctactgtttggctcccacttatgagtgagaatgtgcagtgtttgattttctgtttctgagttagttcattaaggataattggcctccagctccaatcatgttgctgcaaaggacatgacttgattctttttatgcctgcatagtattccatggtgcatatgtaccacattttctttatctaatcaactgttgatggacagttaggtta

SEQ ID NO: 1506 - DNA, 601 bp, Human
aatgaaaactgtgctaatgtagatgctctctttcttaatatatcttacaaatattatgtgcaaatgcatcttctaaaaagaaaagcctttgtatgtccaattatctgtttttaatactacttaaaaattccaaaaaaaattccatacttacttcagaagctacctttaagagtaaaaacttacttaaaaaaattttttttattttagatttagggggtatatgtgcatgtctggtatatatgtatattgtgtattggtggggactgggcttctagtatacccattacccaaacagtgaacrttgtacccagtaggttgttcttcaccccttgttcttttcccacctttcccccttttggagtccccagtgtctattatttccatctttatgtccgtgtgtacctactgtttggctcccacttatgagtgagaatgtgcagtgtttgattttctgtttctgagttagttcattaaggataattggcctccagctccaatcatgttgctgcaaaggacatgacttgattctttttatgcctgcatagtattccatggtgcatatgtaccacattttctttatctaatcaactgttgatggaca

SEQ ID NO: 1507 - DNA, 601 bp, Human
ctaaaatgctggttcaatgagcattttctttaagtgtcatgtcagtactcaaaatgctttgaattttggaacattttgggtttttgcattaagtatgctcagcctttcacactgaaatgaaaactgtgctaatgtagatgctctctttcttaatatatcttacaaatattatgtgcaaatgcatcttctaaaaagaaaagcctttgtatgtccaattatctgtttttaatactacttaaaaattccaaaaaaaattccatacttacttcagaagctacctttaagagtaaaaacttacttaaaaaaattttttttattttagatttagggggtatatgtgcatgtctggtatatatgtatattgtgtattggtggggactgggcttctagtatacccattacccaaacagtgaacattgtacccagtaggttgttcttcaccccttgttcttttcccacctttcccccttttggagtccccagtgtctattatttccatctttatgtccgtgtgtacctactgtttggctcccacttatgagtgagaatgtgcagtgtttgattttctgtttctgagttagttcattaaggataattggcc

SEQ ID NO: 1508 - DNA, 601 bp, Human
ccgtgaatgaaggccctgttaggagctgtatatctccattttatagcaaataagcagcagcttgatacccgaagacaagtagtccatgtccaaagcgtgctctcttaactattacattatactctttttcacttaggtacatctctctgtctttggtagcttccaacatttttcccttttaattttatttaaaaatgttttcttcatttattttccccccataaaacagtatgtacaagggtttgattcaggggagagaaaggatatatgaagacacattcttccctcttctattctcttmcctggttagaaataaataggcatatagtcctgtttattatgggcaggaaggtaggtaaagatcacctaagtgcttatggcgtgttggctttggcacatggagaatgagtttttgatcttgttttctcggcatgtctgtttcatgagatgagcctgtaggaagagttactaggctccctgactaagcagcccggagtcttgaccaacagcaggctgtcaacaatcctaaatagcatatttattacggactcaaaatgaaatcttgaaaaacaaaaacacaatatatatgtcactgcatgga

SEQ ID NO: 1509 - DNA, 601 bp, Human
attgtggtcctaaggaaagatcccatagagccataaaaaggagtctacaattaaaaaaaaaacaatttgaataattcctaccaacaaggtttcatacttacagtgggttctatgttgagttcttttctctctctgtctccttgatcaaaaaattcagttgctacaagttctgctatctgaaataaataacagactcagttttgacaatgaaaagcatatcattctttaaaacagagaccgtgaatgaaggccctgttaggagctgtatatctccattttatagcaaataagcagcagcttsatacccgaagacaagtagtccatgtccaaagcgtgctctcttaactattacattatactctttttcacttaggtacatctctctgtctttggtagcttccaacatttttcccttttaattttatttaaaaatgttttcttcatttattttccccccataaaacagtatgtacaagggtttgattcaggggagagaaaggatatatgaagacacattcttccctcttctattctcttacctggttagaaataaataggcatatagtcctgtttattatgggcaggaaggtaggtaaagatc

SEQ ID NO: 1510 - DNA, 601 bp, Human
catgtaatcatgataatacataagaatatttgttaaaatgaaaagtggtttctaatacttaagcggaaaaaaacaaattacaaagaacactgatacaatatgatgaacccaagagtctttattatgccttttattggttttgctttctgtaatgaacatgtataattcttccaatgagaaaaaagttttaaaaaataaaatgagaaattgtggtcctaaggaaagatcccatagagccataaaaaggagtctacaattaaaaaaaaaacaatttgaataattcctaccaacaaggtttcayacttacagtgggttctatgttgagttcttttctctctctgtctccttgatcaaaaaattcagttgctacaagttctgctatctgaaataaataacagactcagttttgacaatgaaaagcatatcattctttaaaacagagaccgtgaatgaaggccctgttaggagctgtatatctccattttatagcaaataagcagcagcttgatacccgaagacaagtagtccatgtccaaagcgtgctctcttaactattacattatactctttttcacttaggtacatctctctgtctttggta

SEQ ID NO: 1511 - DNA, 601 bp, Human
acatcgatttcatgtaatcatgataatacataagaatatttgttaaaatgaaaagtggtttctaatacttaagcggaaaaaaacaaattacaaagaacactgatacaatatgatgaacccaagagtctttattatgccttttattggttttgctttctgtaatgaacatgtataattcttccaatgagaaaaaagttttaaaaaataaaatgagaaattgtggtcctaaggaaagatcccatagagccataaaaaggagtctacaattaaaaaaaaaacaatttgaataattcctaccaayaaggtttcatacttacagtgggttctatgttgagttcttttctctctctgtctccttgatcaaaaaattcagttgctacaagttctgctatctgaaataaataacagactcagttttgacaatgaaaagcatatcattctttaaaacagagaccgtgaatgaaggccctgttaggagctgtatatctccattttatagcaaataagcagcagcttgatacccgaagacaagtagtccatgtccaaagcgtgctctcttaactattacattatactctttttcacttaggtacatctctct

SEQ ID NO: 1512 - DNA, 601 bp, Human
atgatggatgtttatcacagtgctgtttgtaatagtgaacactgcaaatattacaccaagggacgtaggtaaattatggttacatcgatttcatgtaatcatgataatacataagaatatttgttaaaatgaaaagtggtttctaatacttaagcggaaaaaaacaaattacaaagaacactgatacaatatgatgaacccaagagtctttattatgccttttattggttttgctttctgtaatgaacatgtataattcttccaatgagaaaaaagttttaaaaaataaaatgagaaattktggtcctaaggaaagatcccatagagccataaaaaggagtctacaattaaaaaaaaaacaatttgaataattcctaccaacaaggtttcatacttacagtgggttctatgttgagttcttttctctctctgtctccttgatcaaaaaattcagttgctacaagttctgctatctgaaataaataacagactcagttttgacaatgaaaagcatatcattctttaaaacagagaccgtgaatgaaggccctgttaggagctgtatatctccattttatagcaaataagcagcagcttgata

SEQ ID NO: 1513 - DNA, 601 bp, Human
aatgctgagaaaactggggagactgtggtggtggcatgacatctggtcatctttcctccatgtttcttttggtatctctccttcctttctctgtcagccacagcttctctattaaattcttttgatggcgagaaccaaggagtaggagtgaaacatctatgatggatgtttatcacagtgctgtttgtaatagtgaacactgcaaatattacaccaagggacgtaggtaaattatggttacatcgatttcatgtaatcatgataatacataagaatatttgttaaaatgaaaagtggtttstaatacttaagcggaaaaaaacaaattacaaagaacactgatacaatatgatgaacccaagagtctttattatgccttttattggttttgctttctgtaatgaacatgtataattcttccaatgagaaaaaagttttaaaaaataaaatgagaaattgtggtcctaaggaaagatcccatagagccataaaaaggagtctacaattaaaaaaaaaacaatttgaataattcctaccaacaaggtttcatacttacagtgggttctatgttgagttcttttctctctctgtctccttgatc

SEQ ID NO: 1514 - DNA, 601 bp, Human
ggagaactttgaacaaaggagtaaacaagtagaatgctgagaaaactggggagactgtggtggtggcatgacatctggtcatctttcctccatgtttcttttggtatctctccttcctttctctgtcagccacagcttctctattaaattcttttgatggcgagaaccaaggagtaggagtgaaacatctatgatggatgtttatcacagtgctgtttgtaatagtgaacactgcaaatattacaccaagggacgtaggtaaattatggttacatcgatttcatgtaatcatgataatacrtaagaatatttgttaaaatgaaaagtggtttctaatacttaagcggaaaaaaacaaattacaaagaacactgatacaatatgatgaacccaagagtctttattatgccttttattggttttgctttctgtaatgaacatgtataattcttccaatgagaaaaaagttttaaaaaataaaatgagaaattgtggtcctaaggaaagatcccatagagccataaaaaggagtctacaattaaaaaaaaaacaatttgaataattcctaccaacaaggtttcatacttacagtgggttctatg

SEQ ID NO: 1515 - DNA, 601 bp, Human
acctcccaagtttaagctattctcctgcctcagcctccctagtcaggtgtgcagtaccacgcctggctgattttttatttttattagcgacagggtttcaccatgttggccaggctggtctagaactcctgacctcaagggatctgactgccttggcctcccaaagtgctggcatcacaggcatgagccattgtgtgcatttatttaaagaacacaaagctggctctagaaaggtgaatcagtgggttagcctaggaaggtcagacagcaactaatacaaaaagaaaaaaagaggaaaacycttatgttttatttcaaggaaactcattccaaaaaacagaagtgggctgagaggaatctttacttgtatctgagatccatactctatgtaaaaaggcagtatgtatcaaagacctttaaattctgtttgcccttcaacacgacaactttgggaatttatgctaacaagataatgaagaatgaggtttggcggtttatctattcccttggtgtaatgtttgcagtgttcactattacaaacagcactgtgataaacatctatgatagatgaaacactgctctgaacacacttctgaggaga

SEQ ID NO: 1516 - DNA, 601 bp, Human
agatgtgcatttatttatttagttagttattactttattattttttgagatggagtctcactctgttgtccaggctggagtgcagtggcaccatctcagctcactgcaacctccacctcccaagtttaagctattctcctgcctcagcctccctagtcaggtgtgcagtaccacgcctggctgattttttatttttattagcgacagggtttcaccatgttggccaggctggtctagaactcctgacctcaagggatctgactgccttggcctcccaaagtgctggcatcacaggcatgarccattgtgtgcatttatttaaagaacacaaagctggctctagaaaggtgaatcagtgggttagcctaggaaggtcagacagcaactaatacaaaaagaaaaaaagaggaaaactcttatgttttatttcaaggaaactcattccaaaaaacagaagtgggctgagaggaatctttacttgtatctgagatccatactctatgtaaaaaggcagtatgtatcaaagacctttaaattctgtttgcccttcaacacgacaactttgggaatttatgctaacaagataatgaagaatgaggtt

SEQ ID NO: 1517 - DNA, 601 bp, Human
gcaagcagatggcatctatgaacccaacttgcatacttgggattttgtttttcttctccctgttcattagatcctgaaaatacaaatacagaccagacacacagatgtgcatttatttatttagttagttattactttattattttttgagatggagtctcactctgttgtccaggctggagtgcagtggcaccatctcagctcactgcaacctccacctcccaagtttaagctattctcctgcctcagcctccctagtcaggtgtgcagtaccacgcctggctgattttttatttttatyagcgacagggtttcaccatgttggccaggctggtctagaactcctgacctcaagggatctgactgccttggcctcccaaagtgctggcatcacaggcatgagccattgtgtgcatttatttaaagaacacaaagctggctctagaaaggtgaatcagtgggttagcctaggaaggtcagacagcaactaatacaaaaagaaaaaaagaggaaaactcttatgttttatttcaaggaaactcattccaaaaaacagaagtgggctgagaggaatctttacttgtatctgagatccatactc

SEQ ID NO: 1518 - DNA, 601 bp, Human
tgtgtgtgtgtatatatatatatataaatgtagaaggataacatctataataggtgattactatgttgactgtatttacagggatggagaaaactcaaaagagccattagtatttttaatggagaaactcttaatccaatcaataaggaaagcaactgttatggaaagaatgagatgtccaagtgtttgaaacaatgctctgaacacacttcatacttctgaggaagagctttgaacaaaggagtaaacaagtagaatgctgagaaaaatagggagacgacagtggcacatgacacctagtttttttttttttttttctccatggttcttttggtatctctccttcctttccctgtcagccacagttctttatattaaattcttttgatggcgagaatcctggagtaggagtgagaactggactgtagatgcacctctcccactaaccacctgtttggggcaaatagtctgtctcgttgggagatgaactttacaagttcaattactaaatctgaaatatctggattagaatatttctaggttttttttctgctcttgacattctatgataactccatgacaaatgttctttttccaaata

SEQ ID NO: 1519 - DNA, 601 bp, Human
catacacagatcatttacacatgattcttctaaaacactacagataaggagtacatgctgagggacagagcaaacacacacattccaaaataacattactgtgctagggagacagatctgtgtggaatccacttttaggggaaaaaagacattttgtttctatgtagtacagttggctcttcctaagtgtgactgcatcagggaactgcttagtttttgcgtttttctagggaatggtttcatacaatgtacttaaataggcttttatccaggattatattataataaagattcataattyggtgtggcattattatgtaccaattatagtgccataaatatttagccaccagaatgttcatttcagatttcttcctaatagtgaaccacttaaaatgacaaatacccaacaataggttgtcactgtaaaacctcccgcagaataaaaaaataaaaagaaacctcacagaaacacatttgatacataaaatatggatataatgacattatggattgcaaaaggcaattactgaattattaaatgaaaagtatatgaaaatgtcataaagcatatacattgatatgttatctgtagttttct

SEQ ID NO: 1520 - DNA, 601 bp, Human
taagaaaatattaactatactaaatgttatgggaagaaaatacattgaatgtgagttaagggccagtgtttagcattcacatccaggattctctggatctcagttgacttgtcctatacatcaaaatatggcaatttttcaatcacaatactgctaaatgttattcaggcataaagtttcttacccactgttccctcaaattcatttttgaccctagtattggcaatagccctttgctatttatataattaaaacttttctttaaatttcaattgacaggaaaaagagtcattttgtactstcttatctataaccatgtctcacttcaagtcaatgctacaattgtcacttttattttgaaaaggaagctcagaaggaaaaaaactcttagagagatcttctaacagaacatttttcttcactgatagacatccaaggccattccatttctaaatcacacttatccctcaatcaagtcagtgactggatcatctcctaaggtttcacctgctttgcatcaggtaggtgagatgaaagtgattttatgggtagctttcagaaaaatgtactgcactgaagtgacaaagttctgtcttgcctg

SEQ ID NO: 1521 - DNA, 601 bp, Human
gcccgccaccacaaccagctaatttttgtatttttagtagagatggggtttcatcatgttggtcaggctggtctcgaactcctaaccttctgatccacccgcctcggcctcccaaagtgctgggattacaggcatgagccaccgtgcctggcaacagtttcttactaagaactagcacttgagaaagttatataaaatatgctcaaaaagatataattatctctcattttattttatttttttgagatggaatcttgctctgtcgcccaggccgaagcgcagtggcacaatctcagctcartgcaacctctgcctcccaggttcaagtgattctccttcctcagcctccggagtagctgggattacaggcacatgccaccacacccagctaattttttttttatttttagtagagatgaggtttcaccatgtcggccaggctggtcttgaactcctgacctcaggtgatccacccgccttggccttccaaagtgctgtgattacaggcatgagccaccgcacctggccaattatctctaattttatactcactacttttattaacttttatcaaagataactttttttttttttttttttt

SEQ ID NO: 1522 - DNA, 601 bp, Human
aggagaggagtcgggaaagcggaggccccagccgggctccaggtccactcaccttgccggtggtggcactgaccagcttggcctggcagtccacagagccagttaggatcaagctgccatcctggttggcagcaacacaggtgagtgggccctggtgaccctcagtccctagcatagagcagggaggcagctcaggcttcgtcctacctcccctctgagtcctgccccaggttctcagcccctccctacaaaggcccaggctaacacttcccccacctctgatacctttcagtacatggayagggcttccctgcttcaggtcccaaatcctgatggtcccatcttcatagcctaccacagctctcttccctgaagagaggcacagatgaagagagggcagagggcacgctcacatacactaagcaagggaatggggagagggagaggaaagaagagtggaagggcccagacactgccccaggaatcacaggtgagttcagagcaggaaggaggcgctgtgaactttggggcccaggaggtcagcactgcaaacagcaggcctcagattttgccggctgtgacccagaaggctgctctggga

SEQ ID NO: 1523 - DNA, 601 bp, Human
actccaccttcccctgaggctggggcggggcatggttttggtggccggttgggcttggggcaaatccagagaggcccggtggggtcccccataccctgacccagccccgtgagcaccctgccagtttcctgctgagccctgctctagggacctggacccccacacagcaggagacccccacgcagcaggacacactggccccacagcctccaagcatctcccgcccacctgactggggcccccaggacatggagggggtgtccctgcctcttcagggtccgccccacctcctgggcctgtstgtctctcatggccacaacctctcgccctgaagcctctcgggtcggctggagctgggagggagagactcggggtgtggtgctggggccccatggccggacactgaccatgcgccctgtgcttcctccccaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggct

SEQ ID NO: 1524 - DNA, 601 bp, Human
cattgtgtgcatgggccatgttgttggtggatgaaccaagaatccacattttaagagatgttaaaggacgtaaaatttcgttgtaccctttatataccttttatagcaggtagtttttcaacatcagttatcttttcctcctcccagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagcgttccacggtccrgctagtgccgctcagccctagaccctgactttgcaggctcagctgctgttctaacctcagtaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggc

SEQ ID NO: 1525 - DNA, 601 bp, Human
cttgggcccggcgcgcagacccgcggagtttcccgtgccgacgccccggggccacttccagtgcggagtagcggaggcgtgggggcctcgaggggctggcgcggcccagcggtcgggccagggtcgtgccgccggcgggtcgggccgggcaatgcctcgcgggcgcaatgaatccgcggcaggtaagccgggccggccttggaccttcgccgccgtctgggttcgtttacaacctcacaggctttgtgttgcagtgcgtagcgtgtgcgtcttgtgagtgttagagtgtgtgtgtgtgtggcgtcttgccaagcagcattgctggtttaggaatttgtgcgtcttgtgagtgtgtgtgtgtgggtgtgtgtcgtcttgccaagcagcattgctggtttaggaatttgtgcgtcttgtgagagtgtgtgtgtgtgtgtgtgcgtgtgtgtgtagtcttgccaagcagcattgctggtttaggaatttgtgaatttgtatcctgctcattaattctgcagaatggagcagtgcgtgaagagggcttgggggaaaatgcgcccccgtctgagtaggaaggcctgagcccatgtcaaggcagaca

SEQ ID NO: 1526 - DNA, 601 bp, Human
acctcctgaaggccttctgggagttaaaaatggcacttaagctgtaggagaaagcttgttaaccactttatagctaaaaactgggaaaacacaaatggccttcagcaggttaacagataaactgaaatacatccacataatgggatactgcttagtagtgaagaggaaatactgttacaagtaacaacacgggtgactcgcaagtgcgttatgctaagcacgagaagccagactcaaaaggctgcatactgtatgagtccatttatatgacattctggaaaaaaaaaaccacagttatagsgatggaaagtggatccgtgggtgccagggactgggtatcgtggaagaaattgattgttgagtggcatgaaaaagctttttagggaaatagaaatgttctatatcttgattgtggtggcgattgtcgaaattcatagatttatacacttaaaaggataaattttactgtatctaaattatatacctcaattttgttaagatatatatatatatttttttttttaagcactcctttgaaaggattaaggacgcctaacttgaaggaaaagcatttctgcacaggtgtcagtgtattgcactg

SEQ ID NO: 1527 - DNA, 601 bp, Human
tgctaagcacgagaagccagactcaaaaggctgcatactgtatgagtccatttatatgacattctggaaaaaaaaaaccacagttatagggatggaaagtggatccgtgggtgccagggactgggtatcgtggaagaaattgattgttgagtggcatgaaaaagctttttagggaaatagaaatgttctatatcttgattgtggtggcgattgtcgaaattcatagatttatacacttaaaaggataaattttactgtatctaaattatatacctcaattttgttaagatatatatatatwtttttttttttaagcactcctttgaaaggattaaggacgcctaacttgaaggaaaagcatttctgcacaggtgtcagtgtattgcactgtggaacctgtgtggtaaaggcaaagggggtagtgcttatctcttgatcctaaatatgtgagaccagattaaagtgaaatctgggaggcaatgaatgttaaatgagttgttatgtaatttgcatagaggtgatgctgagagatttagaaaggatcactgtgggttgcttgctcactttcttgctctcctattccgtagctttccaaatggct

SEQ ID NO: 1528 - DNA, 601 bp, Human
gctaagcacgagaagccagactcaaaaggctgcatactgtatgagtccatttatatgacattctggaaaaaaaaaaccacagttatagggatggaaagtggatccgtgggtgccagggactgggtatcgtggaagaaattgattgttgagtggcatgaaaaagctttttagggaaatagaaatgttctatatcttgattgtggtggcgattgtcgaaattcatagatttatacacttaaaaggataaattttactgtatctaaattatatacctcaattttgttaagatatatatatataattttttttttaagcactcctttgaaaggattaaggacgcctaacttgaaggaaaagcatttctgcacaggtgtcagtgtattgcactgtggaacctgtgtggtaaaggcaaagggggtagtgcttatctcttgatcctaaatatgtgagaccagattaaagtgaaatctgggaggcaatgaatgttaaatgagttgttatgtaatttgcatagaggtgatgctgagagatttagaaaggatcactgtgggttgcttgctcactttcttgctctcctattccgtagctttccaaatggctg

SEQ ID NO: 1529 - DNA, 601 bp, Human
ttgcatagtggcgtcttgttcatgcagtcattaattcaacaaatgtttgttgagaatcagctttgtgccaagtgctagagaggttgagatgattgaagcatagtccttgacccccaagagctcaccatggaatcaactgaagcccctcatcagtactgtgttgggaatattgagagtggagagttgagtataacttataggacacctaatgttaattacctttcagacactgcaatgtgtgtgtgccataaaaaaaaaaaaaaatccagtagctctgatacgagggaaagtaaatggttttaacaggtgctgagtaggagaagctcaaggagaggaaaccccaagggctgaagaaggtgggagtcaggagtctcctgaagcaagtggcatttaaggagctctataaggaaagggtcagagttgtgataggtggctgtggagggagatgtgccacctggattggcatgtagagggatagaaagattataggcctttgcaatggcccagtaagaggtaatgaggggctggaactggaagaaaacacatttaagacacagtacagaggtggcagacaaggtgggacttggcaactacctgatga

SEQ ID NO: 1530 - DNA, 601 bp, Human
gtcaggagtctcctgaagcaagtggcatttaaggagctctataaggaaagggtcagagttgtgataggtggctgtggagggagatgtgccacctggattggcatgtagagggatagaaagattataggcctttgcaatggcccagtaagaggtaatgaggggctggaactggaagaaaacacatttaagacacagtacagaggtggcagacaaggtgggacttggcaactacctgatgagatccaggagatgaggccaggaggcgggcagcaaagatgacgcaggtttctagccttaatargctaggaggagagtgatgccattagcaataagaactacaggagaaggagctgagtttgagggaactattaatttggttcagaatatgtgctgtttgagttatggcaggatatttaagtggacagactgtcgacatagttggaaattcagatcttaagctcccacacaaggtagtggctggacatagtagatttgagtgctcttgcttcagagggctagtttaggttggggcagtgattaaagcaacctaggaaataaattataaaggaagaagaggtccttaaaaccttggagactgatt

SEQ ID NO: 1531 - DNA, 601 bp, Human
tcagagggctagtttaggttggggcagtgattaaagcaacctaggaaataaattataaaggaagaagaggtccttaaaaccttggagactgattatataaagggtggatccgttaatacagtagctattaaaaaattataaggggtgggaaaaagggacaaagaagaaaaaagaggtgaaagacctttgctgtgtcaccaaaccctgggaggagaattttttaaaagaagagtactcaatccacagtgaactacggcatgtttgttaaacacaattgaccaccacacagcgaagacccaamtgaggttcaagagaaggaatttttatggaccctgttagcacaagtcaaggtccttctccagtaccactgggaagctttggagaagaaaagggggacagtgggccttgggtggagaagggaactgaccatgagatccaggtggggtgaggaggtgtgtgaagtcagagtggggaagaatcagggtggcttactggcagcttcaccggggtcatgcgaggagcaggttccaccagagtaaggagtgaagttgtagaaacacagggaagtcaccatcagaaaagagcaggagtcaagaaacta

SEQ ID NO: 1532 - DNA, 601 bp, Human
ggtttgggcaaaagtctctggcatcccttctgagcctgggtaccacactgaagagtgaggacagtgtgccatttttatcaggaaaccctccagctccctgaagaccaaattctgatcctcctgggatggcagtgaagagccacagagatgactctgaggtcccgtggccttttcccacctggagattgttttcgttactgcgctgttacagccttggaggactggggttcagtttcatccaatcacatttcttcttttgtcatagtcatctaaacgatagatcttagagacaggtgggcarggggtgcactggtgagcctgacttaaggagaggtcatctcgtcccttccctagtcccatctcccttggttattgttatttcatgtgattgttctggttatttcaggttattctgtttttgttttcaaaacaataacatatatttgttgttctgattttaaaggggtaattgttttggtaactagaaaattaccttctcaactcccttaaattctgtcaaagggaaaagtaagttaggttgctggagaggctatgctgaggcctcagaacctctgtactcctggaagttctgcgtgctttg

SEQ ID NO: 1533 - DNA, 601 bp, Human
ggtgggcaaggggtgcactggtgagcctgacttaaggagaggtcatctcgtcccttccctagtcccatctcccttggttattgttatttcatgtgattgttctggttatttcaggttattctgtttttgttttcaaaacaataacatatatttgttgttctgattttaaaggggtaattgttttggtaactagaaaattaccttctcaactcccttaaattctgtcaaagggaaaagtaagttaggttgctggagaggctatgctgaggcctcagaacctctgtactcctggaagttctgygtgctttgcctcctgctcccctctctgtgttcctgttggcaggcccctaggcaggatttaggaggtaggcaagtcaccctagccaagtcataagcccatggctcaattgccttctcagcccttcaagggctgttccacaggcagcaaagggaggggcctccacaggttcaccactgcagccctaattcattttctttttccactgtcttattctgcaggggtattccctcagcggatactacacccatccatttcaaggctatgagcacagacagctcagataccagcagcctgggccag

SEQ ID NO: 1534 - DNA, 601 bp, Human
catctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaraagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacag

SEQ ID NO: 1535 - DNA, 601 bp, Human
cgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcggtaagagaccacccaggaactgtacctagggttggggtcaggtgcttttgctcctgacgcagtcttggctgatttgtgagcagtgctgtttggtggcrcctatcttttcctccttcccttctgccttttagctaaattccccttgattggccctttctccagatattgagcagggaatatagaccttggaccagccagaatcttggctgaacaagggggaggttgactctgttggctgtaatgaagcttctttagaaatgattggttttggccgtacgcggtggctcatgcctgtaatcccagcactttttgaggccgaggcaggcatatcacgaggtcaggagtttgagaccagcctggccaacatggtgaaaccctgtctctactaaaaatacaaa

SEQ ID NO: 1536 - DNA, 601 bp, Human
tccttcccttctgccttttagctaaattccccttgattggccctttctccagatattgagcagggaatatagaccttggaccagccagaatcttggctgaacaagggggaggttgactctgttggctgtaatgaagcttctttagaaatgattggttttggccgtacgcggtggctcatgcctgtaatcccagcactttttgaggccgaggcaggcatatcacgaggtcaggagtttgagaccagcctggccaacatggtgaaaccctgtctctactaaaaatacaaaaattagctgggcrtggtggcgtgcacctgtagtcccagctactcaggaagctgagacaggagaatcacttgaacccaggaggcagaggttgcagtgaactgagattgcgccactgcactccagcctgggccacagagcaagactccatctcaaaaaaaaaaaagaaagaaatgattggtcttgggggccggggcggtggcttacgactgtaatcccagcactttgggaggccaaggcaggcagatcatgaggtgaggaattcgagaccagcctggccaacatggtgaaaccccatctctactaaaaatacaaa

SEQ ID NO: 1537 - DNA, 601 bp, Human
ctgaggcaggagaatcacttgaacccaggaggtggaggttgtagtgagccgagattggcgccactgcactccagcctgggcgacagagtgagactccatcttggaaaaagaaagaaaaaagaaaaacatgattgatctccatgcatcaatatcatgcctgcctcctaaggcagaggtaatgaagacttaattcccttctgtaggccttcccctcctccctaagccgttttctgagagaggtgcaggagcaggtgggttggggcaggctgcatacacagtgggggtgggttgtgctgctaarcagcagcaggtccacaatcccccctctgcatagctcctggggggaaaggatggaggagcgtgtgcacggctgcctgcctgttgaaggtggtggttctaattttataaacctcctctgcacagatgggtaggctagcacttgctgccactcctgagctgtgaagtcagcgattacctcactcagatagctggtcaggccctgcactgtaggtcctaataggccagtggacagattgaggaaaacaggagcttctgaagggcataacagagagcaaaaccactgaagctgagtggctgcagc

SEQ ID NO: 1538 - DNA, 601 bp, Human
tttctgagagaggtgcaggagcaggtgggttggggcaggctgcatacacagtgggggtgggttgtgctgctaagcagcagcaggtccacaatcccccctctgcatagctcctggggggaaaggatggaggagcgtgtgcacggctgcctgcctgttgaaggtggtggttctaattttataaacctcctctgcacagatgggtaggctagcacttgctgccactcctgagctgtgaagtcagcgattacctcactcagatagctggtcaggccctgcactgtaggtcctaataggccagtgracagattgaggaaaacaggagcttctgaagggcataacagagagcaaaaccactgaagctgagtggctgcagctgcagccagggaaagagccagtaggatgggggagaattccactgacctttatgtttacctagcctggtttctaggggtgtagattcctggctagggcccttattccttgtcttgactgtcttcatgacaccaatttggcatttcaggagagcggttaagaaaaggagttgtgtctgtccaaaagctggcaaggccagagctggattgtttggggtagagactggatg

SEQ ID NO: 1539 - DNA, 601 bp, Human
caggtagattacctgaggtcaggagttcaagaccagccggaccatatgaggaaaccctgtctctactaaaaatacaaaaattagctgggcgtggcagcgggtgcctgtaatcccagctactcgggaggctgagacaggagaattgattgaagctgggaggcggaggttgcagtgagctgagatcgcaccactgcactccagcctgagcaacagagcaagactccatcttgaaaaaaatcattcaagctgattgaaaaagtagtcatttcaatgaaaagtctcatttccgtctcagacttcyagtttccctccctagacccatatattactatagccctgcattagcaactgggatgcggtctgagaagcatggttttgttgttgtgagaacatcagtgtgtatttacataaacctagatggcatgggctcctacacacgtacaggctgtatggtatggccggttgctcctaggctacaaacctgtacagcatgtaactgtagtgaatactgtgggcagctgcaacacactggtaagtattggtgtctatctaaacagcaaaaagatacagtaaaaagacagcataaaggattaaaaaaata

SEQ ID NO: 1540 - DNA, 601 bp, Human
gcagtgagctgagatcgcaccactgcactccagcctgagcaacagagcaagactccatcttgaaaaaaatcattcaagctgattgaaaaagtagtcatttcaatgaaaagtctcatttccgtctcagacttccagtttccctccctagacccatatattactatagccctgcattagcaactgggatgcggtctgagaagcatggttttgttgttgtgagaacatcagtgtgtatttacataaacctagatggcatgggctcctacacacgtacaggctgtatggtatggccggttgctcytaggctacaaacctgtacagcatgtaactgtagtgaatactgtgggcagctgcaacacactggtaagtattggtgtctatctaaacagcaaaaagatacagtaaaaagacagcataaaggattaaaaaaatactacacctgtatagggcgcctgccatgaatggagcttgcaggactagaagttgctgtgggtgagtcagccagtgagtggagaatgaatatgagggcctaggacatgactgtacactaatgtaggctttgtaaacactgttcacttaggctaactacatttatttaaaa

SEQ ID NO: 1541 - DNA, 601 bp, Human
agcataaaggattaaaaaaatactacacctgtatagggcgcctgccatgaatggagcttgcaggactagaagttgctgtgggtgagtcagccagtgagtggagaatgaatatgagggcctaggacatgactgtacactaatgtaggctttgtaaacactgttcacttaggctaactacatttatttaaaatatttttctttaataaattaaccttagcttactgtaacttttttactttatttttactttattttttactttattaacttttttattttttgttccttttgtaataatacktagcttaaaacacaaacatgttgtactgctatccaaaaatatttcctttgtttatatccttaattctatagtcttttttctgtttgtaaatttttttatttttttaactttttaaacttttttgttgaaagctaagatgaaaatacattagctgttagcctaggcctacacagggtcaggatcctcagtatcactgtcttccacctccacgtcttgtcccactgtaaggtgttcaggggcaataacatgcatgggggccgtcatctcctatggtaacagtgctttctggaatacctgcct

SEQ ID NO: 1542 - DNA, 601 bp, Human
taaatttttttatttttttaactttttaaacttttttgttgaaagctaagatgaaaatacattagctgttagcctaggcctacacagggtcaggatcctcagtatcactgtcttccacctccacgtcttgtcccactgtaaggtgttcaggggcaataacatgcatgggggccgtcatctcctatggtaacagtgctttctggaatacctgcctgaggctttttttagttacttatttttctagaagtagaaggagtatacgctgaaataatgataaaaatatagtaaacacataaggagygtgtagcctagatccctcgcattcacagttcacagtcgagttcacactcctacaagaatctcatgctgctgctgatcccacaggaggcggagctcggaccagaatgctttcttgctcgccactcacctcttcctgtgtgcccaggttcctaacaggttacagagccctgcacttggtgataagaatttttcagctccatcataatcttacggggcccctgtcatatgtgtgatttatcattgaacaaaacactgttatgcagtacatgactataccagtttcttgagtccttctagaaat

SEQ ID NO: 1543 - DNA, 601 bp, Human
tttatttttttaactttttaaacttttttgttgaaagctaagatgaaaatacattagctgttagcctaggcctacacagggtcaggatcctcagtatcactgtcttccacctccacgtcttgtcccactgtaaggtgttcaggggcaataacatgcatgggggccgtcatctcctatggtaacagtgctttctggaatacctgcctgaggctttttttagttacttatttttctagaagtagaaggagtatacgctgaaataatgataaaaatatagtaaacacataaggagtgtgtagcytagatccctcgcattcacagttcacagtcgagttcacactcctacaagaatctcatgctgctgctgatcccacaggaggcggagctcggaccagaatgctttcttgctcgccactcacctcttcctgtgtgcccaggttcctaacaggttacagagccctgcacttggtgataagaatttttcagctccatcataatcttacggggcccctgtcatatgtgtgatttatcattgaacaaaacactgttatgcagtacatgactataccagtttcttgagtccttctagaaattgctgtgc

SEQ ID NO: 1544 - DNA, 601 bp, Human
tgagtgtgtagcagacatatagccatagcagtattgaaatgtgccattggaggtgaatgcagagtgctgtggggacacagaggacactgctgccactgtctgccagggagctgaggaaggttgcatagagaggggaaatgctaattgagtaactacgtttattaactatctcgtacaataatatactttagttgcttcttaatgtgaattatgctgggtctttttttcctttctgtctactgtggctggtgacgttaactaattttatgacttcttttctgttttttttttttttttttttggagatggagtctcactctgtcacccagggtggagtgcagtggcgcagtctcagctcactgcaacctccgcctcctgggttcaaacaattctcttgcctcagctcctcgagtagctgggattacaggcatctgccaccacatctgactatttttgtatttttagtagagacagagtttcaccatgttggccaggctggtcttcaactcctgacctcagatgatccacccgcctcagcctcccaaagtgctgggattacaggcatgaaccaccgcgacagccatgacttttaatatctaaa

SEQ ID NO: 1545 - DNA, 601 bp, Human
gtattgaaatgtgccattggaggtgaatgcagagtgctgtggggacacagaggacactgctgccactgtctgccagggagctgaggaaggttgcatagagaggggaaatgctaattgagtaactacgtttattaactatctcgtacaataatatactttagttgcttcttaatgtgaattatgctgggtctttttttcctttctgtctactgtggctggtgacgttaactaattttatgacttcttttctgttttttttttttttttttttggagatggagtctcactctgtcacccaggstggagtgcagtggcgcagtctcagctcactgcaacctccgcctcctgggttcaaacaattctcttgcctcagctcctcgagtagctgggattacaggcatctgccaccacatctgactatttttgtatttttagtagagacagagtttcaccatgttggccaggctggtcttcaactcctgacctcagatgatccacccgcctcagcctcccaaagtgctgggattacaggcatgaaccaccgcgacagccatgacttttaatatctaaatgctggagaccactcagagctcccgattcc

SEQ ID NO: 1546 - DNA, 601 bp, Human
ccacctccagcgtcagcactctaatccaagccactgtctcatctagactgtcacaatagcctcctaactgatctttctactttatttactcaacacttatttatggagtatcttctattttttttagaacaggaaccaaacattaaccaatagtcacctaaagaaatgtaagatctcatatttgataagtattccaaagggctggagttgcagcgagaatcaattatagcacagtttgacttaggaaggagagggggaagggcttccccaagaagtactgcctgagctgagactttaaggwtgatgaagagagaaagactgagggttctaggcgaaggacactgttaaatcctgtggtgggagaagcgcagagctggcaaagaggctgagaggaggcacttatggcaatagccccatttggctagtggctaccatattggatagcacagctctaaaggattctagttgcataattaacaaactttatcatatatgtaaatatatcagtataaaactttgcacgtaagagttcatattcttttcaaacacatggggcagtcatgaaattctcctggatccctgaggtaaagatactacacaa

SEQ ID NO: 1547 - DNA, 601 bp, Human
taaggatgatgaagagagaaagactgagggttctaggcgaaggacactgttaaatcctgtggtgggagaagcgcagagctggcaaagaggctgagaggaggcacttatggcaatagccccatttggctagtggctaccatattggatagcacagctctaaaggattctagttgcataattaacaaactttatcatatatgtaaatatatcagtataaaactttgcacgtaagagttcatattcttttcaaacacatggggcagtcatgaaattctcctggatccctgaggtaaagatactrcacaatctgtccctcctgaccgccttcaccatcttcttttcatgccactgtccctctcattctgaacttaagcccactggcctgcacgggcctgccagcatggacaaagaaaagagtgaaggcatttagttgcttcggatcatcaaggaacagtgagaaactccatgtggttgaacataaacgttgattccttttactgcctgagctgctaagtcttgaaactgaagcctctgttatatgcagttagagtatccaaagctgggttctcagccagtggattaggatctggttgaaagctag

SEQ ID NO: 1548 - DNA, 601 bp, Human
ctggatccctgaggtaaagatactacacaatctgtccctcctgaccgccttcaccatcttcttttcatgccactgtccctctcattctgaacttaagcccactggcctgcacgggcctgccagcatggacaaagaaaagagtgaaggcatttagttgcttcggatcatcaaggaacagtgagaaactccatgtggttgaacataaacgttgattccttttactgcctgagctgctaagtcttgaaactgaagcctctgttatatgcagttagagtatccaaagctgggttctcagccagtrgattaggatctggttgaaagctaggattcttgatgccttgtctggtacatttccaagctgttttgctccaccatgctcttccctctgtgtttggaaattaccagccggagcggtagaagccacctccctgctccacttgggcactttattgtcagcgcagctcatgcgcccaagatccattccttaccccagagttagcttaagcctgccaggagtcaaaaaaacaactcccagcaaaacctgggtccctggcctaaggccgaccttgacctaatgacctctccaggtcaagtccccttg

SEQ ID NO: 1549 - DNA, 601 bp, Human
gccggagcggtagaagccacctccctgctccacttgggcactttattgtcagcgcagctcatgcgcccaagatccattccttaccccagagttagcttaagcctgccaggagtcaaaaaaacaactcccagcaaaacctgggtccctggcctaaggccgaccttgacctaatgacctctccaggtcaagtccccttgagctaataggaagtaaatgagggaatggagttgggcgctttaaaaatcagacagtgtatgaagtaacagtgacttgtggggagaaaggtagtcccttctgattctgcttaagaagagagtccaagttggtgctagcatttcgttaagccttcctcatacttcataatcttcctttatagtaaggacaggctcagagcctttgcaggtaacagtatctagtcagaattttataacatgattttatcatattctgttttacagccaccttcaatatgtggcaagtgatactggttttccatttacagtagtgaaacaaagtttcctatttcagtgtgtttacatttttatctcttttttcatacctagtattacggatatttacatttttagagtctgtttgttta

SEQ ID NO: 1550 - DNA, 601 bp, Human
agccaccttcaatatgtggcaagtgatactggttttccatttacagtagtgaaacaaagtttcctatttcagtgtgtttacatttttatctcttttttcatacctagtattacggatatttacatttttagagtctgtttgtttattttagagatggggatcttgctgtctcgcgcaggctggagtgcagtgatatggtcatagctcactgcagccttgacctccagggctcaagtgatcctctcaccccagcctcccaagtagctgagactataggcacagaccaccgtgcccagctaawttttttttttttttttaagagacaggggtctcgctatgttgcctgggggattactatgttgcccaggctggtcttgaactcctggcctcaagtgatctcccaccttagctcctcaagttgctgggattacaggtgtgagccacaatggctggctctaagaagtcaatttagagaaaaatattaattaatagtccaagtaatacctggatgtggcacaaatcatgtggtgattcatgaatgaccaaaatctaggaaatgctgccttagaaacagcttctgtttgacgggtccatatgtttg

SEQ ID NO: 1551 - DNA, 601 bp, Human
aggctctgagacatgccgcctcccatggcgcctgaaagcgggtgcctctcatcctcccctggagtccatgcatgtaagtccaaggcagggagaagagacttcattttagctacagtcaattcagagtgaggaatgagttcttagttcctagaggagagaatatgggagtctaggatctgagaaactgaggctgtttctgccttgaagctttcagaacaaatagccttcatcctgttttccatcggtttccttccattattctatttctgttttaaacaccttcctagggaatcgctgtgtraaaggagattctctcagcctaaaaggagaaactgtcaatgactgccatgcagaaataatctcccggagaggcttcatcaggtgagcgaggtcagagctgtggcccggctgcccggctgtggagagctccagttccctgccccacatggctctgacacggcctctgaatccccctcagacagacgggtcatgatgtggcagtggcagcctttgcttttcacccgtccatttgaacctgtctgatggaatccatcccctctgtgacctgagctgcctcccactgctcggcctgtttttaaat

SEQ ID NO: 1552 - DNA, 601 bp, Human
ccacaggtgagttttaacagccacccctgtttttcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggtgagtgatacatgcccccgcctcctttcctcaaaaggctctgcaaggtccagggaccccaagtctctacaaggctgctaggattttaccattagtcactgggcacagaggtgctgtttacaggaaaggraagacctgggtcagggagctgtgtggtaagatcagggttctattttgaatgtgttagtttgggagatctgggagatccccaagtcaaataggaggtgggggttcccatgtggagctcagaggagggagcttggctggaaatagaaatatgggagtcatccccctatagggtcttcatggccatgagaatgcataggattacctcaagaaagcggggaggaaatgaagagtgcggcacaaccaagccctgaggagttgacagatgaggatgccaaatgctggggtcccctcctgtctagct

SEQ ID NO: 1553 - DNA, 601 bp, Human
gttagtatgtctagagggtgctcagtcttagccaaacagaaccctaaatacaggggaaagatcatgaccccacacttcctctctcctatgagtcttgagtccctgcttcagaatcttattcctgaaaggtttccatctttctcccgttgcttctgggattcctaggttggcagagtcagcatatatgattccaaaaggcaatccgggaagactaaggagacaagcgtcaactggtgtctggctgatggctatgacctggagatcctggacggtaccagaggcactgtggatgggtaaggaracaggagagcgcagtgaggaccaagcctctgccctgacttgcaagggtgcatcatacctctgcagtctcagggcttgagagccgcctcccctcccacggtgtctccactgtgagctccttatcttacaggtcccaggtgaataatgagtgcttttgtttctctaggccacggaatgaattgtcccgggtctccaaaaagaacatttttcttctatttaagaagctctgctccttccgttaccgcagggatctactgagactctcctatggtgaggccaagaaagctgcccgtgactacga

SEQ ID NO: 1554 - DNA, 601 bp, Human
gtcatgactccaagagcagagcagggaagagcccaagcatagacttggtgccgtggtgaaggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctrtgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgttt

SEQ ID NO: 1555 - DNA, 601 bp, Human
gccagaagctgtggctgcagccagggcagacccattgccagccagagtcagcccaagactaagctatggctgtcacccgtccatgccagcttggagaggtggcccgaagtgcactccaggcatgcacgtgctgagcctcttgtgaggacctgagaagcacgtgccttgctcctaggagcccacccacctcctttcctcctccatcccctctgcctccgtgagctcaagtttctcagacaccctcagggtgtccagtgtgatgcctgacaccctcaccctttccccagacaatgcccaagastaccagtggatcggcctgaacgacaggaccatcgaaggggacttccgctggtcagatggacaccccatggtgagttctgctgtaggcacagctggtggcccaggggacagggagtgggatagagacccctggagagagatgcattcaaaccccatgcagacagccgcttaccagctgctggaccgggaacccttgagggcagggattatctccttcatctctgcctctggaacccagcccggggctggacagattgagctaatgatggcaagaggcaaggagccaggaaggaaatgaagg

SEQ ID NO: 1556 - DNA, 601 bp, Human
agatatgacgggaggtgggtcgggaaatcgagagcgttctcctgtcttgactccccatcccttccctctcaccacccactccaccccaggtgataaagcctgaaaggtagagatccaacagcgctagcggttgaaacggtttttaaaatagagaaagcgagaggaccgacggcggctccagtgactgctgagtttccagacaagggagctctgtgcaatgaggggcgcacaggagcatgccctcaattccaaggagatcgggtagcggcaacatttattgagcgcttactgtgtgccaccractgccctaaagccccccacccccgtggcctccgcgcgctttgagcccaatgcgcgggcccttggcaaagagaatcggccagaggccgacgggggcgcatgtcctccccggtatttgactgactcggagccaggggcgcagcccaccccgcccggctctggggagctcaccttgccccgtgcgggccacagtcgcttcccgagcgccgcctccccgtgctggccgaccagccacagctgcacctggttgttggaaccggcatagagcgaggccccagtggacacgcggatgcggtagaga

SEQ ID NO: 1557 - DNA, 601 bp, Human
gagaggaaggaggcgcgggtgacaccgggggaggcaggaggagagggctgggaggtggggagaggggaggacctcatccgggcatgttgctttgacgttccctgagacagacatccggatttggggatctgggagagagctagagcagtgatgggaatttgggctttcgcggaagaaaaaaagttaacaggaccgggtagaacacccggtagatgtgacatgagatatgacgggaggtgggtcgggaaatcgagagcgttctcctgtcttgactccccatcccttccctctcaccacccaytccaccccaggtgataaagcctgaaaggtagagatccaacagcgctagcggttgaaacggtttttaaaatagagaaagcgagaggaccgacggcggctccagtgactgctgagtttccagacaagggagctctgtgcaatgaggggcgcacaggagcatgccctcaattccaaggagatcgggtagcggcaacatttattgagcgcttactgtgtgccaccgactgccctaaagccccccacccccgtggcctccgcgcgctttgagcccaatgcgcgggcccttggcaaagagaatcgg

SEQ ID NO: 1558 - DNA, 601 bp, Human
gggcgggacggatattgggcagggacgcgggagatgctcagggtctagaactgactgcgccggattcttgtttagagggaggtgaagagaggaaggaggcgcgggtgacaccgggggaggcaggaggagagggctgggaggtggggagaggggaggacctcatccgggcatgttgctttgacgttccctgagacagacatccggatttggggatctgggagagagctagagcagtgatgggaatttgggctttcgcggaagaaaaaaagttaacaggaccgggtagaacacccggtagatrtgacatgagatatgacgggaggtgggtcgggaaatcgagagcgttctcctgtcttgactccccatcccttccctctcaccacccactccaccccaggtgataaagcctgaaaggtagagatccaacagcgctagcggttgaaacggtttttaaaatagagaaagcgagaggaccgacggcggctccagtgactgctgagtttccagacaagggagctctgtgcaatgaggggcgcacaggagcatgccctcaattccaaggagatcgggtagcggcaacatttattgagcgcttactgtg

SEQ ID NO: 1559 - DNA, 601 bp, Human
cacagtgcggcctagaaggacagaggaggacttggccagtgacttttggtgagcgcctcttcttgtctctgccaggagagcctcagcaccccgtccttctgtgtggcctctgccccttcagcatcacgcccctcccccaggctccagccactttgtgccagctgcagccaccgccccttcgacacccccaaagaccccggcgctccaggttccagcacccccatcctgcgccctcttctccacacgcgcatccccccagcttctcacacagcccagaggcctcctgacaccctcagccccrcgcttaccggtgccttcaggcaggctcaggacgccgttgccctccacccagcggtaacaagggaacctgacctcgtccccggctccggggccctgcacagagatccagttgcagaaccaggcgtcgtccttaaggaggtgccgtttgcgcagtttcacaaacagcagcggccccagatactccggtacttccaccttgagttctgtctcctgcgggcgacagaagaggctcagccccggtggggcctggcgggaggggcacccggctgagccctgctccctccagcgcccacgcccttcc

SEQ ID NO: 1560 - DNA, 601 bp, Human
ggtgtgagtcactgtgctcagccttataatttttatacctagttgaatgagcctcaattttacagaagaggaaacagataatcagagaggttgggtattttgcctgaggtcacacagcttacaaatagcagaaccaggattcacatccaagcctatctgcccttaatcccatgaatttcctctctgttgttccatatcgcctcctgatgaacagccacagcactctgatcctgactctcttactctgcacactccccgaatccctagcaccaggggccagtcacatttcttcatttgaccytgtttctatcaaccattccaccttgcacgccctccctccgcagctactctcgtgtaggaaggaggccgagcagctgaacttctccagggtccctcaggacctctcctgcagaatccgtccttgctggctggcagcaagccaggcccacagtgggtcccgcagcagcatcattggcactaggccaccccacttcactgctgagcttcctcagggctctgatgtccatacctccagctccttctccagctgggcctgcagttcctccatgcctggagggaacactaggcgagcaggaaggtg

SEQ ID NO: 1561 - DNA, 601 bp, Human
taggctggtctccaactcctgggctcaggtgatcctcctgcagcctcccaaagtgctgggattacaggtgtgagtcactgtgctcagccttataatttttatacctagttgaatgagcctcaattttacagaagaggaaacagataatcagagaggttgggtattttgcctgaggtcacacagcttacaaatagcagaaccaggattcacatccaagcctatctgcccttaatcccatgaatttcctctctgttgttccatatcgcctcctgatgaacagccacagcactctgatcctgaytctcttactctgcacactccccgaatccctagcaccaggggccagtcacatttcttcatttgaccctgtttctatcaaccattccaccttgcacgccctccctccgcagctactctcgtgtaggaaggaggccgagcagctgaacttctccagggtccctcaggacctctcctgcagaatccgtccttgctggctggcagcaagccaggcccacagtgggtcccgcagcagcatcattggcactaggccaccccacttcactgctgagcttcctcagggctctgatgtccatacctccag

SEQ ID NO: 1562 - DNA, 601 bp, Human
tggagtgcgtggcaggatcaccacggctcactgcagccttgacttccttgggcccaggtgatcctcccacctcagcctcccaagtagctgggactacaggtgcatgccactacaccaaagattacaggtgataatttttgtacttttgtagagacagggtttcaccacgttgcctaggctggtctccaactcctgggctcaggtgatcctcctgcagcctcccaaagtgctgggattacaggtgtgagtcactgtgctcagccttataatttttatacctagttgaatgagcctcaatttyacagaagaggaaacagataatcagagaggttgggtattttgcctgaggtcacacagcttacaaatagcagaaccaggattcacatccaagcctatctgcccttaatcccatgaatttcctctctgttgttccatatcgcctcctgatgaacagccacagcactctgatcctgactctcttactctgcacactccccgaatccctagcaccaggggccagtcacatttcttcatttgaccctgtttctatcaaccattccaccttgcacgccctccctccgcagctactctcgtgtaggaa

SEQ ID NO: 1563 - DNA, 601 bp, Human
ctggagtgcgtggcaggatcaccacggctcactgcagccttgacttccttgggcccaggtgatcctcccacctcagcctcccaagtagctgggactacaggtgcatgccactacaccaaagattacaggtgataatttttgtacttttgtagagacagggtttcaccacgttgcctaggctggtctccaactcctgggctcaggtgatcctcctgcagcctcccaaagtgctgggattacaggtgtgagtcactgtgctcagccttataatttttatacctagttgaatgagcctcaattktacagaagaggaaacagataatcagagaggttgggtattttgcctgaggtcacacagcttacaaatagcagaaccaggattcacatccaagcctatctgcccttaatcccatgaatttcctctctgttgttccatatcgcctcctgatgaacagccacagcactctgatcctgactctcttactctgcacactccccgaatccctagcaccaggggccagtcacatttcttcatttgaccctgtttctatcaaccattccaccttgcacgccctccctccgcagctactctcgtgtagga

SEQ ID NO: 1564 - DNA, 601 bp, Human
atcatttttttttttaatcagggtcttaccgtgctgcccaggctggagtgcgtggcaggatcaccacggctcactgcagccttgacttccttgggcccaggtgatcctcccacctcagcctcccaagtagctgggactacaggtgcatgccactacaccaaagattacaggtgataatttttgtacttttgtagagacagggtttcaccacgttgcctaggctggtctccaactcctgggctcaggtgatcctcctgcagcctcccaaagtgctgggattacaggtgtgagtcactgtgcycagccttataatttttatacctagttgaatgagcctcaattttacagaagaggaaacagataatcagagaggttgggtattttgcctgaggtcacacagcttacaaatagcagaaccaggattcacatccaagcctatctgcccttaatcccatgaatttcctctctgttgttccatatcgcctcctgatgaacagccacagcactctgatcctgactctcttactctgcacactccccgaatccctagcaccaggggccagtcacatttcttcatttgaccctgtttctatcaaccatt

SEQ ID NO: 1565 - DNA, 601 bp, Human
ataatttaagtgtcttcccgttacctcaacattggccagacaaaaatccacctgggcaccctgttctctttatcggtgctatttctgcaggcaactggcctggctcccctttcccctctccttgatctccctctgcactcgcatccacctgtcctctccatcctgatggtcactacccacatccgagctcccctcctcctggggtcagtgctggggcatgttgccccagtccctatttctagcatctcccctctccaacccaccctaaacaccactgcccacaccgcgtgcccacagcacrtttcatcacggccttctccagcttcccacctcatactccttagcctggcttagtctggcttctggtccaactgtcccctaggaattgcctgactcctctacctcagcctctgcccagtctgtcttgcccctgaggaccggtccttcctctccctcctgcttgtctgagacctggccctcctccaaagctcgtgacaccccacctccccaatccctcctgggctgtctctgtcctcagggacttcctcagtcctggagcttctgcagactggcccagtctgtctctccagctacactgcaa

SEQ ID NO: 1566 - DNA, 601 bp, Human
caatgacctcagccatcaagtgtcccctcagaagatgagactgcagctcatggagctggaagtcagagctgcgcacccagcatttggccagaagccaggccattgggggatccgtaggcaagaaaaggggaggtggtggggatcctgtgcggggcagctggagctggagcagggacaagtgtggggagagaaggcatgagtgccaggcactcagcgattcccgccccccttgcatgttaacctcacccttcgtcctccaaacctgttctgctttccccatctcactcctgccgctccctayggctcccgtttcctcccctccccttcctgcccgctcagtgcattagcaccctgcaagctgctttgcctccagcattctgcagaaactgctcttctggtgcctcctccagcctccacttcccctttcagttcccacagtgtggacaagattcaaaccacctgcttcctccatcccacactgttttttgaaaactcatcttttggccccacctctacacaaatgactgaatctcttgttctcagctgcctgctggataatttaagtgtcttcccgttacctcaacattggccagacaaaaat

SEQ ID NO: 1567 - DNA, 601 bp, Human
tggccacaacaatgacctcagccatcaagtgtcccctcagaagatgagactgcagctcatggagctggaagtcagagctgcgcacccagcatttggccagaagccaggccattgggggatccgtaggcaagaaaaggggaggtggtggggatcctgtgcggggcagctggagctggagcagggacaagtgtggggagagaaggcatgagtgccaggcactcagcgattcccgccccccttgcatgttaacctcacccttcgtcctccaaacctgttctgctttccccatctcactcctgcygctccctacggctcccgtttcctcccctccccttcctgcccgctcagtgcattagcaccctgcaagctgctttgcctccagcattctgcagaaactgctcttctggtgcctcctccagcctccacttcccctttcagttcccacagtgtggacaagattcaaaccacctgcttcctccatcccacactgttttttgaaaactcatcttttggccccacctctacacaaatgactgaatctcttgttctcagctgcctgctggataatttaagtgtcttcccgttacctcaacattggcca

SEQ ID NO: 1568 - DNA, 601 bp, Human
tttctattaaaaatacaaaaaaaattagccaggcctggtggtgcgcgactgtaatcccagctactggggaggctgaagtgggagaattgcttaaacccaggaggcagaggttgcagtgagccgagatcgcatcactgcactccagtctgggcaaagggagactccatctcaaaaaaaaaaaaaaaatcaatgtctggaaaagatctttttaacgttatttcacgggttcctcttgttggatggaatccttggtcatttgcatgtactgtgctttacatataaaaagagtaagattattttygccactttcccaggtgggaggtgctatcccctttgaaaatgcatggccagccctgctcattctctgttgctctcacattgtccattcattgtttctctctgtaccccgagaccccacagagagggagcctccagaggtcggaacgtgccctggggcagagatagtggcaggcaagagagaaggggataaggagttaccttgaagataggatgtatcgacggcaggcacctcatggtggccacaacaatgacctcagccatcaagtgtcccctcagaagatgagactgcagctcatggagc

SEQ ID NO: 1569 - DNA, 601 bp, Human
ttggaccaggcacagtgactcacgcctgtaatcccagcactttgggagacctagacaagcagatcatctgaggtcaggcattcgagaccagcctggccaacatggtgaaatcctgtttctattaaaaatacaaaaaaaattagccaggcctggtggtgcgcgactgtaatcccagctactggggaggctgaagtgggagaattgcttaaacccaggaggcagaggttgcagtgagccgagatcgcatcactgcactccagtctgggcaaagggagactccatctcaaaaaaaaaaaaaaaatcaatgtctggaaaagatctttttaacgttatttcacgggttcctcttgttggatggaatccttggtcatttgcatgtactgtgctttacatataaaaagagtaagattattttcgccactttcccaggtgggaggtgctatcccctttgaaaatgcatggccagccctgctcattctctgttgctctcacattgtccattcattgtttctctctgtaccccgagaccccacagagagggagcctccagaggtcggaacgtgccctggggcagagatagtggcaggcaagagagaagggg

SEQ ID NO: 1570 - DNA, 601 bp, Human
gaaggagtgaggggatccaaaaactacctatggggtaccatgcttattacctggtgacaaaataatctgtacaccaagccccatgacacacaatttacttacagaacaaacctgcccatgtatccttgaacctaaaattaaagttaaaaataaatacataaaaataaaaccactgagctttcagttgatttgcatcaactatttccattccacaaaccagacttagtgctttatgataattgaaagaaatcattctttgttgttgttgttttgttttgagatggagtcttgctctgtttcscaggctgaagtacagtggtgtgatctcggctcactgcaacctccgtcttctgggttcacgcgattctcctgcctcagcctcccgagtagctgggattacaggcgtgaaccaccgtgcctggcctccttttcttttcatattttttcataggtctagaccaagatttctcaacttttttttttttaatcacccactaagtacccttttgagatgttttttcctaatctcactccacctcattaaatattaatgctacatatatactgtatatctgtctatgtattgcattatatctgtgct

SEQ ID NO: 1571 - DNA, 601 bp, Human
cccccagtctgggatgccacacgtccccacagctgcctccttccttagggccctgggcactcagctctcaccataacgggctggcgtctgcccagctgccaagtgatggacatctggagagaagcctggtggaagttgggcagtgtcgccatcactgtctccagcgttgcatccttggtggttggcgggggcagccgcatcgtgcagggtgcattaggcacccaagagtaccagtccagctaaggaagggcagggatccagagtcagtgcctgccaagcacgcgagccccgtggtccaccygcacacagacccctccctcactccaggccccaaattcccagctgcccatctctggtaagtacctggcccaggtgcacagaggcgtgttggccggtgcaggtgaagatacacatggtgacaaagtggcaaacctggtcccgagcctgtaaagagacaggaaaccctgcaaggggtgaagagagttagaagctgcgaaggcaggagtagggcagcgctcagaggaagaggccaagagaggagaacaagggcgagaaagagcggcaggaatgctcagttaactcttacaggaattaccatgac

SEQ ID NO: 1572 - DNA, 601 bp, Human
gaggaaaaggtggctgagagccttatgacccccagtctgggatgccacacgtccccacagctgcctccttccttagggccctgggcactcagctctcaccataacgggctggcgtctgcccagctgccaagtgatggacatctggagagaagcctggtggaagttgggcagtgtcgccatcactgtctccagcgttgcatccttggtggttggcgggggcagccgcatcgtgcagggtgcattaggcacccaagagtaccagtccagctaaggaagggcagggatccagagtcagtgcctrccaagcacgcgagccccgtggtccacccgcacacagacccctccctcactccaggccccaaattcccagctgcccatctctggtaagtacctggcccaggtgcacagaggcgtgttggccggtgcaggtgaagatacacatggtgacaaagtggcaaacctggtcccgagcctgtaaagagacaggaaaccctgcaaggggtgaagagagttagaagctgcgaaggcaggagtagggcagcgctcagaggaagaggccaagagaggagaacaagggcgagaaagagcggcaggaatgctc

SEQ ID NO: 1573 - DNA, 601 bp, Human
tcagcacagccttaggctcagggcccgaaaaatactcctcctcatgctggcccacagccacctgggagggagaggaaaaggtggctgagagccttatgacccccagtctgggatgccacacgtccccacagctgcctccttccttagggccctgggcactcagctctcaccataacgggctggcgtctgcccagctgccaagtgatggacatctggagagaagcctggtggaagttgggcagtgtcgccatcactgtctccagcgttgcatccttggtggttggcgggggcagccgcatcrtgcagggtgcattaggcacccaagagtaccagtccagctaaggaagggcagggatccagagtcagtgcctgccaagcacgcgagccccgtggtccacccgcacacagacccctccctcactccaggccccaaattcccagctgcccatctctggtaagtacctggcccaggtgcacagaggcgtgttggccggtgcaggtgaagatacacatggtgacaaagtggcaaacctggtcccgagcctgtaaagagacaggaaaccctgcaaggggtgaagagagttagaagctgcgaaggcag

SEQ ID NO: 1574 - DNA, 601 bp, Human
ccactgtttcttgtatgcagtgaacatacaacaaaattgtggttactggattagaagctccctgagggcaaggactttgttttctttgttgccatatatgtagtctctgggatgtaagcatattcacatatttgaatgcattaatggggcggtaaccctgaagcttaaatatgcaaaacttctcacccctaggcgtaatggaaaactgtatcacctaatgagtgtcatttaaaaatatcacagtatcagtgatgccactgaccttgtggctttttttctctcttcccagatggcagatgakcagggctgtattgaagagcagggggttgaggattcagcaaatgaagattcagtggatgctaagccagaccggtcctcgtttgtaccgtccctcttcaggtaagtttgcttaatcagggaccctggaccacgtcagcctgccatgcctctgccatctccacccacccatggggagggggacattcagggaaggaggttcatgctgagcatgaggtttgcacaggttcttgctagctgtacgtagcaacactagtgtcctcatgtgcaccctgttgtctgtgggccaagcccaggaatggac

SEQ ID NO: 1575 - DNA, 601 bp, Human
tagtaaaatgaagagacgttactatacacacttcttccacagcccctgactctggaactttatatttcaccagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtgggtgtgtgggcatgggctcatctttccggttccctttcatcttctcctatttgtatcagacatttatgggagaaatgctgcacctacytactgtggcagacagcccctctgaaggcaaggttcctgtattcaggggaaagggttatgcggaaatcaagaatgttcagtctaaggccccaccacgtgtattagctgatgcggggctttgaccaaagggctaagaatccaggggaaccttggctttgatgggagctgaatgttaccaggaggctcacctgttgcgggcaggtggcactgttagcctcccctttgagtttgcttcagttcatttaaattgtggccttggaaggcattgtatatacttggagtgtttctgctgcagctggca

SEQ ID NO: 1576 - DNA, 601 bp, Human
aaaataaaagaaggggtggagcttcagagaggaagaaagatacactgaagggtgcagttagtaggggcagaaccgaaacccacgctctggtcttctaactccaggacaaatgcgtttcctattacacgaccctctctaatggatgccacctaaggtattctggcatttagggcaagtgtttgaaagtaacatcctatcaattcactagacacagacccacaggaagtagataggaacacaatctaaatcactgctatttttcttaacctcacagctaaaacaaaaaaagtccccaccatcttttttttttttaaaactaggcatttttcctaatttcctccaacttgactcttacaagctgaccttttgtaccctagtaggttatgtcctagaccagactagaaatcaggagtctgagatctgggtctggcccaagttctaacaggcaacccaggcaaggcaaccacatcatcctgatttttttgctttcctgaaaggcagattatgataccagctcctgctgtttcttggggatggagtgaggaagcctgtgagccaagaggaattttgtgagcgtgcttcgagaagtataatggcccag

SEQ ID NO: 1577 - DNA, 601 bp, Human
aggggtggagcttcagagaggaagaaagatacactgaagggtgcagttagtaggggcagaaccgaaacccacgctctggtcttctaactccaggacaaatgcgtttcctattacacgaccctctctaatggatgccacctaaggtattctggcatttagggcaagtgtttgaaagtaacatcctatcaattcactagacacagacccacaggaagtagataggaacacaatctaaatcactgctatttttcttaacctcacagctaaaacaaaaaaagtccccaccatctttttttttttwaaaactaggcatttttcctaatttcctccaacttgactcttacaagctgaccttttgtaccctagtaggttatgtcctagaccagactagaaatcaggagtctgagatctgggtctggcccaagttctaacaggcaacccaggcaaggcaaccacatcatcctgatttttttgctttcctgaaaggcagattatgataccagctcctgctgtttcttggggatggagtgaggaagcctgtgagccaagaggaattttgtgagcgtgcttcgagaagtataatggcccagataggcatatg

SEQ ID NO: 1578 - DNA, 601 bp, Human
taatgcaaagtgtcttggtaattcgaatgggagaggccactcttactctgcctggaactggtgaggtagctggactttgcagtgtcctgggcttgaaaaacggccccaaggctccaacgtgttctaccacctttggggaaggttatgagacctctccgagattccatttttttaaatcagtgaaataaagataaatgaggcctacttccagtcttgtaggaattaaaaataactcatgtaaagtacctagatcagtgtctgcacatagtatttgctcaagaaattctaaatattattcctycccccctcattaatcagagagaagaagaaaggatatgtgtattagctagttataggttggtgcaaaagtaattgcggtttttggcattaaaagtaatggttagttcacctatagctggttagttagtatcatagaacctttggtgagttctagctgggccaactagctacatggtttatgattcctctcctcagtatcctaaatggacagccaagctagtatttttatttatttttctttaattttgtttaattgtggtaaaatacacataacgtaaaattaccatcataaccattttta

SEQ ID NO: 1579 - DNA, 601 bp, Human
gtaattcgaatgggagaggccactcttactctgcctggaactggtgaggtagctggactttgcagtgtcctgggcttgaaaaacggccccaaggctccaacgtgttctaccacctttggggaaggttatgagacctctccgagattccatttttttaaatcagtgaaataaagataaatgaggcctacttccagtcttgtaggaattaaaaataactcatgtaaagtacctagatcagtgtctgcacatagtatttgctcaagaaattctaaatattattcctccccccctcattaatcakagagaagaagaaaggatatgtgtattagctagttataggttggtgcaaaagtaattgcggtttttggcattaaaagtaatggttagttcacctatagctggttagttagtatcatagaacctttggtgagttctagctgggccaactagctacatggtttatgattcctctcctcagtatcctaaatggacagccaagctagtatttttatttatttttctttaattttgtttaattgtggtaaaatacacataacgtaaaattaccatcataaccatttttaaatgtatagatcagaat

SEQ ID NO: 1580 - DNA, 601 bp, Human
tatgattcctctcctcagtatcctaaatggacagccaagctagtatttttatttatttttctttaattttgtttaattgtggtaaaatacacataacgtaaaattaccatcataaccatttttaaatgtatagatcagaatgacttcacatggttgtgtcaccatcaccaccatccatctcaggctttctttcatcttccgtaactgaaactttatctccattaaacactaactggctatttccccttccctccagcccctggcaaccaccgttctatattctgtgatcttgactactcarggtacctcctgaaagtggaatcatgcgatgcttgccctttagtgactggcttattgcacttagcgtaatattttattctctttaacaaacacttgcatgatgcttattatgtggcgtgttttacaaatattaactcatttaatgagttaatattgatcttcaatgtacagataaggaaatcaaggcacaaaatggttcagtaacattcctgatgtcacagaactagccaacagcagggccacacacatcagcccccatacactgtacctatccctctctcttaacgtcttagataagtct

SEQ ID NO: 1581 - DNA, 601 bp, Human
gttcgtattatttgcttgcagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggtaatctcttttcaatgccaatacacttgaaaatgggaaagattgcagagtgacggggatggcatcatttttacaaatccaaatgctgcttccatattcaaatyagggttttatttttctgggaaagattacagagtgacggggatggcatcatttttacaaatccaaatgctgcttccatattcaaattagggttttatttttctatctctgaatggttagcatatgtgtttccactggatcacaaattatgaaggtttctttttttttttctttgagatggaatcttgctctgtcacccaggctggagtgcagcggcgtgatctcggaagactgcaacctccacctcccaggttcaagcaatactcctgcctcagcctcctgagtagctgggattacaggca

SEQ ID NO: 1582 - DNA, 601 bp, Human
tatttggcacaagggtactggttacagtaaataggttgatgtgtttggaaaaccagctctggcaggatctacagatgagattttgtgagagcgataacttcacaagttttaaggatggcataagatcgaaaataatttggtctttctgctcttgagagggaggtggtgtaatgggggcatatgtctgtgtaaacaaacccagtggtagagttgtagttgctctgagcaaggaggcagttgagaaaagctatgttaaaaaggagctgctgggccgggcacggtggctcacgtctgtaatccsagcactttgggaggccagggcaggtggatctcaaggtcaggagattgagaccatcctggctaacacagtgaaaccccatctctactaaaaatacaaaaaaaaaaaaaaatagctgggcatggtggtgggcgcctgtaatcccagctactcgggaggctgaggcaggagaatggcgtgaacttgggaggcggagcttgcagtgagccaagatcgcaccactgcactccagcctgggcaacagagcaagactccgtctcaaaaaaaaaaaaaaaaaaaaaaggagctgctataactgagcct

SEQ ID NO: 1583 - DNA, 601 bp, Human
aacttcacaagttttaaggatggcataagatcgaaaataatttggtctttctgctcttgagagggaggtggtgtaatgggggcatatgtctgtgtaaacaaacccagtggtagagttgtagttgctctgagcaaggaggcagttgagaaaagctatgttaaaaaggagctgctgggccgggcacggtggctcacgtctgtaatccgagcactttgggaggccagggcaggtggatctcaaggtcaggagattgagaccatcctggctaacacagtgaaaccccatctctactaaaaatacaaaaaaaaaaaaaaatagctgggcatggtggtgggcgcctgtaatcccagctactcgggaggctgaggcaggagaatggcgtgaacttgggaggcggagcttgcagtgagccaagatcgcaccactgcactccagcctgggcaacagagcaagactccgtctcaaaaaaaaaaaaaaaaaaaaaaggagctgctataactgagcctaaaatttcaaacaacataggtaaaagaaggatggcttgtcagacggagtgctgaggggctggatagcccagtgcatttggtaaaactcggggctg

SEQ ID NO: 1584 - DNA, 601 bp, Human
ctcaaagcattttctagcatcttcatgccagccgttaaatctcagatgtttgctctctgagcacaccagcataattctcattaatgacttgtgtgcagagtagagtgaaatagtttctgaaaagcaggtgtgaaagtgccatatactcattctcattggtgagtggagcagctgtcagaattagctgatttggtcgtctcctttctttcctgttgaaggctattactcgtggaggagcccaggaagaggctcctggtttgtgcaagccctctgctccatcctggaggagcacggaaaagasctggaaatcatgcaaatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtct

SEQ ID NO: 1585 - DNA, 601 bp, Human
agcatcttcatgccagccgttaaatctcagatgtttgctctctgagcacaccagcataattctcattaatgacttgtgtgcagagtagagtgaaatagtttctgaaaagcaggtgtgaaagtgccatatactcattctcattggtgagtggagcagctgtcagaattagctgatttggtcgtctcctttctttcctgttgaaggctattactcgtggaggagcccaggaagaggctcctggtttgtgcaagccctctgctccatcctggaggagcacggaaaagagctggaaatcatgcaratcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaatt

SEQ ID NO: 1586 - DNA, 601 bp, Human
tcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacytctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagaggg

SEQ ID NO: 1587 - DNA, 601 bp, Human
aatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacctctggagaaagctcatggctgtgtccactgcaattggtggtaacagtggtagagtcatgtktgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagct

SEQ ID NO: 1588 - DNA, 601 bp, Human
cagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggtatgtaattaacaacccttcttactccagagtctcatgcttgaatcttttcctttgcttcatggcttcgtgttgtagaaacttgcaaaaayttgtcagcaatggcactattttttcttagatttctttgtcatgcctgggaaaacaaaagttaaaaaatccggaagcctccaacatagccttttaccggggcagaaatatgttagctcacagagacaaagtttggtagactcactaaaactagagatcagaattgtcaagaaaccacaaggcaaatgctagatgcggtagaatagaaaggtgtctccaataaaccactcatttgacctcagggctagtagcagggaagatcccctggattatcacattaaaaatgacatttttttgtttct

SEQ ID NO: 1589 - DNA, 601 bp, Human
tatacacacacacacacacatgcacacacacacatgacctaaaggttcagtaattcttggagaattttaaaaatcaggcgattttgttttagggaattcttttttataaaacattgtaaggatcttctgcttttgccgtaaaatttcagtgcccacatttgcagtggtacaaagcaattacctgctcaaatggtagcattataccttaaatacagaatttctcaaagtcagaggagattcctgtagtttgacaagcgctccaggtggttttcataacattctctcccaagttggggcatcygctcacaaattttccagtgtctaggtttatacataaaatgagaccactttttattgttataccccgtcctatgttagggactctctgaacaatatgaggtggcgggtgagggacgagagaaaggtcatttgttaaagcaatctctgatattcgaaacactgagtgttagttttcaaacaagaaaagctggaaaatgtttttttttctcttttgcttgcacaggttctagaactctacttgaaggcatctgtggctacagaattattattattattattattattatttttagacagagtt

SEQ ID NO: 1590 - DNA, 601 bp, Human
gatagcatggggtaagagtggactctatagagtcggattgccaggactccacttactagtggtgcagtggtacttttttggcttttctatgtgtcactttccctatctgtaaagtgggcataataattgtacctacctcctaggtttttgtgaggattgaatgagataatttctgtaaaatgcatgtctggcatggagtaagccttctatacatgtggctattatggctctctcagagagaaaagtcataaagacttcacattctcagaaactactatcaaaaaagaactttattttcttggtgtgtgtgtgtgtgtgtgtgtgtgtgttttaagtctgtctgataaaggtagttctgctgtgatattttatacagatagaagcacagggcaaaagtcaaacctggctgccttaccacgtgtcagtacgctaaatatctgtgtttttctgagttcatttctccactgttaagcaagcgctatacataaaaactcatgagtgtattcatgaaacttttatgccacacccttaatttagttcagtgagtgactctagtgtgcaaatttcttggttgaaaatgaaactagctaagaggaaatgt

SEQ ID NO: 1591 - DNA, 601 bp, Human
acctctgcctcccaggctcaagccattctcgtgcctcagcctcccgagtagcagggattacaggcgtgagccaccacacctggctattttttgtattttcagtagagatggggttttgccatctggccagactgttctcaaactcctgacctcaagtgatccgcctgcttcggccttccaaagtgctgagattataggtgtgagccactgtgcccggccttgtttcagttcttcattttgttttgcatcattttattatttcccctttctctctctctctctcttttttttttttttttgkttttaaacagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaa

SEQ ID NO: 1592 - DNA, 601 bp, Human
aggaaggcagctggtatattcagtctctgtgtaatcatctgaagaaattggtcccaaggtgagagctcttttttttcttccatttgtaattaattagttttatttattttttattttactctcattcaacacctttggtaagggtgagagttctacgttgttctatccatgtacctgttcaaccatctgcctaccctcctgtttatctatttatccatctatccacccattcatctatccatccatctatccacccattcatctatccatccatccatctgtccatccatccatccatccrgcaaccttgtattgagtaccagcctggacctggaaaggaagatacagagttaaaaaaagacagagtccttgccctcaggttgcttacaagctagagggatagacaaacaaatagacggggaagggcatccccagctggtaagtgcacattgtgaagtataggtgttatgggaacatgcagaatgagtaccttgcccagatttgaaggatcagaggaggcttctagaaatgacaaatagatgttaggtaaagaatcaggtgaaagatgtgctgggcagagggaatagcatgaacaaaagca

SEQ ID NO: 1593 - DNA, 601 bp, Human
cagtctctgtgtaatcatctgaagaaattggtcccaaggtgagagctcttttttttcttccatttgtaattaattagttttatttattttttattttactctcattcaacacctttggtaagggtgagagttctacgttgttctatccatgtacctgttcaaccatctgcctaccctcctgtttatctatttatccatctatccacccattcatctatccatccatctatccacccattcatctatccatccatccatctgtccatccatccatccatccagcaaccttgtattgagtacsagcctggacctggaaaggaagatacagagttaaaaaaagacagagtccttgccctcaggttgcttacaagctagagggatagacaaacaaatagacggggaagggcatccccagctggtaagtgcacattgtgaagtataggtgttatgggaacatgcagaatgagtaccttgcccagatttgaaggatcagaggaggcttctagaaatgacaaatagatgttaggtaaagaatcaggtgaaagatgtgctgggcagagggaatagcatgaacaaaagcatgggggccttttatttgttc

SEQ ID NO: 1594 - DNA, 601 bp, Human
gtactgggtaccgaactggggacagggggtgcaactgtgtacaagagagacaaaatctgctctccagggagctaaaagtccagtgaaggaaggacagataataaaaatataagtgaatatttaaattattattattttaaaaattcaacaatattaaaaggagacagtatacatgcatgattaagcaatgtgtggttttttttggtactccagaaatttctgttatttttaattgatacttcataactacatatttcagggttataatttgatgtttcaatacatatatgtgttgtataaygatcaaatcagggtagttagtgtatccatcacctcatgcatttatcatttctttgtggtgagaacctctaaaagcctctcttgtagctattttgtaatatacaacaccttactgattgatcgattgatttaaatatgggatctcaccatgttgccgaggctggccttgaactcctaggctcaagcaatcttcctgccttagccttgtaagtagctaggattatatgctcaaaccacagtgcccagctcagaatgccttactgttaaccatagtcaccccactgtgcagcagaacaccaga

SEQ ID NO: 1595 - DNA, 601 bp, Human
tgctgtgttagcatctgcttggccatgtcatcagccaattagtagaaaagatataattcctacaccctctcatctgataaagagttggaaaatgttgttggcagtaactagaattaatattgtggtgaggaaaataagtaggtatttgaaaaactgattaatgttcagatctgccttcatatatcatattgagaattctataatagatcaagtgataaatagtgctactagaataaacattatggagaattagtctagtttgaagcttaatgagagttttagggtttggattgttattcartatcagtttgagatgatggtttcttggtctgtacacataaatgttgtgggaatgaggctaatggtgaaagtgcatgcgacagctatttttacatagtatggatatgagttctttttgtgagggttgataaaggtaataataattggtaaggttaaggagattaaggttattatagtaatggaaaaatacatgattattacttttatttggagttgcaccaatatttttggttcctaagaccaatggataactctcatcctctaaaagttgagaaaactatgttgttaggcatggaggcat

SEQ ID NO: 1596 - DNA, 601 bp, Human
aaaaatagtgatagttaaggatgaggggatgagagtagtcatactaatactaaaaatgatggtcagcagaacagtgtagccagtgttctaagtgcttgacccaatatacatcctttaatgctctcggcaacccctaagatggggactgttatggttcctattttagagctgggaaaaccgaggcatggagcagtgagtaaccagcctaagagcacacaatgaatgaatgatggagccacaatttaaaattgaatgtgttttcagaacctgtgcttgcttccagtgatatgtattgcctacyctgagaacgttctgctaaatgctatatgtcctgcaagcccaggctcaaatgctaccatctgcatgaagccttctctctccctcccaaccagaaatgcattctcctctgaacttgcagtggaaccttgacctttcatttggtgttgaccacattctgccttgtgttatgaatattgtgtatatgccatcctcggtaaatgtttcatatctgcattctaagtggttaacttcaggaattgtgtcatgtctatctttgtatctctcccaagactacagatagagagggcattgttggtatctg

SEQ ID NO: 1597 - DNA, 601 bp, Human
gtaatcccagctactcgggaggctgaggcatgagaatcacttgaatccaggaggtggaggctgcagtgagctgagatcacaccactgcactccagcctgggcgacagagtgagactccgtaaaaaaaaattttgttttcttctttgttgcagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcawtatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttc

SEQ ID NO: 1598 - DNA, 601 bp, Human
cccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctrtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtacttttt

SEQ ID NO: 1599 - DNA, 601 bp, Human
tgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccrcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgaga

SEQ ID NO: 1600 - DNA, 601 bp, Human
tgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttsatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttga

SEQ ID NO: 1601 - DNA, 601 bp, Human
ggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaa

SEQ ID NO: 1602 - DNA, 601 bp, Human
ccctggggagatgaacagtttatgggacacaataaagggttaggagaccagagttctggttggctctgaccagggctggtgatcagagggctggagaaaccaggggtttctccaggcaccagaggggctcagagccaaccaagcatatctccgggattttcagaagcctacacttgactcactttttgtttaaatgtatttttgtagttcctcattctggaggctgggaatcccccaagtacctggctccttcatcccagcccctctggcctccccctactttagagggctgtagattcckgcctgaagcctgggcaggaatgacccatggtatcaaggaaagcaagggaagcagcaagggaagagagggagtggggaggctgctttggtcccacagctttcactttcacctgaagcaatggctcttagggaacagggaggcagggggagggcggagctggaaagaggtaaaggggggcccttgtggtaggagtggagaaagagccagaggaggtggggtgaagggtgtgatccaggcttctcaagagcagagtttgccctcataactcccaactttggctccaggtagaggctgggctgt

SEQ ID NO: 1603 - DNA, 601 bp, Human
gggattttcagaagcctacacttgactcactttttgtttaaatgtatttttgtagttcctcattctggaggctgggaatcccccaagtacctggctccttcatcccagcccctctggcctccccctactttagagggctgtagattccggcctgaagcctgggcaggaatgacccatggtatcaaggaaagcaagggaagcagcaagggaagagagggagtggggaggctgctttggtcccacagctttcactttcacctgaagcaatggctcttagggaacagggaggcagggggagggyggagctggaaagaggtaaaggggggcccttgtggtaggagtggagaaagagccagaggaggtggggtgaagggtgtgatccaggcttctcaagagcagagtttgccctcataactcccaactttggctccaggtagaggctgggctgtgacaacaatgtcagaagctatctattgagggcttcttgtgtgtcaggctctgagccaaacactgcctgttttctttgtctgatttctcacaactcccccattatacagatgggcaaattgaggctcagaaagggggattgtcttgccaaagg

SEQ ID NO: 1604 - DNA, 601 bp, Human
gagttctcatttggactctgtcactgtgagactctgggcaagtgaccctcctctttggtgctcagtctcaactatctgtaaaatgaaagtgtgagtttacccttccagctttacattctagcattttatgagggaagggctggatgaacagatgatgaggagttggaggaagaaaacatgatgggctttggaaaggagcaggaagggaagcagaagaataggaggaagaggccaagtgctaaacatagccccaaacagcactgggaccagctgaagtcagccagcttcaggactccagggragctgctggagtccccatatcctatgggatctttgggaagaggaatgactcaggcatcaagccccaaggaattctgttctgttcagagaatattgtgagtttacagtaccattgctttgtaaaaataccagaatgattctctgggtgcgattataatcagctcagttgacaatttacttgaaaacaaacatgccaaatatcatgcaggttccactttctgttttgacttgcacttcagtttgcagcctctgtcctggatgacttttacctttctgctgaagaagttgcaacggagatttc

SEQ ID NO: 1605 - DNA, 601 bp, Human
agttctcatttggactctgtcactgtgagactctgggcaagtgaccctcctctttggtgctcagtctcaactatctgtaaaatgaaagtgtgagtttacccttccagctttacattctagcattttatgagggaagggctggatgaacagatgatgaggagttggaggaagaaaacatgatgggctttggaaaggagcaggaagggaagcagaagaataggaggaagaggccaagtgctaaacatagccccaaacagcactgggaccagctgaagtcagccagcttcaggactccaggggwgctgctggagtccccatatcctatgggatctttgggaagaggaatgactcaggcatcaagccccaaggaattctgttctgttcagagaatattgtgagtttacagtaccattgctttgtaaaaataccagaatgattctctgggtgcgattataatcagctcagttgacaatttacttgaaaacaaacatgccaaatatcatgcaggttccactttctgttttgacttgcacttcagtttgcagcctctgtcctggatgacttttacctttctgctgaagaagttgcaacggagatttca

SEQ ID NO: 1606 - DNA, 601 bp, Human
tgatcattaaatgatttgattgccatctctacttggaagagggtctgaggaagaaagagcaggcaatgtggggagtgaggctcagagcatggcccagcagggggttcccatccttcctgcccttctcttctcagacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattggtaagtggctcatctgggartcagttttggagggggacagaggagcttagggcccaaggtgaggggctgggcagtgggcacttagccccagaggcagaggaagcagaggctccaacctatgtcggtatccccactggagtgagctgcagacgggaccttgttcattctgccttctgccatggggatctgcctttgaagggcaatgggagaagtcctcctggggactgcagctgtcgggggcagtaccacatcgggggaagagtgctcaaggcaggagctcttcccgtcctgcctggccactggctgccttgtgagccgga

SEQ ID NO: 1607 - DNA, 601 bp, Human
gctgctgaacatctgcaatgcataggacagcccacccccacccccacacccccagtaaataatgatccagcccaagtgtcactggtgctgacgttgagtaaccctatcttaagctgaactcatcatctctccattccagccttggtggattctgtctcctctgaaccattcccatctcactttagcctacctagatcacaaagcttggcactcattatagactcccctatttattactccttcaagatgtgcaagaatcttttctctgcacttttaagttctgtaagaagagtctgtgtckttcctataataaccagcataggacgttgcacgtgttgtgtgctcagtgaacctggatttgttgattgttgactgactcactctagagttggaaatcttatgcttggggaaacttaatatctctttctttctctgtgtgtgtgcatttgtgcacgtgtctgtgcatagctgtgagaccaaagacctggttgtgcaacaggcaggcacaaacaagactgatgttgtctgtggtgagtcctggacaatgggccctggagaaagcctaggaaggtgggaactgaagggggagatgaggcacaca

SEQ ID NO: 1608 - DNA, 601 bp, Human
cacagaactgcccctggcaccactggcagagcctaacactggctgttcttcactcctttcctggcattcaacgcgtggggagctgcatcctttgggccttggggctgggtcaaatgggtgggagcaaatgtggcagccccttaagcccactggctcccactctggaagctcttcgtcgcccttggtgtggccagcagggggcaggaggcacccgaggaatcagcactgacccgccgtctgggaaaggggggagggcttggggaagggatccgcttcccagggaggggctcctcagaggcayagctgcccctgctgctgggggtgacctcacaccttgcctctccaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctg

SEQ ID NO: 1609 - DNA, 601 bp, Human
tcactcctttcctggcattcaacgcgtggggagctgcatcctttgggccttggggctgggtcaaatgggtgggagcaaatgtggcagccccttaagcccactggctcccactctggaagctcttcgtcgcccttggtgtggccagcagggggcaggaggcacccgaggaatcagcactgacccgccgtctgggaaaggggggagggcttggggaagggatccgcttcccagggaggggctcctcagaggcacagctgcccctgctgctgggggtgacctcacaccttgcctctccaggccscccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttg

SEQ ID NO: 1610 - DNA, 601 bp, Human
aaaagcagcatctcactggggggaaacggggagagaaattgggaatgactgctggtggttatggagtttctttttctttttctgtttttgagacaggatcttgccatgtggcccaggctggcctcaaactcctgggcttaagtgatcctcccacctcaacctcccaagtgcatgccagtttctttcttgggtgatgaaagtgctgtaaaattgattgtggtgacggtgggccaactctgtgagcataccaaaaaccactgcaccgtatactttaaatgagtggatcatatgatatgtgaaytatacatcagtaaagctgtttttaaaagaggaggaaaagaaagaaggagaaacagcaagttaaactcatcagaccctctcttggcctcagagactctgagagtaaaggttaggtataaatgatcaaggggaacattacatctctgtaccataaaacattgaggtacagagacaaaaaccttaaaacagtcactaatggagaatgttgctttgtttctttgacaagggaggatgcagggatggagccgactttggaagtctgggtttggttgtaaaggccaggatctagaacagtgtccta

SEQ ID NO: 1611 - DNA, 601 bp, Human
aagaatcccagcctctcagagaagcataactcagactcaggcacccatggaaacaagaaacaagcatccaacatgcagtctctgaagcaagagagacactcagctacgcacacgaggctgtggctcttacagcagcaaacatgcaagagctttctttttattcatctaaataaataggtaatcttagaaattacaaatattatttaatgtaatcattacctcatgtatcttaagaagacagatccattaaaaatcttaacttcccggccgcatgcaatggcatgtacttgtagccccagcyactccggaggctgtggcaggaagattgcttgagcccaggagtctgaggctgtgatgcactatgattgtgtctgtgaatagccactgcactccagcctgggcagcatagtgggtccccatcttaaaaagaacattcttcacttccctgtttccaagcaaagactgagtcatagacacaagtcaaggttacctttaccattaaaattttatcagaatcagcccaacacttttgaaaactgtaacttaataaatgtcattggctggtcacatggaaatacctggcttcactccatttctctga

SEQ ID NO: 1612 - DNA, 367 bp, Human
gaagggttaaggaaggctcctgaagcctgcccccctctccccccattgtcacagggcagccagcacktccccacttgctcgccgccgaagaggtcgggaatagcgagagtcaccttcgacttgtacaggctgaaccccaaggacttcatcggctgccttaacgtgaaggccaccatgtatgagatgtactccgtgtcctacgacatccggtgcacgggactcaagggcctgctgaggtaacacactccaggggtcacctccgggggtctgcagactgcacagggtgtggcacaggcagcagtccccaccctgttcctctgggctcccaggccggctagcactgttaggggcagttggagtaatgttg

SEQ ID NO: 1613 - DNA, 601 bp, Human
gaggccgaggtcagcagatcacttgaggccaagagttcgagaccagcctagccaacatggcgaaactctgtctctactaaatatacaaaaattagctgggcgtggtggcggatgcctgtaatcccagccactcaggaggctgaggcaggagaattgtttaaccccaggaggcggaggttgcagtgagctgagatccgccactgtgagccataaccacaccactgcactccagactgggtgacagagcaagactgtgtctcaaaaataaataaataaacaaacaaaaaataaataaaatgaraaggttgcttccaagctctttatgattgccagggctctaactacacctacttctactccagtaaatttaccgttgatccttaaagaactaacctctgtggagggagtggatgggagagtggctgattgcagtagaaaggtcttcaagtcgaaaagttttgcagctgctgccattccagtgccccctgcacgtccctgtgggcagggccgcccgtttctctttgagggtgttgtttccgtcccccgtggccttgacaactgctctgatttgtgctgagcacagcaaaggggaaatgccctc

SEQ ID NO: 1614 - DNA, 601 bp, Human
ttttgcagctgctgccattccagtgccccctgcacgtccctgtgggcagggccgcccgtttctctttgagggtgttgtttccgtcccccgtggccttgacaactgctctgatttgtgctgagcacagcaaaggggaaatgccctcctctcagaggtctcctggcctcacctgaggtgggccagggtgtgtggcttctctgtggcctcagtttcccattcagagccatcagtggctgactctaaactacagtcactgtcatagtgttggagtcttgactcccaggagagcttccttttttttgtcttttcctttttgccgggataggagaaaatagctttacacttggattttaaaagttaggcaagagagttacaacaactgaaaaaggtaagatgaagaaagctaacctcacccaaaattccacctcagtgaaatcttttttctttttcttttctttttttttttttttttttgagacggaatctcactctgctgcccaggctggagggcaggggcacgatctcagctcactgcaacctcctcctttcaagttcaagccattcccgtggctcagcctcccaagtagctgagattacaggc

SEQ ID NO: 1615 - DNA, 601 bp, Human
cactggaggcaccgcctgctagggaccctgttgtgggtgctgggggcagtgggccctcctgatgagacagctgcccaggcttggctatcgcatccccatgggctcagtcactgctgaatgtcctgctactaccttaggaagggaagggatttcagtagcagggcccctagaacagcccagcagccgaagcccaggacacagcacacctgtgcgggtgcggccatctgctccacacagagcttgccagccactcaacaagcaggccgcacttcaggtggctcatgggagccgtgcttcttgyggtggtcttgggccagcagcaagggggtcctcagggagctcacagagacctgctcctggccagacccactgccacggcagctgcatctgtgccagccctgggacacgtgcactctgagagtcagacagccatgctctaaatgtcagcctggcctcctccgagtgccttttggtggggggagtgaagtattcccatcctgtctgtttctcactggcccaaaatcccaagctaaagcctccccatctgcctctgccacaggagtctgctgcggttcctgtcctactccgcccaggtgacggg

SEQ ID NO: 1616 - DNA, 601 bp, Human
gattgcatctgaagcgaggggtgtggtatttgggtatttggtccgaggaaataattcagtaaacagagggcattattgttattttattggaactagagatagcagacaatgtcagcctatgtgtgtaattaccccacattctagcaacaacagtacccagagctaaagttgaagaagtcctacgaggcaccagctatgggacatatgttatctctagtccgcagacccatcccccagttgggtactgttttcccatttaaattagagaagacacaggctgagggaataagtgacttgtccraggtcacacagccagtaagttgctgggacaggatgtggactcaagtgcgagacctttatatcacccacgctgcccacttcccgggtcttggtctatctcagcacccagacccccctgggcctggctccctccttagcctcagagccctgccccggcttaagcagggaagcccccctcgcccgagctgacggagccgggtgcaggagtgagtcaagcccaccatgcaacacgaaggcacctacttgtctggtactggatgcccagtgctgccaagcaggccaccagtcctgccgccagaag

SEQ ID NO: 1617 - DNA, 601 bp, Human
cccagtagcctgtgggtgaattccaacttccgcattggattagcaagtcactctatctcagtgcctcagtttcctaatatggaaaaggggccaaaagtaaccacacttcacagggctgcctccaggaggaaatgagattgcatctgaagcgaggggtgtggtatttgggtatttggtccgaggaaataattcagtaaacagagggcattattgttattttattggaactagagatagcagacaatgtcagcctatgtgtgtaattaccccacattctagcaacaacagtacccagagctaragttgaagaagtcctacgaggcaccagctatgggacatatgttatctctagtccgcagacccatcccccagttgggtactgttttcccatttaaattagagaagacacaggctgagggaataagtgacttgtccgaggtcacacagccagtaagttgctgggacaggatgtggactcaagtgcgagacctttatatcacccacgctgcccacttcccgggtcttggtctatctcagcacccagacccccctgggcctggctccctccttagcctcagagccctgccccggcttaagcagg

SEQ ID NO: 1618 - DNA, 601 bp, Human
aaagcaccagcatgtttctggaaaggaagcatagcaggaaggtaagtaaacacgtactatgtgtccagacattcccagaggctggccttcagaatcatcagatttgctttctttttttttttttttttttgagacggagtctcgctctgtcgcccaggctggagtgcagtggtgccatcttggctcactgcaacctctgcctcccaggttcaagtgattctcctgcctcaacctctcgagtagccggtgtgcaccatcacagccacctgagtagctgggactacagttgtgcgccaccatscctggctaatttttgtatttttagtagagacggggtttcaccatgttggtcaggctggtctcgaacatcttgacctcaggtgatctgtccatctcggcctcccaaagtgctgggattacaggcgtaagctactgcgcccggccagatttgctttgactggcctgatgtttgctcagatgtggccagcaccagcacctgctcctgggtaatgaggttactgttaatatctggggtggtcactgctttcccaggtggctcaggggtcacctgatactctgcccagctccactccaggggaag

SEQ ID NO: 1619 - DNA, 601 bp, Human
aaactgtgtagaatgctttctttaaaatatgttcttggagaatgtattgtttgttttgctgcctctgtttgcaaagcaccagcatgtttctggaaaggaagcatagcaggaaggtaagtaaacacgtactatgtgtccagacattcccagaggctggccttcagaatcatcagatttgctttctttttttttttttttttttgagacggagtctcgctctgtcgcccaggctggagtgcagtggtgccatcttggctcactgcaacctctgcctcccaggttcaagtgattctcctgcctyaacctctcgagtagccggtgtgcaccatcacagccacctgagtagctgggactacagttgtgcgccaccatccctggctaatttttgtatttttagtagagacggggtttcaccatgttggtcaggctggtctcgaacatcttgacctcaggtgatctgtccatctcggcctcccaaagtgctgggattacaggcgtaagctactgcgcccggccagatttgctttgactggcctgatgtttgctcagatgtggccagcaccagcacctgctcctgggtaatgaggttactgttaatatc

SEQ ID NO: 1620 - DNA, 601 bp, Human
tgttcaccacctgcagaggcagcaaacatttctttccgttgggacatgcgtgatcaattgagaaagcagaaacagatcctagatttaatttacagacactcatctggacagcctggcctcaaaactgtgtagaatgctttctttaaaatatgttcttggagaatgtattgtttgttttgctgcctctgtttgcaaagcaccagcatgtttctggaaaggaagcatagcaggaaggtaagtaaacacgtactatgtgtccagacattcccagaggctggccttcagaatcatcagatttgcwttctttttttttttttttttttgagacggagtctcgctctgtcgcccaggctggagtgcagtggtgccatcttggctcactgcaacctctgcctcccaggttcaagtgattctcctgcctcaacctctcgagtagccggtgtgcaccatcacagccacctgagtagctgggactacagttgtgcgccaccatccctggctaatttttgtatttttagtagagacggggtttcaccatgttggtcaggctggtctcgaacatcttgacctcaggtgatctgtccatctcggcctcccaaag

SEQ ID NO: 1621 - DNA, 601 bp, Human
aacacaagacttctactcagctgtctaaaatccttcctgtggctaaaaggtacccagaacccaggtgtttctcttaatcaaccttctcctccataaatattcattgactctttattattccttgatgctcaacaaatttattcattcacgcatgcattcatttattcagcaagataatgactaccttccaggttctctgctgagtatggagtgcgtgtgtgtgcatgtgtgcacctgcgtgaaagtgtgtgcccgtgcgtgtgtgcgtgtgtgtgtgtgtgtgtgtgtgtgtgtgtgtgtttagggtactggggtattgggcataaaaaggcagagtcctttaatccaagagctaacaattcagttggggatatacacataaatcaaaatggaacagtaggagaaatgtctgtcctcctttctacaaaaataaactgaacatttactatgtgccaaaagggtgatgtagacagtatggatgacaggacataggaaggaggaaagcctattagaaatagaaggaggaaataggaaaaatcactcctacgtacaagcaggagagtgagtgacctcagggaatcctcaaaaacccaaaggctac

SEQ ID NO: 1622 - DNA, 601 bp, Human
ccacccagggcaagcccctctcccaccccaggtcctgctaaactcaaaacaggaagaggtcgtgcccgccccctcgaccgctgcaggttcaagctagctcacctggatcacgttgctgttggagttcttggaatcggcactgacatagacagagaagaagggtgaggtgcggtagtgggcggtgaccacctgcagggtgtcctggaagttgtccttggcccagggacctgtgatgttccagcccccgagctgtggggagggagagcaggcagggaggtgatgaggtggcggggagacccasatgtgaattctggttctgccgctgacttgctctgtgaccctggagcagtcgcctgacctctctgagcctcaagagcaaaggaaaggattggtcttcatcgggggtttccgacccatgagctggagacccatggatggagcaaaggcttatcctagacaagccaagcagccaggcatgaatccagccgctccctgggtggctgggatgagaatgggaaagagacttttcccggttcacggtttatattttggataatgaattgtgtgaatgtgattatatcaaaacataaattcaattgtg

SEQ ID NO: 1623 - DNA, 601 bp, Human
gtgctgggaggcaggctgggaggggagaggcacgcttaccttctcgttttcagttttgttcaggtaatagtctctcgagggcaagcccaggccagactggtccacctggcaagagaagcaggcatgagagggaattcgtgttgcaatgcgtgtatccactgcacggcctcctgccctgggaatggctggcacatggcagcagaggcccagctcaggcccttggagaagcaggactgctggctacagtcactgagaagcccactcagggacgggatgacacattcctgcctgtccacgtggcccccccccgcagggctcctgggctcctcagaagggctggacagagccaccctcctttttaaacagctacttgcctcggcaaagtgcctctatctccccaacgctttccaggtggttaagagtcactcaaaagctgtgtgatcttggccaagttactgaacctttctgattctcaggtttcttctcaggtaaatagggaaaataaaacctaaccttcagagctagaatggggattcaagaagacagtgctggtcaagtgcctgccaagcaggaggggagggtcaaattctgcttgctacta

SEQ ID NO: 1624 - DNA, 601 bp, Human
ttgacagatgaggcaaatgaagttcagtatctgcagggttaatgggagggtcacaggtgatgtataaagggccaggcgaattgtggtagctgttattgctgcctctgcctctctctagaaccaggacaaatgatacctgtctcttgccccttgtgtccatgatgcctgagtgacacagccagcctaggggtgtccctcccctgccagggtctgcctgtttcacccatcaggtcactgacacccctgggctcccctagcttcaaagacctgcacaggtgtgggtgtggacacggagcaggarggaccgtgctgggaggcaggctgggaggggagaggcacgcttaccttctcgttttcagttttgttcaggtaatagtctctcgagggcaagcccaggccagactggtccacctggcaagagaagcaggcatgagagggaattcgtgttgcaatgcgtgtatccactgcacggcctcctgccctgggaatggctggcacatggcagcagaggcccagctcaggcccttggagaagcaggactgctggctacagtcactgagaagcccactcagggacgggatgacacattcctgcctgtcca

SEQ ID NO: 1625 - DNA, 601 bp, Human
gagcctgataccctcttctgtaaaaggcaagacaaaactaattcctgtttgacagatgaggcaaatgaagttcagtatctgcagggttaatgggagggtcacaggtgatgtataaagggccaggcgaattgtggtagctgttattgctgcctctgcctctctctagaaccaggacaaatgatacctgtctcttgccccttgtgtccatgatgcctgagtgacacagccagcctaggggtgtccctcccctgccagggtctgcctgtttcacccatcaggtcactgacacccctgggctccyctagcttcaaagacctgcacaggtgtgggtgtggacacggagcaggaaggaccgtgctgggaggcaggctgggaggggagaggcacgcttaccttctcgttttcagttttgttcaggtaatagtctctcgagggcaagcccaggccagactggtccacctggcaagagaagcaggcatgagagggaattcgtgttgcaatgcgtgtatccactgcacggcctcctgccctgggaatggctggcacatggcagcagaggcccagctcaggcccttggagaagcaggactgctggctacagt

SEQ ID NO: 1626 - DNA, 601 bp, Human
gaatctcaggctcgtcatttactggctatgtgaccttgagcagatcacttagcatctctgagcctgataccctcttctgtaaaaggcaagacaaaactaattcctgtttgacagatgaggcaaatgaagttcagtatctgcagggttaatgggagggtcacaggtgatgtataaagggccaggcgaattgtggtagctgttattgctgcctctgcctctctctagaaccaggacaaatgatacctgtctcttgccccttgtgtccatgatgcctgagtgacacagccagcctaggggtgtycctcccctgccagggtctgcctgtttcacccatcaggtcactgacacccctgggctcccctagcttcaaagacctgcacaggtgtgggtgtggacacggagcaggaaggaccgtgctgggaggcaggctgggaggggagaggcacgcttaccttctcgttttcagttttgttcaggtaatagtctctcgagggcaagcccaggccagactggtccacctggcaagagaagcaggcatgagagggaattcgtgttgcaatgcgtgtatccactgcacggcctcctgccctgggaatggctg

SEQ ID NO: 1627 - DNA, 601 bp, Human
tgtctcaaaaaaaaaagaagaagacacccgtgggagacacagcattgagaatgatctcggggccgtgtctctctgctgcttccctacagcctccaggagaaagcccaaagtcttggctcgtctcacaggtccccacctgggctggtccctgtcttccagggcttgtcctggggctgtctttccattcttagaatgcatcttttctgaccaccccccacccgtgttccaagatctgaattaggtctccacggtagactttctcagctccactttctcttagttaaataatatccgcctcgcygaccaaaccacaggccctgtgggacgaaggctatggtggtcttgtctgctaccatctccccagcatcaggcactctgtgggcgcttggtcaagtacatgccggcggaaggatgaaaggacagatgaatgagttccaggtgaggtcgccccaagaggcatcacaagaggcaggccagggggagggagagccatgggcttcggagcacgtggatccggatgtgaatctcaggctcgtcatttactggctatgtgaccttgagcagatcacttagcatctctgagcctgataccctcttctgt

SEQ ID NO: 1628 - DNA, 601 bp, Human
atggcactctagcctgggcggcagagagagactttgtctcaaaaaaaaaagaagaagacacccgtgggagacacagcattgagaatgatctcggggccgtgtctctctgctgcttccctacagcctccaggagaaagcccaaagtcttggctcgtctcacaggtccccacctgggctggtccctgtcttccagggcttgtcctggggctgtctttccattcttagaatgcatcttttctgaccaccccccacccgtgttccaagatctgaattaggtctccacggtagactttctcagctycactttctcttagttaaataatatccgcctcgccgaccaaaccacaggccctgtgggacgaaggctatggtggtcttgtctgctaccatctccccagcatcaggcactctgtgggcgcttggtcaagtacatgccggcggaaggatgaaaggacagatgaatgagttccaggtgaggtcgccccaagaggcatcacaagaggcaggccagggggagggagagccatgggcttcggagcacgtggatccggatgtgaatctcaggctcgtcatttactggctatgtgaccttgagcagatc

SEQ ID NO: 1629 - DNA, 601 bp, Human
cttggccagccaagtccggcacagggagccagggggctgcacagtgcccccaagacacccgtggggccaggtgtggtggctcacgcctgtaatcctggcactttgggaggctgaggtgtgtggatcacctaaggtcaggagtttgagaccaacctggccaacatggcgaaaccccgtctctactaaaaatacaaaaattagctgagcatagtgggaggtgcctataatcccagctactcaggaggctgaggcaggagaatcacttgaacccaggaggaggaggttgcagtgagcccagatygtgcgccatggcactctagcctgggcggcagagagagactttgtctcaaaaaaaaaagaagaagacacccgtgggagacacagcattgagaatgatctcggggccgtgtctctctgctgcttccctacagcctccaggagaaagcccaaagtcttggctcgtctcacaggtccccacctgggctggtccctgtcttccagggcttgtcctggggctgtctttccattcttagaatgcatcttttctgaccaccccccacccgtgttccaagatctgaattaggtctccacggtagacttt

SEQ ID NO: 1630 - DNA, 601 bp, Human
tgccgtctcaaagtccaagatctgctgcatctggggccggatggcctcctcgtccccgccgcccagcagcttccccagctggaccatgtagttcagatatccggtcagcacctgcagggcccataccccaaactgtcagtggctgcccccccactatccactggacgagagttggtggggggcttggccagccaagtccggcacagggagccagggggctgcacagtgcccccaagacacccgtggggccaggtgtggtggctcacgcctgtaatcctggcactttgggaggctgaggtgkgtggatcacctaaggtcaggagtttgagaccaacctggccaacatggcgaaaccccgtctctactaaaaatacaaaaattagctgagcatagtgggaggtgcctataatcccagctactcaggaggctgaggcaggagaatcacttgaacccaggaggaggaggttgcagtgagcccagatcgtgcgccatggcactctagcctgggcggcagagagagactttgtctcaaaaaaaaaagaagaagacacccgtgggagacacagcattgagaatgatctcggggccgtgtctctctgct

SEQ ID NO: 1631 - DNA, 601 bp, Human
aatgacagaatccacaccatgcatttattaagtgctcactgtaaccaagttcgatgtgcttggtgctggagagactggaaaggcgctgtcaatgtaagctggtgtggtcatgaccccgagcctccaagtaaacactattaattacagagaagcagcctggtgtcggccaggcgcctattttggagtcacttactagctgtgtgcccttcagcaggtaacttgacctttctgagcatcagtttttccatctgtggactgggcataacaaccatccttcctttgtcacatagtttcaaggacyagatgaaatgagtataaaagcccccagtccagggccctgtctgaaacctggaggccatcccagcctccctagcagccggcgctcaagttacctgcagctcggctgccgtcactttgtggtagatgagctcctcatcacggcgcttctcctgtgggatggtgatgttggccagtgccgtctcaaagtccaagatctgctgcatctggggccggatggcctcctcgtccccgccgcccagcagcttccccagctggaccatgtagttcagatatccggtcagcacctgcagggcccataccc

SEQ ID NO: 1632 - DNA, 601 bp, Human
ggaaggagggagatgacactctgcgggagcccctcctcagcagagaagcaaggcctggccacgcattcctgggtgatgtcaagaaacggcaagatcggtggtggccattctgctgatccctctgcaatgccagctgatgctctggaaagaaggaaccagcaagctattctctctggaccctcaagaaccaagcagccaccagagggcagcctttggcagaggctgagcccttggacgttgggcttctccaatgggtgacagagagcatcacagatctaacgccctgttgtacagtgagccmatctgcggctggctcctctgccacttaggagcctccggaccttgatctggctcagaaaagggaaaagtaatgacagaatccacaccatgcatttattaagtgctcactgtaaccaagttcgatgtgcttggtgctggagagactggaaaggcgctgtcaatgtaagctggtgtggtcatgaccccgagcctccaagtaaacactattaattacagagaagcagcctggtgtcggccaggcgcctattttggagtcacttactagctgtgtgcccttcagcaggtaacttgacctttctga

SEQ ID NO: 1633 - DNA, 601 bp, Human
gcagccagcaccagcaggaggccaggctcccctgaccctgatcgtgggccctagcacggcctgcatctccgcctgggacacccagttggcctggaaatgctcatctatcgttagactcaccttccctgacttctccccacccctggctcccagggcccgctgcttttgcccaaagcactcagcaatgagacagggttgtttctagctggtgtcccccactagccaggaagcacatgaagcgcaaggtcccaagacggacccatatacacctgtcagctggaggagggtaaagggcagggamctagtgttcttcctgaaagtagaaggaacggacaacaggtcaaattcggctggtcacaaggtaaggaaggagggagatgacactctgcgggagcccctcctcagcagagaagcaaggcctggccacgcattcctgggtgatgtcaagaaacggcaagatcggtggtggccattctgctgatccctctgcaatgccagctgatgctctggaaagaaggaaccagcaagctattctctctggaccctcaagaaccaagcagccaccagagggcagcctttggcagaggctgagcccttggac

SEQ ID NO: 1634 - DNA, 601 bp, Human
tctgtaaaaactcgagagaatccatatatttcctaaagatcttaattgaactttgggtacttagaacacagaggctgtttggccaggcgtggtggctcatgcttataatcccagcacttagagctccaaggggcttacagtcctctgaatctaagcccagggcttgtgtactacaagctgctgagtctgctaaactccccccaccttggcagctgtgcagctgggaggcaggaaaagcctttcttcctctgcttggaagaagagagcagaagcagtggtgataggatgcctggggggaacytggtggccatgctgggctgatgtgctcagggctcctgtgccttctccgctattcctggcacagacagttggcatcatggccacggtagggggctgaggcactgcgggggcccctcaggctgagaaatcggctggaacaaaccaaattataatgcacaaacaacatcaccctcagcctcctggcctcagagcaggaaaagagtgccagatggtatctaacagcagctgttgatctccatcctggtctgagcagcaccactgagcctcaggccagtttctctgggagctgaagggcagccag

SEQ ID NO: 1635 - DNA, 601 bp, Human
ggagatcgagaccatcctggctaacacggtgaaacccggtctctactaaaaatacaaaaaaattagccgggcgtggtggcgggtgcctgtagtcccagctactcgggaggctgaggtgggagaatggcgtgaacccaggaggtggagcttgcagagagccgagatggcgccactgcactccagcctgggcgagagcgcgagactctgtctcaaattaaaaaaaaaaaaagaaccacaggccaggtgcggtggctcatgcctgtaatcccagcactttgggacgccgaggcgggtggattaygaggtcaggagttcgagaccagcctgaccaacatggtgaaaccccgactctactaaaaatacaaaaattagccgggcgtggtggtgcctgcctgtaattccagctactcaggaggctgaggcaggagaatcgcttgaacctgggaggcagaggttgcagtaagctgagatcatgccactgcactccatcctgggcgacagagcaagactttgtctcaaaaaaaaaaaaaaaaaaaaaagaggaaccacagtcccttgtgagggcaagggctatgtctcatttgtgttctggcacacagct

SEQ ID NO: 1636 - DNA, 601 bp, Human
tgtatttttagtagagacggggttttaccatattggtcaggctggtcttgaactcctgacctcaggtgatccacctgcctcggcctcccaaagtgctggaattacaggcctgagccaccatgcccggccaggacgtctttaaatgtcagacataattttaaaaatatgcatatatacccatttattctgggagatagtccatggtttttgatctgttctcaaaggactctgtgacttaaagttaagaaccacaggccgggcgcggtggctcacgcctgtaatcccaacactctgggaggcygaggcgggcaactcacgaagacaggagatcgagaccatcctggctaacacggtgaaacccggtctctactaaaaatacaaaaaaattagccgggcgtggtggcgggtgcctgtagtcccagctactcgggaggctgaggtgggagaatggcgtgaacccaggaggtggagcttgcagagagccgagatggcgccactgcactccagcctgggcgagagcgcgagactctgtctcaaattaaaaaaaaaaaaagaaccacaggccaggtgcggtggctcatgcctgtaatcccagcacttt

SEQ ID NO: 1637 - DNA, 601 bp, Human
ccccacttaacagatgctgaggccgggcgcggtggctcacgcctgtaaccccagcactttgggaggccgaggcgggcagatcacgaggtcaggaaagggagaccatcctgactaagagggtgaaaccccatctctactaaaaatacaaaaaattagccgggcattatggtggacgcctgtagtcccagctacgcgggaggctgaggcaggagaatggcatgaacccgggaggcagagcttgcagtgagcggggatcgcgccactgcatccagcctgggcgacagagcgagactcagtctcaaaaaaaaaagagatgctgaatttgcagatggggtaaggtgactttcctgaggtcacatagttaactagccactgtggaggtctaaaacccaggttcactcatctctttgggtttaaaagggcaactcagctgctggggaacaaggacctcaaaggacaggtgaatttgtgaggagggcaggtcctgaaggcagtggcgtgctggtaaacagttaacaactgcgccgggcacggtggctcatgcctgtaaatcccagcactttgggaggccaagacaggagaatcacctgagtccaggagt

SEQ ID NO: 1638 - DNA, 601 bp, Human
atgacaccctctgtgagggaggtagccataaacccccacttaacagatgctgaggccgggcgcggtggctcacgcctgtaaccccagcactttgggaggccgaggcgggcagatcacgaggtcaggaaagggagaccatcctgactaagagggtgaaaccccatctctactaaaaatacaaaaaattagccgggcattatggtggacgcctgtagtcccagctacgcgggaggctgaggcaggagaatggcatgaacccgggaggcagagcttgcagtgagcggggatcgcgccactgcacccagcctgggcgacagagcgagactcagtctcaaaaaaaaaagagatgctgaatttgcagatggggtaaggtgactttcctgaggtcacatagttaactagccactgtggaggtctaaaacccaggttcactcatctctttgggtttaaaagggcaactcagctgctggggaacaaggacctcaaaggacaggtgaatttgtgaggagggcaggtcctgaaggcagtggcgtgctggtaaacagttaacaactgcgccgggcacggtggctcatgcctgtaaatcccagcactttgggag

SEQ ID NO: 1639 - DNA, 601 bp, Human
tgtcgatcacttagatggatatgtctggcatttagcaagcaactcatcaatattggccattacaatctttgttcaaggtctcccatgtatgttcctgggcctgtccaattccaaattctcttttgttttcttgaaaaaggacaaaatgcaagacaaaggaggtgagagaggctccacatatggccttcacatggaaaaatcaatcaataaagtaaaattgatctgtaatgtaagaccagtctatagcctgttggtaaatactgatgacaccctctgtgagggaggtagccataaacccccrcttaacagatgctgaggccgggcgcggtggctcacgcctgtaaccccagcactttgggaggccgaggcgggcagatcacgaggtcaggaaagggagaccatcctgactaagagggtgaaaccccatctctactaaaaatacaaaaaattagccgggcattatggtggacgcctgtagtcccagctacgcgggaggctgaggcaggagaatggcatgaacccgggaggcagagcttgcagtgagcggggatcgcgccactgcatccagcctgggcgacagagcgagactcagtctcaaaaa

SEQ ID NO: 1640 - DNA, 601 bp, Human
ttttttggaattatatatactgctacagcaaaaatgcctgtacatgtcgatcacttagatggatatgtctggcatttagcaagcaactcatcaatattggccattacaatctttgttcaaggtctcccatgtatgttcctgggcctgtccaattccaaattctcttttgttttcttgaaaaaggacaaaatgcaagacaaaggaggtgagagaggctccacatatggccttcacatggaaaaatcaatcaataaagtaaaattgatctgtaatgtaagaccagtctatagcctgttggtawatactgatgacaccctctgtgagggaggtagccataaacccccacttaacagatgctgaggccgggcgcggtggctcacgcctgtaaccccagcactttgggaggccgaggcgggcagatcacgaggtcaggaaagggagaccatcctgactaagagggtgaaaccccatctctactaaaaatacaaaaaattagccgggcattatggtggacgcctgtagtcccagctacgcgggaggctgaggcaggagaatggcatgaacccgggaggcagagcttgcagtgagcggggatcgcgcc

SEQ ID NO: 1641 - DNA, 601 bp, Human
tctgagctgcattggtccgaaggtgatatttctcaggcatgggatcgggaagggttgaacattaactttcagcaagaaaggaaaagccctcagctcagctaatgcacacagcaggctggtcagctctactttttttttttttttgagacggagtctcactctcttgtccaggctggagtgcagtggtgccatcttggctcactgtaacctctgcctccagggttcaagtgattctcctgtttcagcttcccgagtagctgggattacaacaggcacccaccaccatgcccacttaattttygtatttttagtagagatggggttttgccatcttggccaggctggccttgaactcctgacctcaagtgacccgcctgcctcagcctcccaaagtgctgggattataggcatgagctaccgcacccagcctggtctgctctattttaagatgactgaaaatgagcgctcgcgcctggggcttcctctcctcacagaggcgccttccagccctgtaactctcagcctccagcaggttgcactttctctgtgaccctaaaggcgcttgttcagagctctctttttcttttcttttttttttgag

SEQ ID NO: 1642 - DNA, 601 bp, Human
taaacctgtgcctgtaaccaggatgtcctgctgcctctcgtaaaagcccgcccaggtcccactctcctgagtcagactgtcatccccacccctgcccacctgcccaagaagagggctgtctgtgagaggcgtgccccaggccactgggggtcctcttaccatctgtcggtggtgttgatgagagtggagatctgctcaaggtattccttgtcatagaccacaataggctcggattcattgatctccacggggtagaagatggtgttgagaaaaggcaaccagttgatggcgggtgccaagrtctgcaagggaaaaggacagtgtgaccctgtggggctgctcctcctcacagcccagggctctaggacgggcttctacaggaagcaaaggaaagagcttgggcttggcgccatctgacagcgcaccgggcagagagtcaagcggagcctggcgggcttttgtcagagatgctgtaggtagaattctaaggagtccaacaccaaaatttaacctgaaatggaatgaggatgcaatgagaagatgcagcagctgccgctaccattcagcaagcgtctcctgtgtgccaggagccgtggcaaat

SEQ ID NO: 1643 - DNA, 601 bp, Human
caattacgggcgttcatgcccggccacaggtgatatttgtatcaccattttatgaaggaggagaatgaacttaagaaaggttacgaaatttgcccaaggctacaaagctggtagtttgaaagaggctgggatttaaacctgtgcctgtaaccaggatgtcctgctgcctctcgtaaaagcccgcccaggtcccactctcctgagtcagactgtcatccccacccctgcccacctgcccaagaagagggctgtctgtgagaggcgtgccccaggccactgggggtcctcttaccatctgtcrgtggtgttgatgagagtggagatctgctcaaggtattccttgtcatagaccacaataggctcggattcattgatctccacggggtagaagatggtgttgagaaaaggcaaccagttgatggcgggtgccaaggtctgcaagggaaaaggacagtgtgaccctgtggggctgctcctcctcacagcccagggctctaggacgggcttctacaggaagcaaaggaaagagcttgggcttggcgccatctgacagcgcaccgggcagagagtcaagcggagcctggcgggcttttgtcagaga

SEQ ID NO: 1644 - DNA, 601 bp, Human
gcgacaccatgtctggctaattttttattttttgtagagacaccgtctcgccatgttgcccaggctggtctgaaacgcagggactcaagggatcctcctgcctctgtctcccaaaagtcccgcaattacgggcgttcatgcccggccacaggtgatatttgtatcaccattttatgaaggaggagaatgaacttaagaaaggttacgaaatttgcccaaggctacaaagctggtagtttgaaagaggctgggatttaaacctgtgcctgtaaccaggatgtcctgctgcctctcgtaaaascccgcccaggtcccactctcctgagtcagactgtcatccccacccctgcccacctgcccaagaagagggctgtctgtgagaggcgtgccccaggccactgggggtcctcttaccatctgtcggtggtgttgatgagagtggagatctgctcaaggtattccttgtcatagaccacaataggctcggattcattgatctccacggggtagaagatggtgttgagaaaaggcaaccagttgatggcgggtgccaaggtctgcaagggaaaaggacagtgtgaccctgtggggctgctcctcc

SEQ ID NO: 1645 - DNA, 601 bp, Human
cagtatatgctaggcactctattaaatcacctcatatggattgtttcacttgattctcacaacagccctaaatggtaggtgctaggtttttttgtttgagacagggttttactctgtctcccacgctggagtgcaacagtgcaatcacagctcactacaacctctgcctcctgagctcaagagatccttccacttcagcctccctctcaaggagctgggtgacaggcacgcgacaccatgtctggctaattttttattttttgtagagacaccgtctcgccatgttgcccaggctggtctsaaacgcagggactcaagggatcctcctgcctctgtctcccaaaagtcccgcaattacgggcgttcatgcccggccacaggtgatatttgtatcaccattttatgaaggaggagaatgaacttaagaaaggttacgaaatttgcccaaggctacaaagctggtagtttgaaagaggctgggatttaaacctgtgcctgtaaccaggatgtcctgctgcctctcgtaaaagcccgcccaggtcccactctcctgagtcagactgtcatccccacccctgcccacctgcccaagaagagggct

SEQ ID NO: 1646 - DNA, 601 bp, Human
aggtcaagggaaaaggagactagacatttagttatgataatgggaaaaaaagaccacatattagaaaaccgatctctctttccctcctctctcctgccctcccccatgctttctctctacatatgcacacacacataccacaagatcaacaggagtcatttaaaattttttcagagcctggtgaggtggctcacacctgtaatcttagcattttgagaggccaaggtgggaggattgcctgagaccaggagtttgagaccagcctgggcaacatagtgagaccccatctcattaaaaaaawtttaacaagtaagtttggggagttaggaaaaaaataagttaaatacgataaatttttttccctatttttttggtagttttcaaaaaattttttaaaaattataagtattgctgggtgtggtggcttatgcctgtaatcctagctctttgggaggctgaggcaggcagatcaactgaggtcaggagttggggaccagcctggcaaacatggtgaaaccccatctctactaaaaatacaaacattagccggtgtggtggcaggcgcctataatcccagctgtttgggaggctgaggcaggag

SEQ ID NO: 1647 - DNA, 601 bp, Human
tgacaagggggaaaatgttcaggatacaggtcaagggaaaaggagactagacatttagttatgataatgggaaaaaaagaccacatattagaaaaccgatctctctttccctcctctctcctgccctcccccatgctttctctctacatatgcacacacacataccacaagatcaacaggagtcatttaaaattttttcagagcctggtgaggtggctcacacctgtaatcttagcattttgagaggccaaggtgggaggattgcctgagaccaggagtttgagaccagcctgggcaacayagtgagaccccatctcattaaaaaaattttaacaagtaagtttggggagttaggaaaaaaataagttaaatacgataaatttttttccctatttttttggtagttttcaaaaaattttttaaaaattataagtattgctgggtgtggtggcttatgcctgtaatcctagctctttgggaggctgaggcaggcagatcaactgaggtcaggagttggggaccagcctggcaaacatggtgaaaccccatctctactaaaaatacaaacattagccggtgtggtggcaggcgcctataatcc

SEQ ID NO: 1648 - DNA, 601 bp, Human
tgttgccaccgttgccaagaagtcaccttgagactgtagtgaacatctaacctctaatcagaatcaaccaaaatgcctgataatgagaaggaggaagtaaagaactgtatttgtacacgacggagtactatgcaaccatgaaaaatgatgtttgcagaggttttgagatgacaagggggaaaatgttcaggatacaggtcaagggaaaaggagactagacatttagttatgataatgggaaaaaaagaccacatattagaaaaccgatctctctttccctcctctctcctgccctcccccwtgctttctctctacatatgcacacacacataccacaagatcaacaggagtcatttaaaattttttcagagcctggtgaggtggctcacacctgtaatcttagcattttgagaggccaaggtgggaggattgcctgagaccaggagtttgagaccagcctgggcaacatagtgagaccccatctcattaaaaaaattttaacaagtaagtttggggagttaggaaaaaaataagttaaatacgataaatttttttccctatttttttggtagttttcaaaaaattttttaaaaattataag

SEQ ID NO: 1649 - DNA, 601 bp, Human
ttttgctataaattggctgagtggctaggactcctctttaccctttacttggcataagcactccttccggaagcttctacccacccccagctggctgaggtcccttcctgtgctcccatagacaccttggcataaagtaggcgctcagcccatattcaggcatacgcagtagcaggctcaccttcttggtcccgtacatgacttccatgaacttctcatcggcgtcctgaaagcgctggtcaaggaaggagcttgttttccgcaccaggttccagatcatgtagttgttgagcaggctgcrgggagaggaggccagagaggctcagggacacctaggcagggaggattgcggcccttcccctgctggcccctagggggctctcaaacttggcctgtgaccccaggccccttccagcctgcgggggcttggtgggttactgctccctaagcacgtgcaatgtaagctcttcaagggaaaagcctgggtcttctaccataggaaacgcttcagtgttgagtgcagtcacttgtataccacaggtgctcaataaatgcttgttgcctagctgctctgtgtctggaagctatgaagccccagcat

SEQ ID NO: 1650 - DNA, 601 bp, Human
gaccatctttggaaccatcatcctgggtcctgatcaaatctctctgtaggaagtcccctgggaggccaagttctgcagggaacagaatcctggctttggccccatctctaacccagggccagtccaaggtagatgcaggaggagcaggaaggcaagttggccaggcagggcagccaacccactgctcccgctttgtcctctgcagggcagtatgcttcttgtggccaaggtctggtggtgcccttggaagtgcctctggttagaaatggggcttgttcccagctaccttctccctcagtcyccttcctgccagaggtaggtttgcatggggatgggagagaggacgtgtaggatgcattccagggctcgaagcaggagcccacatcctgccattctctgccaatcctcatctggattggactctgggaagggctgcaggagtggggtccagctggagtcagctctgcctcctctctggggaggattgttggggtcttgctagctgctgtctgggttggggaagctgtgccaggtgagcttggcacaccagcctctactgctctgtagcggggcctcttccagccactctctggggcccgag

SEQ ID NO: 1651 - DNA, 601 bp, Human
cacaagaatcgcttgaaccctggggatggaggttgcagtgagctgagatcataccacagcactccagcctgggtgacagaataagactctgtctcaaaaccaaaccaaaccaaaaactcactgaactgaatacttaatgtacactgcatttttattgtatgtaaattatgccttagctacaaaaattccttctaggcaagaaagaaaggaagggccactcttcttcttacccatgttctttttagttttcccaactacgtgtccatttggatgccttgccctcagcctttccctccctccygcgcctaccctccctcggctgagaagcccaaagctggacacatggtctgtgtctggccgaggccgaccacacaggatgtcaggacgagggggactctaatttgaagctccgtggaggctccaggctgtgagggctgaatcacagacagactttcttatgtgtcgtcttctctggagattctctggataaacccattccttcacacgagctttcattcatttacgcatccagcgttctgtgagcagttgccctgcatcctgactgtgctaggtctttcgaagctagagatgaatcaacagt

SEQ ID NO: 1652 - DNA, 601 bp, Human
actcagaaggctgaggcaggagaatagctgtaacctgggaggcggaggttgcagtgagccaagatcaggccactgcactccagcctgggtgacagagcgagactgtctcaattgaaaacaaaaacaaacaacaaacaaacaaaaaaggccgggatggtggctcacacctgtaatcccagcactttggatggctgaggtgggtggatcccctgaggtcaggagttcgagaccaccctggccaacacggtgaaactccatctctattaaaaatacaaaaattagccgggtgtggtggtaggcmcctgtaaccccagctactcgggaggctgaggcacaagaatcgcttgaaccctggggatggaggttgcagtgagctgagatcataccacagcactccagcctgggtgacagaataagactctgtctcaaaaccaaaccaaaccaaaaactcactgaactgaatacttaatgtacactgcatttttattgtatgtaaattatgccttagctacaaaaattccttctaggcaagaaagaaaggaagggccactcttcttcttacccatgttctttttagttttcccaactacgtgtccatttg

SEQ ID NO: 1653 - DNA, 601 bp, Human
gtgtgacctcacagcctgtgtccacggggaaggcacttactatgctcttgctgtcctcggcgaaggttgctttgacaaacatggggcccaacgcaaagcccaggttgttttctgtgtcactcacgcaaaacttccagcgaggaagacaggtctggaaaacacaagtcagggggctcgctgggccccagccctttgtttcccaacccctttcttgctgggaggtagcaccatgtggggcccatgctttgttctggaagttcagggagagctttccgacccagtaaagttattttagtcaccrgaccaagaggccactgataccctcactcccaccccctgccatttcctgaatgccaggctctgtgctgggacttcacaaatagtgtcccgttgagccattcaatgaccctcggggcttacaagccgtttgactgatggggaaacacactcggcacggagcagctgctggcccagggtgccccacgagtgacaagtgttgttggaatgagaactgagacgtgcctgactccacatcctatgctcctacctacccccatctcgtcctgcctcctgggaagagcaggagtcctggaggcaaaga

SEQ ID NO: 1654 - DNA, 601 bp, Human
taatctccaggatgatctcggtggcctgaggagatacacatcacagcagtaaggtctgcgcactggtctcaggtaaatgcaacaggcaccccgtgcagaacaatgatggccagagattaaactcaattttccaagcgtcaggctgggtgagaaggggagccacagctgtgcttccaaaccacgctcctaacgtgaacaccctgcaagacaggactggccttccacacacagggctccatgctccaataagcttaggatgagcttcgggaaagttggaaaagtctctgctgtggtacttttyagagcctttaatatggtaataataggcaccgtgattcttccagagaggggagaagacacagcctctcccagccttattgccttattggaccacagcattcctttttgatggagcgggctttaagatctagagtactcatgttccgaggagcagcttcggaaataccatgctcaggctggatatagacaggtgttcttgagggagacaatgtcatgagcagacaagctcgaagatggaaagttgaaggttctagagaaggggaaggcagagctgtgcggcaacaagagcagaggggccagc

SEQ ID NO: 1655 - DNA, 601 bp, Human
tcactttcccaagggaagtcttccctgactcccatcccactggagggtgccagagccttcccgacccacgggacgtgctgcgttttcctgcaccttttccccgtacactcagcgaggtttgtcttctacagacatccaagcaatcatgtgcttgaggcctaccccgaatcctgctaggcctagaccgctcacccgctgaaggcgagacagcatccaggctgtgctgccggacagaactggcctcaccgggcgcggtggcttatgcctataatgccagcgctttggcaggccaaggcgggtsgatcacctgaggtcgggagtttgagaccaacctgacccacatggagaaaccccatctctactaaaaatacaaaattaaccgagcgtggtggcgcacgcctgtaatcccagctgctcgggaggctgaggtgggagaatcgcttgaacccgggaggcggaggttgcggtgagccaagatcgcaccatagcactccagcctgggtaacaagaacgaaactctgcctcaaaaaacaaacaaaaaaaccggcctctccttcccccaccctcctctatctgtgctggacgccgcagcaccccctcc

SEQ ID NO: 1656 - DNA, 601 bp, Human
aggatgtgcctacagcagtgcctgggcccaggcaagaaatatctcccatgttgtccaatagaacctcctgcgatgatggatgttctgtgctctatgcctgcgctgtccagtatggcagactactaagcatttctttctttcttttttttttgagacgggaatcttgatctatcatccaggctggagtgcaatggcacgatcttggctcactgcaacctccacctcctggtttaagtgattctcgtgcctcagcctcccagagtagctgggattacaggcgcatgccaccaagcccagctartttttgtatttttagtaaagacggggtttcaccacattggccaggctggtttcaaactcctgacctcaggtgatcagcccaccttggcatcccaaagtgctgggattacaggcgtgagccaccacgcccggccactaataagcatttcaaatgtggcaagtgtggcttttaaatttaatttaaactaatttaagttttaattatttaaatagccacctgtggctagtagctaccatactagatctcataagtaaagtagaaatctatctgaactgtcaagggcatcactgtacacccttt

SEQ ID NO: 1657 - DNA, 601 bp, Human
tcttccaagacaggaagccaagggctgtcatggttaagagattaatctgcaggctggagaccggaatgcagggcttggggctgcagggtcagctcttctcttggccttcaccctggggcacgagatggaatgacaccgttgcaggatgtgcctacagcagtgcctgggcccaggcaagaaatatctcccatgttgtccaatagaacctcctgcgatgatggatgttctgtgctctatgcctgcgctgtccagtatggcagactactaagcatttctttctttcttttttttttgagacggkaatcttgatctatcatccaggctggagtgcaatggcacgatcttggctcactgcaacctccacctcctggtttaagtgattctcgtgcctcagcctcccagagtagctgggattacaggcgcatgccaccaagcccagctaatttttgtatttttagtaaagacggggtttcaccacattggccaggctggtttcaaactcctgacctcaggtgatcagcccaccttggcatcccaaagtgctgggattacaggcgtgagccaccacgcccggccactaataagcatttcaaatgtggca

SEQ ID NO: 1658 - DNA, 601 bp, Human
ggtgccagatcggctccgctccagaggccaggctcaccctgccaacaggctgggcaggctcaagcccatcccagctcctagctgggccatacttcttttgcccttggtttcttcatctgaaaagtgggataacaagggcatccactcttcagacggctctcgtgatagctgatcgggtgcacagtgagggtgcaatgaaggccagttcgtcccaaggcttgcccacaggtggggagctggcaccttgccggcagggcctgggggaactcactgatctctgttgggggctttcctgagctgrtcggcagtgaccctccatgagaagttgaaaaaccgcatggcattttcaaagtagaggtctggaactgcagtgtactagaaaagaagaagtggagtcaatcacagtgtgccctcggtggtgtgcatcttccaagacaggaagccaagggctgtcatggttaagagattaatctgcaggctggagaccggaatgcagggcttggggctgcagggtcagctcttctcttggccttcaccctggggcacgagatggaatgacaccgttgcaggatgtgcctacagcagtgcctgggcccaggca

SEQ ID NO: 1659 - DNA, 601 bp, Human
attgcaggcctgagctactgtgattgacctgaggagacagtaataaaaaggacaaagaccaggtctcattctaggttatcctgatttaaggtcaggaagctgtattttttttttttttttgagatggagtcttgctctgtcacccagactggagtgcagtggcacgatctcggctcactgcaacctccgcctcccgggttcaagcaattctcgtgcctcagctactcactcctgagtagctgggactacaggtgtgcgccaccacacccggttaatttttgtatttttagtagagacaggkttttgccatgttgaccatggctggtctcaaactcctgggttcaggtgatccacctgtcttgccctcccaaagtgctgggattacaggcgtgagccaccacgcccggccaggaagctgtatctttgaaaaagttccccagaggactctgatgtgcagtgagctttgggaagcacagctgtcaagcccatccagaaccttccccaggcctctgtgggctccctgtcctgagatcccaccattcgtggtagtgaggaacaatgggaaagctgctcttgctggggcctccttggggtctggcgc

SEQ ID NO: 1660 - DNA, 601 bp, Human
caggctggagtgcagtggtacaactgtagctcaccgcaacctcaacctcctgggctcaagcgcatgctaccacgtccagctaattttttaaattttttgtagagatggggtttcaccatgttgcccaggctggtctcaaacttctgagctcaagagatcctcccaccttggcctctcaaagcgttcgaattacaggcgtgggccgctgtacctggccatatggaggaatttaaaacatcatatttatattcaaataatcacaaatacttcaatgggtaggcaaggaaatttaaataaaaamattcaagctaagttaaaatacttcagataaactggcaacagagcctatgccatgttctgaaggtaaaagcccaccttcttgtacatagcggggtgtcctggttggaggctggaaatgaaggaaatagagatgtttgaacccctatagtccaccagggggcaccagaggcaaagagaagttgattgcacccttccctaagatttatcccaaatgtttgcactgaggaatggaaggaccttggactgaagactggaactgggctgactacatctaatttttttgaggagacagttttttttt

SEQ ID NO: 1661 - DNA, 601 bp, Human
gagtaacattaaatccacatataaagcattctgcttctttcctggaaccctgttggtacttttaggatgactggtaaactatggaatttcagacgtggacatctggcagacattttctttaaaatgaataaagtgagcttatcacctcaaggaaaacaactcaagccatctgttgccaatgataaaaatatgagatttaaaaaaatgttgaagtttcaggctaaaattaaaattttgaaaaacttatattggccaccacaagtttgacaccttaccaataataatggaaggtttttctcawgaggtcagcagtgatattaacaaatgtggatttttttgctattgtatattggaagtataaccatttggaagatctgtaagactcagtgaaccattgttttccaaatgactaagacatgatgttacaaaatcacgcctgggtaaaagatccattcaaagtgcaggacagaccaatggaatttagtgtaacagagtatgaaagttcatgaaggctgggcatggtggctcatgcctgtaatcctagcaccttgggaggccgaggtgggaggactgcttgagcccaagagtttgagaccagcct

SEQ ID NO: 1662 - DNA, 601 bp, Human
atgttacagaggtggagtaacattaaatccacatataaagcattctgcttctttcctggaaccctgttggtacttttaggatgactggtaaactatggaatttcagacgtggacatctggcagacattttctttaaaatgaataaagtgagcttatcacctcaaggaaaacaactcaagccatctgttgccaatgataaaaatatgagatttaaaaaaatgttgaagtttcaggctaaaattaaaattttgaaaaacttatattggccaccacaagtttgacaccttaccaataataatgraaggtttttctcaagaggtcagcagtgatattaacaaatgtggatttttttgctattgtatattggaagtataaccatttggaagatctgtaagactcagtgaaccattgttttccaaatgactaagacatgatgttacaaaatcacgcctgggtaaaagatccattcaaagtgcaggacagaccaatggaatttagtgtaacagagtatgaaagttcatgaaggctgggcatggtggctcatgcctgtaatcctagcaccttgggaggccgaggtgggaggactgcttgagcccaagag

SEQ ID NO: 1663 - DNA, 601 bp, Human
ggctctgtgtggataagggtgtggtcatggcctgagtctccagcaaggcccctgaagccagagggaggctgggcacagtctgtgtggtcagctgtgcctattgggcaccatgcgctgtgctagatgctctacagacctaactgtcctcttcagtcattgcgaaagcgttagcaatggtcgccattgaccagctctatttatgagtagaccaaggctgggaatgggtcaattgctttgcccaaggaccacacaatcatccaatagcagacctgggattcaaactgagacagcagccttaacyctccccactccccagctctgactgtgttataacattgtcagaggggcgtttccctgaggtagggctcttgattccatgagatgctcccaataccccactgtgcagggcttccagatctcactggagggaaggaaagtgggtgaggatgttgcttcctctgcaacatctctgacatctgcaacctggagcactggggcaaagatcacatggtgagactggcttaggtcgtatgggccccagggctgggctgggggaaaagaattggggtaggggccccagaggcagcctacttgggtgagg

SEQ ID NO: 1664 - DNA, 601 bp, Human
gcccagctggaattcgtaccttgatcatcaaaagcatgagtcagctcatggcccacgacgacacctatgccaccaaagtttaaggccctggagggaaagacacaaaggtagagatgatgctttgagaggagggcctctcactcttgctcaggtatgtgaccctcacttcctgggcttagagatatagcaaaattccacagggctctgtgtggataagggtgtggtcatggcctgagtctccagcaaggcccctgaagccagagggaggctgggcacagtctgtgtggtcagctgtgcctaytgggcaccatgcgctgtgctagatgctctacagacctaactgtcctcttcagtcattgcgaaagcgttagcaatggtcgccattgaccagctctatttatgagtagaccaaggctgggaatgggtcaattgctttgcccaaggaccacacaatcatccaatagcagacctgggattcaaactgagacagcagccttaaccctccccactccccagctctgactgtgttataacattgtcagaggggcgtttccctgaggtagggctcttgattccatgagatgctcccaataccccactg

SEQ ID NO: 1665 - DNA, 601 bp, Human
gccaggctgatctcgaactcctgacctcaggtgatccaccagccttggcctctcacagcgctgggattacaggcataatccatcatgcacagcctaattttttttttagtagagatggaggtcttgctatgttgcccaggctggtctcaaactcctgccctcaagcaatcctcctcttaaagcacggagattacaggcatgagccatcgtgcccagctggaattcgtaccttgatcatcaaaagcatgagtcagctcatggcccacgacgacacctatgccaccaaagtttaaggccctgkagggaaagacacaaaggtagagatgatgctttgagaggagggcctctcactcttgctcaggtatgtgaccctcacttcctgggcttagagatatagcaaaattccacagggctctgtgtggataagggtgtggtcatggcctgagtctccagcaaggcccctgaagccagagggaggctgggcacagtctgtgtggtcagctgtgcctattgggcaccatgcgctgtgctagatgctctacagacctaactgtcctcttcagtcattgcgaaagcgttagcaatggtcgccattgaccag

SEQ ID NO: 1666 - DNA, 601 bp, Human
gcagaggcagtggggcctggaagatgattggcccagtctaaaggggaccaaggaacctgtaccaggcagtggtgcaatcataatcatagttcactgtagcctcaaactcatgggctcaagtgagcctcccacctcagcctcccaagtagctaggactattaaaattttgccaccacacctggctaaatttttactttcttagtagatacaattttattttattttattttttgagatggagtctcgctctgtcacccaggctggactgcagtggcgcaatctcagctcactgcaacctccrcctcccagattcaaacgattttcctgcctcagcctcctgagtagctgggattacaggcacccgccaccatgcccgggtaatttttttatttttagtagacagggtttcgccatgttggccaggctgatctcgaactcctgacctcaggtgatccaccagccttggcctctcacagcgctgggattacaggcataatccatcatgcacagcctaattttttttttagtagagatggaggtcttgctatgttgcccaggctggtctcaaactcctgccctcaagcaatcctcctcttaaagc

SEQ ID NO: 1667 - DNA, 601 bp, Human
tgggggcctggagaaatgacagcgcttgctaaacttcatataatcggcaggtggcagagcaaggatttgaacccagatccttctgcctccaaagctaagacccttagaagtgaaggatgcagaaagcagaggcagtggggcctggaagatgattggcccagtctaaaggggaccaaggaacctgtaccaggcagtggtgcaatcataatcatagttcactgtagcctcaaactcatgggctcaagtgagcctcccacctcagcctcccaagtagctaggactattaaaattttgccaccayacctggctaaatttttactttcttagtagatacaattttattttattttattttttgagatggagtctcgctctgtcacccaggctggactgcagtggcgcaatctcagctcactgcaacctccgcctcccagattcaaacgattttcctgcctcagcctcctgagtagctgggattacaggcacccgccaccatgcccgggtaatttttttatttttagtagacagggtttcgccatgttggccaggctgatctcgaactcctgacctcaggtgatccaccagccttggcctctcacag

SEQ ID NO: 1668 - DNA, 601 bp, Human
ctcccgtcctgtgggtcagagggaggcgtcatgtcaagggagggaggggcacagcagggacctgctgctcctccctgctcctggtgagaagcggttcatccgtccacccccgtcctccagccaccatggggagacgaggtccctgtgagtgccgagggacgtggatgtggtggccagtcagaggcgggagaggatgaaggagagaaatcgggaaaagctccagcgtggcccgaggctcagtggggcttgctttgttttctttcttttttttttttttttgagacagtctcactctgccacycaggctggagtgcagtggcgcaatctcagctcactgcaacctttgcctcctgggttcaaggaattcttgtgctcagcctctggagtagctgggattacaggcacatgccgccatgcctagctgatttctgtttttttttttagtagagatggggtctcaccatgttggccaggctggtcttgaactcctgacctcaagtgatctgcccacctcagcctcccaaagtgctgggattacaggtgtgcgtcaccgtgcctggcttattttcaacactggctaagggcccctgaccctgagtaa

SEQ ID NO: 1669 - DNA, 601 bp, Human
tcttccaccatggccggaggttcccgtccttgtcatactcccgtcctgtgggtcagagggaggcgtcatgtcaagggagggaggggcacagcagggacctgctgctcctccctgctcctggtgagaagcggttcatccgtccacccccgtcctccagccaccatggggagacgaggtccctgtgagtgccgagggacgtggatgtggtggccagtcagaggcgggagaggatgaaggagagaaatcgggaaaagctccagcgtggcccgaggctcagtggggcttgctttgttttctttcttttttttttttttttgagacagtctcactctgccactcaggctggagtgcagtggcgcaatctcagctcactgcaacctttgcctcctgggttcaaggaattcttgtgctcagcctctggagtagctgggattacaggcacatgccgccatgcctagctgatttctgtttttttttttagtagagatggggtctcaccatgttggccaggctggtcttgaactcctgacctcaagtgatctgcccacctcagcctcccaaagtgctgggattacaggtgtgcgtcaccgtgcctggctta

SEQ ID NO: 1670 - DNA, 601 bp, Human
tctctcgtggcctctgttactaactctcccatctgactccgcgagcatctctgagtgtctctctgggtcagcccgtgtctaaatcatcttgttttatcttcccaacaacccaataatgcaggtagtagctaatcagagccaagtcaagtgaggctcaaggaggttctgtgacttactccagaaccgggacttgaacccagaactggctccacgaccagtgctccttgccctggctgcttagtcctcaggggcctcccagacccacagctggctgacttggtggtagcttcccctgcagagrtgagaacaggcaggctcttcaggcggatgaagcccgagccccttcctgtgtctttgtcaggccagactcagagcacaaagccttctggtgccaagccctgtggtgggggagcctccacggtcggcatcgcgattggtcctcgccacccccaatttcgcagaagaggaaacggaagctcgcacggctgctgcgcctgccctggttgtccgtgatgatcctctacggacaggcatctggaaggagccagcactgggaccgtgcgcgtgtggggagcggggctctcacccgataggccgcctt

SEQ ID NO: 1671 - DNA, 601 bp, Human
ccaagcctggcacttaagaaggcctcaataaatgacagctctatggatttctgctcttactgccgtggttgggaggaagccctgtcttaatctctctgacagacacctactgtttttctctcgtggcctctgttactaactctcccatctgactccgcgagcatctctgagtgtctctctgggtcagcccgtgtctaaatcatcttgttttatcttcccaacaacccaataatgcaggtagtagctaatcagagccaagtcaagtgaggctcaaggaggttctgtgacttactccagaacygggacttgaacccagaactggctccacgaccagtgctccttgccctggctgcttagtcctcaggggcctcccagacccacagctggctgacttggtggtagcttcccctgcagaggtgagaacaggcaggctcttcaggcggatgaagcccgagccccttcctgtgtctttgtcaggccagactcagagcacaaagccttctggtgccaagccctgtggtgggggagcctccacggtcggcatcgcgattggtcctcgccacccccaatttcgcagaagaggaaacggaagctcgcacgg

SEQ ID NO: 1672 - DNA, 601 bp, Human
caggagttcatgaccagcttgggcaacatggcaagaccccatctctacaaaaaattaaaaaaaaaattaaccagggatggtggtgtacacctatggtcccagctcctggggaggctgaggtgggaggatcactggagctggagaagtcaaggctgcagtgagctgtgattgtgccactgcattccagcctcggtgatagagtgagatcctgtctcaaaaagcaaaacaaggttgggtgtggtggctcatacctgtaatcccagcactttaagaggccaaggtggcggtggatcacttgagrccaggagttcgagaccggcctgacaaacatggtgaaaccctgtctctactaaaaatacaaaaattagatgggcgtggtggtgcgtgcctatatcccagctacatgagaggatgaggcaggagaatcacttgaacccgggaggttgaggttgcagtgagccaagatcacaccattgcactccaggccgggtgactgagggagactccggctccaaaaaaacaaaacccagaaaatacaacaccagggagataagccccccacctgatcctgagatcccggggagtcaggagggtcccctga

SEQ ID NO: 1673 - DNA, 601 bp, Human
tttttccctgaagatttccagtgtattccacagtgtttaaaaaatagtttccccaaaaatatatcttgaaagcatttgacacagtggtatttgtggcgtatctggcgcttgtcagtgtggggcccaggcctgatgagccaccagcccagcacccgaatgcctgctgaaggtggcgcacacgtgtgcctgggatgtccggctcttcacaggggatcagactgcgggtcacgttgagagccaacaccatgggctcggttccggctgaaaacccgccagtgtgaggaagcagggccccgggtgkccaagcgggctgagcaatgccctggaggctggatgggggtctcgtcctcagccccttcccctcctccgtcttggctctctccgcttcgtccttaccagacttcgcacttgtgaggcgggttcatgggtgagccaggtgggcagcggaagtgttctgagaactccttggaattggagagggagccgatgacccggaagcgagaggggctgtggggatcggtgatgaggccttcgtgggagctctcaggtgtgcggacggagcaccagacctttgaaggggcaacagggagaggccagggtc

SEQ ID NO: 1674 - DNA, 601 bp, Human
caaccttaattagtctagagtgccctcccattcttccttgttcagtcctttgggccacctgattatggctgtagccagaagtatctcagtggtggagatcaggtgaacagtgctggcctccagatcccagggcagagctcctcagtgcccctggctgtgagaaccaccagacatatggtgagtaagaaaaaactcaggggataacctgataccataaattacttctagagaaacaatcctcactaactctaatcactcattggacattcctaaccttccaggatggttaaaaaaaaaaaaacaccagtactggacatccaaaatttgtcccccaagttccatctgactgggtccacacaggtgctgagtatggacacaggaactgagctgatcaggaaacgcaatcactggaggaagtttctaagacagaaatctgagccatataattactgcaaaaagcaggtcaatctttaggattaagctttagaaaacaaatgtaattctaatctcagaggggtaagaaaatggaggactctgttaaggacaaaaaccactcggggctgccatctttactggaagtatccaaaagcaccaccatccc

SEQ ID NO: 1675 - DNA, 601 bp, Human
atgactttgtctagtcctgacacaggcacatgccacagtcacagagcacccaagctgctctaactgaacagccataatggcccattgtacatttgggacctgcatctaattatactgatatgaaaattcatgtgtgtcattgttaactttagactgaaaagacaaccttaattagtctagagtgccctcccattcttccttgttcagtcctttgggccacctgattatggctgtagccagaagtatctcagtggtggagatcaggtgaacagtgctggcctccagatcccagggcagagcycctcagtgcccctggctgtgagaaccaccagacatatggtgagtaagaaaaaactcaggggataacctgataccataaattacttctagagaaacaatcctcactaactctaatcactcattggacattcctaaccttccaggatggttaaaaaaaaaaaaacaccagtactggacatccaaaatttgtcccccaagttccatctgactgggtccacacaggtgctgagtatggacacaggaactgagctgatcaggaaacgcaatcactggaggaagtttctaagacagaaatctgagc

SEQ ID NO: 1676 - DNA, 601 bp, Human
caggtgctcctggcctcacacctgaaggggagagagcttccccaagcaaatgactttgtctagtcctgacacaggcacatgccacagtcacagagcacccaagctgctctaactgaacagccataatggcccattgtacatttgggacctgcatctaattatactgatatgaaaattcatgtgtgtcattgttaactttagactgaaaagacaaccttaattagtctagagtgccctcccattcttccttgttcagtcctttgggccacctgattatggctgtagccagaagtatctcagyggtggagatcaggtgaacagtgctggcctccagatcccagggcagagctcctcagtgcccctggctgtgagaaccaccagacatatggtgagtaagaaaaaactcaggggataacctgataccataaattacttctagagaaacaatcctcactaactctaatcactcattggacattcctaaccttccaggatggttaaaaaaaaaaaaacaccagtactggacatccaaaatttgtcccccaagttccatctgactgggtccacacaggtgctgagtatggacacaggaactgagctg

SEQ ID NO: 1677 - DNA, 601 bp, Human
ggacccacaccaggtgctcctggcctcacacctgaaggggagagagcttccccaagcaaatgactttgtctagtcctgacacaggcacatgccacagtcacagagcacccaagctgctctaactgaacagccataatggcccattgtacatttgggacctgcatctaattatactgatatgaaaattcatgtgtgtcattgttaactttagactgaaaagacaaccttaattagtctagagtgccctcccattcttccttgttcagtcctttgggccacctgattatggctgtagccagargtatctcagtggtggagatcaggtgaacagtgctggcctccagatcccagggcagagctcctcagtgcccctggctgtgagaaccaccagacatatggtgagtaagaaaaaactcaggggataacctgataccataaattacttctagagaaacaatcctcactaactctaatcactcattggacattcctaaccttccaggatggttaaaaaaaaaaaaacaccagtactggacatccaaaatttgtcccccaagttccatctgactgggtccacacaggtgctgagtatggacacagg

SEQ ID NO: 1678 - DNA, 601 bp, Human
gaattgtagtccaacatccttacaaaaacccacacaggttccttctcaggttgggaatggaactgatatgacatcagtaaagaaaagactgccagacaaggtggctcacgcctgtaatcccagcactttgggacgccgaggtgggtggatcgcttgaggccaggagtttgagaccagcctggccaacacaatgaaaccccatctctactaaaaatacaaaaattagccaggtgtggtggtgtgcgcctgtaatcccagctactcgggaggtgaaggttgcagtgagctaagatcgtgccaytgcacactccagcctgtgcaacagagtgagactgtctcaaaaaaaagaaaaagaaaaagaaaaagaaaagattgctactgatggaactgggtgctttgaaaactcagccaagcagagtctcctccagtagaaaaatgtctttaatgacagcatgccccgatggcatgcttgtaatttcacaagggcccaaatgagtctatcaggaccagaggtatctagaagctgtgacactatgaatgcacaatagcacctcaggaatgagacttctgagtgacatcagaggaggggaggttgggcact

SEQ ID NO: 1679 - DNA, 601 bp, Human
agggcgggggaaggggatggtgagaaacctctgaaaagcaagagtaaacttttaaaactgatcatatggtggctagaaaatgctgggccaccaactacaaaagaactgcaggggaaagccagtttaatctgttcatgtgttagccctacgaattgtagtccaacatccttacaaaaacccacacaggttccttctcaggttgggaatggaactgatatgacatcagtaaagaaaagactgccagacaaggtggctcacgcctgtaatcccagcactttgggacgccgaggtgggtggatcrcttgaggccaggagtttgagaccagcctggccaacacaatgaaaccccatctctactaaaaatacaaaaattagccaggtgtggtggtgtgcgcctgtaatcccagctactcgggaggtgaaggttgcagtgagctaagatcgtgccattgcacactccagcctgtgcaacagagtgagactgtctcaaaaaaaagaaaaagaaaaagaaaaagaaaagattgctactgatggaactgggtgctttgaaaactcagccaagcagagtctcctccagtagaaaaatgtctttaatgacagc

SEQ ID NO: 1680 - DNA, 601 bp, Human
gaagcatgttccatgacataagagacctggcaccaccctggagatgcaatattccaccaacgaaatgagctgctctactcagacatgaagacatggtgaaaacttccagtagtgcccaaggccacaaatgtgaatgtcaggatgctcagaaaacaaacaagatactgatggggtcacgaattcacttctcctccaggtccttacaggaaccatcgacttttcattctaatatgaatggatgatgctgtgatgttgcaaaggacatgggaatcctgcacatcgtagctttgattatgtgtttaaatgtgcaacaacaattatacctagtaattacatgcatttagatatttagaaacagcaataaagacaagaaaaacaaaaggccacacagaatagttattagtactaataaaattattgggaccaggcacagtagctcacacctgtaatcccaccactttgaaaagccgaggcggtggtgggggtcacgaggtcaggagatcgagaccagcttggccaacatgatgaaaccccgtctctactaaaaatacacaaattagccgggtgtggtggcatgagcctgtagtcccagctacttggg

SEQ ID NO: 1681 - DNA, 601 bp, Human
tagtaacatccatactataagatattatgcacctattgaaaaggcataggcagtgctacaggtggaagttgatccaagaaaaattgttaagagtacagaacaatgttactgtccatgtcattgtatgcagaaaacatattttattttgacatacatatctgtttatatctgcataaaatatctgtggaagaattcataagaagctggtagtgtggttccttatgggaatcccggggggaagaggtgtttattttcactgtaaccccttgtagtggctgaatagtgtccctccaaaatgcaygtccacctggaacctcagaatgtgattatttggaaatagcaactttgcagacgtaattagcaaagaggaggtcttgctggattggggtgggccctaaatccagtggctggtgctatgaactgaattggtccccctccaaattaatatgctgaattcataacccacgatgtgactacatttggaggtaggacttttaggaggtaattaaagttaaatgaggtcataaggctgagtgagaccctaatccagtaagattggtgtcttataagaagaagaagagagatctctctccaggtgcat

SEQ ID NO: 1682 - DNA, 601 bp, Human
atgggtaatcaagggtcaattatatgaactaatatgtccaatcccaccatatctcaaatcctactaataaatgcccatgacagttaagaaaactgtttattaacccataatcaagctcaaatttatcttccagacacagttggaaccaacagtgacatcctccctctgtacttgggaaactcacttgtatctagaacacggatgccgatgggggctgactcctcctccgtcagccggtaccattccttctgagggctgggcagccactcctccacatggcaggagtaattgcctgtatctygggggcttgcctgcagcactgtgagccggtagagcaccggggagagcctctggaagcgaagcctgccctcccaaggactgccctctgggccaaagacagcatctgggcccacgctcagcagggccgtccgctctgttgggtcgtcgtcgtcgtcgtcgtcctcctcctcctcctcctccctttcctcttcctgttcttccaggccagggctgctccttttccccccagctttagtcctcagggaataccaggccacagcgaagcgggagtcctggctggagcgggacacgatgctacagt

SEQ ID NO: 1683 - DNA, 601 bp, Human
gcagccggcactccaactggaccgtcaccaacacccgcttctctgtggatgaaggtgcttttcctcccttgacttagaacatggctctgaagtcccttccagccaggaactctagtctagagcttttctgtctattaccatagctcaccatgtctgccagcctccctggccggagaactagttgcccaaacagggcaggactttggagaatgttagataaaaatagcccaagttgtttgagatttaaaagggaactggagttgtttatcctacagaagagaggtcttggggtgggttgggrcagctgagtcaccaggtccaggcctgtgaacttgttttttcagggagggttcagggagaggaagcgaatccatgaacactcagcatagggcagcaagcagtaggcagaatttgggtgaacgccccgcttctttaggggtgaacacccaggggtcatccctttgaaatgggaagtgctactaaagagaagttatggatccctctctggagaggtaagaggaaaggataagcccccaactcagtgggatttttcatcccaccagttgggattgagaaagttttgtgtgcatggagacctcgc

SEQ ID NO: 1684 - DNA, 601 bp, Human
tctacatgtttatgaggtacagtgttatgtatacataatacatgtataccttgtggaatgatcaaatcaaggtaattagaatatctatcacctcaaatatttagcatttctttgtgccaaaaacatttaaaatattatctttcagctattttgaaatatacagtccattattattactacagtcaccttgccgtgcaataggcaccagaacttattcctcctgtctcactgtaacttggtacccctctccttgttccctatccacttctcccacctgcctccttccagcttctggtaaccrcttctactctctacttctatgaattgaattctaaaagaattctacttagattctatacataagtgagatcttatggcatttatctctttgcacctggcttatttcgctcatgatgtcctctaggtccatctgtgttgtcccaaatgagagtttccttttttttcaatttgagacaaagtcttgctctgtcacccaggctgcagtgcaatgtcttgatctcatctcacttcaacctccgcctcccgagttcaagagattctcttgcttcagcctccttagtagctgggattacaggcacgt

SEQ ID NO: 1685 - DNA, 601 bp, Human
cctccttccagcttctggtaaccacttctactctctacttctatgaattgaattctaaaagaattctacttagattctatacataagtgagatcttatggcatttatctctttgcacctggcttatttcgctcatgatgtcctctaggtccatctgtgttgtcccaaatgagagtttccttttttttcaatttgagacaaagtcttgctctgtcacccaggctgcagtgcaatgtcttgatctcatctcacttcaacctccgcctcccgagttcaagagattctcttgcttcagcctcctkagtagctgggattacaggcacgtgccaccatgcccggctaatttttgtatttttaatagagatggggtttcaccatgttggccaggctggtctcggactcctgacctcaaatgatccacccgcctaagcctcccaaagtgctaggattacaggcgtgagccactgggccgggcctcagtttcctatttttcaaggctgaataggattctgttgtatatacataccacatttaaaaaacccattcatccattggtgggcatttccatatcttggctgttatgaataatactgcaatgaacg

SEQ ID NO: 1686 - DNA, 601 bp, Human
gagccactgggccgggcctcagtttcctatttttcaaggctgaataggattctgttgtatatacataccacatttaaaaaacccattcatccattggtgggcatttccatatcttggctgttatgaataatactgcaatgaacgggggatacaggtatctcttcaatacactaatttcaatatctttcgatatatacccagtagtgggaattgctggatcacatggtagctctatttttagattttcgaggaacatccatactgttttccataatggctgagaaattcaccaccagcgacrtgcaagggtttcccttttcaccacatccttgccaatgcttgttacttccatcttttggataatagccaatctaacaggtgtggagtggtatctcattgtggttttaatttgcatttctctgatgattagagatgttgaccattttttcatgtatctgttggtcatttgtatgtcttcttttaactgtctattcaagtcctttacccattttaaaaacaggtttatttgttttcttgttattaagtagtatgagttccttgtatattttggatatgaaccccttattcaatgaacatttgt

SEQ ID NO: 1687 - DNA, 601 bp, Human
actgttttccataatggctgagaaattcaccaccagcgacatgcaagggtttcccttttcaccacatccttgccaatgcttgttacttccatcttttggataatagccaatctaacaggtgtggagtggtatctcattgtggttttaatttgcatttctctgatgattagagatgttgaccattttttcatgtatctgttggtcatttgtatgtcttcttttaactgtctattcaagtcctttacccattttaaaaacaggtttatttgttttcttgttattaagtagtatgagttccttrtatattttggatatgaaccccttattcaatgaacatttgtaaatattttccacccattcatagattgtgtcttcactctagtggttgtttcttttgctgtgcagaagctctttagtgtgatgcaatcccatttgtctatttttgcttttgttgcctgtgctttagggatcgtatccaagaaatctttgcccagaccaaagtcttagaactttgccccaggttttcttctggtggtttttatagtttcaggtgttacatttgtctttaatccattttgtgttgattgttgcgtaagaggtg

SEQ ID NO: 1688 - DNA, 601 bp, Human
agggatcgtatccaagaaatctttgcccagaccaaagtcttagaactttgccccaggttttcttctggtggtttttatagtttcaggtgttacatttgtctttaatccattttgtgttgattgttgcgtaagaggtgagacaaagatctattttcattgttctgtttgtgaatatccagttttcccaacaccatttgttgaagagactgttcttttcccattgtgtgttcttggcccctttgttgaaaatcaattgtgggtttatttctgggctgtccatcatattccattggttgatgcrtctgattttagggtatatgtatttttaatgtgctccccaagaagtccttacattctgctgcattgacaaacccgtggccaagttttaggcctaggttctaattaagcttaattctggaggcaaagtctcggcggggacacccaggccctcctcagccctcaagtctcatggtattcccccccaccccaactccatttagtgactctgacagttggcagtgtgaacctagagatccacaatggcttcatcctcgggaagattcagctacccaggcccaagatggcccccgcaaatgacaca

SEQ ID NO: 1689 - DNA, 601 bp, Human
tttatagtttcaggtgttacatttgtctttaatccattttgtgttgattgttgcgtaagaggtgagacaaagatctattttcattgttctgtttgtgaatatccagttttcccaacaccatttgttgaagagactgttcttttcccattgtgtgttcttggcccctttgttgaaaatcaattgtgggtttatttctgggctgtccatcatattccattggttgatgcatctgattttagggtatatgtatttttaatgtgctccccaagaagtccttacattctgctgcattgacaaaccygtggccaagttttaggcctaggttctaattaagcttaattctggaggcaaagtctcggcggggacacccaggccctcctcagccctcaagtctcatggtattcccccccaccccaactccatttagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacggtat

SEQ ID NO: 1690 - DNA, 601 bp, Human
ggttgatgcatctgattttagggtatatgtatttttaatgtgctccccaagaagtccttacattctgctgcattgacaaacccgtggccaagttttaggcctaggttctaattaagcttaattctggaggcaaagtctcggcggggacacccaggccctcctcagccctcaagtctcatggtattcccccccaccccaactccatttagtgactctgacagttggcagtgtgaacctagagatccacaatggcttcatcctcgggaagattcagctacccaggcccaagatggcccccgcraatgacacatatgaaagcatcttcagtcacttccgagagtatgagattgccattcgcaaggtgccgggaaacttcacggtatggggttccccaaggccccagggccagaactcccttggcttccctgtcccctgggctggaagcacccttgtgtgccattgggaactttgcttatggactaaagggagggtctgggatggtgggtgggcagaggagggagtagaaaccacctcagccctcagagctatgctcttgtgagatgctcctcaaaggaattgcctactagggcaattgggcacc

SEQ ID NO: 1691 - DNA, 601 bp, Human
gttggccatggactagcccctgtgcattgcatctctgattatgaggcacagttattatccccatttcataagtgaggaaactgaggcacagagagattgttacacacagagggccacacagccaggaagagtcagggagggaacccactttcctactgctattagccatgggtgttccacaagagagaaagaaggaaaggccagaagtgctggtcctcgggctgctgccagagtgggccagaggagagaggacactggggggcggtggggatgctgcgccactggagaggggatgctggcrggggacagggaggggctcatggaggaggccaagccctcctcccctcccagggtgtgtcctcttgctacattgtactgacaaatgatacatttgtggcaagccagtctccaaaactcagcttgcaaagattgggcagcattttccaaacctcggcctggtctctggcctggagttcaggccgcattgaagattgcccaccatagcctccatagctggcactattgcatgatggctgagggatcagctgggaaggaaccagctccgtctgcaaggcaggggccccacaactggaaggggaat

SEQ ID NO: 1692 - DNA, 601 bp, Human
caagagagaaagaaggaaaggccagaagtgctggtcctcgggctgctgccagagtgggccagaggagagaggacactggggggcggtggggatgctgcgccactggagaggggatgctggcaggggacagggaggggctcatggaggaggccaagccctcctcccctcccagggtgtgtcctcttgctacattgtactgacaaatgatacatttgtggcaagccagtctccaaaactcagcttgcaaagattgggcagcattttccaaacctcggcctggtctctggcctggagttcaggycgcattgaagattgcccaccatagcctccatagctggcactattgcatgatggctgagggatcagctgggaaggaaccagctccgtctgcaaggcaggggccccacaactggaaggggaatctccagagcgatcctgggatctctagggaaaacaagacgagagacaagtgcagtggcacaatctcagctcacttgcagcctcaccctctcaggttccagtgattctcctgccttagcctcccgagtagctgggattacaggcatctgccaccatgcctggctaatttttgtatttttag

SEQ ID NO: 1693 - DNA, 601 bp, Human
atttgtggcaagccagtctccaaaactcagcttgcaaagattgggcagcattttccaaacctcggcctggtctctggcctggagttcaggccgcattgaagattgcccaccatagcctccatagctggcactattgcatgatggctgagggatcagctgggaaggaaccagctccgtctgcaaggcaggggccccacaactggaaggggaatctccagagcgatcctgggatctctagggaaaacaagacgagagacaagtgcagtggcacaatctcagctcacttgcagcctcaccctcycaggttccagtgattctcctgccttagcctcccgagtagctgggattacaggcatctgccaccatgcctggctaatttttgtatttttagtagagacggggtgttgaccaggctggtctcgaactcctgacctccggtgatatgcccacctcggcctcccaaagtgctaggattataggcatgagccaccgcaccctgccccttctgtacttttggatcacagaactgacttgtccttgagggttttttctcttcaggataaatatagctcaatcccttcatctgatgatcgtagtcatt

SEQ ID NO: 1694 - DNA, 601 bp, Human
gtgccagctcagtttagactctggagacagggtagtaaacaacactagacagttcctgccctcaaggagtttgtgttcttttgggaatgtggagtaagtgagtgtgtgtatggtgagagacgaaaacaaacaagtaaaataattctaggaacaaagtgctaggaagaagtaacagggttaatgtggagagagtggcaggagtactgctttaggcaaggtattcaggaaggctttgctgaagaagtgacatctgagctgagacctaagccatgtacaggacacagccatataaagtgccgaragcatttcaagcaggagggagagtgtgtgcaaaggccctgaggcagcacggtgcttgatgtgttctgggacagaaagaacaccagtgtggctagggcagaggggttatgtggcttccttgaaacccttggcaattaacagagagcagccccttcactgtgagttccacacttgtgccactgccccacgctgcagccaccatgttcgcgtgagtcactactcggggaatagaaaacttaatttggtgtcttacatccagaattttagaaaatgaagtaggcaggagggcatagactgggat

SEQ ID NO: 1695 - DNA, 601 bp, Human
cactgggatgggtgctggaaggtgactcctgcttctctcactctgccctctcttccccagctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacrgggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagacca

SEQ ID NO: 1696 - DNA, 601 bp, Human
catgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcrtagggatgtgaggttctgctgaggaaatgggtatgaatgtgccttgaacacaaagctctgtcaataagtgatacatgttttttattccaataaattgtcaagaccacaggaatcgtgtgaaactagtcagattgctgatggcacattggctcatggaggactcggttgttgataatgaggagggtaataatgtgtgggatgtgtgatgtcactttaaggaaacagggctgaggactcaggcttaaatctgacagacccagggagtcctcatgctacctgtattgtgaccttgggcccatt

SEQ ID NO: 1697 - DNA, 601 bp, Human; identical to SEQ ID NO: 1695

SEQ ID NO: 1698 - DNA, 601 bp, Human
atggtgtcggcgccaggtcccaaagaaagggagtgtgctcagcccatgcactaggcggacgtcctagaaagcagccactacacggggtaagagatttttttggacatgagaagtagccgtggcttccatggtaaaaggtaatcaagagactactgcttgatcttttttttttttctttttgagacagagtctccttctgtcgcccaggctggagtgcagtggtgctatctccaaccttcgcctcccgggttcaagtaattctcttgcctcagcctcccgagtatcttgaattacaggcatsagccgctctgtccggccttgcttggtctttctaaggacaaactctccactgcctgggaggacccttagaaatcatctagcagagtgattttcaagtggtgttgggcacagaggggctccttgagaatactcaggaattgctgttggcagcaagaggggttgggggaggtgcaggcccccacctgtgactcggaccagacacccacttttgacttctctcagttactgtattgggttctctggaaagggtttggtagctggaaaaaatcttcaataaccactgctgtagcccaagcctccc

SEQ ID NO: 1699 - DNA, 601 bp, Human
aggacaaactctccactgcctgggaggacccttagaaatcatctagcagagtgattttcaagtggtgttgggcacagaggggctccttgagaatactcaggaattgctgttggcagcaagaggggttgggggaggtgcaggcccccacctgtgactcggaccagacacccacttttgacttctctcagttactgtattgggttctctggaaagggtttggtagctggaaaaaatcttcaataaccactgctgtagcccaagcctcccattttacagaagggcaagtgaagggccacagacragaagatgaggccacagaacttgtttttgtcagagctctctggactcccagttcagccttatgtccatcgtcttgcgctgtcacgtggcaggagctggaggcttcagtctttgttctcagcctttgctagcacaggtgtcccccaagtgtccatgtgccccgatgttcagtcattcattccgcagttgtacactggggccaggggacacatctgttcgggaacaaggcagacccaggtccacgctcctggaactcatggacattgcatagtaattgtctttgtggtgagcgccaggacag

SEQ ID NO: 1700 - DNA, 601 bp, Human
ttgagaatactcaggaattgctgttggcagcaagaggggttgggggaggtgcaggcccccacctgtgactcggaccagacacccacttttgacttctctcagttactgtattgggttctctggaaagggtttggtagctggaaaaaatcttcaataaccactgctgtagcccaagcctcccattttacagaagggcaagtgaagggccacagacgagaagatgaggccacagaacttgtttttgtcagagctctctggactcccagttcagccttatgtccatcgtcttgcgctgtcacgkggcaggagctggaggcttcagtctttgttctcagcctttgctagcacaggtgtcccccaagtgtccatgtgccccgatgttcagtcattcattccgcagttgtacactggggccaggggacacatctgttcgggaacaaggcagacccaggtccacgctcctggaactcatggacattgcatagtaattgtctttgtggtgagcgccaggacagtgtatgatgaggaccccaccctgttgaccttcctgaggaaggggggtttaagcacacgaagagcaatccaggcagaaggaacaccc

SEQ ID NO: 1701 - DNA, 601 bp, Human
ctcccagttcagccttatgtccatcgtcttgcgctgtcacgtggcaggagctggaggcttcagtctttgttctcagcctttgctagcacaggtgtcccccaagtgtccatgtgccccgatgttcagtcattcattccgcagttgtacactggggccaggggacacatctgttcgggaacaaggcagacccaggtccacgctcctggaactcatggacattgcatagtaattgtctttgtggtgagcgccaggacagtgtatgatgaggaccccaccctgttgaccttcctgaggaaggggkgtttaagcacacgaagagcaatccaggcagaaggaacaccctgcaaatggcctgagctgagagagagctcagcacgttcaagggcctggaagaaggtccgaagggctagaacacaacacatggggcacagtggcttgtgttgggtgtgtcgaggaaggagttgtccaatgatagaaggctttgtaggcacagtaaggatttttgcagagccactaaggtttttttttttttttttttttttttaacagaatctcactctttcacccaggctacagtgtagtggtgcaatctcggctcact

SEQ ID NO: 1702 - DNA, 601 bp, Human
ttcagtctttgttctcagcctttgctagcacaggtgtcccccaagtgtccatgtgccccgatgttcagtcattcattccgcagttgtacactggggccaggggacacatctgttcgggaacaaggcagacccaggtccacgctcctggaactcatggacattgcatagtaattgtctttgtggtgagcgccaggacagtgtatgatgaggaccccaccctgttgaccttcctgaggaaggggggtttaagcacacgaagagcaatccaggcagaaggaacaccctgcaaatggcctgagcygagagagagctcagcacgttcaagggcctggaagaaggtccgaagggctagaacacaacacatggggcacagtggcttgtgttgggtgtgtcgaggaaggagttgtccaatgatagaaggctttgtaggcacagtaaggatttttgcagagccactaaggtttttttttttttttttttttttttaacagaatctcactctttcacccaggctacagtgtagtggtgcaatctcggctcactgcaacctccactttccaggttcaagcaattctcctgcctcagcctcccgagtagctga

SEQ ID NO: 1703 - DNA, 601 bp, Human
ttcaaccaattattctttcagtaagactttcattcttttattcattccattattttgttcagtgtgtcacttaaggtgcaggtgaaactgctataacaaggagactgcaaaatgcagtggtttaaataagatagatgtttattctctttagtgtaacagtttgaatttacgcagtccagtgttaatgtggcagtgccacagtattggggacccaggctccttctatgttgtttgtttgctatccttaccatgtggcttccatgtcagggtctaagatggctgctgttgctcaggccatcayacctgcaatccagccagtgaaagagggttaaaaggaaaaggtggacacactccctttcttttaaagatataacctggaaatgcatcactttttctcacataatagagagcagaacttagctacatggccacgcctagctccaaggaaatgcggtctttagattggcaaatatttattgggcatctactgtgaagatttatctcaagaagtaacatgtgacctgggccttgaaggatgagacgtttgccacgtaaaataaaggggatagggcactttaggtgtaagaagaggtaggagatg

SEQ ID NO: 1704 - DNA, 601 bp, Human
gttgctcaggccatcacacctgcaatccagccagtgaaagagggttaaaaggaaaaggtggacacactccctttcttttaaagatataacctggaaatgcatcactttttctcacataatagagagcagaacttagctacatggccacgcctagctccaaggaaatgcggtctttagattggcaaatatttattgggcatctactgtgaagatttatctcaagaagtaacatgtgacctgggccttgaaggatgagacgtttgccacgtaaaataaaggggatagggcactttaggtgtamgaagaggtaggagatggccttagctcttagtacatcacaaccaagctgggaagatgaaagaacagctgggtcagggactggaagataataagcaggcctgggtttgatggtcacctttgccatttactgtactggctgggtggctttaggcagggaacttaacttttctgatcttttaattttttatttataaaaattcatgcattgtgtatgaaatggatacattagtggccgggtgcggtggctcacgcctgtaatctcagcactttgggaggccgaggcgggcggatcacgaggtca

SEQ ID NO: 1705 - DNA, 601 bp, Human
agaagaggtaggagatggccttagctcttagtacatcacaaccaagctgggaagatgaaagaacagctgggtcagggactggaagataataagcaggcctgggtttgatggtcacctttgccatttactgtactggctgggtggctttaggcagggaacttaacttttctgatcttttaattttttatttataaaaattcatgcattgtgtatgaaatggatacattagtggccgggtgcggtggctcacgcctgtaatctcagcactttgggaggccgaggcgggcggatcacgaggtcrggagatcgagaccatcttggctaacatggtgaaaccctgtctctactaaaaatacaaaaaattagccaggcgcggtggcgggcacctgttgtcccagctactcagaaggctgaggcaggagaatggcgtgaacccgggaggcagagcttgcagtgaaccgagatacgcccctgcagtccggcctgggcgaaagagcgagactctgtctcaaaaaaaaaaaaaaaaaaaagaaagaaagaaatggatacattagtatactgaattttttgcaaggcactgaggagatgagatttgttattg

SEQ ID NO: 1706 - DNA, 601 bp, Human
ttataaaaattcatgcattgtgtatgaaatggatacattagtggccgggtgcggtggctcacgcctgtaatctcagcactttgggaggccgaggcgggcggatcacgaggtcaggagatcgagaccatcttggctaacatggtgaaaccctgtctctactaaaaatacaaaaaattagccaggcgcggtggcgggcacctgttgtcccagctactcagaaggctgaggcaggagaatggcgtgaacccgggaggcagagcttgcagtgaaccgagatacgcccctgcagtccggcctgggmgaaagagcgagactctgtctcaaaaaaaaaaaaaaaaaaaagaaagaaagaaatggatacattagtatactgaattttttgcaaggcactgaggagatgagatttgttattgttattacgggtataagggtatgtatgtgtgctctgtgtgtgtgtgtgtgtgtgtgtgtgtgtgtgtgtgaagaagaaacattccttccttgcttccgtctaattttcctaacctccctaaccacaaaaaccttccagggcaacatctatattatttgtgcttttttgattgaaagtgttaggaactta

SEQ ID NO: 1707 - DNA, 601 bp, Human
acattagtggccgggtgcggtggctcacgcctgtaatctcagcactttgggaggccgaggcgggcggatcacgaggtcaggagatcgagaccatcttggctaacatggtgaaaccctgtctctactaaaaatacaaaaaattagccaggcgcggtggcgggcacctgttgtcccagctactcagaaggctgaggcaggagaatggcgtgaacccgggaggcagagcttgcagtgaaccgagatacgcccctgcagtccggcctgggcgaaagagcgagactctgtctcaaaaaaaaaaaaraaaaaaagaaagaaagaaatggatacattagtatactgaattttttgcaaggcactgaggagatgagatttgttattgttattacgggtataagggtatgtatgtgtgctctgtgtgtgtgtgtgtgtgtgtgtgtgtgtgtgtgtgaagaagaaacattccttccttgcttccgtctaattttcctaacctccctaaccacaaaaaccttccagggcaacatctatattatttgtgcttttttgattgaaagtgttaggaacttaaactcttacacacacacacgtgcacgcacacaca

SEQ ID NO: 1708 - DNA, 601 bp, Human
tcaaacaccaaaggtacagccattgtgtctctctgtctgtggctctctcttcgttgcttgcctctgctttactctgtgttgagctttcattttcccctactgtaaatgggttttctgggtgtagtggggcgtctggttctaccactagagaggaaaggctggaggtctttccccaataagctctaggtggaaaagtttcagggaaggattctgattggccagcttcgatcacatgcccaaatctagactaatccctatggtcagaggagtggggtactatgatctgcccatgttgggtcaygccgtctcatctatgacagggcggttggtgggcaagcacaggtcttttcaaaggaagggtgtggttttttcagacaaaacaaccagcattaggttcttcagtctgctccccgccccctctctgctgggaggccagatgttagcatttctatttcagagagaattcctgatgagctcccttctctctcttctcccaaaggtgtgtggctctgtggctgctgtggaagagcggctccgaggtcgggagacgttgctcccttggagtgggctttctgagggtacaggctcttcttccaacacc

SEQ ID NO: 1709 - DNA, 601 bp, Human
aaacaccaaaggtacagccattgtgtctctctgtctgtggctctctcttcgttgcttgcctctgctttactctgtgttgagctttcattttcccctactgtaaatgggttttctgggtgtagtggggcgtctggttctaccactagagaggaaaggctggaggtctttccccaataagctctaggtggaaaagtttcagggaaggattctgattggccagcttcgatcacatgcccaaatctagactaatccctatggtcagaggagtggggtactatgatctgcccatgttgggtcacgccgtctcatctatgacagggcggttggtgggcaagcacaggtcttttcaaaggaagggtgtggttttttcagacaaaacaaccagcattaggttcttcagtctgctccccgccccctctctgctgggaggccagatgttagcatttctatttcagagagaattcctgatgagctcccttctctctcttctcccaaaggtgtgtggctctgtggctgctgtggaagagcggctccgaggtcgggagacgttgctcccttggagtgggctttctgagggtacaggctcttcttccaacacccc

SEQ ID NO: 1710 - DNA, 601 bp, Human
atcacatgcccaaatctagactaatccctatggtcagaggagtggggtactatgatctgcccatgttgggtcacgccgtctcatctatgacagggcggttggtgggcaagcacaggtcttttcaaaggaagggtgtggttttttcagacaaaacaaccagcattaggttcttcagtctgctccccgccccctctctgctgggaggccagatgttagcatttctatttcagagagaattcctgatgagctcccttctctctcttctcccaaaggtgtgtggctctgtggctgctgtggaagrgcggctccgaggtcgggagacgttgctcccttggagtgggctttctgagggtacaggctcttcttccaacaccccagaggaaacagacgacgttgacaattccagccttgatgcctcctcctccatgagtgtggcaccctgggcaggggctgccaccccacttctccccacagagaatggggaaggaaggctgcgggtcatcgtgggaagggaggctgactcctcctctgaggcctgtgttggcctggagcctccccaggatggtaagccggaagtcagagtgcatttggatgctcatgt

SEQ ID NO: 1711 - DNA, 601 bp, Human
ttgtggcagagccagaattagaacccaggtctctgacttccagaaccagtctctcaatggctaccccacttcatggaatagtaataactttctttccaccttgttttcagggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccaggtattttaaatttaacttttttacttaaagcacttttatttaargaaatgaagatatatctataaggacattcagcttagcatataagagcaaaaaattgaggctgagcatggtggcccatgcctataatcccagctccgtgaggctgaggcgggaggatggcttgagcccaggagtttgagaccagcctaggcaacctggtgagaccttttctctacaaaaaattttaaaaaaatcatccaggcatggtggcatgcacctggtagtcccagctattcaggaggctgaggtagggggattgctcgagcccaggagtgcaaggctgtggtgagctatgatcacac

SEQ ID NO: 1712 - DNA, 601 bp, Human
ttgttttcagggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccaggtattttaaatttaacttttttacttaaagcacttttatttaaggaaatgaagatatatctataaggacattcagcttagcatataagagcaaaaaattgaggctgagcatggtggcccatgcctataatcccagctccgtgargctgaggcgggaggatggcttgagcccaggagtttgagaccagcctaggcaacctggtgagaccttttctctacaaaaaattttaaaaaaatcatccaggcatggtggcatgcacctggtagtcccagctattcaggaggctgaggtagggggattgctcgagcccaggagtgcaaggctgtggtgagctatgatcacaccactgcactccagcctgggtgacagagcgagactcttcctaaagaaagcaaaaaatctggcaacaacaatgggggataataaaattaatgtcagacagtc

SEQ ID NO: 1713 - DNA, 601 bp, Human
tctctacaaaaaattttaaaaaaatcatccaggcatggtggcatgcacctggtagtcccagctattcaggaggctgaggtagggggattgctcgagcccaggagtgcaaggctgtggtgagctatgatcacaccactgcactccagcctgggtgacagagcgagactcttcctaaagaaagcaaaaaatctggcaacaacaatgggggataataaaattaatgtcagacagtcacaacaaagtactatcaacagtgatgtagacgtgcatatgtacatggaaacatactgacaatatcggraggtagaaaagtagaaaaaatcaggtaacaaaatgtatataacatctgttaccatttttgtgagcagaaaagaaatagctcggtaattggaggctttctagtgccagacactattccaagtactgtacttcaaagatattgactcatttaatcttcaactaactatgaattaggtattgtgattatgcccatttcatggatgagaaaactaaagcacagcgaggttaaccaacctggctgaggtcatgtactgccgggtccctgttttcaccagtggtctcccgtgtccccagcacaggt

SEQ ID NO: 1714 - DNA, 601 bp, Human
taacaaaatgtatataacatctgttaccatttttgtgagcagaaaagaaatagctcggtaattggaggctttctagtgccagacactattccaagtactgtacttcaaagatattgactcatttaatcttcaactaactatgaattaggtattgtgattatgcccatttcatggatgagaaaactaaagcacagcgaggttaaccaacctggctgaggtcatgtactgccgggtccctgttttcaccagtggtctcccgtgtccccagcacaggttggccctgcgtgcaggctctggaccrgatgtctgaccatttctctgtccattctccataggccccggccctcgcagccatgcagtggggaattgaggggtgcttcctgcccaccactttcctcccctccatcagtcacagtctgctgaagcccagagagggagagcagcttgcttaaggtcacacaaataggaagtaatgtctgagctgtgtgatttgaacactcacatccctaagcatcatactcactgctatcccaaatccttttggaccacttcagatttgtctccgtcgcctgtgcccaggcaagggctcagggacagtttc

SEQ ID NO: 1715 - DNA, 601 bp, Human
ttcaccagtggtctcccgtgtccccagcacaggttggccctgcgtgcaggctctggaccggatgtctgaccatttctctgtccattctccataggccccggccctcgcagccatgcagtggggaattgaggggtgcttcctgcccaccactttcctcccctccatcagtcacagtctgctgaagcccagagagggagagcagcttgcttaaggtcacacaaataggaagtaatgtctgagctgtgtgatttgaacactcacatccctaagcatcatactcactgctatcccaaatcctttyggaccacttcagatttgtctccgtcgcctgtgcccaggcaagggctcagggacagtttccaaatgacagaatggctcagccagcagatgacctccctaggggagctgctgctcagcccaatctccattctcaccgcctcacccctggagccctgcctcacctcctgtctcctgcggcctcctgagtggtgagccagagaccccaaatccatgtaatctcagttcactgttgccgtttctgaagccaggggcggcatcagctgaaaggaacatgttttgtgggcttttgtattagacagac

SEQ ID NO: 1716 - DNA, 601 bp, Human
gcacaggttggccctgcgtgcaggctctggaccggatgtctgaccatttctctgtccattctccataggccccggccctcgcagccatgcagtggggaattgaggggtgcttcctgcccaccactttcctcccctccatcagtcacagtctgctgaagcccagagagggagagcagcttgcttaaggtcacacaaataggaagtaatgtctgagctgtgtgatttgaacactcacatccctaagcatcatactcactgctatcccaaatccttttggaccacttcagatttgtctccgtcrcctgtgcccaggcaagggctcagggacagtttccaaatgacagaatggctcagccagcagatgacctccctaggggagctgctgctcagcccaatctccattctcaccgcctcacccctggagccctgcctcacctcctgtctcctgcggcctcctgagtggtgagccagagaccccaaatccatgtaatctcagttcactgttgccgtttctgaagccaggggcggcatcagctgaaaggaacatgttttgtgggcttttgtattagacagactcatatttgaatcctagtgctgctgt

SEQ ID NO: 1717 - DNA, 601 bp, Human
gaccggatgtctgaccatttctctgtccattctccataggccccggccctcgcagccatgcagtggggaattgaggggtgcttcctgcccaccactttcctcccctccatcagtcacagtctgctgaagcccagagagggagagcagcttgcttaaggtcacacaaataggaagtaatgtctgagctgtgtgatttgaacactcacatccctaagcatcatactcactgctatcccaaatccttttggaccacttcagatttgtctccgtcgcctgtgcccaggcaagggctcagggacartttccaaatgacagaatggctcagccagcagatgacctccctaggggagctgctgctcagcccaatctccattctcaccgcctcacccctggagccctgcctcacctcctgtctcctgcggcctcctgagtggtgagccagagaccccaaatccatgtaatctcagttcactgttgccgtttctgaagccaggggcggcatcagctgaaaggaacatgttttgtgggcttttgtattagacagactcatatttgaatcctagtgctgctgttttgtagaatgacttagcgtttgtacctc

SEQ ID NO: 1718 - DNA, 601 bp, Human
ggtgttagcacaaatatagatcatgtgtagaagaactagggacttcatggatattactgtttaacacaaggctgaatacataacactggaattaaagttggttgaaagaaaaccgtcaggtgactcatagtgaggtggcacagacatggccaaaaacttggagaccggatgaacataactgcagtctgagggatgcgggccaagggtactgagctgaggccaagagaaggcagggcaagggtggaagtggccatcacagagcagcctttctgcaggacgggggccctgtgctggccagcasaggcctccattagtccaggtccttggtgagaggcagataccaagacaggataggatttcatcaacaagataggatttcattaggacaaatacttgcaagaaaatgcagagggagctgggcaaggctgggagagccttgggaccatggtgcgccatttccgaggaaggctgggtgggcacttgctggcctgccttcggtctaaggcagactctccagggtgtccgttggccatcacagtcctatctgcctagtgtaccctctgcacacagtgcctggggaacagcccctgggaagcatggt

SEQ ID NO: 1719 - DNA, 601 bp, Human
gagggagctgggcaaggctgggagagccttgggaccatggtgcgccatttccgaggaaggctgggtgggcacttgctggcctgccttcggtctaaggcagactctccagggtgtccgttggccatcacagtcctatctgcctagtgtaccctctgcacacagtgcctggggaacagcccctgggaagcatggtccggatgcagatgcagggattgattggagccagccacagccaggcccgcagatagccaggctcccagcagctgggggtctccagctcgcattctcctggctgctagaytcacacagcagcagggcaaagatcccaggaatgaggctgagggcagccccttgacaggctccagaccttgtctcaggtgatttcatgttatcagctatctgtgtgggttaattgtttagccaggctgattttactttcagtctcgtgaaataaaattttttgttttttgttttttgagactgagtctcgctctgttgcccaggttggagtgcagtggtatgatcttggctcactgcaacctctgcctcccaggtttaagcgattcttgtgcctcagcctcctgagtagctgggcctacag

SEQ ID NO: 1720 - DNA, 601 bp, Human
gggtgggcacttgctggcctgccttcggtctaaggcagactctccagggtgtccgttggccatcacagtcctatctgcctagtgtaccctctgcacacagtgcctggggaacagcccctgggaagcatggtccggatgcagatgcagggattgattggagccagccacagccaggcccgcagatagccaggctcccagcagctgggggtctccagctcgcattctcctggctgctagattcacacagcagcagggcaaagatcccaggaatgaggctgagggcagccccttgacaggctcyagaccttgtctcaggtgatttcatgttatcagctatctgtgtgggttaattgtttagccaggctgattttactttcagtctcgtgaaataaaattttttgttttttgttttttgagactgagtctcgctctgttgcccaggttggagtgcagtggtatgatcttggctcactgcaacctctgcctcccaggtttaagcgattcttgtgcctcagcctcctgagtagctgggcctacaggcatgtgccaccatgcccggctaatttttgtatttttagtagagacagggtttcaccatgtt

SEQ ID NO: 1721 - DNA, 601 bp, Human
taatcccagcactttgggaggccgaggcaagtggatcacttgaggtcaggagttcaaaaccagcctggccaacatggtgaaaccccatctctaataaaaatacaaaaattagccggcatcatggcgcacgcctatagtcccagctacttcgtaggctgaggcaggagaatcgcttgaacctgggagggggagtttgcagtgagctgagattgtgccactgcactccagcctgggtgacagagtgagactctgtttccaaaaaaaaaaaaaaaaaaagaacatagacactggaaccactgaygactgtgtgccccatgtgaagattaatctgaagactaatgaggccgtctggtaggggggctcctcggtgggcgcaggcacagactgtgggtgaggtgggccatggtggctggtccgcacagaagcaggccttggccaaaggccaaggcccttggaaaagtgacttaacttctccatgcctcatttcaccatctgcaaagaggcaatgaaaatggtgcagtggtaccttatttcctgattggcatgaggattagatgagttaacgcacgggaaggattttttttgagacagggtctcattc

SEQ ID NO: 1722 - DNA, 601 bp, Human
cacagaagcaggccttggccaaaggccaaggcccttggaaaagtgacttaacttctccatgcctcatttcaccatctgcaaagaggcaatgaaaatggtgcagtggtaccttatttcctgattggcatgaggattagatgagttaacgcacgggaaggattttttttgagacagggtctcattctgcctcctaggctagagtgcagtggtgtgatcatggctcaatatagccttgacctcctgggcacaagtgatcctcatcctcccaagtagaggggaccacaggtgtacaccaccatayctggctattaaaaaaaaatcttttgtaggactgagcgcagtggctcatgcctgtaatcccagcactttgggaagccaaggtgggcagatcacgagttcaggagatcgagaccatcctggctaacacagtgaaaccccatctctactaaaaatacaaaaaattagctgggtgtggtggcgggcgcctgtagtcccagctactcgggaggctgaggcaggagaatggtgtgaacccgggaggcggagcttgcagtgagccgagattgtgccactgcactccagcctgggcaacagagggaga

SEQ ID NO: 1723 - DNA, 601 bp, Human
cctctgtgtctttttctgctctttgagtaggaggtgagatagtgcagggcctagaagtcaaacagatttccgtctgaatttcggctctaccatctactggctgggtggtcctgagcactgcgtctacctccggtgtctccgtgtctccacttgccaactgggatgataaacaggccccaggttgtaggggagtcagaggcttatcctgaggtgatgcttgaggagtgtgttggttggcacatggtgggtgtcaggaattggcagcaacaagtgtttggggagtgaacaggagactggcatrgtctgaggactagaccaggatccctcctgtcttcctccccgaggctgcatcctgacccatagtccctcctttccagggtcctctccagccagagcccaccagccggcctttctccagcctcctgaagaagatgcccctcattccttgagaagcgacctccccacttcgtctgattcaaaggtaaatccacccctcggctgcagcccccaagccatgtctcccagcgtgtagttccctctcaaaaatgcaatttctctaccccttgagaccagtttaagggtggagaggagaaaggaaatt

SEQ ID NO: 1724 - DNA, 601 bp, Human
ccagtttaagggtggagaggagaaaggaaattgccatcaaattaccccaagcttctaagactgtaagtagaggaggtcaataatagcggggagagggagggagggcacttcagtgaatatacttcttgttttttaatttgttattattattatttttgagacagagtctcgctctgccacccaggctggagtgcagtggcacgatctcgggtcactgcaacctccgcttcccgggttcaagtgattctcctgcctcagcctcccaagtagctgggattacaggtgcatgtcaccatgctcrgctaattttttgtatttttagtagagacggggtctcaccatgttggccagcttggtctcgaactcctgacgtcaggtgatccacctgcctccgcctcccaaagtgcttggattacaggcatgagccactgcacccggccattattttcttttattattttattttattttcgacctgtggtctcagctacttgggaggctgaggcgggaggatggcttcagcccaggaggcagaagttgcagtgagctgtgatcctaccaccacattccaccctgggtgacagagtgagaccctgtctcc

SEQ ID NO: 1725 - DNA, 601 bp, Human
ctcctttttttttttcttttcttttctttttttgttttttgagacagagtcttgctctgtctcccaggctggagtgcagtggcgtgatctcggctcactgcaatctctgcctaccaggttcaggtgattctcgtgccttagcctcccgagtagctgggattacaggcgtgcgccaccaggcccggctaattttcatatttttagtagagacggggttttgacatgttggccaggatggtctcaaattcctgacctcaagtgatctttctgctttggcttcctaaagtgctgggattacagrcgtgagccaccgtgcctgacttttttttcttttttaagagctagggtcttgctctattgcccaggctggaatggccttggaatgattgtagatcactgcagctttgaactcatgggctggtgatcctcccacctcagcctctgagaagctgggactacaggtgtgcgcccagctcattttttgcttttttttttttttttttttgtagagatagggtcttgctatgttgaccaggctggtgttgagctcccgggctcaagtgatcctcctgccttgacctcccaagatgttgggattata

SEQ ID NO: 1726 - DNA, 601 bp, Human
aaaaaatacaaaaattagctgggtgtggtggtgtatgcctgcagtcccagctactcaggaggctgatgggaggatcacttgagcccaggaggcagaagttgcagtgagccgagatcatgacactacactccagccggggcaacaaagtgagtctctgtctcaaaaataaataaaggccaggcatggtggctcacacctgtaatgccagcactttgggaggccgaggtgggcagatcagttgaggtcaggagtttgagaccagcctggccaacatggcgaaacctcatctctactaaaaaawattcatacaaaaatcagcctggtgtgttggcatgcacctgtagtcccagctactcaggaggctgaggcatgagaatcacttgagcccagaaagtggaggttgcagtgagcccagatcgcaccactgcactccagcctgggcaatagagtgagactctgtctcaaaaaaaaaaaaaaaaaaaaattaattaattaattaaaaagtaaaacaaatttaaaaaggaataaagaaaattataaataagaaaatagaaactttttcacagcacctataaataagcactactgttttaatattttg

SEQ ID NO: 1727 - DNA, 601 bp, Human
cagaggggagaggggccatctaggtgagaccagggagacttcaaggagagaagtggggccaggatacataagatctggttaagtgctcactttggcagcacatataccaaaattggaacgatacagagaagatcagcatggcctctgaatgaggatgacaaaatatgaaaaagaaaaagaaaagctcaaaaagatctgattaaacatcttcaggaaaaatctataaaaaattatttgacgagaagcatttcattcaaatcaagagcaggacaaaggtatctcatagaactaacttcgttcrtcatggttctggaggtgttagccaatgcagtaggacaagaaaaagaattaagaggtaaagagtatggaaaagtggaggtgaatttttattataaaatgttcttctaatatatacctatttgcttgtgtgtttatggaatgtctctggaaagatacacaagaaactggtttactggctgctgctagggagcagaactaggtgattggggcctaggataagaagcaaacttactattagagtattatatcatgtgaaggtaatccttaataaaaattacagtgttttaaaacaggtcttctg

SEQ ID NO: 1728 - DNA, 601 bp, Human
ccagggagacttcaaggagagaagtggggccaggatacataagatctggttaagtgctcactttggcagcacatataccaaaattggaacgatacagagaagatcagcatggcctctgaatgaggatgacaaaatatgaaaaagaaaaagaaaagctcaaaaagatctgattaaacatcttcaggaaaaatctataaaaaattatttgacgagaagcatttcattcaaatcaagagcaggacaaaggtatctcatagaactaacttcgttcgtcatggttctggaggtgttagccaatgcrgtaggacaagaaaaagaattaagaggtaaagagtatggaaaagtggaggtgaatttttattataaaatgttcttctaatatatacctatttgcttgtgtgtttatggaatgtctctggaaagatacacaagaaactggtttactggctgctgctagggagcagaactaggtgattggggcctaggataagaagcaaacttactattagagtattatatcatgtgaaggtaatccttaataaaaattacagtgttttaaaacaggtcttctgcttatcttatcctcaaatagaggggaaag

SEQ ID NO: 1729 - DNA, 601 bp, Human
acagaattattgcttcccatggcagggacaagacaaagcagttactcacggcatactaatgatctttagcttttctgggcactcactgtatgcaggttgctgtgataagggttttacgtaggtcatcacctccaggccgtgccacaaccaaagcaatttcttccctcatttttcaaaagaggaatctctgacacatagagacaaagtgacttgcccaaaggaacatagaggacaaatgtcaggccagagcttacattgggttcgtctggctctaggtttcagagtttttgagaagaaattrgcaggggctgtccaggccagttcttagaggatgtgggacctacaccagggcttcaaaaataggtgatgaggctgggcacagtggctcacgcctgtaatcccagtacattgggaagccgaggtgggtggatcacttgaggtcaggagtttgagaccagcctgaccaatatggtgaaaccctgtctctactaaaaatataagaattagccaggcgtggtggcgtgtgcctgtagtaccagctactgaggaggctgagacaggagaatcacttgaacccgggaggcagaggttgcggtgagcc

SEQ ID NO: 1730 - DNA, 601 bp, Human
ggctgggcacagtggctcacgcctgtaatcccagtacattgggaagccgaggtgggtggatcacttgaggtcaggagtttgagaccagcctgaccaatatggtgaaaccctgtctctactaaaaatataagaattagccaggcgtggtggcgtgtgcctgtagtaccagctactgaggaggctgagacaggagaatcacttgaacccgggaggcagaggttgcggtgagccgagattgcaccactgcactccagcctgggcgacaaagtgagactccgtctcaaaaaaaaaaaaaaaaaamaaaccaaaacggtgatgatttagcctgggagagtcagtcttagaacaacagtgggagcaaatgagaggctttagcccatcccacaatccccatcagccctggtgaagtttcccctaatacagataaaatcagcgtaaggcccaggtgcttggcttgcaaacacaagctccctagctcctctcccatccagcttcttttagagagaaattccagagcagcctctgtaatggacatgataaaaataactgctgattgagcacctactgtgtggcaggtgctatgctaggggtataccatata

SEQ ID NO: 1731 - DNA, 601 bp, Human
gggcacagtggctcacgcctgtaatcccagtacattgggaagccgaggtgggtggatcacttgaggtcaggagtttgagaccagcctgaccaatatggtgaaaccctgtctctactaaaaatataagaattagccaggcgtggtggcgtgtgcctgtagtaccagctactgaggaggctgagacaggagaatcacttgaacccgggaggcagaggttgcggtgagccgagattgcaccactgcactccagcctgggcgacaaagtgagactccgtctcaaaaaaaaaaaaaaaaaaaaaamcaaaacggtgatgatttagcctgggagagtcagtcttagaacaacagtgggagcaaatgagaggctttagcccatcccacaatccccatcagccctggtgaagtttcccctaatacagataaaatcagcgtaaggcccaggtgcttggcttgcaaacacaagctccctagctcctctcccatccagcttcttttagagagaaattccagagcagcctctgtaatggacatgataaaaataactgctgattgagcacctactgtgtggcaggtgctatgctaggggtataccatatactcc

SEQ ID NO: 1732 - DNA, 601 bp, Human
gaccaatatggtgaaaccctgtctctactaaaaatataagaattagccaggcgtggtggcgtgtgcctgtagtaccagctactgaggaggctgagacaggagaatcacttgaacccgggaggcagaggttgcggtgagccgagattgcaccactgcactccagcctgggcgacaaagtgagactccgtctcaaaaaaaaaaaaaaaaaaaaaaccaaaacggtgatgatttagcctgggagagtcagtcttagaacaacagtgggagcaaatgagaggctttagcccatcccacaatcccyatcagccctggtgaagtttcccctaatacagataaaatcagcgtaaggcccaggtgcttggcttgcaaacacaagctccctagctcctctcccatccagcttcttttagagagaaattccagagcagcctctgtaatggacatgataaaaataactgctgattgagcacctactgtgtggcaggtgctatgctaggggtataccatatactcccttgaatccttacagcaaccctaaaatatagggattaacatttccattttatacccaaggaaactgaggctcagagatgttaagtgt

SEQ ID NO: 1733 - DNA, 601 bp, Human
aaaaatacaaaaattagttgagagtggtggcacgtgcctgtgatcccagctattcgggagtctgaggcgggagagtcacttcagcctgggattttaaggctacagtgagctatgatgctgcactccagtctgggtgacagagcaagacctgtctcaaaaccagcaaacacaaaacaatgaaaaaactcacagtatcatgctgagccctgtgacagaggacatgaagggtgggaggaggatcaggagcctgggaccctgccatcaggacttcgtttttttgtttttgtttttgtttttttttgagatggagtctcgctctgtcacccaggctgcagtgcagtggtgcaatctcggcttactgcaagctctgcctcctgggttcacgccattctcctgcctcagcctcccaaatagctgggactacaggcagccgccaccaggaccggctaattttttgtatttttagtagagatggggtttcaccgtgttagccaggatggtctcgatctcctgaactagtgatctgcctgcctgggcctcccagtgtgctgggattacaggtgtgagccaccgcacctggctgccatcaggactttaaaaa

SEQ ID NO: 1734 - DNA, 601 bp, Human
gaagctccatgctgagggtctttagagacctcaacttgcaggaggtgaggttgctatattgtctccccaaagggtctccatggcaacttgttgttatccagctcaaaatgagaaggttccctctcctttcatttccacagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagstgacaaagcgagtggacatcttcagctgtggaatagtaagagtgtcctgctctgcgtagagtggggcccaccttgatttgtccttcccacggctcctttgtaatcacaggatacggtagaggcacacagacaggttccatcaaagtacaacaggggctgacaaactgtggcccacaggccactttggcctgtggcgtattttgtatggtctgtgagctaagggtagttttacatttataaaggattatatttttaaacacaaagaatatgtgatagagactgaacatgctccccaaaagc

SEQ ID NO: 1735 - DNA, 601 bp, Human
ggttttttggtgtttttttttttttttgagacggagtcttgctctgtcgcccaggctggagtgcagtggtgcgatctcagttcactgcaagatccacctcccaggttcacgccattctcctgcctcagcctcccaagcacctgggactacaggcacccgccaccgcgcctggctcatttttttgtatctttagtagagacggggtttcgctgtgttagccaggatggtctcgatctcctgaccacgtgatccgcccacctcagcctcccaaagtgctgggattacaggcatgatccaccgygcccagccagctgaaggatttttaaatgaaacaatctttaaaaaatagtgtatatatacgtgtgtgtgtatctatatttatctatacctatatatatcttatggtaatacatataaacacacacacacatgaatttttgaaaaccatcttctctgcctggctatcaattaattacaaccttccactggcagcttggtggcatctttaattggaggaggtgtttagtgatattcccatgttccagattttgggcaggtgtgtctgctggcaatggcagagctgcacctggagctcagaact

SEQ ID NO: 1736 - DNA, 601 bp, Human
aaatagtgtatatatacgtgtgtgtgtatctatatttatctatacctatatatatcttatggtaatacatataaacacacacacacatgaatttttgaaaaccatcttctctgcctggctatcaattaattacaaccttccactggcagcttggtggcatctttaattggaggaggtgtttagtgatattcccatgttccagattttgggcaggtgtgtctgctggcaatggcagagctgcacctggagctcagaactgagaagagaagacagaatctgctgcctggctgtgtgcacgagygtctgaaccatgctaactcacgttctgttctctccaggtgttggccgaggtcctcacgggcatccctgcaatggataacaaccgaagcccggtttacctggtaagggaacttgtcacatctggctgggaggtatatttgggcctcacagctctgtagagagggcaacgacctcaattctagctagttttacacatgcaaatgaggcccggtacaaggttgcatttgcatccccacaaagcagctttaacctcccatccccacctgccagccaaccattgctttttcatgataatagcatc

SEQ ID NO: 1737 - DNA, 601 bp, Human
ggataacaaccgaagcccggtttacctggtaagggaacttgtcacatctggctgggaggtatatttgggcctcacagctctgtagagagggcaacgacctcaattctagctagttttacacatgcaaatgaggcccggtacaaggttgcatttgcatccccacaaagcagctttaacctcccatccccacctgccagccaaccattgctttttcatgataatagcatctggggcttggtgcggtggctcatgcctgtgatcacagcctttgggagactgatgtgggtggatcatttgagaycaggagttcaagaccagcctggccaacatggtgaaaccctgtctctattaaaaaaaaagaaaagaaaaaacttacaaaaaacccccaacattatccaggtgtggtcgcatgtgcctgtaatcccagctactcgggaggctgaggcaggagaatcacttgaacctgggaggcagaggttgcagtgaaccaagattatgccactgcactccagcctgggtgacagagcgagactccatctcaaaaaaaaaaaaaaaaaaagattttggaatgtttatagaaagcacttgtataaaagagaaa

SEQ ID NO: 1738 - DNA, 601 bp, Human
atcacagcctttgggagactgatgtgggtggatcatttgagatcaggagttcaagaccagcctggccaacatggtgaaaccctgtctctattaaaaaaaaagaaaagaaaaaacttacaaaaaacccccaacattatccaggtgtggtcgcatgtgcctgtaatcccagctactcgggaggctgaggcaggagaatcacttgaacctgggaggcagaggttgcagtgaaccaagattatgccactgcactccagcctgggtgacagagcgagactccatctcaaaaaaaaaaaaaaaaaaagattttggaatgtttatagaaagcacttgtataaaagagaaagcacttctctatatatcaggcaattcattagggattttcctcaaattgataaaagttaatttcagcccttttaaacaagtttctataataaaaacaatttccattttgtaggccaaagatctgatatacacagtcatttaaaaaatataacaacctggctgggtgtggtggctcacacctctaatcccagcactttggaggaggccaaggcgggcggatcacttgaggctgggagttcgagaccagcctgggcaacat

SEQ ID NO: 1739 - DNA, 601 bp, Human
cgcccaggctggagtacagtggtgcaatctccgctcactgcagcctctgcctcctggcttcaattgattctcctgcctcagtctcccaagtagctgggattacaggcatggaccaacatgcccagctaatttttgtatttttaatagagacagggtttcaccatgttggccaggctggtcttgaactcctgacctcaagtgatccacctgcctcggcggcctcccaagtacctgggaccacaggcatgtgccctcacgcccagctaatttttaatttgttatttgtagagatggggtcttrttacgttgcccaggctgatattgctattattttaacagcttttaggatactgttataattattatataagtaaatataaaaccaaaataattatagctgtatagcagaaaataatataatccaaactattagcaggagttacctttggagagtagaaatgaaaggtaaacttttgtccccaaattttaaccacttatgtttaattttaatttttttttgaaatggagtctccctctgtggcccaggctggagtacagtggtgtgcttttggcttaccacaacctctgtctcccaggttca

SEQ ID NO: 1740 - DNA, 601 bp, Human
atagcagaaaataatataatccaaactattagcaggagttacctttggagagtagaaatgaaaggtaaacttttgtccccaaattttaaccacttatgtttaattttaatttttttttgaaatggagtctccctctgtggcccaggctggagtacagtggtgtgcttttggcttaccacaacctctgtctcccaggttcaagcaattctcctgcctcagcttcccatgtagctgggatcacaggtgtgtgccaccatggcccagataatttttgtatttttaatagagatggggttttgcyatgttgcccaggctggtctcgaactcctgagcccaagtgatcctcctgccttggcctcccaaagtgttgggattacaggtgtgagccaccgtgcccagccaaaagttgctttttaagggtggtttgtttgaaactagaccccaaaaatgtccatatattactttggttatgtttgtttttttcatttttaaaaaaaaattttatgtggagatgggatgtcactttgttgcccaggcgagtttcgagctcctgggcttaagcattcgcctgcctcaacctcccaaagtgctgacattacag

SEQ ID NO: 1741 - DNA, 601 bp, Human
gcattcgcctgcctcaacctcccaaagtgctgacattacaggtgtgaaccaccacgcccgggcatggttatgtttcttaagactcttattcttggccgggcacggtggctcaagcctgtaatcccagcactttgggaggctgaggcaggcggatcacaaggtcaggagatcgagaccatcctggctaacatggtgaaaccccgtctctactaaaaatacaaaaaaattagccgggcatggtggcgggtgcctgtagtcccagctactcgggaggctgaggcaggagaatggcatgaacccrggaggcggagcttgcagtgagccgagatcgtgccactgcactacagcctgggcgacagagcgagactccgtctcaacaacaacaacaaaaagactcttattctctcacaacctctcccgcaatgccctttttcattttggatgtcgttggatttttgcatagactaggtcatttgccctatgtagacagactgtctcacattctgggttttgctcattacatcctgtggtctccttcccttgtttctctattcctcatatttcctatatttggcagttagcacttgtgacttgtttagag

SEQ ID NO: 1742 - DNA, 601 bp, Human
taaggttttagtgctaagattgatcagtggtttcaggtggagctgccgactcctccatggtgaagttccctcgacatcctttcatcgcgtgttctcagtcccccaacccctgtttaaacactaggtgtcttctgtagtttttttgattatcgtcatagtctttgcatcaagatacatagcaatgatggcaggtttccatttggggcaaattgtgagaccctgcctctagaaaagaagaaaataatacacttctactgttcttgattatcagctttaaacactagtacactttaaaaaaaaataaacatttaggctgggtgcagtggctcacacctataatctgagcactttgagatgccaagacaggaggattagttgagcccaggagttcaagaccagcctgggcaacataatgagactccatctctacaaaaaatttaaaaattagccaagtacagtagcatgtgcctatagtcccagctacttgggaggctgaggtgggaggatcgattgaatcgaggaggttgagactgtagtgagctgtgattatatcactgtgcccggcctatttttatttttatttcttatttatattttgaga

SEQ ID NO: 1743 - DNA, 601 bp, Human
aatgagactccatctctacaaaaaatttaaaaattagccaagtacagtagcatgtgcctatagtcccagctacttgggaggctgaggtgggaggatcgattgaatcgaggaggttgagactgtagtgagctgtgattatatcactgtgcccggcctatttttatttttatttcttatttatattttgagacggagtctcactctgtcgcccaggctggaatgcagtggcgcaatcttggctcactgaagcctctccctccccagttcaagcaattctcctacctcagcctcccgagtaccygggactataggcacgcaccgccatgcccggctaattttttgtattttttagtagcgacgaggtttcaccgtgtcagccaggctggtctcgaactcctgacctcgagtgatctgccagtctcggcctcgcaaagtgctgggattacaggcatgaggcaccgcacctggcctacaatacatgtttttacaatatttagtatgtttgtaacattcatatatgctaatcatatataccatattactcatgaaatatacaatataatttatattaaatatgcttacatatttgtataaaattatt

SEQ ID NO: 1744 - DNA, 601 bp, Human
ccccttgggtttccctttacctctcactactctttgcttttgcagattaataaggatggggacccagtaactatagtcattttgtttggaaagacacttgctgcatgggcactgccaggcattttacacccacgctccctaatctatctttggcgcaggggaggcttcttattcctgtttatggatcgggatgcttaggctccaggacatggagcagcctgtctgagaccacccagctaaggagggagagctgagacagggcttccccgtcacagcacttgccctcaatgttcatcactgaagcatgtgattttctcatcacatcctcccacttcaagtggggcagggcagtgaggtccttcctgaggctcaggcatcttgagaaaagaaggtgtggacagagcagaaggtcatggcagagcactccagcaggcagaggtttctgtccacagggcttaggaaccaaggagggtgtcatcattgagatcctggcctctcggaccaagaaccagctgcgggagataatgaaggcgtatgaggaaggtaaggggtggcacagatggaggggctcaggagtggccacaagctttggcagcctggc

SEQ ID NO: 1745 - DNA, 601 bp, Human
cccagctaaggagggagagctgagacagggcttccccgtcacagcacttgccctcaatgttcatcactgaagcatgtgattttctcatcacatcctcccacttcaagtggggcagggcagtgaggtccttcctgaggctcaggcatcttgagaaaagaaggtgtggacagagcagaaggtcatggcagagcactccagcaggcagaggtttctgtccacagggcttaggaaccaaggagggtgtcatcattgagatcctggcctctcggaccaagaaccagctgcgggagataatgaaggygtatgaggaaggtaaggggtggcacagatggaggggctcaggagtggccacaagctttggcagcctggcagggaacaaggatcaagaattaacctgggccacactagaaaggaccctttggggacttttttacccacaggtgctgagcacctaccgtatgccaagatctgtgcctgatggtgacactgaacatgattcagacttgatctgtaagctcaccagctcctcttacaggggagagaggcctgtgaccaactaaaatctctgcccttgaggactgtggtagtagggggtgtggac

SEQ ID NO: 1746 - DNA, 601 bp, Human
agctcagctccctataggcctttgtcctgtggtgtctggggaggagagtgagggtgttgggagactcgggaggaaggagtgtgacttgggggtgggggagcactaaagctctgtcctggcaggaacagcccatgaacccgggggcgctaggccccagtgctggacacaggtgtccgggtctctgtaggtctgcctgctggcagagggaagtctggggaccaggcagttcctagagcagcttgtggcccaggatagagaaaatattctaagccagagctgctagagaaaggggagctccctrtcagagacgaccaagcaggggagcatgctggcctggcagagtggacagggccaggccatggccacagctctgggactctggggctcagtccctcacctccctggtctccctcactggcttattgtgggtgtcccaatgctaggatctgtatgcggcaggcgagaagattcgtgggactgatgagatgaaattcatcaccatcctgtgcacgcgcagtgccactcacctgctgagaggtaccagggagggaggggctggggccggggccacagggggtgtcctggccatgagcctctccct

SEQ ID NO: 1747 - DNA, 601 bp, Human
tccctataggcctttgtcctgtggtgtctggggaggagagtgagggtgttgggagactcgggaggaaggagtgtgacttgggggtgggggagcactaaagctctgtcctggcaggaacagcccatgaacccgggggcgctaggccccagtgctggacacaggtgtccgggtctctgtaggtctgcctgctggcagagggaagtctggggaccaggcagttcctagagcagcttgtggcccaggatagagaaaatattctaagccagagctgctagagaaaggggagctccctgtcagagaygaccaagcaggggagcatgctggcctggcagagtggacagggccaggccatggccacagctctgggactctggggctcagtccctcacctccctggtctccctcactggcttattgtgggtgtcccaatgctaggatctgtatgcggcaggcgagaagattcgtgggactgatgagatgaaattcatcaccatcctgtgcacgcgcagtgccactcacctgctgagaggtaccagggagggaggggctggggccggggccacagggggtgtcctggccatgagcctctccctcgtgcttc

SEQ ID NO: 1748 - DNA, 601 bp, Human
agagctgctagagaaaggggagctccctgtcagagacgaccaagcaggggagcatgctggcctggcagagtggacagggccaggccatggccacagctctgggactctggggctcagtccctcacctccctggtctccctcactggcttattgtgggtgtcccaatgctaggatctgtatgcggcaggcgagaagattcgtgggactgatgagatgaaattcatcaccatcctgtgcacgcgcagtgccactcacctgctgagaggtaccagggagggaggggctggggccggggccacagggggtgtcctggccatgagcctctccctcgtgcttctgccttgtcaagtctagagttagggagagagccagggagcccaggactgtttccccagccaccagtgggaggtcagggcggcaaattgatgtgcgatctctgatccgagacactgaggggcatcacgaggaggtctgaccatcccctgagcagagccctctccacagtgtttgaagagtatgagaaaattgccaacaagagcattgaggacagcatcaagagtgagacccatggctcactggaggaggccatgctcactgtggg

SEQ ID NO: 1749 - DNA, 601 bp, Human
tagagaaaggggagctccctgtcagagacgaccaagcaggggagcatgctggcctggcagagtggacagggccaggccatggccacagctctgggactctggggctcagtccctcacctccctggtctccctcactggcttattgtgggtgtcccaatgctaggatctgtatgcggcaggcgagaagattcgtgggactgatgagatgaaattcatcaccatcctgtgcacgcgcagtgccactcacctgctgagaggtaccagggagggaggggctggggccggggccacagggggtgtyctggccatgagcctctccctcgtgcttctgccttgtcaagtctagagttagggagagagccagggagcccaggactgtttccccagccaccagtgggaggtcagggcggcaaattgatgtgcgatctctgatccgagacactgaggggcatcacgaggaggtctgaccatcccctgagcagagccctctccacagtgtttgaagagtatgagaaaattgccaacaagagcattgaggacagcatcaagagtgagacccatggctcactggaggaggccatgctcactgtgggtaagagct

SEQ ID NO: 1750 - DNA, 601 bp, Human
ggactgtttccccagccaccagtgggaggtcagggcggcaaattgatgtgcgatctctgatccgagacactgaggggcatcacgaggaggtctgaccatcccctgagcagagccctctccacagtgtttgaagagtatgagaaaattgccaacaagagcattgaggacagcatcaagagtgagacccatggctcactggaggaggccatgctcactgtgggtaagagctcagacttgcacgtttttcaggccacagggctcaccgtggggcagcaccaaagaacaaagggcctagggatgygaccacaagagaaagaatccctgtgtcaccttcacgggatgtccccccgactcacactctgcctgtctccctcacccagggactgctccacctctagagtcccagtgtgtgctgccaaagattgttctctgtgctgcccacgtggtgcccagtgctgtgtgggtgtgtctgcatgagtgtgtgtgtgcgtgagagtgtgtgtgcctgagggtgtgtgtgcatgactgtgggtggaatgtgagtgtgtgtgtgtgagacagacagtgtgtgtgtgtgcgcacacaaatgcatacgccagtg

SEQ ID NO: 1751 - DNA, 601 bp, Human
gggaggtcagggcggcaaattgatgtgcgatctctgatccgagacactgaggggcatcacgaggaggtctgaccatcccctgagcagagccctctccacagtgtttgaagagtatgagaaaattgccaacaagagcattgaggacagcatcaagagtgagacccatggctcactggaggaggccatgctcactgtgggtaagagctcagacttgcacgtttttcaggccacagggctcaccgtggggcagcaccaaagaacaaagggcctagggatgcgaccacaagagaaagaatccctktgtcaccttcacgggatgtccccccgactcacactctgcctgtctccctcacccagggactgctccacctctagagtcccagtgtgtgctgccaaagattgttctctgtgctgcccacgtggtgcccagtgctgtgtgggtgtgtctgcatgagtgtgtgtgtgcgtgagagtgtgtgtgcctgagggtgtgtgtgcatgactgtgggtggaatgtgagtgtgtgtgtgtgagacagacagtgtgtgtgtgtgcgcacacaaatgcatacgccagtgattatgccagccccaaccctgtg

SEQ ID NO: 1752 - DNA, 601 bp, Human
cacagtgtttgaagagtatgagaaaattgccaacaagagcattgaggacagcatcaagagtgagacccatggctcactggaggaggccatgctcactgtgggtaagagctcagacttgcacgtttttcaggccacagggctcaccgtggggcagcaccaaagaacaaagggcctagggatgcgaccacaagagaaagaatccctgtgtcaccttcacgggatgtccccccgactcacactctgcctgtctccctcacccagggactgctccacctctagagtcccagtgtgtgctgccaargattgttctctgtgctgcccacgtggtgcccagtgctgtgtgggtgtgtctgcatgagtgtgtgtgtgcgtgagagtgtgtgtgcctgagggtgtgtgtgcatgactgtgggtggaatgtgagtgtgtgtgtgtgagacagacagtgtgtgtgtgtgcgcacacaaatgcatacgccagtgattatgccagccccaaccctgtgtgtactcatggcagccatgcagggagcactctggctgtggttgtgaagccctggccagcacaaagtcatctttctggacatgaaccaggggcctgg

SEQ ID NO: 1753 - DNA, 601 bp, Human
cacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaaygaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtg

SEQ ID NO: 1754 - DNA, 601 bp, Human
gaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtaagcgagggtaaccttcccttcctgctgtctccagcatccctccttggccttttggggccaggcttcatcagcctttctcttcaggtgtgaccaccactccatggtctttggccyggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagaggtttgagggcaatgagtgtgggcagtggcctaaggcagaaacagggcaggcggcagcaaggtcaggactaggatgagactaggcagggtgacaagg

SEQ ID NO: 1755 - DNA, 601 bp, Human
agagtgcagaggtttgagggcaatgagtgtgggcagtggcctaaggcagaaacagggcaggcggcagcaaggtcaggactaggatgagactaggcagggtgacaaggtgggctgaccgggagtaggagcagttttagggtggcaggcggaaagggggcaagaaaaagcggagttaacccttactaagcatttaccctgggcttccaggcagccctggaagtcaagagaacactcagaaatggggagggagaagcagtggaaatccatatgggttgaggagtaggtaagatgctgcttctgygggactgggaatgcgctgtttctcagtgacatggtctccgagaccaggagggatacacctaaggcagcctttccctcttgatgacttctacttgtccccccttctcaaagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggaggtga

SEQ ID NO: 1756 - DNA, 601 bp, Human
tccatatgggttgaggagtaggtaagatgctgcttctgcgggactgggaatgcgctgtttctcagtgacatggtctccgagaccaggagggatacacctaaggcagcctttccctcttgatgacttctacttgtccccccttctcaaagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgrtggagtgggcagacagcgatctgtgacaacggaggtgagaagcatcccctccccctacattgctgtctccctgacggcgcccagcccgaggagtgggcactcggctccggacactgtaactcttgctctctaccttgctcacggggcctcaggcttcagtgcttacctcgatgtctcatacctctgcagcggggtactgctccaacccgggcatccccattggcacaaggaaggtgggcagccagtaccgccttgaagacagcgtcacctaccactgcagccgggggcttaccctgcgtg

SEQ ID NO: 1757 - DNA, 601 bp, Human
aagttgaagtcagggactaacaccaagaaggccctccaggcagtgtacagcatgatgagctggccagatgacgtccctcctgaaggctggaaccgcacccgccatgtcatcatcctcatgactgatggtcagaagggacctctctcctgtcccagcctccccaccttctcagaccagcatgtggcccttaagtccacttgtaacactatacccatggttggggccctgaatgtgactcatagctggctgttcatctctcctgtgacccttcataaggaattcttcctaagccctgtgatcractatctctaacccttcctcaacttgctcaccctgccatgtgtatccctgcctttagccagtttatcttccttatctcctaccctcatggtcctgtctcttctgcaggattgcacaacatgggcggggacccaattactgtcattgatgagatccgggacttgctatacattggcaaggatcgcaaaaacccaagggaggattatctgggtgagtaacctgcctaggacccagcaccccacttcctcagggcttggaccctcatccttcctttttatccctcagatgtctatgtgtttgg

SEQ ID NO: 1758 - DNA, 601 bp, Human
catcaatgctttggcttccaagaaagacaatgagcaacatgtgttcaaagtcaaggatatggaaaacctggaagatgttttctaccaaatgatcggtagggagatacaagggaataaagaacacaactctcctcaggttcccctgaagtaattcattcttcctctacacctgaagctctagttgcctggaaagccttcttcattcctccttctctacctcagtgtcactattcttgtttcctggcactgttcacttaaccttagaatcacagagctctgagcacttcagagatctttctayagtcctacatttgacacgtggaaacagaagccaaaggaggtcaagggacagcaagttagcaacaagggtgggcttgaaaacagccaggcctctgacagcttgatcccaagttctttcccttttcagtccaccatagcagttttctcctaacacgaggaaacaaatacccgtggtctttccctttctccttttgggcctttgctccccatagactcctacccaaaaggctgctgccatttgggaatgaagtgttccgagttttcagcacattctccttctctgccagatgaaagccagtct

SEQ ID NO: 1759 - DNA, 601 bp, Human
caagtgcccaaggcccaacagtccttttctctacagcttctcctctccttgcaggtgattctggcggccccttgatagttcacaagagaagtcgtttcattcaagtgagtcctccctttcctatctggggagatgccaagtggtcagcatgggccccaaagcaggaaagctcaatgcatgtggctagtaattcgaggtaggcagagcctgcctcaccttaggaccgcatgtcttgcctgcgtgtgtcaagaacgaggctgagctgggtccctagtctgattcctttaggtcagctaagacrcaagcaggaacagccatgcttccaggattaggaattctactgaatgatccatggcaccccactgcctctgcaggttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaacacctgtgttccagatcct

SEQ ID NO: 1760 - DNA, 601 bp, Human
tctgggagaaaccatctgtggagtgggggacacaggcacagagtgtcccgtcctgggcaaggggtcccctcctctcgctgctccctgccaagagcccagagggaagaaaggaccatggcatgagcatctatgtatgaagtctcctctgatccctaggaggagggatggggcgtgtgttgtgtgtgtccacgcgtgtgcacagtggaactgatgaggtgtgtgaagagagaagggtgttcctgtctccctgaattgcctcccatgccctggcttctcccctggcttctccctccctcctggktgcccatcacccttactcacatttctcaaggcccgtgttgaatcctgggctctcccgacagcgtcttcgtgcactgtgtgcagagggagcccgcgtcatgcacagcagggaggggagggttttctgtggagtggaggggggaccattcccggaggaatgttggagggaatgaactatttgcataaacaaaagatctgagtttccactttaatttagttttggttttgaaatccctgtttgtggtgccacctgctggtcggtgagggaaagggctaaggagacgggagtctggctttttag

SEQ ID NO: 1761 - DNA, 601 bp, Human
agagcgtctgggagaaaccatctgtggagtgggggacacaggcacagagtgtcccgtcctgggcaaggggtcccctcctctcgctgctccctgccaagagcccagagggaagaaaggaccatggcatgagcatctatgtatgaagtctcctctgatccctaggaggagggatggggcgtgtgttgtgtgtgtccacgcgtgtgcacagtggaactgatgaggtgtgtgaagagagaagggtgttcctgtctccctgaattgcctcccatgccctggcttctcccctggcttctccctcccwcctgggtgcccatcacccttactcacatttctcaaggcccgtgttgaatcctgggctctcccgacagcgtcttcgtgcactgtgtgcagagggagcccgcgtcatgcacagcagggaggggagggttttctgtggagtggaggggggaccattcccggaggaatgttggagggaatgaactatttgcataaacaaaagatctgagtttccactttaatttagttttggttttgaaatccctgtttgtggtgccacctgctggtcggtgagggaaagggctaaggagacgggagtctggct

SEQ ID NO: 1762 - DNA, 601 bp, Human
catcttgttcccttgggacataaattccttctttcccggggggttgcccagtggagaacccagttgcccacagaacctccccaggcttttcttatcagcagagatctggtggaagaaggacagggggtaggaagaagatctgttgcggagtggcgcacgtggtggctcagtgatggtcctccttgtctcgcccagagtgcatcatgcaccacagtggctctggctggtcactacctgctgggctcagctgctgcaaacttccccatgtgactttcagctgttccctgagtctcccactgaytcactctttgcgtgttgtcctggactgggtacctcaccctttccctgttttctgctcctctggcaggtttcaggtccttctccatccccaccacctcctatggcctgttcccctggggtcctggttgtctgtacccagcctttacctgcccctcattcccagagctcagacagctccgctttattttctgtcttcagattccacctcagcctaatcaaaccattcacacctcgagtgcctcctgatgccctcggcggaacatgagccctgaagcccacccatctcagtgtcagcaggcac

SEQ ID NO: 1763 - DNA, 601 bp, Human
cacagcttggtagtaggccaggaagcccttgtagaacatgatggtcccattctcctcgttggagaagtctgtgtggaaggtcagcagcatcttgttcccttgggacataaattccttctttcccggggggttgcccagtggagaacccagttgcccacagaacctccccaggcttttcttatcagcagagatctggtggaagaaggacagggggtaggaagaagatctgttgcggagtggcgcacgtggtggctcagtgatggtcctccttgtctcgcccagagtgcatcatgcaccacartggctctggctggtcactacctgctgggctcagctgctgcaaacttccccatgtgactttcagctgttccctgagtctcccactgactcactctttgcgtgttgtcctggactgggtacctcaccctttccctgttttctgctcctctggcaggtttcaggtccttctccatccccaccacctcctatggcctgttcccctggggtcctggttgtctgtacccagcctttacctgcccctcattcccagagctcagacagctccgctttattttctgtcttcagattccacctcagccta

SEQ ID NO: 1764 - DNA, 601 bp, Human
acccacagcttggtagtaggccaggaagcccttgtagaacatgatggtcccattctcctcgttggagaagtctgtgtggaaggtcagcagcatcttgttcccttgggacataaattccttctttcccggggggttgcccagtggagaacccagttgcccacagaacctccccaggcttttcttatcagcagagatctggtggaagaaggacagggggtaggaagaagatctgttgcggagtggcgcacgtggtggctcagtgatggtcctccttgtctcgcccagagtgcatcatgcaccrcagtggctctggctggtcactacctgctgggctcagctgctgcaaacttccccatgtgactttcagctgttccctgagtctcccactgactcactctttgcgtgttgtcctggactgggtacctcaccctttccctgttttctgctcctctggcaggtttcaggtccttctccatccccaccacctcctatggcctgttcccctggggtcctggttgtctgtacccagcctttacctgcccctcattcccagagctcagacagctccgctttattttctgtcttcagattccacctcagc

SEQ ID NO: 1765 - DNA, 601 bp, Human
ggggcagtgtacttgctggtggtcatcaatatcaaaaggctccaggaacttgaggtgcagggtgaggccccgctccacccggatgctgtagttgcagcgcaggtcaggggggtaggaccgagggtactccaggctggagatgtagcctgatgcctccgtgtacagctcgctgctgcactcagctgtgagagcagagccacagggcattacgggggactccagctggcccagcaagccctggctcaaccccttcccctctgctacaccactctggctcaccctggcaggaatgcctgtcttyctgaagctcatagcctggacggcaggaacagaagtagcctccaacgtagttgtgacacaggtgctggcactggggctggggatcctcctcccctgatttgctccgggaagcacattcatcaaggtctggaaggcattcaggaaggagggttaagcttctgctgggagacctgagtagtggctctgatcttagggaggtcactcaccagagacctaaagacaaaggcatctttaggccacctggacctccaggcctctccaatgctctctggggactgctccatggggacagagcccaggt

SEQ ID NO: 1766 - DNA, 601 bp, Human
cccacagaactcgccaatgttcttcccgttggcatagatctagtaggggaggagggtttttttttttcagcttggacgtttttacacagggccaactgggtagtagcctggtggccagggtggtggtggtggtgatgaaatcctgccttatgtgtgttttcaggggaaggtgaaaagggatccccatgacccaattctagttgtgtgggaacttacccagcccatgggtgatgttggccgttcctgccccagctggccaggggatccaggaggaagttgggacaagaggagccaagtgcakacagaaggggaggaaggggtctttcaggggtaggacggctgtacctgtagctggtcataggggcagtgtacttgctggtggtcatcaatatcaaaaggctccaggaacttgaggtgcagggtgaggccccgctccacccggatgctgtagttgcagcgcaggtcaggggggtaggaccgagggtactccaggctggagatgtagcctgatgcctccgtgtacagctcgctgctgcactcagctgtgagagcagagccacagggcattacgggggactccagctggcccagcaagccctgg

SEQ ID NO: 1767 - DNA, 601 bp, Human
ttctgaaattctagttcctcagctattgtggataatcctgccttttcacttctctgcatcttttaagcctatatagatttccaccgaaagcccaaagttacttttttactgactttcctggtagaataacatgcagtaaaatcattatgattcctccccactcttcccactgcaggaggtgaaactgactcaatttctttctctttccttcttcttttcgtgcttctctctcactttctaattttcacatgaagtatgatatttaagaaggtgaatctttgtttccttttgattttagtgttttttttccattagttaatgattgaatttgactcagggaataacatctgatggaattatatttcaattgtatttcattactacagaattagcacatcttccctctgaacacctacctttcatcatctgctgtgccattgctctagatgttttgcaatgtcttctcattaaattttcacaaggacactatgaagtctgtcctgatcatcttcctgtaatagataagggaaatgaggctttgagttgaccttgatccacttgatatttcagagcctcagttgagatgaaagatatggcccct

SEQ ID NO: 1768 - DNA, 601 bp, Human
gtgcagcccccgtgactcaggaatgcctggtgcttgtgagctgtttgttgccatgaactaattagagcgtattctctggtgagagaatccttcgtgacatgatggatctaatttaaaatgtacaacagcaagtataacctgtagaccctttgtaatgtttacaaggtttcatactttggataaaatgtaaaatgatttcatgccatgtgttttcccccccggataggataaagatggaaagccactcctgccaaaagagtctaaggaacagcttccagtaagcaaaccagttttctctgargatatcttttccttttggccctgattgcaatggtgtttgttgatacatttcctggttcttgcagcccatgagtgaagacttccttctggatgctttgtctgaggacttctctggtccacaaaatgcttcatctcttgtaagtccaaaactcttggttttatttctttagttttttttttttttttcctttgagatggagtcttgctctgtcatccaggcgggagtacagtggtgccatcttcagtcaccgcaacctccaccttccagattcaagcgattctcctgccccagcctcctgag

SEQ ID NO: 1769 - DNA, 601 bp, Human
cggataggataaagatggaaagccactcctgccaaaagagtctaaggaacagcttccagtaagcaaaccagttttctctgaggatatcttttccttttggccctgattgcaatggtgtttgttgatacatttcctggttcttgcagcccatgagtgaagacttccttctggatgctttgtctgaggacttctctggtccacaaaatgcttcatctcttgtaagtccaaaactcttggttttatttctttagttttttttttttttttcctttgagatggagtcttgctctgtcatccaggygggagtacagtggtgccatcttcagtcaccgcaacctccaccttccagattcaagcgattctcctgccccagcctcctgagtagctgggactacaggggtgcaccaccacacccagctaatttttgtatttttagtagagacgggctttcaccatgctggccaggctggtgtcagtctcctaacctcatgatccgcccacctcggcctctgaaagtgcttggattacaggcatgagccaccgcgcctggcctatttctttagttttagagtggcagaaataaatggaaactggtgactta

SEQ ID NO: 1770 - DNA, 601 bp, Human
aaatattaggaaatcgaagagtcaaataaaccatgataattcacgggagctttctttgctgtgattattagattgttactaacagtgttacatacactgaaagcatttgaagacatgatttcaaagatctgtgtaataaaatcactccaacaggaaaactgcttcaaagaaaatagaagatcatggatgtgactaagcatgacagggaaaagctttatcagtcccaagacctgggttctattcactttttaacaatttgttttcaagcaactgacttagcttccctgagctttttacctcaaaaaaaaaaagcctgcttagttcactgagaaccattgtgggcatcaaataaaactggatagtgtatgtgaaaacattttgaaaatcaactggaaagttctatacagtattggacagagttcagcatggtgtcttatacaatgtagatattaaacacattttaattgaattcatttagaggtggaattttgaatgcaatgtgttgaaaaatatggattttgctataataatactaataataatttaccatttgttgggtcctaacatacaactagtattgttttaaatgccttttcaatca

SEQ ID NO: 1771 - DNA, 601 bp, Human
aaacgtgaaatgagtacctccttgttattttcaggagagttaattctgcagatctcagtttgctattgttttggctgttctaaggcactgctctcgatcactgaattgtcagcccttccatactgggtagcttaatttctagaccacttcagcatcctatctctcacccctggtaactcgtaagtaatgccttttttggtgaatggactttatttttatacgtaacctgctccagctttcctcggttgtttcccattgttcatttctctcccataacactgaaaacagggtttttttttgtttttttttttttgccttttggtacacaaaagccagtcctgatcgagacaagctctattttgttttttaaatacattttattgtgtatatttgaggtttacaacatggtagtttgggatgcatagaaataataaaatggttactgtagggaagcagatttacatatctatcattctcacacaactactttttgtgacaaaagcagctaaaatctacttagttaacaaaatccctaatacaattttattaaccttagtcctcatgttatacattaactctctacacttgttcattctgcata

SEQ ID NO: 1772 - DNA, 601 bp, Human
ggagagagttgccggttcctgacaaggcagtgttgtggggagatggaaaggtagcctgggatccccaggagcccgccccacctccatcagctcaggctgggggtgctggcaggcattgctgtcacaatgccccatctctgctgtcacttcctgttctgagtcatcagggaaggggagtctccctgacttccagcaacaatccttgagtctgggactgccctggcctaagatgggccagtttctatcttcgactttcttggagggctcaccggccacagtgtggcacgataagctttgtgayggtgaacgcagaggagcaagagaagcagttcgtatcttccaggaccaagtaatgtattgggaagaagggaaacttgattacaacacaatgtgagatatacattacttagagtagccgacagaagcagtgtcatcttgaggaaagcggggtgttggcagaatcctggggggagtcaggaggccaagctgagttgtggctttaccacctgagggcgacagggccacaagtatattgcacttctgccccaagcttcttacagacacttaaggagagacaattaatgtgggaagggagggtata

SEQ ID NO: 1773 - DNA, 601 bp, Human
aatttttagccacagtgcatgacaacagcatcttgcctttgcatcttgttttgttgtatctgtacccttgacattgtcaaaggacatgtctgtcccccattcagatattaactctgaaaaccctgaacctttttttctctgctccctacagttagaccccttgagggatggtttgtccctgcctggcttcctaagtagtgaccatgtgttcatttaaattcccacagatttaaatgtttcgtttattaacagttcttacaatagatcctaaaactcagaaggaacaatttggggataattycttttctaactgctatatggataaaagcaccataggtcttctgaggggtagatatgaatgtacgagggtttaccagtatcctaagtgaaggtggttttgttgctgttgtttttgattatggtgaggatggtagactaactcctgtcattacatttgtcatttacttttgaaatcatgcatataaacacatgttggaaaatagttacaattctaagttatgaaacctcatatccaaaaaaactaaaccgtgttataggaatgatatccacctcttcactctaggttggagaattggggttt

SEQ ID NO: 1774 - DNA, 601 bp, Human
aacagttcttacaatagatcctaaaactcagaaggaacaatttggggataatttcttttctaactgctatatggataaaagcaccataggtcttctgaggggtagatatgaatgtacgagggtttaccagtatcctaagtgaaggtggttttgttgctgttgtttttgattatggtgaggatggtagactaactcctgtcattacatttgtcatttacttttgaaatcatgcatataaacacatgttggaaaatagttacaattctaagttatgaaacctcatatccaaaaaaactaaacmgtgttataggaatgatatccacctcttcactctaggttggagaattggggttttttaaaagcttcgattaacatagctacatctttattgccaaagaacttttttttcctattactctacccaacagattaaaaacatttttaataacttaaagtaaatgtgcattctgcttggtaacatctcgatttttatagctcaactcctttttttatactttataaaaagtaaatctgaaacacaaactcatgtaaatctaagaaaaaaattagctgacatttcatatcctggaattcccagaaa

SEQ ID NO: 1775 - DNA, 601 bp, Human
gccccaacctaaccctgatattcttgcaattgaagtcctgcaatgactccttcggaaagctctggaacccatgccttccttcttatcccagcttctgtaactgacctgattggaactgtcaccacccctcccctctgggttgcagtggcctttctgcagtctccttcatgtccgccggactcattctttctcaagcatgtctgtagttatgtcattcctctgcttctatccccaggagtttcccatccctacaaaaaaaagttcctattaccatattcttgacccagttttctttcctacmaaactgtgtccctgtgtcagtaaacagaacaataagtatgtgtgcatccctggcttttctcacttggttcctctgtcttgattgacctttctttctaatgctagatcaactaaagtcttactcatcttttcaaggctctgctgaaatatggctttatctgctgcttttccctccctaagctatatccatccaacctttattaagcagaacacaacatggcagaggatctgtagttctttttttatatatcactattaaagcctttgttacaaagaagagtttagctgttttagtccctct

SEQ ID NO: 1776 - DNA, 601 bp, Human
tgctgcttttccctccctaagctatatccatccaacctttattaagcagaacacaacatggcagaggatctgtagttctttttttatatatcactattaaagcctttgttacaaagaagagtttagctgttttagtccctctttaactctaacatttatgccaagtttaaatgggtagtaagttccttgaacgaagagatcatatcctattaatgaccatctgctgagcaccttgcatataggataggcttccataaaagtctagatttaaaacaatttgtttaaaggtttgcttctgttytttttgtttgtttgttttgttttgttttttcttgagatagggtctcactctctctcccagctgggagtgtagtggcacagtcttggctcactccagcctcaatcttccaggcccaagcaattctctcgcctcagcctcctgagtagctgagactacaggtgcatgccaccatgcctggctaatttttgtattttctgcagagctggggtttggccatgttgcccaggctgattcaaactcctggactccagtgatccaccctccttggcctcccaaagtgctgggatcacaggcatgagc

SEQ ID NO: 1777 - DNA, 601 bp, Human
gaacgaagagatcatatcctattaatgaccatctgctgagcaccttgcatataggataggcttccataaaagtctagatttaaaacaatttgtttaaaggtttgcttctgttttttttgtttgtttgttttgttttgttttttcttgagatagggtctcactctctctcccagctgggagtgtagtggcacagtcttggctcactccagcctcaatcttccaggcccaagcaattctctcgcctcagcctcctgagtagctgagactacaggtgcatgccaccatgcctggctaatttttrtattttctgcagagctggggtttggccatgttgcccaggctgattcaaactcctggactccagtgatccaccctccttggcctcccaaagtgctgggatcacaggcatgagccaccacacccagccttgaaactttattcttgtgataaaataagatgggacagtggttctcaaactttagcatgcatcaggatcatctggagagtttttttttaaacacaggctgctagactctacccccaaagtttcttagtacatggggcaggggtctaagaatccgcatttctaggttcccttatg

SEQ ID NO: 1778 - DNA, 601 bp, Human
attttacacatgtggaaactcagtttcacgagtttcagtaacctgcctaaggtgagaagtaaaaccaagttgaaaaaaatggcagctgaagagttttagcatgctttgacttatttactatttagcaatccttaggtattcaagagaatcatgttcacaccatataatgtagcggagtgtcttgttggtctaccattactcagtcttattaaccaaatatttctaaacttattgagagtacttgtgtctttcctcaggaatctaaggccgctgctccagctcctgtgtcggaggctgtgtstcggacctccatgtgtagtatacagtcagcaccccctgagccggctaccttggtgagtgactccctgggcatttgagcagtggcttgagaaagttttctgcctcctcctgtcactctctgctgtgtattaccatcattttatcttatcctgacaaattaaaaataaaatctgatatcattatagtatctgttgtttctttgggcttcaggggtgtcgtagaaattcagactaagatttaaatttttaattaaattactcccaactgtatttttctctactcttctgaaattctagttcct

SEQ ID NO: 1779 - DNA, 601 bp, Human
attctagttcctcagctattgtggataatcctgccttttcacttctctgcatcttttaagcctatatagatttccaccgaaagcccaaagttacttttttactgactttcctggtagaataacatgcagtaaaatcattatgattcctccccactcttcccactgcaggaggtgaaactgactcaatttctttctctttccttcttcttttcgtgcttctctctcactttctaattttcacatgaagtatgatatttaagaaggtgaatctttgtttccttttgattttagtgttttttttccattagttaatgattgaatttgactcagggaataacatctgatggaattatatttcaattgtatttcattactacagaattagcacatcttccctctgaacacctacctttcatcatctgctgtgccattgctctagatgttttgcaatgtcttctcattaaattttcacaaggacactatgaagtctgtcctgatcatcttcctgtaatagataagggaaatgaggctttgagttgaccttgatccacttgatatttcagagcctcagttgagatgaaagatatggcccctgctctca

SEQ ID NO: 1780 - DNA, 601 bp, Human
acttttttactgactttcctggtagaataacatgcagtaaaatcattatgattcctccccactcttcccactgcaggaggtgaaactgactcaatttctttctctttccttcttcttttcgtgcttctctctcactttctaattttcacatgaagtatgatatttaagaaggtgaatctttgtttccttttgattttagtgttttttttccattagttaatgattgaatttgactcagggaataacatctgatggaattatatttcaattgtatttcattactacagaattagcacatctwccctctgaacacctacctttcatcatctgctgtgccattgctctagatgttttgcaatgtcttctcattaaattttcacaaggacactatgaagtctgtcctgatcatcttcctgtaatagataagggaaatgaggctttgagttgaccttgatccacttgatatttcagagcctcagttgagatgaaagatatggcccctgctctcagctgtcttcaagactagtgtggatatgagccctccccagttttttggggtttcagggtactcttcaggtactttttacagcatgtgtgctag

SEQ ID NO: 1781 - DNA, 601 bp, Human
agaaaaacagcttttcttacttgaaatcatggctaaaatataaaacagaaatacagttttactctaaaattttaataggtgctcattgtgaggtcagagattttaataataagattaaactctgagattgtttgacccaaggccttttacatttttgtttgaccaagaccaacagtgggaaattcattgatattgcaaccccatccccatacactggaagcaacagtttaaagaatagtatttatcccttctatgtatgatgcattttatacacacacacacacacacacacacacacacwcttacatttttttttttttgaggcagagtctcgttctgtcatccaggttggactgcaatggcatgatctcggctcactgcaacctcaacctcctgaggtcaagcaatcctcccacctcagcctcttgaggagatgggactacaggcatgcaccatcatgcctggctaatttttaaaaactttttgtaaagatgggatctcactgtgttgccccggctggtctcaaactcctgagctcaaacaatcttcctgccttggcctcccaaaatgctgtgatggattacaggtgtgagccactgtg

SEQ ID NO: 1782 - DNA, 601 bp, Human
ataatgatatgcctttctgaattgatagcatatgttttaaagggagtgattaaccacctacttaatatatccactaatgcactttcagaagggcacagtgccagatgatgctgtagaagccttggctgatagcctggggaaaaaggaagcagatccagaagatggaaaacctgtgatggataaagtcaaggtaatggcaactgagatgcttctggaaaataaatatcattgatcaccttctccccctgcaaataagttagtcatttgttttgttttttatatttcctgtaaaacatgaccrgctggctttttctattattgtgcatatcctgtttaataagctaaacctgaataagctgcagtgttgaacccccacagtggatggtcgacatgcacagaccggaggcctctgagtctcatctttgcccacctgcattgacattgctgggacttgggaaggaaggggcagctgcctgctgctcctcacagctgtcttgcatcccagcaggctttctgctggtgcctgagtctgccagatgaagttgctgtaggagcactaagcatacggtcatatgtacttcctaacctaatgatagatttg

SEQ ID NO: 1783 - DNA, 601 bp, Human
gatcctcaagtgaaagaaatctaatgtctaagctacctaatgttttcctttctaacccacagcttgttacaataccagaaatattaaaaaaccttgtgtagataggagaactaaaatgaggaataggccgggcatggtggctcatgcctataatcccagaagtttagaaggccaaggcaggagcatctcttgagcccaggagttcaagactagcctgggcaacataatgagaccctgtctctacaaaaaaatcaaaaaaattaggcatggtggcatgtgcctgtagtcccaggtacttgcraggctgaagtgggaggatcacttgagcccaggaggtagaggctgcagtgagccatgatcgtaccactgcactccagccagggtgacagagcgagaccctaactcaaaaagaagtaaaaaatgaaaaaaaataaaataaggaacaattactttatataagaaaaatttgcaactttcagatataagttggaaaaataagagaacctatttaacattgagtatagtgttaagttgccccatttcttctattttgaaagtacagattgtacacaacaagggggaagaccccattatgagtcct

SEQ ID NO: 1784 - DNA, 601 bp, Human
catacagcatacatagaatataacaaacagttaaattatttgccattataagtattgattcagtagcaggaaaactgtcaatatattgtagtggtatatcaaatagaaacaaataatcatgtccatgtaaaagatctatttaaaattttacatatactcatattataaataaaaactttttaaaaagtaggcaatcccctaatctgttaaagagtctttagttttcagaatcaaatattcaatatcatgctggaggcattttccttaaaagcagaaactatgaaaagtttattgtcatttstgcttattatcacatggaagaatcattaacaacacatgaaaaaaatgacaaacattaaaagggaacatttgaatatatttgtggatagcactacttgtagataatacatttgtaagtaacattatgccatgtttattagtaacaacagatgagaaaatgtaattaatatgagatcagacttaatgtaaactataaaaggagaaatgatcagaaaaataaggacacaaaaaaattgaaggccatacattaagtcagtttaactaaatatcttaaaaagaatgatgacaattcaagtcattt

SEQ ID NO: 1785 - DNA, 601 bp, Human
aattttttattaaatagcaataagatacttttataactcaataaaattattcaatgatacattcggaaaataaatgtataaaatatgaaaaagtactaaaaagcatttttcagtacttttaggtaagattaatccaactaaacactagcatatgttatacagtaataataagtggaaaatacaataatgttgagaaagcaaactcaaagcatagatcaatgaaaaaattgagaaatggacataaatgatttagtatttttaaagagagtgaaaaatcattattttatgcttttgtgtagcrttagatgaattaaataacatatgcacatatagctttgcgatacaaatttccagaccataggttgtttcatacttagtattaaaaggcttaaataataagtcaataagatagtttaagaagagacaatacaaatgtttcaatgtcattcttttcatttgacaacttgttattcttttcatttgtcatataagcaaagatttctcataactaaaaatgaatttaatttagtacattttggattacctaaaatattacattctaaaacggctttacagggtataaatggacaataagtatctt

SEQ ID NO: 1786 - DNA, 601 bp, Human
tgatggcattgtgctcataattttatatacaacatgttactaataaaatttttttcaataaaagaaatttgaagatgctaaacttgctgctgccatctctgaagtggtttcccaaaccccagcttcaacgacccaagctggagccccaccccgtgatacctcggtaagcagcacatcttatttgggagataaatgtttttgcgcagccacaactagaaagaaaatagggcgcctgtttaaagcaaatgaaaataggcagaattattaggaagatcaggcaccttctatttcagaagagccragactgatgatttagcgagatggcagagattaactttgaaatgattaaatgaaactatatatgtgaaaacattgtacacatagtcaaggaccttaatattattgttgctttataagaattgaaagtgcaataaagtgcattgtgtctatattcaaattactagatttgaaaagttctttagctttcctgataattgattttctcctttatattttttcttatacattctataatttactacccattatttaacctcaagtttattttatggaatcgtcatgtttgagcttttacaaacat

SEQ ID NO: 1787 - DNA, 601 bp, Human
aatcgaagagtcaaataaaccatgataattcacgggagctttctttgctgtgattattagattgttactaacagtgttacatacactgaaagcatttgaagacatgatttcaaagatctgtgtaataaaatcactccaacaggaaaactgcttcaaagaaaatagaagatcatggatgtgactaagcatgacagggaaaagctttatcagtcccaagacctgggttctattcactttttaacaatttgttttcaagcaactgacttagcttccctgagctttttacctcaaaaaaaaaaaagcctgcttagttcactgagaaccattgtgggcatcaaataaaactggatagtgtatgtgaaaacattttgaaaatcaactggaaagttctatacagtattggacagagttcagcatggtgtcttatacaatgtagatattaaacacattttaattgaattcatttagaggtggaattttgaatgcaatgtgttgaaaaatatggattttgctataataatactaataataatttaccatttgttgggtcctaacatacaactagtattgttttaaatgccttttcaatcatttacttttc

SEQ ID NO: 1788 - DNA, 601 bp, Human
tgcagaatcttgcttcctaaccatctgacaacattagtagatgtttgttttcatatccagttttctaatggtgtttaatttctaaatgaaaggcacacatgattggttcatttgcttttggaccctttatgtgacctccaggtcacccactggatatggctcctgaggctgccactaagacctccttaacctggtgggatcttcaccaagagatgggcagggttgggtggaaggtgctggccctccaaccccagtagggtgacagatactgccgctcttctcctgatcttccattcctagscttctcttctctgaccctgtctactcccctgccccagccccagatgtctttttcttccaaggaaacaggttccctcctgaaaagatggagttcctgggctaatttgcctctgatacagtttggctaatgagtgactaattcagcattatttacttttcagcagagtgacaaagacctcgatgatgccttggataaactctctgacagtctaggacaaaggcagcctgacccagatgagaacaaaccaatggaagataaagtaaaggtaaaaaaaaaaaaaaaaaaaaaaattcactaata

SEQ ID NO: 1789 - DNA, 601 bp, Human
catatgttttgcctcatgaaagtacaacaaatgctgaatgctgcatttgacaatgtattttctaagtgaaagaggaaatgaatattaattctatctgctcactgttgatataggaaaaagctaaagctgaacatagagacaagcttggagaaagagatgacactatcccacctgaatacagacatctcctggatgataatggacaggtaaactgaggcaaattgctagatcggatttatgctaccaagatctttaaattcaaacctcccttgaaataaatagtagctatactcctttacartagcataaaacatatcatgactgactgcttctaatgtgtcaccaaagccgaccagcaggtaaatatttatttgagccaatatcattatatatgcatatgctaggctctgtggtataaacagggttgaatactgttcagtcactcacagatgcttaagagtgatccaagaaatgtgattctctctttcaagaaaaggctataaaaatgactaaggtgataggatttcaaaggaagcaatctctgtttaaggagagcagaaaaggagctggtgttgggataattaatagggaaaattaataa

SEQ ID NO: 1790 - DNA, 601 bp, Human
atgaaagtacaacaaatgctgaatgctgcatttgacaatgtattttctaagtgaaagaggaaatgaatattaattctatctgctcactgttgatataggaaaaagctaaagctgaacatagagacaagcttggagaaagagatgacactatcccacctgaatacagacatctcctggatgataatggacaggtaaactgaggcaaattgctagatcggatttatgctaccaagatctttaaattcaaacctcccttgaaataaatagtagctatactcctttacagtagcataaaacataycatgactgactgcttctaatgtgtcaccaaagccgaccagcaggtaaatatttatttgagccaatatcattatatatgcatatgctaggctctgtggtataaacagggttgaatactgttcagtcactcacagatgcttaagagtgatccaagaaatgtgattctctctttcaagaaaaggctataaaaatgactaaggtgataggatttcaaaggaagcaatctctgtttaaggagagcagaaaaggagctggtgttgggataattaatagggaaaattaataaggcagctccaagacc

SEQ ID NO: 1791 - DNA, 601 bp, Human
agtcatgggacaatagattctctactgcctaaacctaagtaaacctttacagatatctatgcttaaccaatagtctgccttctttttaaggacaaaccagtgaagccacctacaaagaaatcagaggattcaaaggtaaagaccataggaacatatttccattaaattttgttttattctagccataggggtatttggcattttagaaaactaaaacatattgaatgcctactctgtgcctggtactttgtcaaagcatgcatataaatgtgtgtgactattgtttacctctcttttagtyttcacaaaagccctttagggtggaaaactgaggctcagagaatgctaagcaacgtgtattaaagagtagatggaaaaaaagccatcaagattttcttgtttttctatctcctttacaatacattattattaataaagaatgtcagtcagtttttttcttatagaaacatcttttatttgtaagtgatgtgggaaaagaccccatattgcattttgccttctgcttcttcactgatggttatttctactcatatctcagaaacctgcagatgaccaagaccccattgatgctctctcagga

SEQ ID NO: 1792 - DNA, 601 bp, Human
tcaacaagtgtgaggcattttccctcaagctacaccctcttgtaaatcaaatagaaggaaacgtgaaatgagtacctccttgttattttcagaagagttaattctgcagatctcagtttgctattgttttggctgttctaaggcactgctctcgatcactgaattgtcagcccttccatactgggtagcttaatttctagaccacttcagcatcctatctctcacccctggtaactcgtaagtaatgccttttttggtgaatggactttatttttatacgtaacctgctccagctttcctyggttgtttcccattgttcatttctctcccataacactgaaaacagggtttttttttgtttttttttttttgccttttggtacacaaaagccagtcctgatcgagacaagctctattttgttttttaaatacattttattgtgtatatttgaggtttacaacatggtagtttgggatgcatagaaataataaaatggttactgtagggaagcagatttacatatctatcattctcacacaactactttttgtgacaaaagcagctaaaatctacttagttaacaaaatccctaatacaatt

SEQ ID NO: 1793 - DNA, 601 bp, Human
agtacctccttgttattttcagaagagttaattctgcagatctcagtttgctattgttttggctgttctaaggcactgctctcgatcactgaattgtcagcccttccatactgggtagcttaatttctagaccacttcagcatcctatctctcacccctggtaactcgtaagtaatgccttttttggtgaatggactttatttttatacgtaacctgctccagctttccttggttgtttcccattgttcatttctctcccataacactgaaaacagggtttttttttgtttttttttttttgccttttggtacacaaaagccagtcctgatcgagacaagctctattttgttttttaaatacattttattgtgtatatttgaggtttacaacatggtagtttgggatgcatagaaataataaaatggttactgtagggaagcagatttacatatctatcattctcacacaactactttttgtgacaaaagcagctaaaatctacttagttaacaaaatccctaatacaattttattaaccttagtcctcatgttatacattaactctctacacttgttcattctgcatatctgctattttg

SEQ ID NO: 1794 - DNA, 601 bp, Human
tagattttagaacatggaagttggaaacttcctattattaaaattactcaagctgtgatgagaaatgaaaattggattagacaacttctaggtcccttccaattccaagaacatatgatttaaatgattattactatgatcccctggctataaggaggagttaaaggtgtagctttaaagacaatagtccagttacaccaaagcttttaaaacaatatattaaaatcttcctgtagtagattcccttaagggatataggaaacagcattgataattggcagttatgccattatatctcagwttaaatacttatttgcctattatttaatttcagttatacgaagtacttaatcagccctttaacaaataatagaaagcataataaccctttatgatgagtggatttactggacagccatgaccctatgtacaggaaaggaaggatcaccacagaatgaaacattgccatttaagaacacctatgcatattttataacctaccctagccttaaaaaaataaagctgagagtgatacatttaggatcaggatcacttaaggttatttttagcttataagcttgaggaggaagaactcacaata

SEQ ID NO: 1795 - DNA, 601 bp, Human
gagaagtgaagtccacctcttgagtaattcatgctcactttacagtattggcatgaaatgcatactgcaagatctacagagtaattggtcattctctgaaagcactaaatgggatgagtttgctattgaaatgtttaaaaaccttaatcttataattaaaagcttttaaaaatattaggccaggcacttagaatgaccatctgaggctagttgaatctttgaaatccaaatgctcattactgcaggttattgtggcaaagcaaaattagcatgttacaacttagcgaaatgtcctgaagayattggcattccccagaataccaatacatggtggggtggggagaagtaccctttagagtctggtggaaattacagggttttgggaacaagggcaaaggaaaagattggccatttttatttgtcattattttggaaagtaaagtactgtgtttgattctaatttataattgctgaagaaactggacagattgaagggatttctgagatcttcagaactgggcccttatcttaatcttcagaaaggagagggcttaatgtaagccttaaaagcatacaagcacttactgaccaaagcctaaaa

SEQ ID NO: 1796 - DNA, 601 bp, Human
ccctgagtataatccttgatgagtagcaccagagagagctccacgttacccggggcctggcattcaaagcactcagtggtctggtgccactcaaagcctgtgagccaggcaggaagtttataaaattagagatggatgaatggatggatgggaaaaagcaagcaagggaggaaggaaggaagaaaggaaggagttctgggaagagagagaggctgcccccgcagggctctcagtttgaaggagaggtgcagcacactcagaaaaaactcccggccaggagtggtggctcacacctgtagtrccagcactttgggaggccaaggctggcagatcacctgagatcaggagttcaagaccagccaggccaacatggtgaaaccccatctctactgaaaatacaaaaatcagccaggcgtggtggcacctgcctttacccagctacttggggggctgaggccagagaaacgcttgagcctgggaagcagaggttgcagtgagcggagatcacaccactgcactctagcctgggagacagagcaagactctgtctcaaaaaaaaagaaagaactccgtgagcatcccaaatgccacatccccataa

SEQ ID NO: 1797 - DNA, 601 bp, Human
tagtcagccaaacactgacatctcagtgcttagaagctgagataggattatttaatttagccaaagcaaggggacagaagagagaaactctcaaatctgacctgactttgagcgttagtgggggcttttatgagtaaagtaggtgtgcaggaggtgacctcccgatcgtcaaagctgttgtgcccctcggctcatcaaatttctggatgtcatcaaggaggtctgtgtgacctaaggatcattgttctttgaaagagagacaagttcatttatcttgcaggcagctgccagggagtcaggwtgtaagttaaacaattatgagtgaattaatggttacctgctactgaaatgaccaaatgtaactaatcatgcatggaggaaggaaaggacaaagagaaaagaaaagaagtaaaacgaacatcttataatttttataacataggttcagttatagcactgcacatgtaggggtggctttgacccatcaaacacaggtgtggggggcccctgccacagggagtgtggtcactccgttccacaccgtttcccggatgggcagttctgagcagccttaaatttggggtgagcaatgcaacttcag

SEQ ID NO: 1798 - DNA, 601 bp, Human
gggagtgtggtcactccgttccacaccgtttcccggatgggcagttctgagcagccttaaatttggggtgagcaatgcaacttcagaccccgctgtctgaaggaggtggtccagccttggggagagctgaggctgggtgcacacagacccactccactaaaggaatgcggtgcgtggatggctgcaatactgaaggaagccatgaaagtaacacaagtttgtcaaagctgaaaagtccgtgaactaaactgataaaattcacttagaggtggtgggaataggccgggcacggtggctcacrcctgtaatcccagaactttgggaggccgaggcaggcggatcacaaggtcaggagatcgagaccatcctgactaacacagtgaaaccctgtctctactaaaaatgcaaaaagttagccaggcgtggtggcaggcgcctgtagtcccagctactcaggaggctgaggcaggagaatggcgtgaacccggaaggtggagcttgcagtgagctgagatcacgccactacactccagtccgggcgacagagcgagactctgtctcaaaaaaaaaaaaaaaaaaaaaagaggtggtgaggtggtgg

SEQ ID NO: 1799 - DNA, 601 bp, Human
agagctgaggctgggtgcacacagacccactccactaaaggaatgcggtgcgtggatggctgcaatactgaaggaagccatgaaagtaacacaagtttgtcaaagctgaaaagtccgtgaactaaactgataaaattcacttagaggtggtgggaataggccgggcacggtggctcacgcctgtaatcccagaactttgggaggccgaggcaggcggatcacaaggtcaggagatcgagaccatcctgactaacacagtgaaaccctgtctctactaaaaatgcaaaaagttagccaggcrtggtggcaggcgcctgtagtcccagctactcaggaggctgaggcaggagaatggcgtgaacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggaggcttagtgtggtcaaggcctttcagaggggatttcgggtgag

SEQ ID NO: 1800 - DNA, 601 bp, Human
taaaggaatgcggtgcgtggatggctgcaatactgaaggaagccatgaaagtaacacaagtttgtcaaagctgaaaagtccgtgaactaaactgataaaattcacttagaggtggtgggaataggccgggcacggtggctcacgcctgtaatcccagaactttgggaggccgaggcaggcggatcacaaggtcaggagatcgagaccatcctgactaacacagtgaaaccctgtctctactaaaaatgcaaaaagttagccaggcgtggtggcaggcgcctgtagtcccagctactcaggrggctgaggcaggagaatggcgtgaacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggaggcttagtgtggtcaaggcctttcagaggggatttcgggtgagcaaaagtgattcaaagtggagaaaagcaggactgc

SEQ ID NO: 1801 - DNA, 601 bp, Human
ccgggcacggtggctcacgcctgtaatcccagaactttgggaggccgaggcaggcggatcacaaggtcaggagatcgagaccatcctgactaacacagtgaaaccctgtctctactaaaaatgcaaaaagttagccaggcgtggtggcaggcgcctgtagtcccagctactcaggaggctgaggcaggagaatggcgtgaacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggaggcttagtgtggtcaaggcctttcagaggggatttcgggtgagcaaaagtgattcaaagtggagaaaagcaggactgcgttgggtgcagtggttcccgcctgtaaccccagcactttgggaggctgagatcggaggatcgtttgagcccaggagtttgagaccagcctgggtaacatggcaagaccctgtctctacaaaatgt

SEQ ID NO: 1802 - DNA, 601 bp, Human
gcgtggtggcaggcgcctgtagtcccagctactcaggaggctgaggcaggagaatggcgtgaacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggaggcttagtgtggtcaaggcctttcagaggggatttcgggtgagcaaaagtgattcaaagtggagaaaagcaggactgcgttgggtgcagtggttcccgcctgtaaccccagcactttgggaggctgagatcggaggatcgtttgagcccaggagtttgagaccagcctgggtaacatggcaagaccctgtctctacaaaatgtttaaaaaactagctaggtgtggtggcacatgcctgtagtcccagttactcagggggctgaggtgagaggattgcttgagcctaggaggttgaggctacagtgagctaggattgcgccactgcactccagcctgggtga

SEQ ID NO: 1803 - DNA, 601 bp, Human
cgtggtggcaggcgcctgtagtcccagctactcaggaggctgaggcaggagaatggcgtgaacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggaggcttagtgtggtcaaggcctttcagaggggatttcgggtgwgcaaaagtgattcaaagtggagaaaagcaggactgcgttgggtgcagtggttcccgcctgtaaccccagcactttgggaggctgagatcggaggatcgtttgagcccaggagtttgagaccagcctgggtaacatggcaagaccctgtctctacaaaatgtttaaaaaactagctaggtgtggtggcacatgcctgtagtcccagttactcagggggctgaggtgagaggattgcttgagcctaggaggttgaggctacagtgagctaggattgcgccactgcactccagcctgggtgac

SEQ ID NO: 1804 - DNA, 601 bp, Human
ctccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggaggcttagtgtggtcaaggcctttcagaggggatttcgggtgagcaaaagtgattcaaagtggagaaaagcaggactgcgttgggtgcagtggttcccgcctgtaaccccagcactttgggaggctgagatcggaggatcgtttgagcycaggagtttgagaccagcctgggtaacatggcaagaccctgtctctacaaaatgtttaaaaaactagctaggtgtggtggcacatgcctgtagtcccagttactcagggggctgaggtgagaggattgcttgagcctaggaggttgaggctacagtgagctaggattgcgccactgcactccagcctgggtgacaaagcaagaccctgtctctaaagaaaaaaagaggccgggtgtggtggcttacacctgtaatcccagcactttgggaggccaaggcgggaggatcacttgaggtcag

SEQ ID NO: 1805 - DNA, 601 bp, Human
ttaaaaaactagctaggtgtggtggcacatgcctgtagtcccagttactcagggggctgaggtgagaggattgcttgagcctaggaggttgaggctacagtgagctaggattgcgccactgcactccagcctgggtgacaaagcaagaccctgtctctaaagaaaaaaagaggccgggtgtggtggcttacacctgtaatcccagcactttgggaggccaaggcgggaggatcacttgaggtcaggagttcaagaccagcctggccaacatggcgaaaccctgtctctactagaaatacaraaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtc

SEQ ID NO: 1806 - DNA, 601 bp, Human
gacagaggagaaagtccacatcccaaagatcctcccctggcacgctgggacttattcctgtgtggcagaaaacattcttggtactggacagaggggcccgggagctgagctggatgtccagtgtgagtagccacggagcctctggttctagggagagaagatggacacagggaacggggaaggcagatggggtgcagggcattccggggtcctggagtcaagagcaaggagcagccagggtctcctgttcacaactgctgtctcagctcctagcatagggcctggctcatggagggtgctyggtagatgcttgtttttttgtgttttagttttttttgagatggagtctccctctgtctcccaggctggagtgcagtggcacaatctcggctcactgcaagctccaccttcccgggttcatgccattctcctgtctcagcctcctgagtagctgggatgacaggcgcccgccaccacgcccggctaattatttgtacttttagtagagacggggtttcaccgtgttagccaggatggtctcgatctcctgacctcgtgatccacccgcctcggcctcccaaagtgctgggattagaggcgt

SEQ ID NO: 1807 - DNA, 601 bp, Human
tggctcacacttgtaatcccagcactttgggaggccaaggtaggcagctcacttgaggccacgagttcaagcccagcctgggcaacatggtaaaaccccatctctacaaaaaaaaattagcctggcatggtcatgcatgcctgtagtctcagctacccaggaggctgaggtgggaggatcacctgagcctggaagtagaggctgcagtgagcctgtgatcatgccgctgcactccagcctgggtgactgagtgagaccttgtctcaaaaaaaagaatggattggccaggcatggtggcttrcgcctgtaatcccagcactttgggaggccaaggtgggcagatcacctgaggtcaggagttcgagaccagcctggccaacatggcgaaaccctgtctctactaaaaatacaaaaaattagccgggcatggtggcaggcacctgaaatccacctacctgggaggctgaggcaggagaatcgcttgaacccaggaggcagaggttgcaatgagctgagatcatgtcactgcactctagcctgggtagagtgagattctgtctccaaaaaaaaagaataattaactgcaagataccaggactcc

SEQ ID NO: 1808 - DNA, 601 bp, Human
aggtaggatggggctgggcacgatggctcatgcctgtaatcccagcactttgggaggctgaggcaggtggatcacctgaggtcaggagttcgagaccagcgtagccaacatggtgaaaccctgtctctacaaaaaatattttaaaaattagccgggcgtgatggtccatgcctgtaattccagctactcgggaggctgaggcaggagaatcgcttgaacctgggaggcagaggttgcagtgagccaagattgcgccattgcactccagcctgggtgacatactgagactctgcctcaaaamaaaaaaaaaaaaaaaaaaaagggtaggcatgaggcagactgtgaagctgagtggggaaacaaggtgaaggaaggggataaaatgtcctctgaggagacctgggctgtcagaggccagggaaggggacgagggttggggaacaggtggttagcacttcatcctcgtctccctcccaggttagaagggcccccctctctgaagacccccactccctgggatgctacaatccaatgatggaagatggcattagctacaccaccctgcgctttcccgagatgaacataccacgaactgggtact

SEQ ID NO: 1809 - DNA, 601 bp, Human
aggagaatcgcttgaacctgggaggcagaggttgcagtgagccaagattgcgccattgcactccagcctgggtgacatactgagactctgcctcaaaaaaaaaaaaaaaaaaaaaaaaagggtaggcatgaggcagactgtgaagctgagtggggaaacaaggtgaaggaaggggataaaatgtcctctgaggagacctgggctgtcagaggccagggaaggggacgagggttggggaacaggtggttagcacttcatcctcgtctccctcccaggttagaagggcccccctctctgaagrcccccactccctgggatgctacaatccaatgatggaagatggcattagctacaccaccctgcgctttcccgagatgaacataccacgaactgggtactgagggtaccaggagggtgaccctgcaccctgggagggaggcgggaggaaaagctctgtcccgcctgccctctttgtgccaggcccatgccaggcaccctgatacatgctctgcctcattcccactcggcaacaagcctctgggtaagggccagtctccagaagtggacctgctccttcaagtcagcagcacacatgcccagt

SEQ ID NO: 1810 - DNA, 601 bp, Human
tccaatgatggaagatggcattagctacaccaccctgcgctttcccgagatgaacataccacgaactgggtactgagggtaccaggagggtgaccctgcaccctgggagggaggcgggaggaaaagctctgtcccgcctgccctctttgtgccaggcccatgccaggcaccctgatacatgctctgcctcattcccactcggcaacaagcctctgggtaagggccagtctccagaagtggacctgctccttcaagtcagcagcacacatgcccagtccgttcttatcacaaagatcaagasctcgtgatacacacccacgcctactccctccacgcacatttgcacgagctcctactgtgagctttgggcactggggaggccacaggttttacataaggggctgaggttggggtgctgttgggggctctgggtgttgagagggaggagagttcgtgggagatgcttcatgcgtggtcgtctatctgccctgtctctcagagatgcagagtcctcagagatgcagagacctcccccggactgcgatgacacggtcacttattcagcattgcacaagcgccaagtggtaaggagggtctcccc

SEQ ID NO: 1811 - DNA, 601 bp, Human
atgatggaagatggcattagctacaccaccctgcgctttcccgagatgaacataccacgaactgggtactgagggtaccaggagggtgaccctgcaccctgggagggaggcgggaggaaaagctctgtcccgcctgccctctttgtgccaggcccatgccaggcaccctgatacatgctctgcctcattcccactcggcaacaagcctctgggtaagggccagtctccagaagtggacctgctccttcaagtcagcagcacacatgcccagtccgttcttatcacaaagatcaagagctcrtgatacacacccacgcctactccctccacgcacatttgcacgagctcctactgtgagctttgggcactggggaggccacaggttttacataaggggctgaggttggggtgctgttgggggctctgggtgttgagagggaggagagttcgtgggagatgcttcatgcgtggtcgtctatctgccctgtctctcagagatgcagagtcctcagagatgcagagacctcccccggactgcgatgacacggtcacttattcagcattgcacaagcgccaagtggtaaggagggtctccccaggt

SEQ ID NO: 1812 - DNA, 601 bp, Human
agcgccaagtggtaaggagggtctccccaggtctccccagaggggctgtggaaggctggggacagggcctggcctcagtggtgggtcccacataggaaggagttgggtaggcatccgtggtggcagaggttgggtgttggagacggttgctccggcagagctggccagagccaggcaggtacctccaggtcctggatgccggccacagccagtttcctgacacgaggacacccgcctgggcttttggacccccgggtggaatgaaggagagaatgcggagaaaagcggcggtggaggctgrcgacagtggggccaggctaaccaccatgcggttttctcagggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacac

SEQ ID NO: 1813 - DNA, 601 bp, Human
gagaaaagcggcggtggaggctggcgacagtggggccaggctaaccaccatgcggttttctcagggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcrcacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgat

SEQ ID NO: 1814 - DNA, 601 bp, Human
gctggcgacagtggggccaggctaaccaccatgcggttttctcagggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacga

SEQ ID NO: 1815 - DNA, 601 bp, Human
ctggccagcaccacacacaccacatacacacatgcacaggcacacctgtgtacacacactctcactcacacactcacacacagccactgccgcccattcccagctcacgtcacctcttcttttctagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggygaaaacctggagactccttccagcttcaccatcaaagttcatgacgtgaacgacaactggcctgtgttcacgcatcggttgttcaatgcgtccgtgcctgagtcgtcggctgtgggtacgttgcatgcccactctgtcctcctccctccctcatccccagcctgggggcacctctcacatcagccacttcactgcctggggtaggaatccagtgagttcagggtagtgattgtaatgcctgtgttgccactttacatgatttgaaagaaactctagttcctaacaagctctgatctggcc

SEQ ID NO: 1816 - DNA, 601 bp, Human
ccaggattctctctctgcagggacctcagtcatctctgtgacagcagtggatgcagacgaccccactgtgggagaccacgcctctgtcatgtaccaaatcctgaaggggaaagagtattttgccatcgataattctggtctgtgtgactaacactcctggacagtcactgatttggagggacaaggggaggtggatactccaggtgcatgtgctaagggaagtccagtctgacaggtgtcactagctactgaaccacactgtaccatggaagtagtcagtatcatatgtaaagacaaggcrgctggtcaagggagaaggaagcaggcaggtgcccaagaggtggactcaagtccagggaacaaaatcaggatcttgttacccaagaagtggccaaggggcagcagaggatggtggctagccgctctgggtgcaggttcagacagatctggtttccaaagccagctctgccactcaccccctctagagaccttggacaaatcaactaacttctgcaagccttagttccctcatctaggaggtaggaatgcttatatttatatcgtatggtagctgtaaagtttgagttagatcatgtataaa

SEQ ID NO: 1817 - DNA, 601 bp, Human
agggatgagtaggagttttctaggcaggcaagggcaggagaaggatcttgagcaaaggcataaagaaaaagcatgtccggccgggcccggtggttcacgcctctaatcccagcactttgtgaggccgaggcaggtggatcacctgaggtcaggagtttgagaccagcctggccaatatggtgaaaccccgtctctactaaaaataccaaaattagctgggcgtggtggcaggtgcctgtaatcccagctacttggaaggctgaggcaggagaatcgcttgaacctgggaggtggaagttgyagtgagcggaggtcgtgccattgcactccaatctgggtaccaagagcaatattctgtctcaagaacaaagaaaaagcctgtccttaaggacctgtgggtagaaccactagtgacgctcttaagagcaggaccatagttgatccattctatgtcccaaacgctggaaatagggccaggcacacagccagggttgtgggtgtggccatgaggctgctgagatgaaatggggagcagctgaagacagacaccaggcccagccgctgtcttgatgacctcagaaatatcacttgtcgaggccat

SEQ ID NO: 1818 - DNA, 601 bp, Human
cacacaaacatgtggatgcatttatggtgggtttgttgttgtctgtttgcttttgatgtttgattgttttaaaatttttttggatcatgccatgctggtttcatcgatatttgctcttctatcttaactaaatttctcttttacaatctttagaaaaaaatgatatagttccaacagatactttttagagccatataatatgcaatagtaagtataaattcaattcaatcttattttattgtagatgcatagctgattttgccagcaccatttactaaatattataataataagtcatcgytttcccaccttcattatatactaagttttctgtatatacctgtatctacttctaattctctgtcctatccatcattctatagcaaagctattctgttttattctactagcttgtataagtccattctcctataaagaaatagttaagactgggtaatttataaagaaaagaggtttaacaggaagtatagtggcttctccttctggggaggcctcagaaaacttacagtcctggggaagcaggcacgtcttacacggccagaacaggagtgggaagggagttgttacacacttttcaaca

SEQ ID NO: 1819 - DNA, 601 bp, Human
ctgggctggtcttgaactcctggcctcaagcaaacctccagcttcagcctctcccaaagcactcaaattacagatgtgagccaccatgcccaaccttgccttctaataacacctagatgtattcgtataatcctcagattataaacacttcccttcaaaaatactatcaatgtattctagtatttaattttgtgggggcatctgaggcaaatctgatttttctttcctcataaggaaattatttctttctgtctggactcttttcagtttcttcacacagccttgaaattcgtaagtgtcrtcaggatttgcctaagtattggggtttttttcaatgatgcctgatgtcaatgacatcttataatgtgtagactcaagcctttcttcagatcaggaaacttttcttttctttttttttttttttttttttttgttatttcttctgttctgtttgttctgggattttcctcattaatagcaactattattcctatatacacaaaacatatatatttatctttccatagatttttcctgatttctgaaagaactttttaagttttttatttcacaaagttaatttctttgtaattacttctta

SEQ ID NO: 1820 - DNA, 601 bp, Human
accctgcaggttctggtccagtgagccagagatgtgcatttaacaagggtcccatgattcttagttatcatggctgtttgggaaatgttccttcagagggtgtttatgcaccagttaataggtagaattcaaaatgtgaagcagcttccaattttgagattgtgagtttctctagaaattgtgtaatttttgccagagggaggggcaagagttggagttttgcatcctctatctatattagaaaatcacaatcaccctccaggagaactattaatactcccactttacccaggagcccgcyaggccaaggatccctggcgcctgccgggcccacccagactcacttctgccaacacagctgctgccccaaactgtaatggactcctgcatgtttggccagatcagtctttgcttctttctcctccacataatcccattcatagactctttacatttaaatggtttaaaatacggaaaatacagaaaatgagaagaaaatactcctcccaccaatgccaccatgcagagacagttactattagcacattcatgtatttttatttttatacatatttttatacttacatgagattgtaatgtt

SEQ ID NO: 1821 - DNA, 601 bp, Human
tcaccctccaggagaactattaatactcccactttacccaggagcccgctaggccaaggatccctggcgcctgccgggcccacccagactcacttctgccaacacagctgctgccccaaactgtaatggactcctgcatgtttggccagatcagtctttgcttctttctcctccacataatcccattcatagactctttacatttaaatggtttaaaatacggaaaatacagaaaatgagaagaaaatactcctcccaccaatgccaccatgcagagacagttactattagcacattcatrtatttttatttttatacatatttttatacttacatgagattgtaatgtttgtgtaagatattatattccacatttttacttaacctttacttaaccttattccagaaccactttctcatggtactaattttttttttaagagagaaacagggtctcactctgttgtccaggatgaagtgcagtggcacgatcacagctcactgcagcctctaattcctgagttcaaatgatcctcccacctcagcctcctgagcagctgggactacaggcgtgcaccacattgcccagcaaatgtcttaa

SEQ ID NO: 1822 - DNA, 601 bp, Human
tactaattttttttttaagagagaaacagggtctcactctgttgtccaggatgaagtgcagtggcacgatcacagctcactgcagcctctaattcctgagttcaaatgatcctcccacctcagcctcctgagcagctgggactacaggcgtgcaccacattgcccagcaaatgtcttaattttttttgtagagatggggtctcaccatgtttcccaggcttgtctccaactctgggccccaagcaatcctcccttctaggcctttcaaagtatgaaattacaggggtgagccacagcaccyggccttaaaattttttttaattatatgtttaagatgtaagtgacataggcattgtcagtggccatccatttcagtcttttccggtagcctagtttactgacccaatctcacttaggttgtttaccttttcaattcttttatgattaatttattatgttttatgtatttaatcaaataattaaatttttaattttaggaatttaattacaatttttttaatgcacttaggtggtttacctttttgattctcataatcaaagtaatacctcagtaaaccttatggatgagatttaacacctc

SEQ ID NO: 1823 - DNA, 601 bp, Human
taacattatgcccattttacagatggagaaactgaggctcagagggaatatatggggagtagattggcggggcagggaagtagaaagaatggctttatgaagaactaaataggtgagtgttgcaggtgggaaacagccatggtcaggacttaaacccaaaggctccatcgctaaacctcagaccaccccaccaccccaccaccatcactgaccatctcctgtcttccacactccagctggtcctgcagatctccgcaatagacaaggacataacaccacgaaacgtgaagttcaaattcaycttgaatactgagaacaactttaccctcacggataatcacggtaggcatcaaagtaatcagttcagctgggcgtgatgacccacacctgtagtctcagctactcaggaggctgaggcaggaagatcgcttgagcccaggagtttgaggctgcagtgagctatgatcacatcactgcactccagcccgggcgacagagcgagaccccgtctccaaaaaaagaacaaatgcagtcagttggctctaacagggtcggggtgaggttatttgagtcttgaggcaccaaggtcaaagaccaggcc

SEQ ID NO: 1824 - DNA, 601 bp, Human
tgcactccagcccgggcgacagagcgagaccccgtctccaaaaaaagaacaaatgcagtcagttggctctaacagggtcggggtgaggttatttgagtcttgaggcaccaaggtcaaagaccaggccaacaaattgagggcaggctcccactgggattttcaaatcattagatattttgtacaatttctgccacatacattgtacaattggtctatgcaatggtcagagacactccatccaaactcccaagtccacgtcgcctgcaaggagccagcgaggagtacagaacagatgtgaggrtgcaggcagtcagctcagttcaagaactagccaaggagtcccctcccatactggaggctctatgggtcagcaaaactgcacattaaacatggaactttgaggtcattcccaaagagtcaaaactggaaatgtgaaatcctaaatcccaaggatccagtgagctttgttttaattcagctacaacgattactcacgattagcagggtggcccgtgtgatggcattagcagccaatcagagcttctgaggagtaggtgctgacttaagtgatgatgctgagttgacttcattccagccacaa

SEQ ID NO: 1825 - DNA, 601 bp, Human
tcacctagcatgggatggaattcctgcctgtccctaatgggcaaaactatggtggatgaggatggctgtattgcagcagcccattactacatttaaggaagactggggagtggggtccctgaaagttggaggcagacttgagggatcaaccacagaccagtccttaaggagactcctgtgggatggagaaggtggccctgatgtgttgacagtcaatgacagaccattcaacacccagttgtcattagaagtaaataatgtggcaaaaatgtcaccccctccccaatgtccacctcagtcycatctcagagtggggatctgcaatacagtagaaagattcagtgccaccccaaagacacccatatacaataggaggcaagtctgttggtgtcaaattcacttatatcatgaacatcctgcatgtcaaaatctctagtttctcccataagtgtcaatgacatatagtttattttgaaatataatagacttaatgctgaaatgtaattatgaataatgaaatataattggctttcattcaaaatcgaaaagatggattcctgggtttttcaatccagtgtgtggagcctgtgtagctaagtaa

SEQ ID NO: 1826 - DNA, 601 bp, Human
acttatatcatgaacatcctgcatgtcaaaatctctagtttctcccataagtgtcaatgacatatagtttattttgaaatataatagacttaatgctgaaatgtaattatgaataatgaaatataattggctttcattcaaaatcgaaaagatggattcctgggtttttcaatccagtgtgtggagcctgtgtagctaagtaaatcctggagtagggagttcctggatccttctctgatcgttgacattacaacctcctgggaccctgcaaaaggcagattatctggcctctgcccagaaycactgaataagaagtgtgtgtgagcataggggtctgaaaatcagcatgttttaaaagctccctgggggattcttgggtacaggaaaccactgattggatctgggaaggtgggcggggccaatatttggacaaaagcatttcccagttccaaactgcctgggaaacccgcaattctatatgtaatcattttctctgtgccccaagggacatgcccattgtttttactgttttcaacaatgtaacaatggattttcagagagagcagaagctgccttagaaattagcctaatgctaaaagac

SEQ ID NO: 1827 - DNA, 601 bp, Human
tagggagttcctggatccttctctgatcgttgacattacaacctcctgggaccctgcaaaaggcagattatctggcctctgcccagaatcactgaataagaagtgtgtgtgagcataggggtctgaaaatcagcatgttttaaaagctccctgggggattcttgggtacaggaaaccactgattggatctgggaaggtgggcggggccaatatttggacaaaagcatttcccagttccaaactgcctgggaaacccgcaattctatatgtaatcattttctctgtgccccaagggacatgyccattgtttttactgttttcaacaatgtaacaatggattttcagagagagcagaagctgccttagaaattagcctaatgctaaaagactttttaaaactttatttttccccgctgcttgtcaaagcttgaaacggagcattaattaattgagctgaaagagaaaacctcctgttactggagtggggttagggaagaggaaggggagaggcatcagttgcccacaaatacagaaagcaaaggatttgaccttctttcaccaaggcatccttggagattgggtcaaagcagctgccccaaaa

SEQ ID NO: 1828 - DNA, 601 bp, Human
gaataagaagtgtgtgtgagcataggggtctgaaaatcagcatgttttaaaagctccctgggggattcttgggtacaggaaaccactgattggatctgggaaggtgggcggggccaatatttggacaaaagcatttcccagttccaaactgcctgggaaacccgcaattctatatgtaatcattttctctgtgccccaagggacatgcccattgtttttactgttttcaacaatgtaacaatggattttcagagagagcagaagctgccttagaaattagcctaatgctaaaagacttttyaaaactttatttttccccgctgcttgtcaaagcttgaaacggagcattaattaattgagctgaaagagaaaacctcctgttactggagtggggttagggaagaggaaggggagaggcatcagttgcccacaaatacagaaagcaaaggatttgaccttctttcaccaaggcatccttggagattgggtcaaagcagctgccccaaaatatcccctctgtggcggaacagacctgcactcagatggctgaaacaagaggcgctgggtgcaaagggcagaaaagcagcccagcgagcacgca

SEQ ID NO: 1829 - DNA, 601 bp, Human
aagactttttaaaactttatttttccccgctgcttgtcaaagcttgaaacggagcattaattaattgagctgaaagagaaaacctcctgttactggagtggggttagggaagaggaaggggagaggcatcagttgcccacaaatacagaaagcaaaggatttgaccttctttcaccaaggcatccttggagattgggtcaaagcagctgccccaaaatatcccctctgtggcggaacagacctgcactcagatggctgaaacaagaggcgctgggtgcaaagggcagaaaagcagcccagsgagcacgcaggctggtgcagtcagggagggcttcctggaggagccaggtttccccatctgtgcagatggcaaagcctgactccgaggccttggtgtttccagataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtga

SEQ ID NO: 1830 - DNA, 601 bp, Human
ctttttatagaattcctccggccttgatacatattttttttcttgtttgggcctcagaaattttaggagcattgtaggccttagtttggatttcccagggagcagccctgggatgaggattggggtggaagtggtttatttgggaggtggtttatttccctggatacctcctaaggcagagggggagtgaagctgggaagggaggaggccagcgaaggtggaatgttcccatcgtgaggaactggagcctcctcccatagggttgccgggaggcagcgtggggccaccccccagcatcatmccaccgggggagcacagtgatgtactgtatcctgcatttcactcgccatgagacgcagcaggggctgatcctccagaggaagccctcaggtgattagagatcaccctggcactcacggcaaggcctggatacagccacggggcacctgcaatacagattccaggcctctcctgcctgtagccctcctgagagtggcctcggtatgccccacttctgggacttctccagcagagatttctcctttattaataattaatgatgatgatggcatccccaccacaaatagaattgcatttgacc

SEQ ID NO: 1831 - DNA, 601 bp, Human
cagcgaaggtggaatgttcccatcgtgaggaactggagcctcctcccatagggttgccgggaggcagcgtggggccaccccccagcatcatcccaccgggggagcacagtgatgtactgtatcctgcatttcactcgccatgagacgcagcaggggctgatcctccagaggaagccctcaggtgattagagatcaccctggcactcacggcaaggcctggatacagccacggggcacctgcaatacagattccaggcctctcctgcctgtagccctcctgagagtggcctcggtatgcccsacttctgggacttctccagcagagatttctcctttattaataattaatgatgatgatggcatccccaccacaaatagaattgcatttgacctcacaaccatcctcccaaatataaacagagcagggaggtcatcatttccattttacagacaaggaaactgaggctggggggcagggctgccttccagggcatcccagctttacttatgtatatagtagtttgttcagtaactcaaagctagaaggcctgagcctaattttagaagctctctgcacttcaaggtctacccctccttaggg

SEQ ID NO: 1832 - DNA, 601 bp, Human
gaaactgaggctggggggcagggctgccttccagggcatcccagctttacttatgtatatagtagtttgttcagtaactcaaagctagaaggcctgagcctaattttagaagctctctgcacttcaaggtctacccctccttagggatccaagaccctcacatagccacacccctcagagattcccacaggctgagcatccgcacctgcccctgggtgtgggggaacggcagcggtgggagtgtcgggcgaggtggggatgagtatgcgggggagcggcagggacggggtgtggggtgtarggggatggcggggatgggggtatgggggaacggcggggatggggttgcaggggaaggggggccaaaaggatggggttgcaggggaagggggggccaaagggatgggcatgctgggagggcgtgggggtggggttgcagggggcagtggggatgggggcatggggggccgcccaggcccccagccttgtctgactctgctgctcggctccctggctgcagtgatcaccctgctcatcttcctgcggcggcggctccggaagcaggcccgcgcgcacggcaagagcgtgccggagatccacg

SEQ ID NO: 1833 - DNA, 601 bp, Human
ggatgggcatgctgggagggcgtgggggtggggttgcagggggcagtggggatgggggcatggggggccgcccaggcccccagccttgtctgactctgctgctcggctccctggctgcagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcycccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagct

SEQ ID NO: 1834 - DNA, 601 bp, Human
tggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagwcgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtcttttt

SEQ ID NO: 1835 - DNA, 601 bp, Human
ctgttcactttaagagcctgccactgaaaacattcagtaaaggagtgaatcttccttgccccatcaagagtcgcttttcagctggaggaagggtgtgtccccaagtttttacctgggagcaatgatgatcttgtcaagcatttcagtgagaccagcccaagtttttagggtggggatccagactggttatacgtaccttcagtccttctcccagaggaaggcagaaacacctcaaagcctgcatgtaagaacatctactgagaaattattttaatcagacaccagctgagtgggagaaagraaaagaacagagaagaacaaacaaaactcccttggtcttggatgtaagagaatccagcagagatggactggagtttcttcagagtagttgcaatgctgttcatttttctggtgagtggattctggtaaaagtccttcataatcgtgcccattgtaaacaagtgaaaactttttagaaaatgttagtgggcattatttctaacctaaacccattgaaaatgtatattaatgacaagatgattttatgaactagatttttcaatagcatttctctctttaattgaagactcaagatcatgtt

SEQ ID NO: 1836 - DNA, 601 bp, Human
tgtgtccccaagtttttacctgggagcaatgatgatcttgtcaagcatttcagtgagaccagcccaagtttttagggtggggatccagactggttatacgtaccttcagtccttctcccagaggaaggcagaaacacctcaaagcctgcatgtaagaacatctactgagaaattattttaatcagacaccagctgagtgggagaaagaaaaagaacagagaagaacaaacaaaactcccttggtcttggatgtaagagaatccagcagagatggactggagtttcttcagagtagttgcartgctgttcatttttctggtgagtggattctggtaaaagtccttcataatcgtgcccattgtaaacaagtgaaaactttttagaaaatgttagtgggcattatttctaacctaaacccattgaaaatgtatattaatgacaagatgattttatgaactagatttttcaatagcatttctctctttaattgaagactcaagatcatgttaatgcctcagtgtcaactcattgtattacatctctgacactgaagtcattgctaagtcatgctgggaaaagactgaatttaggaaattcctat

SEQ ID NO: 1837 - DNA, 601 bp, Human
gactggagtttcttcagagtagttgcaatgctgttcatttttctggtgagtggattctggtaaaagtccttcataatcgtgcccattgtaaacaagtgaaaactttttagaaaatgttagtgggcattatttctaacctaaacccattgaaaatgtatattaatgacaagatgattttatgaactagatttttcaatagcatttctctctttaattgaagactcaagatcatgttaatgcctcagtgtcaactcattgtattacatctctgacactgaagtcattgctaagtcatgctggraaaagactgaatttaggaaattcctatcgctagttagtagcactttgtcgttcaaaatctcttctgcaagagggcttttaaactaaatatcacaagtgtgtctggatttttaacctgtttttttttttattttttttgtgtgtttggtggtggaattactctaatttttaaaacataaaaatagcaccacataatttaaaatcgtagcagtttgtggctggtctcgctatccaaataaagtcatcagttgcatatttggttagaatctgtatcactactataaaaagccccgcactattt

SEQ ID NO: 1838 - DNA, 601 bp, Human
ctaaacccattgaaaatgtatattaatgacaagatgattttatgaactagatttttcaatagcatttctctctttaattgaagactcaagatcatgttaatgcctcagtgtcaactcattgtattacatctctgacactgaagtcattgctaagtcatgctgggaaaagactgaatttaggaaattcctatcgctagttagtagcactttgtcgttcaaaatctcttctgcaagagggcttttaaactaaatatcacaagtgtgtctggatttttaacctgtttttttttttattttttttgtgtgtttggtggtggaattactctaatttttaaaacataaaaatagcaccacataatttaaaatcgtagcagtttgtggctggtctcgctatccaaataaagtcatcagttgcatatttggttagaatctgtatcactactataaaaagccccgcactatttaactatgattttatttaaaacatttttaatttcaaaaaacggcagtacaggaggtttataaatgacatattaagtgaagaagtggctataattaaagagtaagtataattattattacactcgatcttactactgga

SEQ ID NO: 1839 - DNA, 601 bp, Human
tgtacaattgttaaggcctttaagatatttaaattggtagtgtcttttaagcaaatctacctgagaactgggtaactatttgtttgcaagcatactgtgtattcatctcaatgcatctgaaggttgtgaaccttgttcaaatgagtgggttgaatcagggagaacaaagctggaggagctgctcttacagcaatcaagatcgctctatggctattccattgttctgacaagtctcctggacaggcaagagattacacctgctataacactgcaagtcaaacacattttgttaattctgcayctatttttcattcttctttttgtttccatataatcagtgtatggagtagagaaaggagttagaatgtattttctctaggcctgagaacaatgcttcttatgcaccaaataaaagaaatctatgtgcatgtatatgacaatggtaaaaagtacagcatggtcactgtgggaaagcaaaacagagccagagggatctctatggttttaatgatttctgaaaattacttgcaactttgccaggtccaattagtccatttaagtcaatacaaatctgaagatgtctttttctaaaaaggtaaat

SEQ ID NO: 1840 - DNA, 601 bp, Human
aaattggtagtgtcttttaagcaaatctacctgagaactgggtaactatttgtttgcaagcatactgtgtattcatctcaatgcatctgaaggttgtgaaccttgttcaaatgagtgggttgaatcagggagaacaaagctggaggagctgctcttacagcaatcaagatcgctctatggctattccattgttctgacaagtctcctggacaggcaagagattacacctgctataacactgcaagtcaaacacattttgttaattctgcatctatttttcattcttctttttgtttccatrtaatcagtgtatggagtagagaaaggagttagaatgtattttctctaggcctgagaacaatgcttcttatgcaccaaataaaagaaatctatgtgcatgtatatgacaatggtaaaaagtacagcatggtcactgtgggaaagcaaaacagagccagagggatctctatggttttaatgatttctgaaaattacttgcaactttgccaggtccaattagtccatttaagtcaatacaaatctgaagatgtctttttctaaaaaggtaaatttctgcagctcaagctcaaagaacagagaa

SEQ ID NO: 1841 - DNA, 601 bp, Human
tatgcaccaaataaaagaaatctatgtgcatgtatatgacaatggtaaaaagtacagcatggtcactgtgggaaagcaaaacagagccagagggatctctatggttttaatgatttctgaaaattacttgcaactttgccaggtccaattagtccatttaagtcaatacaaatctgaagatgtctttttctaaaaaggtaaatttctgcagctcaagctcaaagaacagagaaaatgacttttatctatgaccatgaatgatctgattattttggttcattatagtaaccattttcccccyctttctatgggttaatatttcatttcgaaacaaacaaacaaaaaaaaacccaaccctctgaccacctgataaactaactccacagtttgaaccgaactgaaattctgtaaaatatgagcaggagtttttaagagtactttcatcactcaggctaaaatacacagaaaataatacacatttcattacatagttcctaaacttacttgaagacatcttaagtccccaaaattgtgttcacagatgcctaaagcaagagaagaactaacaaattagtacagaccaaacagaagacaagcaaaa

SEQ ID NO: 1842 - DNA, 601 bp, Human
cactgtgggaaagcaaaacagagccagagggatctctatggttttaatgatttctgaaaattacttgcaactttgccaggtccaattagtccatttaagtcaatacaaatctgaagatgtctttttctaaaaaggtaaatttctgcagctcaagctcaaagaacagagaaaatgacttttatctatgaccatgaatgatctgattattttggttcattatagtaaccattttccccctctttctatgggttaatatttcatttcgaaacaaacaaacaaaaaaaaacccaaccctctgaccacctgataaactaactccacagtttgaaccgaactgaaattctgtaaaatatgagcaggagtttttaagagtactttcatcactcaggctaaaatacacagaaaataatacacatttcattacatagttcctaaacttacttgaagacatcttaagtccccaaaattgtgttcacagatgcctaaagcaagagaagaactaacaaattagtacagaccaaacagaagacaagcaaaagagagagctctttgtgctttcttgagcgtgtattatagtgatatgtagtatagagatcagtgt

SEQ ID NO: 1843 - DNA, 601 bp, Human
gatctctatggttttaatgatttctgaaaattacttgcaactttgccaggtccaattagtccatttaagtcaatacaaatctgaagatgtctttttctaaaaaggtaaatttctgcagctcaagctcaaagaacagagaaaatgacttttatctatgaccatgaatgatctgattattttggttcattatagtaaccattttccccctctttctatgggttaatatttcatttcgaaacaaacaaacaaaaaaaaacccaaccctctgaccacctgataaactaactccacagtttgaacygaactgaaattctgtaaaatatgagcaggagtttttaagagtactttcatcactcaggctaaaatacacagaaaataatacacatttcattacatagttcctaaacttacttgaagacatcttaagtccccaaaattgtgttcacagatgcctaaagcaagagaagaactaacaaattagtacagaccaaacagaagacaagcaaaagagagagctctttgtgctttcttgagcgtgtattatagtgatatgtagtatagagatcagtgtttcagtaaaatattttgtagaaaatggaag

SEQ ID NO: 1844 - DNA, 601 bp, Human
attacttgcaactttgccaggtccaattagtccatttaagtcaatacaaatctgaagatgtctttttctaaaaaggtaaatttctgcagctcaagctcaaagaacagagaaaatgacttttatctatgaccatgaatgatctgattattttggttcattatagtaaccattttccccctctttctatgggttaatatttcatttcgaaacaaacaaacaaaaaaaaacccaaccctctgaccacctgataaactaactccacagtttgaaccgaactgaaattctgtaaaatatgagcagragtttttaagagtactttcatcactcaggctaaaatacacagaaaataatacacatttcattacatagttcctaaacttacttgaagacatcttaagtccccaaaattgtgttcacagatgcctaaagcaagagaagaactaacaaattagtacagaccaaacagaagacaagcaaaagagagagctctttgtgctttcttgagcgtgtattatagtgatatgtagtatagagatcagtgtttcagtaaaatattttgtagaaaatggaaggaatatttctgttcacgtattcagtgaaa

SEQ ID NO: 1845 - DNA, 601 bp, Human
actcaggctaaaatacacagaaaataatacacatttcattacatagttcctaaacttacttgaagacatcttaagtccccaaaattgtgttcacagatgcctaaagcaagagaagaactaacaaattagtacagaccaaacagaagacaagcaaaagagagagctctttgtgctttcttgagcgtgtattatagtgatatgtagtatagagatcagtgtttcagtaaaatattttgtagaaaatggaaggaatatttctgttcacgtattcagtgaaacttacaaattgcattcaagtgtsatcattaacagttatatggtgttcataaaagctttattatttcgctgtagatttaggattagcatcttctatcacctttacagaaacaaggagtacaaatttatcatcgctcaattggtttgagttgccacaaagtaaaaacattttgtcatccctgttttaggaaaagagtagaaactaaagcactgaagaatgctgtcttaaatctgaaaggctgaccctagaataagattcacttatttaacaaatctcatcaatctagaaaattatcttatctatacccagagcacttaatttctg

SEQ ID NO: 1846 - DNA, 601 bp, Human
agttcctaaacttacttgaagacatcttaagtccccaaaattgtgttcacagatgcctaaagcaagagaagaactaacaaattagtacagaccaaacagaagacaagcaaaagagagagctctttgtgctttcttgagcgtgtattatagtgatatgtagtatagagatcagtgtttcagtaaaatattttgtagaaaatggaaggaatatttctgttcacgtattcagtgaaacttacaaattgcattcaagtgtcatcattaacagttatatggtgttcataaaagctttattatttcrctgtagatttaggattagcatcttctatcacctttacagaaacaaggagtacaaatttatcatcgctcaattggtttgagttgccacaaagtaaaaacattttgtcatccctgttttaggaaaagagtagaaactaaagcactgaagaatgctgtcttaaatctgaaaggctgaccctagaataagattcacttatttaacaaatctcatcaatctagaaaattatcttatctatacccagagcacttaatttctggtaactctttctccacaacacattcatcaaagacctggttgctg

SEQ ID NO: 1847 - DNA, 601 bp, Human
atggtgttcataaaagctttattatttcgctgtagatttaggattagcatcttctatcacctttacagaaacaaggagtacaaatttatcatcgctcaattggtttgagttgccacaaagtaaaaacattttgtcatccctgttttaggaaaagagtagaaactaaagcactgaagaatgctgtcttaaatctgaaaggctgaccctagaataagattcacttatttaacaaatctcatcaatctagaaaattatcttatctatacccagagcacttaatttctggtaactctttctccasaacacattcatcaaagacctggttgctgagtatccctgtgtcctaatagacattgcctaacatatcagcaggaagcctgctgtgccaggcaccgcaattagatttataatgctccctcatctcagggaacacccttgcccagtgctgggtcatgccacccttgctgattatgcttgatatgcaaattccttcaatagacttagacagatcaaatttttttaaatgccattggctgctgatccatgctcttaattggtctatgagaataggccacagtttttcatactcgtctaatgagaa

SEQ ID NO: 1848 - DNA, 601 bp, Human
actctttctccacaacacattcatcaaagacctggttgctgagtatccctgtgtcctaatagacattgcctaacatatcagcaggaagcctgctgtgccaggcaccgcaattagatttataatgctccctcatctcagggaacacccttgcccagtgctgggtcatgccacccttgctgattatgcttgatatgcaaattccttcaatagacttagacagatcaaatttttttaaatgccattggctgctgatccatgctcttaattggtctatgagaataggccacagtttttcatactygtctaatgagaaatcatatctctacaaattaatggttgcctgttgctctcaaaactgcaagactgtaagttatttgaaggcaggttctgtgtctgatttgcctttgtatcccttatggtgccttgcaccagtgcaagattgctcaaaagatgtctaatcacacacagcagaggtaccacaaggaagtttctggatagtttatacagctcttcccccacacactccaaaaaattatcacgctattaaacatagaaataataatactggatttccccaacattttaatggtgtagtattaaa

SEQ ID NO: 1849 - DNA, 601 bp, Human
tataatgctccctcatctcagggaacacccttgcccagtgctgggtcatgccacccttgctgattatgcttgatatgcaaattccttcaatagacttagacagatcaaatttttttaaatgccattggctgctgatccatgctcttaattggtctatgagaataggccacagtttttcatactcgtctaatgagaaatcatatctctacaaattaatggttgcctgttgctctcaaaactgcaagactgtaagttatttgaaggcaggttctgtgtctgatttgcctttgtatcccttatrgtgccttgcaccagtgcaagattgctcaaaagatgtctaatcacacacagcagaggtaccacaaggaagtttctggatagtttatacagctcttcccccacacactccaaaaaattatcacgctattaaacatagaaataataatactggatttccccaacattttaatggtgtagtattaaattcattttacatttcacctgagacttactataatattttcaggcctttaaaagtcttaatctagtgttggatccacataatacacattcagtatgtacttgtaaaatacacaaacga

SEQ ID NO: 1850 - DNA, 601 bp, Human
tatgcaaattccttcaatagacttagacagatcaaatttttttaaatgccattggctgctgatccatgctcttaattggtctatgagaataggccacagtttttcatactcgtctaatgagaaatcatatctctacaaattaatggttgcctgttgctctcaaaactgcaagactgtaagttatttgaaggcaggttctgtgtctgatttgcctttgtatcccttatggtgccttgcaccagtgcaagattgctcaaaagatgtctaatcacacacagcagaggtaccacaaggaagtttytggatagtttatacagctcttcccccacacactccaaaaaattatcacgctattaaacatagaaataataatactggatttccccaacattttaatggtgtagtattaaattcattttacatttcacctgagacttactataatattttcaggcctttaaaagtcttaatctagtgttggatccacataatacacattcagtatgtacttgtaaaatacacaaacgaaaagaataaattagagaattcaacccattaaggtgctgtcaacctcagactgataccctttgtcagagcagta

SEQ ID NO: 1851 - DNA, 601 bp, Human
ttcaacgcttagcaaaaagtgacttggaagaccatctcacaattattaaatgcaagagattttttaaataaaaatagcttgttactctcaaacccatttttattatgtgcaaggaagcatgaacttcaatattaaaaaggaaaacattaaaaattactgtaattggggatttattaaaattagcctgtgattttgtctcctgtagcttttaaaaagtacataaatggattggttcctaaaacagaaatgaaggggaaactcattgaggatgtatttcaggtgaattatttactgttttcayagaattttaggactagaggggacttttagtctcatatacagctgaggaaactgagcacagattgatttaatgacttaccccaaagtccctatccactgggcaaaacagctgagatatactcagtcagcctgataacctctgtgttcatctctaggtaaatctccatcacagcctccatagcacagactccaaactcatttgggaatccaaacttctcccctaattgtcagaaaataacctcacccttactccagggacaaggtctaggtcatttaggagagtgtcctccaatttcccttc

SEQ ID NO: 1852 - DNA, 601 bp, Human
atattctcttgaaggtccctcagaacctcaggatttcctcagaattcactctgctcaacttttttacctcatctctttcaaccccatctgtctttccgttttccttttcctctgacctccattataatgcattatattttcctattgtttctttcgccattccttctctctttcgccactccttctctccttccttttttttttttttttttttttctttttttgagacaaagtcttgctctgtccccaggagtgcagtggtgcaatctcggctcactgcaacctccgcctcctgggttcmattgattctcctgcctcagcctcccaagtagctgggactacaggcacgcaccacgacgcccagctaatttttgtatttttagtggagacggggtttcaccatgttggccaggatgttctcagtctcctgacctcgtgatccacccgcctcggcctcccaaagtgctgggattacaggcgtgagccacagcgcccggccctctccttccttttttttttttttgtttgtttgttgtcgttgttcctagttctataaatgtaggaactcttctagttttatcctcaattgcaggctgattct

SEQ ID NO: 1853 - DNA, 601 bp, Human
atctcggctcactgcaacctccgcctcctgggttccattgattctcctgcctcagcctcccaagtagctgggactacaggcacgcaccacgacgcccagctaatttttgtatttttagtggagacggggtttcaccatgttggccaggatgttctcagtctcctgacctcgtgatccacccgcctcggcctcccaaagtgctgggattacaggcgtgagccacagcgcccggccctctccttccttttttttttttttgtttgtttgttgtcgttgttcctagttctataaatgtaggaaytcttctagttttatcctcaattgcaggctgattcttgactgtatcctctactttggaaatttcaaattctcacgatttcaactatcctgcctgagcagatctacctcaaatctacatatccagcttgaacttttgctcaagttttgatccatgtttccaattgctgatcatcttcacccaggcattatctggcatctcaaactcaatgtgttctaatctgctaaattctattactgtcttgttcccaatcccacagtttaaaactgccatcccctgagcttcctccctctctcgaacacc

SEQ ID NO: 1854 - DNA, 601 bp, Human
gcaggctgattcttgactgtatcctctactttggaaatttcaaattctcacgatttcaactatcctgcctgagcagatctacctcaaatctacatatccagcttgaacttttgctcaagttttgatccatgtttccaattgctgatcatcttcacccaggcattatctggcatctcaaactcaatgtgttctaatctgctaaattctattactgtcttgttcccaatcccacagtttaaaactgccatcccctgagcttcctccctctctcgaacacccccatcccatttgttctcaagcyctgccaatgctatgctgcagtatcccttgatctttccccatccattccctctgtctctgctccagcgtacctccttctcacctccagtctgctttgatacagagaccctcaactgctcaccgtctgtaatcactgcctcttcccactagtcctaccaactgttgtcagagttagctttaaaaccacaattttatcatgctcttctcacatctaaatacttcaatattttcctactgcacacaggcatttaatattacagctggaaagttacctgtataaaatttagtctactcttgtcat

SEQ ID NO: 1855 - DNA, 601 bp, Human
ttcttgactgtatcctctactttggaaatttcaaattctcacgatttcaactatcctgcctgagcagatctacctcaaatctacatatccagcttgaacttttgctcaagttttgatccatgtttccaattgctgatcatcttcacccaggcattatctggcatctcaaactcaatgtgttctaatctgctaaattctattactgtcttgttcccaatcccacagtttaaaactgccatcccctgagcttcctccctctctcgaacacccccatcccatttgttctcaagccctgccaatrctatgctgcagtatcccttgatctttccccatccattccctctgtctctgctccagcgtacctccttctcacctccagtctgctttgatacagagaccctcaactgctcaccgtctgtaatcactgcctcttcccactagtcctaccaactgttgtcagagttagctttaaaaccacaattttatcatgctcttctcacatctaaatacttcaatattttcctactgcacacaggcatttaatattacagctggaaagttacctgtataaaatttagtctactcttgtcattttacaagt

SEQ ID NO: 1856 - DNA, 601 bp, Human
agtttaaaactgccatcccctgagcttcctccctctctcgaacacccccatcccatttgttctcaagccctgccaatgctatgctgcagtatcccttgatctttccccatccattccctctgtctctgctccagcgtacctccttctcacctccagtctgctttgatacagagaccctcaactgctcaccgtctgtaatcactgcctcttcccactagtcctaccaactgttgtcagagttagctttaaaaccacaattttatcatgctcttctcacatctaaatacttcaatattttccyactgcacacaggcatttaatattacagctggaaagttacctgtataaaatttagtctactcttgtcattttacaagtgagaaaactaaagttcagagaattggggaaatacgttgaagattttccaactctatcaagagtcagatttcactattttgcctttgaaagtccaagagtgactttgtatcagagtttattctagactctgagcaacagaaaataagcttacaccaacccaccacatttttaagcagacttggcggtttttagattacaaatccaattgagagtttgactgtat

SEQ ID NO: 1857 - DNA, 601 bp, Human
ttagtctactcttgtcattttacaagtgagaaaactaaagttcagagaattggggaaatacgttgaagattttccaactctatcaagagtcagatttcactattttgcctttgaaagtccaagagtgactttgtatcagagtttattctagactctgagcaacagaaaataagcttacaccaacccaccacatttttaagcagacttggcggtttttagattacaaatccaattgagagtttgactgtatggtgaaagctacttggtcttctgcccaaattgtctctcatgggaaaaagartgacccagcttcataaagctggaaagatttcttagtcatctgcatagctttccaaaacaaacagcaagcactggcgctccaatgcagtaagggaagcgcaataacagataacagatccatgcacaattctgtagctatgaagaaatggctttcaaacacacaaataaggtatgcccatctcccatcccacactcacaaacaagagagagggaaaagtgttcataaattcacaggcagcaaggagcatgcatttacatgaacaccatttcatcatttcagttctgcacccaagatgggctc

SEQ ID NO: 1858 - DNA, 601 bp, Human
tccaagagtgactttgtatcagagtttattctagactctgagcaacagaaaataagcttacaccaacccaccacatttttaagcagacttggcggtttttagattacaaatccaattgagagtttgactgtatggtgaaagctacttggtcttctgcccaaattgtctctcatgggaaaaagaatgacccagcttcataaagctggaaagatttcttagtcatctgcatagctttccaaaacaaacagcaagcactggcgctccaatgcagtaagggaagcgcaataacagataacagatscatgcacaattctgtagctatgaagaaatggctttcaaacacacaaataaggtatgcccatctcccatcccacactcacaaacaagagagagggaaaagtgttcataaattcacaggcagcaaggagcatgcatttacatgaacaccatttcatcatttcagttctgcacccaagatgggctctacagataacatttcagttacatgttttaaaatttgggccatttacttttcttttttttttcttcatgctgtattcctattgtcgtatgtaaatatcaccaatcacaaggataatag

SEQ ID NO: 1859 - DNA, 601 bp, Human
gactctgagcaacagaaaataagcttacaccaacccaccacatttttaagcagacttggcggtttttagattacaaatccaattgagagtttgactgtatggtgaaagctacttggtcttctgcccaaattgtctctcatgggaaaaagaatgacccagcttcataaagctggaaagatttcttagtcatctgcatagctttccaaaacaaacagcaagcactggcgctccaatgcagtaagggaagcgcaataacagataacagatccatgcacaattctgtagctatgaagaaatggckttcaaacacacaaataaggtatgcccatctcccatcccacactcacaaacaagagagagggaaaagtgttcataaattcacaggcagcaaggagcatgcatttacatgaacaccatttcatcatttcagttctgcacccaagatgggctctacagataacatttcagttacatgttttaaaatttgggccatttacttttcttttttttttcttcatgctgtattcctattgtcgtatgtaaatatcaccaatcacaaggataataggttagtttaaaatcagaattttttgagttcttg

SEQ ID NO: 1860 - DNA, 601 bp, Human
gccatttacttttcttttttttttcttcatgctgtattcctattgtcgtatgtaaatatcaccaatcacaaggataataggttagtttaaaatcagaattttttgagttcttgaagttgcaatataaattctttgtagcatgcttttcttagtagtaatttacttgagggaataggctatctcatattttattgtaaaacccacagctcaagtgaaaatttatgctaaattgtattgaattatatttagccataggttaatatccaagactcaatttcctcatctgtaaaatggagatagwattagtggtgaccacatgtatttgttgtaaagattaagtgcatagatttacataaatacataacctaatacctagctattatttaacaaattataagagtaataacaatcataattattaatattagatacacaatggatatgtaattctcataataaaaacattatctttttatacttctcatattgatcataaatacttattttctgaattatctattgtggcaatttttttaaagtagatacttagagacattaagttcatattttctttaatgctacaattaaaattaactataaa

SEQ ID NO: 1861 - DNA, 601 bp, Human
tcaaattaatatataccatttctttattgctgtcatttaaggtaagagattataacactaaaaatggcaccatcaaatggcattcaatccgaaggcagaaacgtgaatggatcaagttcgcagcagcctgtcgtgaaggtgaagacaactcaaagaggaacccaatcgccaaagtaggtatcaactccaaagcataacattgaaaatcagaatggataaagtttcaaaagaaactgtctgctaaatatttcatgaacatgtctcaccgagaagctacgatacagaacagaactatagtcayctagatgatgaaaactgaaactcataaggagaaattaagaaatgcaggtgctcagagaaacaggcaaacgttgactcacctcattggtgaaatgcatacacatgatcatgtgttatcccaaactccagatgaaaaaagatcattattttaataaagaatttggctttcagcacattcaaaggaattacttcaatgtgtgctctttttgcctcacaatgtattagaattgaattcctacttttttgtttgtttattaacattcacaaggtgccctctctcataccccttttctattcattt

SEQ ID NO: 1862 - DNA, 601 bp, Human
tttgtttattaacattcacaaggtgccctctctcataccccttttctattcatttttccatatcttcctttctacatacacacacactcagaaacaccccccacaaattcatgaacatacagatgtacacgtccacagatacacacacgaatatacacattcatccacacagacactcacaaatactccccactaggatttgtttacagccaaacaatattttatttcaaagaaagagttctggtttctataaccatttattcgcgtggtctccttccttttctgctaatacacccttccyattttcagaattcagagcttccactcaaacccagataactcttgtcacctaaataaatctactttcttcgaaaactttacatttaaaacaaattgaagattaaagttgcatgatgacaacattgataaactccttaagagggcaaagagtttccttctgtagctccagtgcaagcacagaccctgcaaataatacaagatcaaattttaactgttgaatgaatgaagtcatgcatgatgattgcatagacttagatatagtagggtgatatttcgcattttttcatgtttcatagaagca

SEQ ID NO: 1863 - DNA, 601 bp, Human
ttgtttattaacattcacaaggtgccctctctcataccccttttctattcatttttccatatcttcctttctacatacacacacactcagaaacaccccccacaaattcatgaacatacagatgtacacgtccacagatacacacacgaatatacacattcatccacacagacactcacaaatactccccactaggatttgtttacagccaaacaatattttatttcaaagaaagagttctggtttctataaccatttattcgcgtggtctccttccttttctgctaatacacccttcccrttttcagaattcagagcttccactcaaacccagataactcttgtcacctaaataaatctactttcttcgaaaactttacatttaaaacaaattgaagattaaagttgcatgatgacaacattgataaactccttaagagggcaaagagtttccttctgtagctccagtgcaagcacagaccctgcaaataatacaagatcaaattttaactgttgaatgaatgaagtcatgcatgatgattgcatagacttagatatagtagggtgatatttcgcattttttcatgtttcatagaagcag

SEQ ID NO: 1864 - DNA, 601 bp, Human
agtttccttctgtagctccagtgcaagcacagaccctgcaaataatacaagatcaaattttaactgttgaatgaatgaagtcatgcatgatgattgcatagacttagatatagtagggtgatatttcgcattttttcatgtttcatagaagcagaaaccgaatttctttgattacattgtcagttaccattgaaaatattagagctgtaattgttactcttatctaggaaaataatctccattgacaacatttcctaaataacaaggtcatcacatgcaacaactctcaagaaagctgtcrtatatcaaatatagaactctatttgctccctctaatatttttacttgtgttccttctgcagattcactcagattgtgctgcaaaccagcaagttacataccgcatctctggagtaggaattgatcagccaccatatgggatctttgtcattaatcagaaaactggtgaaattaatataacatccatagttgatcgagaggtcactcctttcttcattgtaagtggacttcatgtcaatatatatgttcatgcttaaattcttctcagaagttcttaatctcagatcatacttaatttgat

SEQ ID NO: 1865 - DNA, 601 bp, Human
acgagcatcccacgactgaaaagaaatgcaaagattaagagagaaggaaatgtttcacttaagtgtcagcaaaaatgctaacctctatactgtcctcattggcaaactagagtatttgtttggaaggacaattacctaactttttaatttttccttttttaaaaaattcagtaaagaatgttaccttattttaagtctaatgtcaagtaatgattctagagctactgcaggactgttttctgagcaaatatactttattataaattcagtaaagaatgttaccttattttaggtctaatgwcaagtaaatgattctagagctactgcaggactgttttctgagcaaatatactttactataaattcatattcctcaagctcacctgagctccaaatgcaccttgaaaatgcatccattcttaagtgaatctcactccattctttacaggagctgtcacatagcttaagtatcctatctcttcaaaccctcaacctcatttccactttaagcagttgaccttgtgaccaactttatgaaaaaggctgaggccatccatcacaaactcccataattatttctcactcgcccagctcagaaatg

SEQ ID NO: 1866 - DNA, 601 bp, Human
aaggacaattacctaactttttaatttttccttttttaaaaaattcagtaaagaatgttaccttattttaagtctaatgtcaagtaatgattctagagctactgcaggactgttttctgagcaaatatactttattataaattcagtaaagaatgttaccttattttaggtctaatgacaagtaaatgattctagagctactgcaggactgttttctgagcaaatatactttactataaattcatattcctcaagctcacctgagctccaaatgcaccttgaaaatgcatccattcttaastgaatctcactccattctttacaggagctgtcacatagcttaagtatcctatctcttcaaaccctcaacctcatttccactttaagcagttgaccttgtgaccaactttatgaaaaaggctgaggccatccatcacaaactcccataattatttctcactcgcccagctcagaaatgttcttcattaaatcaaaagcaggatcaattgtttgctttttctcacagcatattccaagacatttccatggtcctataattgccacttacttggagaatcattccatcacctctgttttctgt

SEQ ID NO: 1867 - DNA, 601 bp, Human
ttaccttattttaagtctaatgtcaagtaatgattctagagctactgcaggactgttttctgagcaaatatactttattataaattcagtaaagaatgttaccttattttaggtctaatgacaagtaaatgattctagagctactgcaggactgttttctgagcaaatatactttactataaattcatattcctcaagctcacctgagctccaaatgcaccttgaaaatgcatccattcttaagtgaatctcactccattctttacaggagctgtcacatagcttaagtatcctatctctkcaaaccctcaacctcatttccactttaagcagttgaccttgtgaccaactttatgaaaaaggctgaggccatccatcacaaactcccataattatttctcactcgcccagctcagaaatgttcttcattaaatcaaaagcaggatcaattgtttgctttttctcacagcatattccaagacatttccatggtcctataattgccacttacttggagaatcattccatcacctctgttttctgtctcccttctgctggctccttggctactcccatttctctctatcgtcatggccaacac

SEQ ID NO: 1868 - DNA, 601 bp, Human
tcttcaaaccctcaacctcatttccactttaagcagttgaccttgtgaccaactttatgaaaaaggctgaggccatccatcacaaactcccataattatttctcactcgcccagctcagaaatgttcttcattaaatcaaaagcaggatcaattgtttgctttttctcacagcatattccaagacatttccatggtcctataattgccacttacttggagaatcattccatcacctctgttttctgtctcccttctgctggctccttggctactcccatttctctctatcgtcatggccarcacttcttaatattaaaaatagaaataaagaaaccctattttgctcctgttacctcttctattaaaaccccaccagtccgtatcccaaaataccttcaaataataatcgatatttgcagttttcactcacaccgcctgcctgtattcctcacacaactttaattctttagccttcaattccaaatctctatttctcccttctgtcccacaatgatcccccacaaactttaaaaaggcatgctaccctgttagcttttcttggggcataatgcatttttttacgtctttatttttttttag

SEQ ID NO: 1869 - DNA, 601 bp, Human
aaaggctgaggccatccatcacaaactcccataattatttctcactcgcccagctcagaaatgttcttcattaaatcaaaagcaggatcaattgtttgctttttctcacagcatattccaagacatttccatggtcctataattgccacttacttggagaatcattccatcacctctgttttctgtctcccttctgctggctccttggctactcccatttctctctatcgtcatggccaacacttcttaatattaaaaatagaaataaagaaaccctattttgctcctgttacctcttctrttaaaaccccaccagtccgtatcccaaaataccttcaaataataatcgatatttgcagttttcactcacaccgcctgcctgtattcctcacacaactttaattctttagccttcaattccaaatctctatttctcccttctgtcccacaatgatcccccacaaactttaaaaaggcatgctaccctgttagcttttcttggggcataatgcatttttttacgtctttatttttttttagagacagggtctcattatattgcccaggctagtatcataatgcctttatatatgaaatatgc

SEQ ID NO: 1870 - DNA, 601 bp, Human
ccatcacaaactcccataattatttctcactcgcccagctcagaaatgttcttcattaaatcaaaagcaggatcaattgtttgctttttctcacagcatattccaagacatttccatggtcctataattgccacttacttggagaatcattccatcacctctgttttctgtctcccttctgctggctccttggctactcccatttctctctatcgtcatggccaacacttcttaatattaaaaatagaaataaagaaaccctattttgctcctgttacctcttctattaaaaccccaccartccgtatcccaaaataccttcaaataataatcgatatttgcagttttcactcacaccgcctgcctgtattcctcacacaactttaattctttagccttcaattccaaatctctatttctcccttctgtcccacaatgatcccccacaaactttaaaaaggcatgctaccctgttagcttttcttggggcataatgcatttttttacgtctttatttttttttagagacagggtctcattatattgcccaggctagtatcataatgcctttatatatgaaatatgccattttgtaaaatag

SEQ ID NO: 1871 - DNA, 601 bp, Human
agaaatgttcttcattaaatcaaaagcaggatcaattgtttgctttttctcacagcatattccaagacatttccatggtcctataattgccacttacttggagaatcattccatcacctctgttttctgtctcccttctgctggctccttggctactcccatttctctctatcgtcatggccaacacttcttaatattaaaaatagaaataaagaaaccctattttgctcctgttacctcttctattaaaaccccaccagtccgtatcccaaaataccttcaaataataatcgatatttgyagttttcactcacaccgcctgcctgtattcctcacacaactttaattctttagccttcaattccaaatctctatttctcccttctgtcccacaatgatcccccacaaactttaaaaaggcatgctaccctgttagcttttcttggggcataatgcatttttttacgtctttatttttttttagagacagggtctcattatattgcccaggctagtatcataatgcctttatatatgaaatatgccattttgtaaaatagtacacattacacttagggacgcttcaaatacaaataataat

SEQ ID NO: 1872 - DNA, 601 bp, Human
taatgcaagtaagtaatgtagtggcttccaaatcactcctaacagccaggcacctaactggagactaaactatgtcaaagtacacatcatgaatgtaagagataaactatagaaaagatgcagaatagcaagtctttcctttcaactacggaagcagctccaaactgagggacacaaggcgtgattccaaagcaatgaggaggatttttctcacataactcgcaggccagccctgtagaagagtcctaacaagaaattttaaaggcattttgcacaatggtggcagaggcatcgggatgtsaatttagcctcccagtctaactgtgtagaaggacaatcccacccttttctgctcttactgcgttttttccccttttttaaagttagctactttaaaatcacttatagaaatcacttccacacaaaacttctttttgtgatttaacctttaagtgataaaatttcttgtgaattccaaaaatccctacactttacttttattcattaaaatactgtacctatactttcaacttttaaaagtgttattataaaatgctcattaaatttatgtaatatggaaagtaaaagggaacaaaaatct

SEQ ID NO: 1873 - DNA, 601 bp, Human
cttctttttgtgatttaacctttaagtgataaaatttcttgtgaattccaaaaatccctacactttacttttattcattaaaatactgtacctatactttcaacttttaaaagtgttattataaaatgctcattaaatttatgtaatatggaaagtaaaagggaacaaaaatctgctgtctgcatttcctagtaccattcttcagaggtatgcactgtgtacatgcgctccataattatgtaaacataaatcacatgttttttaacataaatggtatcatctgttacatgctaatccacarcatgaatttttatataaatatattttgaacatatttccatatcaggacacataattgtttcactgctttcaatagttgcatggaatttaattatataaattacataagtgtatataaatgttaattatctagtgaaaacattttaaaggttatgctacaataaatacaggtgggggatgacagatgccatgaagcatttgtaggaaaattgtatttaaaatggagttggagagtagagaacaattccaaagttatgaatgagcactggcagttttccacattctccaataatctaataat

SEQ ID NO: 1874 - DNA, 601 bp, Human
tagtaccattcttcagaggtatgcactgtgtacatgcgctccataattatgtaaacataaatcacatgttttttaacataaatggtatcatctgttacatgctaatccacaacatgaatttttatataaatatattttgaacatatttccatatcaggacacataattgtttcactgctttcaatagttgcatggaatttaattatataaattacataagtgtatataaatgttaattatctagtgaaaacattttaaaggttatgctacaataaatacaggtgggggatgacagatgccrtgaagcatttgtaggaaaattgtatttaaaatggagttggagagtagagaacaattccaaagttatgaatgagcactggcagttttccacattctccaataatctaataatcttcatcaaaactacttataaaattaatgaaaagataagagacaggacaatatgtgtagttaagcaagcatttctttagatctactaattaccttgcacttgacgaaggatcacccaaaacaaaacagtagtaatgtatatttatcaaacgtgcattattcattaggaactttatatagttttctctta

SEQ ID NO: 1875 - DNA, 601 bp, Human
tagtaatgtatatttatcaaacgtgcattattcattaggaactttatatagttttctcttattaatgatttaattctcacatgaattcagtaaggatggcagtaatatcatccccatttatagatataaaaattgaggccaagatcatatagctagaaagtgttgagaaagttgggaaaatgttggtctggccttattatcattttgtttcgccacagcatcctttaaaaaagaagaaaatatgctagaagaagaaatagaaagccagaataacacatttcctttgtttcccagttatcawcaatgtctagattcctagtaaaatgtgatcttcttgttaggcaaagatatagaaaagagctaagatatccatatgttgaaggagtagaaagggaagacagtgaagtccacatcataaggatcaactaactctaacacttttttggaaaggtgatatactctactgtaacaaaaatgtaaatcacccatttgcaatcaattttccttaatttctagatacactggtgatgatactcaatgctactgacgcagatgaaccgaacaatttgaactcaaaaatagccttcaagattataagaca

SEQ ID NO: 1876 - DNA, 601 bp, Human
taagacaagaaccttcagattcaccaatgtttattatcaacagaaatactggagaaattcgaacgatgaataattttctagacagagaggtaattctttttctttaagtgggtttttggtctcaaaggaactgattctaaaagcaaggatactgaagagacaaagagatgaagaaaatgatggtttaaatttttacttgtataactttttcacataattctttcatgtaagaaatattttttaaatgaaaaagggaggatttttcaattacgttttgtactatttttcatataattaattrattaaaatttacttcaatttaagaaaactatattgtgaaagtacatgaaaatatgcctaaggtagaatctaaggtagaatcaaaagctccatttctctaaaaagtgtgttctataataaaatgaatttaggaatgacttgctatatgtccacgttttggtgagttacagtgcatgcgagtatgctggaggctccaggaatattgatacactaagttctctttctttaacctagcatatctaagctccattgacaacagaattcttgtttttcctatgtaacatctattgatagctcaccc

SEQ ID NO: 1877 - DNA, 601 bp, Human
ttaacctagcatatctaagctccattgacaacagaattcttgtttttcctatgtaacatctattgatagctcacccattcatttactttgggaaatgaaccacaggataagaatgatggataggaattaaatgacagactgaccaatctttttatttacaaataagaaaataactagtgatgttaacagagtaaaatcagcattatgaggtttctagcatgccttgtgattttatgatttagttttaaaataagtgctttttcattatttaaaaaaaattgtcttttaatagaatgttgcracctaaatgtacattaggagcataagtgaggaagctttattttctgatggtattcaattaattttgttttaattattaaaaatgacaatcttcttgctgatgacttttaggtttaggataattcatattattttaatactctttaattatctaaatgttacaagtttctatgttacctaagtctccttttatacatgtttgaaaatcaacattagaagaaattgaatgtttacacttttctctctcaaactgtcttaaacagcccaatgaggtttctttcatgtcaaaagagctttcgtg

SEQ ID NO: 1878 - DNA, 601 bp, Human
gttttaaaataagtgctttttcattatttaaaaaaaattgtcttttaatagaatgttgcaacctaaatgtacattaggagcataagtgaggaagctttattttctgatggtattcaattaattttgttttaattattaaaaatgacaatcttcttgctgatgacttttaggtttaggataattcatattattttaatactctttaattatctaaatgttacaagtttctatgttacctaagtctccttttatacatgtttgaaaatcaacattagaagaaattgaatgtttacacttttcyctctcaaactgtcttaaacagcccaatgaggtttctttcatgtcaaaagagctttcgtggtaaagcactgtaagaaagggctgtcagaaggaaagggactctgcagccattgggaagccaccagggcagatattctcaacctggggtcaatggagagacctcaagatgtctctataaaaccccctaaattatatccaccattttgaatgagtgtgcatttttgcatgagtcaaggaaagcctccatagattttaccagcttctagaaatataagcaccattgaatagagtcaagaataga

SEQ ID NO: 1879 - DNA, 601 bp, Human
atgtacattaggagcataagtgaggaagctttattttctgatggtattcaattaattttgttttaattattaaaaatgacaatcttcttgctgatgacttttaggtttaggataattcatattattttaatactctttaattatctaaatgttacaagtttctatgttacctaagtctccttttatacatgtttgaaaatcaacattagaagaaattgaatgtttacacttttctctctcaaactgtcttaaacagcccaatgaggtttctttcatgtcaaaagagctttcgtggtaaagyactgtaagaaagggctgtcagaaggaaagggactctgcagccattgggaagccaccagggcagatattctcaacctggggtcaatggagagacctcaagatgtctctataaaaccccctaaattatatccaccattttgaatgagtgtgcatttttgcatgagtcaaggaaagcctccatagattttaccagcttctagaaatataagcaccattgaatagagtcaagaatagatacatcaccaataattccactgccataacccactacctctcaaaacacaaagctttgttatctgtt

SEQ ID NO: 1880 - DNA, 601 bp, Human
tttcaacctctggacatattattattaataagaaatgaagccttttaaaacgtgttgcatcttttaaataatgcgtgataagtattattgggaataatcatgtgaaacttgtggatttcccatattctgtgttaaccctacctctatcatagatttatgtaaacgttgagccaacttttcaaagaactttacataagacaaagtaaaggctgtctacgtcaagtgtgatattgcctgtaatatgtatttttagcaatacggccagtatgctcttgctgtaagaggctctgaccgagatggyggggcagatggcatgtcagcggaatgtgagtgcaacattaaaatcctcgatgtcaatgataatatcccttacatggaacagtcttcagtaagtatttgttcttggaattaataaatctaaattcgctatattctaaaacatatacgaacaattctgcttacagaggcacatgttatgtttattgacatacaacccaaatgtagacacatacttttttcttgtgtttatgcaagaataaatggagttaagcaatgaaaaatgagatgaaaaccacagatatcttttctaaataatgaagtt

SEQ ID NO: 1881 - DNA, 601 bp, Human
tgttttcttaatcttttttcaaaatgttaaacttaaaataaaatgatgctaacatttcacaaacttggcttagtgaaagaataaaaattactgtgttttaaatatatatataacatagagctttttaatatagtctttctgcttataatcattttagaaaaacaggtattgaattttaactggagacagtttgtcaatacagtactcccaaatagatcatataaattgaaaacacttaaaaatatattttatgcttacaacaaagtataattaatccttaaggttaatgtcttaagaactytttaaagcatatttaatagaggctttaaaactgtgtccatgtcaacattgtaagtcaattattacacatgtagaatattcatcatgtaaataaaaatgtatttattcctcccgcgtgttttcataaaatttaagttaaattactataaatgtagaattatcacactcccatctcactgtggctgctgatcaaggcttattaggaacacagatatactggaaatttggtccaagtcaaccggtccagaacaactggatgccgttctcttatgtcctccccatattaatggtccacatttac

SEQ ID NO: 1882 - DNA, 601 bp, Human
cagaacaactggatgccgttctcttatgtcctccccatattaatggtccacatttacctgcagtaaaatttcatctgagatgtgagaaaaaaaatttgcctcctagggagctgatagtcaaagtttcgccctgtgctacacaacttacacagtcgatttttaaaatctacaacagctgtttatggattgtatatgttgcatgcaatatatagtttcatggtaaaatataatccctatttaactatttcttttttcagactaggtctggaaaacagactctcaaacgactctgtccccatamgaatgtgtggctttttgcctcctgtgtcttcttaaagtgtcaccatgcctacagcttgtatttaatttgagacagtacgcaggtgctttagtttatccctcacagcatccctgcaaattaggttatattatttccatattgcagataaagacattgaggctccaagagagcacagaacctgcataagttctcatagctagtaagtagtgcagccaacatttaaacctagttttctctagatatgaagttcacattctttccatgatactatttaggattcaatactggggaaattggagt

SEQ ID NO: 1883 - DNA, 601 bp, Human
tctcatagctagtaagtagtgcagccaacatttaaacctagttttctctagatatgaagttcacattctttccatgatactatttaggattcaatactggggaaattggagtctaatctattttgccccaaactattatattactttagaaaattattcaacctatctgtcctcaatatctctatctgtaaaatgggaatgataattgtttgcccagacatatcatatattaaatcctttgttatagctatatacatatatatatattatgtgtgtgtaatgtatatatacttttgattttacatccattctttgaattgcaaataaaaccaatattagaacaaagattcaaaattttagctaaataggggagttcaatgcgtgaaattctatttttatctaaattactcttgtgaaattttagaaaaatatatttggtgtgtatgggcctaatggcataattgtttgtggattttatgtgttgtggatattaatatcatttttcataaagaaaatcactactttattattttatgaaataaatatttcctagaacatgttgaagaaaatagatttatttatattatatatatattacatt

SEQ ID NO: 1884 - DNA, 601 bp, Human
tatttaggattcaatactggggaaattggagtctaatctattttgccccaaactattatattactttagaaaattattcaacctatctgtcctcaatatctctatctgtaaaatgggaatgataattgtttgcccagacatatcatatattaaatcctttgttatagctatatacatatatatatattatgtgtgtgtaatgtatatatacttttgattttacatccattctttgaattgcaaataaaaccaatattagaacaaagattcaaaattttagctaaataggggagttcaatgygtgaaattctatttttatctaaattactcttgtgaaattttagaaaaatatatttggtgtgtatgggcctaatggcataattgtttgtggattttatgtgttgtggatattaatatcatttttcataaagaaaatcactactttattattttatgaaataaatatttcctagaacatgttgaagaaaatagatttatttatattatatatatattacattatattatctgatttattcaaagagtcacacttacagatgtgaaatttcttgtaaatagttcttatggataaaaccactca

SEQ ID NO: 1885 - DNA, 601 bp, Human
taagtacatatgttctttttatagattataagtatctgagttaaaatacttttcattatttttgaaactatcatttaattgtaaaaagtactataaactgtgcatttaaaatgtttaacttaagaaaacataaaaattcatgcaagatgtaagatgttaaactgtaaagatgtgatatgtgaaaataatatgtctcaaaagtatcgacactcctgtatttctatgtcttattgatcaattagctgattaccacaggccgtgattcgtctctcagaagagtttaaggaatgattttccgatkgcaaatctgctcagcttgaaatcaattagattttattagctcatttcaattatattcttcactttattcagcatttaatattggtcaataacgctggtgtgaaaattcggttatattaaggaaaactacaccatgtaattttttaaaactctatatatgcagatatttctaccaagtcacaaaaaaatctgtgcgtgcacatgtacctgtatttgcacatgtgactgtgacaagaagaatgggagaagcactttacccatgcattttttgttgtttgggggttttttgtttgtttgtttg

SEQ ID NO: 1886 - DNA, 601 bp, Human
ttctttttatagattataagtatctgagttaaaatacttttcattatttttgaaactatcatttaattgtaaaaagtactataaactgtgcatttaaaatgtttaacttaagaaaacataaaaattcatgcaagatgtaagatgttaaactgtaaagatgtgatatgtgaaaataatatgtctcaaaagtatcgacactcctgtatttctatgtcttattgatcaattagctgattaccacaggccgtgattcgtctctcagaagagtttaaggaatgattttccgatggcaaatctgctyagcttgaaatcaattagattttattagctcatttcaattatattcttcactttattcagcatttaatattggtcaataacgctggtgtgaaaattcggttatattaaggaaaactacaccatgtaattttttaaaactctatatatgcagatatttctaccaagtcacaaaaaaatctgtgcgtgcacatgtacctgtatttgcacatgtgactgtgacaagaagaatgggagaagcactttacccatgcattttttgttgtttgggggttttttgtttgtttgtttgttgtttgtttgt

SEQ ID NO: 1887 - DNA, 601 bp, Human
ctgagttaaaatacttttcattatttttgaaactatcatttaattgtaaaaagtactataaactgtgcatttaaaatgtttaacttaagaaaacataaaaattcatgcaagatgtaagatgttaaactgtaaagatgtgatatgtgaaaataatatgtctcaaaagtatcgacactcctgtatttctatgtcttattgatcaattagctgattaccacaggccgtgattcgtctctcagaagagtttaaggaatgattttccgatggcaaatctgctcagcttgaaatcaattagattttrttagctcatttcaattatattcttcactttattcagcatttaatattggtcaataacgctggtgtgaaaattcggttatattaaggaaaactacaccatgtaattttttaaaactctatatatgcagatatttctaccaagtcacaaaaaaatctgtgcgtgcacatgtacctgtatttgcacatgtgactgtgacaagaagaatgggagaagcactttacccatgcattttttgttgtttgggggttttttgtttgtttgtttgttgtttgtttgttttttgagacagagtttcactct

SEQ ID NO: 1888 - DNA, 601 bp, Human
taaaaattcatgcaagatgtaagatgttaaactgtaaagatgtgatatgtgaaaataatatgtctcaaaagtatcgacactcctgtatttctatgtcttattgatcaattagctgattaccacaggccgtgattcgtctctcagaagagtttaaggaatgattttccgatggcaaatctgctcagcttgaaatcaattagattttattagctcatttcaattatattcttcactttattcagcatttaatattggtcaataacgctggtgtgaaaattcggttatattaaggaaaactacrccatgtaattttttaaaactctatatatgcagatatttctaccaagtcacaaaaaaatctgtgcgtgcacatgtacctgtatttgcacatgtgactgtgacaagaagaatgggagaagcactttacccatgcattttttgttgtttgggggttttttgtttgtttgtttgttgtttgtttgttttttgagacagagtttcactctgtcacccaggctggagtgcagtggcacgatcccggttcactgccacctctgcctcccgggttcacgcgattctcctccctcagcctcccaagtag

SEQ ID NO: 1889 - DNA, 601 bp, Human
caaatctgctcagcttgaaatcaattagattttattagctcatttcaattatattcttcactttattcagcatttaatattggtcaataacgctggtgtgaaaattcggttatattaaggaaaactacaccatgtaattttttaaaactctatatatgcagatatttctaccaagtcacaaaaaaatctgtgcgtgcacatgtacctgtatttgcacatgtgactgtgacaagaagaatgggagaagcactttacccatgcattttttgttgtttgggggttttttgtttgtttgtttgttgtttgtttgttttttgagacagagtttcactctgtcacccaggctggagtgcagtggcacgatcccggttcactgccacctctgcctcccgggttcacgcgattctcctccctcagcctcccaagtagctgggattacaggcacctgctaccacgcccagctatttttgttttagtagagaaggggtttcaccatgttggccaggtcagtctcgaactccagagctcaggtgatccaccctcctcagcctcccaaagtgctgggattacaggcttaagccaccgcactcagcccacccat

SEQ ID NO: 1890 - DNA, 601 bp, Human
tctgctcagcttgaaatcaattagattttattagctcatttcaattatattcttcactttattcagcatttaatattggtcaataacgctggtgtgaaaattcggttatattaaggaaaactacaccatgtaattttttaaaactctatatatgcagatatttctaccaagtcacaaaaaaatctgtgcgtgcacatgtacctgtatttgcacatgtgactgtgacaagaagaatgggagaagcactttacccatgcattttttgttgtttgggggttttttgtttgtttgtttgttgtttgtttgttttttgagacagagtttcactctgtcacccaggctggagtgcagtggcacgatcccggttcactgccacctctgcctcccgggttcacgcgattctcctccctcagcctcccaagtagctgggattacaggcacctgctaccacgcccagctatttttgttttagtagagaaggggtttcaccatgttggccaggtcagtctcgaactccagagctcaggtgatccaccctcctcagcctcccaaagtgctgggattacaggcttaagccaccgcactcagcccacccatgtgt

SEQ ID NO: 1891 - DNA, 601 bp, Human
gctggtgtgaaaattcggttatattaaggaaaactacaccatgtaattttttaaaactctatatatgcagatatttctaccaagtcacaaaaaaatctgtgcgtgcacatgtacctgtatttgcacatgtgactgtgacaagaagaatgggagaagcactttacccatgcattttttgttgtttgggggttttttgtttgtttgtttgttgtttgtttgttttttgagacagagtttcactctgtcacccaggctggagtgcagtggcacgatcccggttcactgccacctctgcctcccrggttcacgcgattctcctccctcagcctcccaagtagctgggattacaggcacctgctaccacgcccagctatttttgttttagtagagaaggggtttcaccatgttggccaggtcagtctcgaactccagagctcaggtgatccaccctcctcagcctcccaaagtgctgggattacaggcttaagccaccgcactcagcccacccatgtgttttataagttctttcttggtgttctcctcacatagtgtgagtagttctgttagaagtcctgtcacactgtaccatgttgctgatgag

SEQ ID NO: 1892 - DNA, 601 bp, Human
gctgggattacaggcttaagccaccgcactcagcccacccatgtgttttataagttctttcttggtgttctcctcacatagtgtgagtagttctgttagaagtcctgtcacactgtaccatgttgctgatgagcgctcttgtaccccacaggagtgagttcactgaaggtagacgcaacccagagcttagcagaatgccagagagagagagagagaattacctaaccagtgtttgtttcacaaataatagatgagaagaaaaacaccgaagtcaaagatgagaaaagaatagaatagaggytcaaggcaaggccttagtttggaattcaaaagaggtcttgtcaagttccagtgcatgtgagaaggaggagcagaaacaggggggaagttcaggccaagctgatgaagtaacttctttgtaaaagaatagtttagaattaggagcagcctgggaaatcctaggatctgggtcttctgtaatagttctgctgctacttaaatcaaatgaaaatgagactgcaagcatcaaaggattattctgacatccaagtgggcataaaaagacattccatcagaaatgggtgctcagtaattttttttt

SEQ ID NO: 1893 - DNA, 601 bp, Human
aggcaaggccttagtttggaattcaaaagaggtcttgtcaagttccagtgcatgtgagaaggaggagcagaaacaggggggaagttcaggccaagctgatgaagtaacttctttgtaaaagaatagtttagaattaggagcagcctgggaaatcctaggatctgggtcttctgtaatagttctgctgctacttaaatcaaatgaaaatgagactgcaagcatcaaaggattattctgacatccaagtgggcataaaaagacattccatcagaaatgggtgctcagtaatttttttttcttraatgtaaatcttgatatatccctgagtggctccatattgctaagactgccctgaaaaaaaataaagtctctagtaattgaaaactgtatctagggattataattactcactgaaaaaaacaatacattttaaattaaaatttctttttttagatagctgacattaatttgtatcattttctttcaaatacaggtatgtaatgggaaataatccagctgacctgctagctgttgattcaagaacaggcaaactcactttgaaaaataaagttaccaaggaacagtacaatatgctcggagg

SEQ ID NO: 1894 - DNA, 601 bp, Human
agctatagaatcttagagaagttatttaatccatctatagctgttgtctcttttttaaaatggaacaataacaatatatgtttagaaggatgtgatgataatgataaaaatagcaacaaaaacaaaacaacaggattagcatagttgagctgaaaggacatgggctttgatatcatatagactagatttaaacatatttctgttatatacttccagaatgtttttattcatttatttagaaagtgtataattgagtcctaactaaatgtcagccattgtgccagattctagggttacatcrattaataaagtcagacaactgagctcacatctatgtaataaagattacaaaaataacctcaaacaaattattcccatatttttgctgaataattccactttcaataatattaggaaaagtttaaatataacaagatgaatgcacaagatgttaattacagcactaataattaaatattgaaaaccacatcaataataggcaacagggtaagtaaaccatggtccatttgatataaaattatataaccatcaggaactatgttaatacaaagtttattaaaatacaaaagaatacttatag

SEQ ID NO: 1895 - DNA, 601 bp, Human
caaaatttaaaacgtatttccaaaaaatgaaatttttacattaacaaataagagtttattcttactggctcataattaattgaagtaataaccaggaaaagttctatgaaacagagaaaagggaaagagagaaagaaaaaagcattctcatcaaaatgaaccaagacaagataaaggcaaaaatgctagtgaagttgcagaatataacataaaatacatatgaaaagagttcattctctctgttatttattaccaactaacattgtaaaatgtttaaatttaatacttcataagagtaacktaattacccaagtgctcattatcactactgtaaataatacctaactttcatgttgagttttgtttgtttgttttctgggttttttttgttcttttgtttttttgtttttttgtttttttttgagatggagtctcactctcacccaggctggagtacagtggtgcaatctcgtctcactgtaacctttgcctcccaggttcaagcgattctcctgcctcagcctcctgagtagctgggactacccatgtgcaccaccacacccggctaatttttgtatttttagtaaagatggggtttcac

SEQ ID NO: 1896 - DNA, 601 bp, Human
ggaaagagagaaagaaaaaagcattctcatcaaaatgaaccaagacaagataaaggcaaaaatgctagtgaagttgcagaatataacataaaatacatatgaaaagagttcattctctctgttatttattaccaactaacattgtaaaatgtttaaatttaatacttcataagagtaacgtaattacccaagtgctcattatcactactgtaaataatacctaactttcatgttgagttttgtttgtttgttttctgggttttttttgttcttttgtttttttgtttttttgtttttttttgagatggagtctcactctcacccaggctggagtacagtggtgcaatctcgtctcactgtaacctttgcctcccaggttcaagcgattctcctgcctcagcctcctgagtagctgggactacccatgtgcaccaccacacccggctaatttttgtatttttagtaaagatggggtttcaccatattggccaggatgatctcgatctcctgacctcgtgatccacccgctttggcctctcaaagtgctggaattacaggcgtgagccaccgcgcccgtcctgagttgtttttttacattgcg

SEQ ID NO: 1897 - DNA, 601 bp, Human
aaagcattctcatcaaaatgaaccaagacaagataaaggcaaaaatgctagtgaagttgcagaatataacataaaatacatatgaaaagagttcattctctctgttatttattaccaactaacattgtaaaatgtttaaatttaatacttcataagagtaacgtaattacccaagtgctcattatcactactgtaaataatacctaactttcatgttgagttttgtttgtttgttttctgggttttttttgttcttttgtttttttgtttttttgtttttttttgagatggagtctcactstcacccaggctggagtacagtggtgcaatctcgtctcactgtaacctttgcctcccaggttcaagcgattctcctgcctcagcctcctgagtagctgggactacccatgtgcaccaccacacccggctaatttttgtatttttagtaaagatggggtttcaccatattggccaggatgatctcgatctcctgacctcgtgatccacccgctttggcctctcaaagtgctggaattacaggcgtgagccaccgcgcccgtcctgagttgtttttttacattgcggactacctctgggtact

SEQ ID NO: 1898 - DNA, 601 bp, Human
tttttttgagatggagtctcactctcacccaggctggagtacagtggtgcaatctcgtctcactgtaacctttgcctcccaggttcaagcgattctcctgcctcagcctcctgagtagctgggactacccatgtgcaccaccacacccggctaatttttgtatttttagtaaagatggggtttcaccatattggccaggatgatctcgatctcctgacctcgtgatccacccgctttggcctctcaaagtgctggaattacaggcgtgagccaccgcgcccgtcctgagttgtttttttayattgcggactacctctgggtactgtagtaaataaaagatttataaattatatatgggccttagtcatcactacctgtagacccaaagtttcctctagtagattttcagaaaaccaatacatgggcttcttttcctctttttttcttttttcttctctccctctctcccttatgtctatccttactaccttccttcttccctaatttacttccttcttttttcctttcctccttcttcacaattttaatttacacattctttctttcatccatttattcaaaaccatttaccaagattaga

SEQ ID NO: 1899 - DNA, 601 bp, Human
cctgaccttttcatctttccttgttctctcctttaatattttcctaaataatgacatggaaagattaatcggttttaataatgtaatactatctgtgatttttttttttttttttttgagagagggtctcactctgtcactcaggctggagtgcagtggcacaaccaccgcccacctccctggttgagcagcctcaacctccctggctcaagccatcctcccacctcagcctccagagtagctaagactgcaggcaaaagcccccatacacgcctaatttttgtattttttggtagagatrgggtttcaccatgttgctcaggcttgtctcaagctcctgggctctagtgatccacccacttccacctcccaaagtgctggaattacaggtgtgagccaccatgccaggcccactatttgtaatttttaatactataaaataaactaaaattgactgcagtctaatatacagaagctcccatttactttggggtctgaccatcattcagcttgtattctgaaactttcataattttagaaccaaccagaattatattacgaattcaaatttaaccataaaaaatcaggttgttttgttttt

SEQ ID NO: 1900 - DNA, 601 bp, Human
aatcagaaacacaacaaaattagatggaagtaaccagggaagattttctaagtgaagttcaaattttaaatggatttcagaatttcctaaatagtattttttttttaggaaatctgaggtaatttaagaataaaccaaatgtatgactgcagaaagattatagtcattggtcactacaaatggaaatgttgtttcctgtcttttaggatataaccactgtcataccacaaataccacctgataacgcaaatataattgaatgcattgacaactcaggtaagaaaaaagaatttgtttaacmtctcaaatgcttaagtaggaagtctattttctctctttgattattgttttttaattatcttatttttcttcaaaagtgtttatatcattcttttttaaatgactaacttgtaaattaaatggcaaggaaaaacctatggtaattattattgttatatgcttcattttaaaaattttcctcaaccatcaaagagtacttagaagatgtccaaattaggatctctatatatgcagaagtactgaattgtaaccatgagtaagttttagtcaagatttttaatttaatagagcaaatttcatt

SEQ ID NO: 1901 - DNA, 601 bp, Human
atcagaaacacaacaaaattagatggaagtaaccagggaagattttctaagtgaagttcaaattttaaatggatttcagaatttcctaaatagtattttttttttaggaaatctgaggtaatttaagaataaaccaaatgtatgactgcagaaagattatagtcattggtcactacaaatggaaatgttgtttcctgtcttttaggatataaccactgtcataccacaaataccacctgataacgcaaatataattgaatgcattgacaactcaggtaagaaaaaagaatttgtttaacawctcaaatgcttaagtaggaagtctattttctctctttgattattgttttttaattatcttatttttcttcaaaagtgtttatatcattcttttttaaatgactaacttgtaaattaaatggcaaggaaaaacctatggtaattattattgttatatgcttcattttaaaaattttcctcaaccatcaaagagtacttagaagatgtccaaattaggatctctatatatgcagaagtactgaattgtaaccatgagtaagttttagtcaagatttttaatttaatagagcaaatttcatta

SEQ ID NO: 1902 - DNA, 601 bp, Human
ctaagtgaagttcaaattttaaatggatttcagaatttcctaaatagtattttttttttaggaaatctgaggtaatttaagaataaaccaaatgtatgactgcagaaagattatagtcattggtcactacaaatggaaatgttgtttcctgtcttttaggatataaccactgtcataccacaaataccacctgataacgcaaatataattgaatgcattgacaactcaggtaagaaaaaagaatttgtttaacatctcaaatgcttaagtaggaagtctattttctctctttgattattgktttttaattatcttatttttcttcaaaagtgtttatatcattcttttttaaatgactaacttgtaaattaaatggcaaggaaaaacctatggtaattattattgttatatgcttcattttaaaaattttcctcaaccatcaaagagtacttagaagatgtccaaattaggatctctatatatgcagaagtactgaattgtaaccatgagtaagttttagtcaagatttttaatttaatagagcaaatttcattaacatacatacacacacatatttcatacacatatatacactaattaa

SEQ ID NO: 1903 - DNA, 601 bp, Human
gtcataccacaaataccacctgataacgcaaatataattgaatgcattgacaactcaggtaagaaaaaagaatttgtttaacatctcaaatgcttaagtaggaagtctattttctctctttgattattgttttttaattatcttatttttcttcaaaagtgtttatatcattcttttttaaatgactaacttgtaaattaaatggcaaggaaaaacctatggtaattattattgttatatgcttcattttaaaaattttcctcaaccatcaaagagtacttagaagatgtccaaattaggwtctctatatatgcagaagtactgaattgtaaccatgagtaagttttagtcaagatttttaatttaatagagcaaatttcattaacatacatacacacacatatttcatacacatatatacactaattaaaattaaagtacaacccaactaaaatagagccgtgctcatttattgaggctaaaatctttatacacaattaatttaaggattcaaaattgctttgactttagctgcttattataacaaagaaaaaaactgcatccattttcagtatcatcacaaatattacctaaaaaatat

SEQ ID NO: 1904 - DNA, 601 bp, Human
gtgtttatatcattcttttttaaatgactaacttgtaaattaaatggcaaggaaaaacctatggtaattattattgttatatgcttcattttaaaaattttcctcaaccatcaaagagtacttagaagatgtccaaattaggatctctatatatgcagaagtactgaattgtaaccatgagtaagttttagtcaagatttttaatttaatagagcaaatttcattaacatacatacacacacatatttcatacacatatatacactaattaaaattaaagtacaacccaactaaaatagasccgtgctcatttattgaggctaaaatctttatacacaattaatttaaggattcaaaattgctttgactttagctgcttattataacaaagaaaaaaactgcatccattttcagtatcatcacaaatattacctaaaaaatatttgtccaatttctttaattgaaagcaagtagatgaaacactatcaaaatctttctaagctctcaactgagattgtgtgcacatggtggagttttttccagcacgtgggtaagactgtataaatacaacttgccttaaaacaggaatctagaccagttc

SEQ ID NO: 1905 - DNA, 601 bp, Human
ggaaaaacctatggtaattattattgttatatgcttcattttaaaaattttcctcaaccatcaaagagtacttagaagatgtccaaattaggatctctatatatgcagaagtactgaattgtaaccatgagtaagttttagtcaagatttttaatttaatagagcaaatttcattaacatacatacacacacatatttcatacacatatatacactaattaaaattaaagtacaacccaactaaaatagagccgtgctcatttattgaggctaaaatctttatacacaattaatttaaggwttcaaaattgctttgactttagctgcttattataacaaagaaaaaaactgcatccattttcagtatcatcacaaatattacctaaaaaatatttgtccaatttctttaattgaaagcaagtagatgaaacactatcaaaatctttctaagctctcaactgagattgtgtgcacatggtggagttttttccagcacgtgggtaagactgtataaatacaacttgccttaaaacaggaatctagaccagttcacaggcagaacccagggaataattagaatttcacagtgagtggataacta

SEQ ID NO: 1906 - DNA, 601 bp, Human
tgaaagcaagtagatgaaacactatcaaaatctttctaagctctcaactgagattgtgtgcacatggtggagttttttccagcacgtgggtaagactgtataaatacaacttgccttaaaacaggaatctagaccagttcacaggcagaacccagggaataattagaatttcacagtgagtggataactaccattataataaaagaacaattaaaataacatctcatatctgtgaaaatagttgtatcacattacttttctcaaggtaaataaatactattggttagcttatttttctcayagtctttttaaacagtaaccattgttttctactttaaactaacaggcatagaaatgtgtataacttgtagaactggaccttattcaaagaactcgacacagtagtctttaaatctatttctccacctgatttgtccattttcattaataaccccaatgtcttctcacctcaaaagcagaatctcattgttgactcgtcgtattcactgacaccaaatcagttctcaagacatttatcaaatcatcaaatccatcagtatttatttacacatttgttcccattaaatctacaaacttttgc

SEQ ID NO: 1907 - DNA, 601 bp, Human
tcaaatatttcttttttttttaatttaaaaaagatgaaacacttgaccaatttgcgtatcatcctgtgcaggggcaatcctaatgttctctatatagttctaattttagtatacgtgctactgaagcgagtacctacctcaaatatagtaacaggcttccacttactcctcacatccaagtgcaaacccaagattcttcatgaaaacctttctcctcacatagccatggcctcctctctgaaagccagtggttctcatgtctttttctggatgtcctgtgcttctagttatacactggggattctagttatacactgtttttttaactttcagaatttgagtattttttctccaatttcctacaggttgaaatcaaatgctttaggacatagattttttttaagtcctctgcagccttcacttccagcagagaatatagtaatctctcaacagataattatcaaattaacaaattaataatattattttgagttcaatattgtatttatatctcctttctttatgtattatctttttatttctttgttcacaaatgcatacctaaatgaaaaaatcacatattacaaggcaagttgttact

SEQ ID NO: 1908 - DNA, 601 bp, Human
ttcttttttttttaatttaaaaaagatgaaacacttgaccaatttgcgtatcatcctgtgcaggggcaatcctaatgttctctatatagttctaattttagtatacgtgctactgaagcgagtacctacctcaaatatagtaacaggcttccacttactcctcacatccaagtgcaaacccaagattcttcatgaaaacctttctcctcacatagccatggcctcctctctgaaagccagtggttctcatgtctttttctggatgtcctgtgcttctagttatacactggggcttctagttatacactgtttttttaactttcagaatttgagtattttttctccaatttcctacaggttgaaatcaaatgctttaggacatagattttttttaagtcctctgcagccttcacttccagcagagaatatagtaatctctcaacagataattatcaaattaacaaattaataatattattttgagttcaatattgtatttatatctcctttctttatgtattatctttttatttctttgttcacaaatgcatacctaaatgaaaaaatcacatattacaaggcaagttgttactttttagtt

SEQ ID NO: 1909 - DNA, 601 bp, Human
ctaaagctctgacctgagcactttactccccaacgtaagaacagccaatggctcccagctctcttttgttcatggcatgcaatccaaagtccttaacatgttaactaagattgttcacaaaatgaaccctccctcttatctccaattactccttgccatcaactccacttgctgagcacctttgccacacacctttcacctccatgtgtttgcttatcctgtgcccctcctggaatgcttgcatcccactatgtctctcacaaactcctacccatccttcaagacccagtccaaatatcaytctccctccgaagtttttacagttaaccctctcatccaaaataggattaatgttttctcatctgtatttctgcagtactttgtttacacatttatagaacctatcattgctaaaatctgtccgtttatatgtctaccaccacttttagtgtctcatccatatattctctacgttgtattgccagtacatagctcagttctagacatagaggcaatagttaatgagagtggggtcaagagccatagtctacttccaaaacattgtaagaacgagctgtaggtggtgggaagagcatgaagc

SEQ ID NO: 1910 - DNA, 601 bp, Human
gctctgacctgagcactttactccccaacgtaagaacagccaatggctcccagctctcttttgttcatggcatgcaatccaaagtccttaacatgttaactaagattgttcacaaaatgaaccctccctcttatctccaattactccttgccatcaactccacttgctgagcacctttgccacacacctttcacctccatgtgtttgcttatcctgtgcccctcctggaatgcttgcatcccactatgtctctcacaaactcctacccatccttcaagacccagtccaaatatcactctcyctccgaagtttttacagttaaccctctcatccaaaataggattaatgttttctcatctgtatttctgcagtactttgtttacacatttatagaacctatcattgctaaaatctgtccgtttatatgtctaccaccacttttagtgtctcatccatatattctctacgttgtattgccagtacatagctcagttctagacatagaggcaatagttaatgagagtggggtcaagagccatagtctacttccaaaacattgtaagaacgagctgtaggtggtgggaagagcatgaagcctgga

SEQ ID NO: 1911 - DNA, 601 bp, Human
tgagcacctttgccacacacctttcacctccatgtgtttgcttatcctgtgcccctcctggaatgcttgcatcccactatgtctctcacaaactcctacccatccttcaagacccagtccaaatatcactctccctccgaagtttttacagttaaccctctcatccaaaataggattaatgttttctcatctgtatttctgcagtactttgtttacacatttatagaacctatcattgctaaaatctgtccgtttatatgtctaccaccacttttagtgtctcatccatatattctctacrttgtattgccagtacatagctcagttctagacatagaggcaatagttaatgagagtggggtcaagagccatagtctacttccaaaacattgtaagaacgagctgtaggtggtgggaagagcatgaagcctggagaagcagctgcaggagaatttaactttgccatccccaggaagagatgcaattgtccatggttacacatcatgtgatacccaatcttaaggaagttcctgtccctgacatcgactagaaaaacatttctgtccttctacattctggcctaaagtggtttcattaacta

SEQ ID NO: 1912 - DNA, 601 bp, Human
tctctacgttgtattgccagtacatagctcagttctagacatagaggcaatagttaatgagagtggggtcaagagccatagtctacttccaaaacattgtaagaacgagctgtaggtggtgggaagagcatgaagcctggagaagcagctgcaggagaatttaactttgccatccccaggaagagatgcaattgtccatggttacacatcatgtgatacccaatcttaaggaagttcctgtccctgacatcgactagaaaaacatttctgtccttctacattctggcctaaagtggtttcmttaactaacctagtggttggtttaaagagtggctgatatttttaaataaaatattggtaaaagcattcaaatagcaatagatagtaatgaggcttgttgaaaaccataggaatacttattcatatatacaacaaaatattttgttatattttaataacatagaaatatcttccttccaatctctgatcaaatatcactttatcagagaccccttccttgattaccctatctaaaagaacagcacccatcactttctttttctttaccctgcatctgccacctcctgaccatatgcttctg

SEQ ID NO: 1913 - DNA, 601 bp, Human
ttgtaagaacgagctgtaggtggtgggaagagcatgaagcctggagaagcagctgcaggagaatttaactttgccatccccaggaagagatgcaattgtccatggttacacatcatgtgatacccaatcttaaggaagttcctgtccctgacatcgactagaaaaacatttctgtccttctacattctggcctaaagtggtttcattaactaacctagtggttggtttaaagagtggctgatatttttaaataaaatattggtaaaagcattcaaatagcaatagatagtaatgaggcttrttgaaaaccataggaatacttattcatatatacaacaaaatattttgttatattttaataacatagaaatatcttccttccaatctctgatcaaatatcactttatcagagaccccttccttgattaccctatctaaaagaacagcacccatcactttctttttctttaccctgcatctgccacctcctgaccatatgcttctgtgttgtctgtctcactcacccaaaatgtaagctctgtgagagaacagctgtatctggtattgttcattatgcatagctaagttccaaacacagagg

SEQ ID NO: 1914 - DNA, 601 bp, Human
ttcatatatacaacaaaatattttgttatattttaataacatagaaatatcttccttccaatctctgatcaaatatcactttatcagagaccccttccttgattaccctatctaaaagaacagcacccatcactttctttttctttaccctgcatctgccacctcctgaccatatgcttctgtgttgtctgtctcactcacccaaaatgtaagctctgtgagagaacagctgtatctggtattgttcattatgcatagctaagttccaaacacagagggtctggcaaatagcaaaggctcratcatttttttatatgaatggcacaatgagttggtttcctataaggtatttctgttaacctgaaagtttacaatccactattacgaacaacaaagatgaaacgaaagtgtatatgtctttgggcttttactttgaatttagagagattatattttttaaaagtgtctttgatcacctttaattttgtagaacagacccagagtcaaattttcctgttgctgtgctgaaaaagtcatgttgcaataaaccttcacagaatcatcatattcactccatctgaaggaaagaaacaaaatcctg

SEQ ID NO: 1915 - DNA, 601 bp, Human
atccactattacgaacaacaaagatgaaacgaaagtgtatatgtctttgggcttttactttgaatttagagagattatattttttaaaagtgtctttgatcacctttaattttgtagaacagacccagagtcaaattttcctgttgctgtgctgaaaaagtcatgttgcaataaaccttcacagaatcatcatattcactccatctgaaggaaagaaacaaaatcctgagtgaacccaactcaactatgaactacttttccagacaaaaaacaaaacaacacatttttatgtccttcaagytcagtatttttatatacctccctctaactttgttataaataattcatgtgatttttttttattattatactttaagttttagggtacatgtgcacattgtgcaggttagttacatatgtatacatgtgccatgctggtgcgctgcacccactaactcgtcatctagcattaggtatatctcccgatgctatcccgcccccctccccccaccccacaacagtccccagagtgtgatattccccttcctgtgtccatgtgatctcattgttcaattcccacctatgagtgagaatatgcggt

SEQ ID NO: 1916 - DNA, 601 bp, Human
aagacctggatgacagcttcttggataccctgggacctaaatttaagaagttggcagacatcagcctaggaaaagaatcatatccagaccttgatccttcttggccaccacaaagcactgaaccagtttgccttcctcaggaaacagagcccgttgttagtggacacccaccaatctccccacatttcggcactaccacagtaatttctgagagcacctatccctcgggacctggtgtactgcatcctaagcctattctcgatcctctgggctatggtaatgtcactgtgaccgagtcttwcaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccc

SEQ ID NO: 1917 - DNA, 601 bp, Human
tggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaacyaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctgttttgcttttccatatagctcgagcaaaattcaaaaagaactaaa

SEQ ID NO: 1918 - DNA, 601 bp, Human
tttctgtcccgttggtgaagtaacagtcagcctttgcctgaatcacaaaatcttctggaaaaccaaaaccaaaaccatgaaccagccccctcctctgggaaaacccatgcctggtaaattacgtcagaccacatggatctaagaggaggcctttgacctcagtatgctcaaaaagcacagtgtcaagtgagaaaagaaacagaatgggattcaacagagaatgacatttattaaattttaaaaacacataaagagcaataatgctacatatttctaaaagccactctcatacttagagacwtaccagacacgtttagaatggattctctagggaggggagagaatgagaacggaggcaagagaagagacgagagagtcttgcactactgccaataattacaatgtgctgtgaactcattgggtaaaattaaaccaatcctatgcacttaagaacaacaactacaataaaaaggaaattcaaatggagttaataatgtaggtaagtcaggaaggacgtcctgaagacattgcatctaagtcaagacttgaaagataattgctattaatgttgggttgtaatttactttcctttctaagttca

SEQ ID NO: 1919 - DNA, 601 bp, Human
cacagagcagtgcagcagattatgctggtgcaggagtggggtcctctctgggtacactgtcacctctggttgcactaggaagggaggaaaaatgagacaccgtgaaagaaaaccaccaagctgggacaggagattctttagggactatcactatgtctaatctctttcccagatcacccaagtgaacacaaagtataggcaagtctcagcccccaagatcagtaacagggtatgtcaatgcctgtcaggaggatttagactttctgaggtactcccacaattactgcttctctttgagggyacaatagccctcgaagtccctgagaaccttgggggtctgagaccaagatcacagtggctgacttgtgaggataatatatcacagctggggccagaacatctacacagacaaccatttatcctaaagcagaaaattgcttgtaagaaagaagagccatggccaggttcacatgggggacattcctgagccccgccagacctcagcttccagctcaccttttctccccacagtgaagggtgcgcccagcctgtagttgtgtctacagaccccatccacggcctgtctgctcctctccaagag

SEQ ID NO: 1920 - DNA, 601 bp, Human
atatcccctggatagaagcctgtcacagagcagtgcagcagattatgctggtgcaggagtggggtcctctctgggtacactgtcacctctggttgcactaggaagggaggaaaaatgagacaccgtgaaagaaaaccaccaagctgggacaggagattctttagggactatcactatgtctaatctctttcccagatcacccaagtgaacacaaagtataggcaagtctcagcccccaagatcagtaacagggtatgtcaatgcctgtcaggaggatttagactttctgaggtactcccayaattactgcttctctttgagggtacaatagccctcgaagtccctgagaaccttgggggtctgagaccaagatcacagtggctgacttgtgaggataatatatcacagctggggccagaacatctacacagacaaccatttatcctaaagcagaaaattgcttgtaagaaagaagagccatggccaggttcacatgggggacattcctgagccccgccagacctcagcttccagctcaccttttctccccacagtgaagggtgcgcccagcctgtagttgtgtctacagaccccatccacg

SEQ ID NO: 1921 - DNA, 601 bp, Human
taattctcactccactccacagaaacagggctcagcaggctggagtgatcgacaaggcaggtgtagacatgtccaagttcaggagtcatttctagcatcaccacagtctgaaaggtccagtctccattcctgatagggccagtggacatgaccccagctctctcctcctgcccattcaggaaccacttgatcttgatatcccctggatagaagcctgtcacagagcagtgcagcagattatgctggtgcaggagtggggtcctctctgggtacactgtcacctctggttgcactaggaagrgaggaaaaatgagacaccgtgaaagaaaaccaccaagctgggacaggagattctttagggactatcactatgtctaatctctttcccagatcacccaagtgaacacaaagtataggcaagtctcagcccccaagatcagtaacagggtatgtcaatgcctgtcaggaggatttagactttctgaggtactcccacaattactgcttctctttgagggtacaatagccctcgaagtccctgagaaccttgggggtctgagaccaagatcacagtggctgacttgtgaggataatatatcac

SEQ ID NO: 1922 - DNA, 601 bp, Human
aagaaatcgagaaaagaatggattgccccaattaggacccaatatgattatcccgagggaagaacaaatggctggcaaggtcagcactctctctgcttatcccatttctagcttcagaaaaaaattatcccggtgatccctgagaggcacaatcagctttccttgcctcagatcattgacgttagggaaggtgggagtggggaaggtctgggacaggtggcagggcactcctcacaggctcattacctttctgagcccttagctggatgacgattcccaccagaaggaagattagcccaartaggaaggctgcaatgccactcagcatctttctccaagaatattcagactgagctcctatgggaaacaggtctttaaattagtaaaaatatcccaatatttaaagcactttcttggaatcccagaatctgtactagacaccaaatccaatgctagctagagaaaaataaataaatttagaaaaggttcttcgaaaccaaagttggcacccatggagttaccacccatcggttacagattctcacagcccataagaatgcctcctaaatactaagaccaaagaattagaggacaccagttc

SEQ ID NO: 1923 - DNA, 601 bp, Human
ctccctacccccatgtcatctccctctggccaaagaaccgggagaatgatctgccactcaaagacaaggaaaaagagacattacctcattaccagacatctgcgtcctcacatatcctggaaagaaatcgagaaaagaatggattgccccaattaggacccaatatgattatcccgagggaagaacaaatggctggcaaggtcagcactctctctgcttatcccatttctagcttcagaaaaaaattatcccggtgatccctgagaggcacaatcagctttccttgcctcagatcattgaygttagggaaggtgggagtggggaaggtctgggacaggtggcagggcactcctcacaggctcattacctttctgagcccttagctggatgacgattcccaccagaaggaagattagcccaagtaggaaggctgcaatgccactcagcatctttctccaagaatattcagactgagctcctatgggaaacaggtctttaaattagtaaaaatatcccaatatttaaagcactttcttggaatcccagaatctgtactagacaccaaatccaatgctagctagagaaaaataaataaatttag

SEQ ID NO: 1924 - DNA, 601 bp, Human
tcgaggggaaggagaggctttgattggcctgacgtacagagacttctgctggagctggcaaagtcctgttccttgacttgattacaggggtttttcttaaataattcactaaaatgtacattttttgtatctccattttatttgacaataaaaggtttttaaaaacagtgaaaaggaaacagtgactacctgagcatttgtcttctgaagactgtggagactgcagttggaagacagaaagctttggagatcatgacttataggagtagggctggaccacagaaaagtaaatgatttgggrctggaaggagtaaggtctcaggggagtttctggacaatgcccttggcaatggggattaatgatgtacacgtagaagggagaagggcagatgggtgggagatgcatgatctcagaacacagagctccagaatcagttcgggctcctccaaggatcagggaagagagttattcccagaacattgacctcatgaatgtcctttacctcacccagggcccagactactcatcactacttcaggctccagagagagaagcttcagtgaggaccttagcatgactgagggagcagaacagctcttg

SEQ ID NO: 1925 - DNA, 601 bp, Human
accgcagggagcagcgctcgctctgcgtcctcccttcctcccatatcccaggtctcacctgctccgggccccgaaggtctcaggatgctgtggctgcacgcggacgccagccgccctaaggtgaccgtcagggaagatgctgccatggccgccgccatcttcccgcagcctcggccggaaacggaaacgacgcgaaccgcgtgcgtaacgcacgggcccggcggggaacaccggtccgctgtaacaccggcccggcgcagaagcgggacgtcggcttctaggggcccaggccggcggcggygatggcctcggcagctgtggagagcttcgtgaccaagcaactggacctgctggagctcgagagagacgcggaggtggaggagcgcaggtacgggaggccgccggcgccgctccctcgcggtcggtcccgccgtgtcccgggcagagtctccgaggggctcggcctcatagtctggggcgggaatttcgtctccgacccttcgagtcaggggcagggatcgtccgtcccctgcttggccacctcccgagttgtcagtctcatcacttcctgggcagcgcgttccgtttggggacccttaag

SEQ ID NO: 1926 - DNA, 601 bp, Human
gtggtctgcccgccttggcctcccaaagtgttgggattacaggcgtgagccaccgtgcccggccgcagtgtaggtttctgttactgtcattttccgtctaaggagatggagacagagaggggttaagtaacttgccccggggtgacacagtgtagcccgatttgctgtcaggcagtctgcttccagagtttgcagtcagccatatgtgggtaggatttgtctgagatgcttttgatcatggcaatggagagcttttgcagttatgttgagtttcttagaatcccagctgtttcatttatgsctgtgtgactttgcaggttctgtctctgagccttacttacttcatctgtaaaactgggatgattcccacctcacaggcttgctctgagaatgaaacgatcccctgtcagtcaggtgctcagcgtggtgccaaggacagagtcagcccccatggcagtggctctttctgaggatgctgagcagactggcagggcgagcctgggaagggcctggctaaggagctagtcttctgttctgtgtatgaaggatgggccatcagcggggttaagcaggtgagggaggcgaatagctttgcatttta

SEQ ID NO: 1927 - DNA, 601 bp, Human
tcttaatcagaagtccaacaattgatgtgggttttagttgtctagatcagcgttgtccaaaatggtagccattagccatgcgtggtcatcaaatgtttgaagtgtggcttgtaattgccgcagatacagaatacacaccaaatttggaagattatgttaaaaaaacaattgggaatatcttgagtaatttttctgaatactgattacatgttgaaataatatttttcatatattgggttaaataaaaaatatcttattaaaataatttacccatttcttttctttttttttttttttttttgagacagagtttcgctcttattgcccagtctggagtgcagtggcatgatctcggctcactgcaacctccgcctccggggttcaagtgattctcctgcctcagcctcccgagtagctgggattagaggcatgcgccaccgtgcctggctaattttgtatttttagtagagacggggtttctccatgttgttcaggctggtctcgaactcccaacttcaggtgatccgcctgctttggcctcccaaagtgctgggattacaggtgtgagccagtgcacccagcctcttttaaatttcttaat

SEQ ID NO: 1928 - DNA, 601 bp, Human
acagaatacacaccaaatttggaagattatgttaaaaaaacaattgggaatatcttgagtaatttttctgaatactgattacatgttgaaataatatttttcatatattgggttaaataaaaaatatcttattaaaataatttacccatttcttttctttttttttttttttttttgagacagagtttcgctcttattgcccagtctggagtgcagtggcatgatctcggctcactgcaacctccgcctccggggttcaagtgattctcctgcctcagcctcccgagtagctgggattagrggcatgcgccaccgtgcctggctaattttgtatttttagtagagacggggtttctccatgttgttcaggctggtctcgaactcccaacttcaggtgatccgcctgctttggcctcccaaagtgctgggattacaggtgtgagccagtgcacccagcctcttttaaatttcttaatatggctactagaaaacttaaaactacacgtgactgggtgcctgtaatcctagcactttgggaggccgaggtgggtggatcacttgatctcaggagttcgagaccagcctgggcaacgtggcaaaa

SEQ ID NO: 1929 - DNA, 601 bp, Human
atgcttgtgttagacaaccacagccttggaagcctggaggaagcagcgttgccagggctgtactttttactatggaagtgtctctgccttgttttggtggtgacggagttttaaatttcatattttgatttcgtagactttagcccaacaattactggaatactggctggatttggagaagatgagatgagggtattgagagaggagagggccaggaggggaacctgtaggttggagtcagacctgagcagagtttgagattttttttttctgagatggagtctcactctgtcgctcaggycggagtgcagtggtgcaatcttggctcactgcagcctcagcctcccgagtagctgggaccacaggtgcccgccaccacgcctggctaattttttgtatttttagtagagacgggctttcactgtgttagccaggatggtctcaatctcctgacctcgtgatctgcccacctctgcctcccaaagtactgggattacaggcgtgagccaccgtgcccggcctaacttactttcttttttttttttttaactgttactgattgcatttactaaagaaagtaacaaagataaaatatttgaag

SEQ ID NO: 1930 - DNA, 601 bp, Human
tacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaagtaagtggatgggactggaaatcctaagtaccatcttccttcaacacagctaatccattcttacatgcctgtcgcacaaaagagagcaacaagtcatggtgtgggtgtggccctcatgggagttkgtggcagcattggggcagaggctcgggcactgaattgcaggtgttctaattttagttttctcccttggcagagccctgattgctctaaagaagtatcattctggcccagcctcctcactcatagaagtgctctttggcagatctgctcccagtcctgccagtgaaatacgtaagaacttctgagttttcttttttggttgaaatcactactgaaagtatagagaacagtgtgaccttgggccgttttaataagagtttgagaaagtatgactagaagaagtctccctgaacatctttgta

SEQ ID NO: 1931 - DNA, 601 bp, Human
tgacctcaggtgatctacctgcctcggcctcccaaagtgctgggattacaggcgtgagccaccgtgcccggtctgtgcactttttatgtcctttgctgttcttggagaacgtcatttttgggaggagtttgttgtctcatccagtcactgcccatgatttaacagtcctgtgagtattggacttggcccatttgtaaagcggtggctttggccaagcctcatgcaagggttaccccacagctattttctatcatactgtgctaggcaagccagtgttgtgttagcttcaaacacacaggaygactttgtagcactctttcagcatgcagtccctcaagatgtgttgtttttaaatactcattttctttctgcattttcctttggaaattctaaatgcagtcacatttcagtaatgctttatttctatgaaatatttactgaagggctcctatgcgtcacaaactgaattagaaatgtatttactgtgtcttagggactctggaatggcttggctagagcacgggaacgtggggttcaatggcctgttactagctgcacaccctgccgtcttccatgttggcttcagtctcacaagtcaggg

SEQ ID NO: 1932 - DNA, 601 bp, Human
aagcaagactccatctcaaaaaaaaaaaaaaaaagaagcagatctttagtcttggtcgtggaagattcaaaatagaaacacgatcctagaatttgttaatcattgtttttgtcatttgtctttatcattttatgggcactttaaagagggacattatgttagaaaggaatatgctctaggaaacatttccttcattcctgttactctagagcaggggtttttcctgtaaagggatggattgtgaatgttttgactctgtgggccatatcatacgtaccgtctacagctgcctgctgtagayggtatgtaaatcaatgggtgtggctgtgctccagtaaaactcaccaaaaccggcagctgactggatgtggcccacagtttgccgattcctgttcaaggagaaaccttgtgaaaataaagcagacttaattttgtgttgattgggttgcccctggggaggtccggcgtgttcctgacaggcatcactcatcccccggggcacacactctctgaggaggaacacccacagagctccccagagcacctgagcctcacgctgctgcttcttccacagacccgctgacattcttcaacacctgcc

SEQ ID NO: 1933 - DNA, 601 bp, Human
cctagaatttgttaatcattgtttttgtcatttgtctttatcattttatgggcactttaaagagggacattatgttagaaaggaatatgctctaggaaacatttccttcattcctgttactctagagcaggggtttttcctgtaaagggatggattgtgaatgttttgactctgtgggccatatcatacgtaccgtctacagctgcctgctgtagacggtatgtaaatcaatgggtgtggctgtgctccagtaaaactcaccaaaaccggcagctgactggatgtggcccacagtttgcckattcctgttcaaggagaaaccttgtgaaaataaagcagacttaattttgtgttgattgggttgcccctggggaggtccggcgtgttcctgacaggcatcactcatcccccggggcacacactctctgaggaggaacacccacagagctccccagagcacctgagcctcacgctgctgcttcttccacagacccgctgacattcttcaacacctgcctggacacctcccagaaagaagcggtttcatttgcgctgtctcagaaagaacttgccatcatccatggacctcctggcactggga

SEQ ID NO: 1934 - DNA, 601 bp, Human
tccctgactaaaactaggggtttatataacagggaagaaatgtagcaatgtgtaaaaaacaggaactagggagggcaaggaggcacctgtagtggtctggtgattttcagatctttgatatttttttgagaggcctcaatgtccttttctgaggaagaaactcacataaataagtttgaagctttaacagcagatggtcaatttctctttatccaaaaacaactgtccatgggactattgagccggtttctccatgatcctgccactgcgctccagcctgggccatagagcaatttgtttaaaaaaaaaaaaagaaagaaagaaaaatatagtggagctacagtgttcgggagacaactgtgagtccatttgaaacgggaagggttcccttgtccccctcgcagggcgtgggatgggggagtggctcgcttcttcagtgtcctgctgctcagacctgcaggggagcatacagatgggcaggctgtgggctctgacctcatggcagtgtctaggggtgaatgtttacagctctgtgagttacagggtgctctcttagtttgccgtctataggtggcttatgttaaccaactcaattagatcc

SEQ ID NO: 1935 - DNA, 601 bp, Human
aaaactaggggtttatataacagggaagaaatgtagcaatgtgtaaaaaacaggaactagggagggcaaggaggcacctgtagtggtctggtgattttcagatctttgatatttttttgagaggcctcaatgtccttttctgaggaagaaactcacataaataagtttgaagctttaacagcagatggtcaatttctctttatccaaaaacaactgtccatgggactattgagccggtttctccatgatcctgccactgcgctccagcctgggccatagagcaatttgtttcaaaaaaaagaaagaaagaaagaaaaatatagtggagctacagtgttcgggagacaactgtgagtccatttgaaacgggaagggttcccttgtccccctcgcagggcgtgggatgggggagtggctcgcttcttcagtgtcctgctgctcagacctgcaggggagcatacagatgggcaggctgtgggctctgacctcatggcagtgtctaggggtgaatgtttacagctctgtgagttacagggtgctctcttagtttgccgtctataggtggcttatgttaaccaactcaattagatccccttccttg

SEQ ID NO: 1936 - DNA, 601 bp, Human
actattgagccggtttctccatgatcctgccactgcgctccagcctgggccatagagcaatttgtttcaaaaaaaaaaaagaaagaaagaaaaatatagtggagctacagtgttcgggagacaactgtgagtccatttgaaacgggaagggttcccttgtccccctcgcagggcgtgggatgggggagtggctcgcttcttcagtgtcctgctgctcagacctgcaggggagcatacagatgggcaggctgtgggctctgacctcatggcagtgtctaggggtgaatgtttacagctctgkgagttacagggtgctctcttagtttgccgtctataggtggcttatgttaaccaactcaattagatccccttccttgtcacaaggacagagggctttctgtatcctgggttcttgccttggggtaccggaagaatcggatcacacgtgggcttggaaaatgaatgcaagatttgattgagagcacgtgtgtacatgccttgtgcttctttctacctttaaggctttttgttgttttagtgtcaacttcagtggtttgattacaaagtaaatgaccagatcctaacttgcggttcccaggtt

SEQ ID NO: 1937 - DNA, 601 bp, Human
ggtttctccatgatcctgccactgcgctccagcctgggccatagagcaatttgtttcaaaaaaaaaaaagaaagaaagaaaaatatagtggagctacagtgttcgggagacaactgtgagtccatttgaaacgggaagggttcccttgtccccctcgcagggcgtgggatgggggagtggctcgcttcttcagtgtcctgctgctcagacctgcaggggagcatacagatgggcaggctgtgggctctgacctcatggcagtgtctaggggtgaatgtttacagctctgtgagttacaggrtgctctcttagtttgccgtctataggtggcttatgttaaccaactcaattagatccccttccttgtcacaaggacagagggctttctgtatcctgggttcttgccttggggtaccggaagaatcggatcacacgtgggcttggaaaatgaatgcaagatttgattgagagcacgtgtgtacatgccttgtgcttctttctacctttaaggctttttgttgttttagtgtcaacttcagtggtttgattacaaagtaaatgaccagatcctaacttgcggttcccaggttctgtgctgcgc

SEQ ID NO: 1938 - DNA, 601 bp, Human
aattgggctgcccttttttttttttttttttttttttttcagagttttgctctcattgctcaggctggagtgcagtggtgcaatctcggctcactgcaacctctgcctcctgggttcaagcgattctcctgcctcagcctccctagtagctgggactgcaggtgcgtgtcaccacgcctggctaatttttctatttttagttgagacagggtttcatcatactggtcaggctggtcttgaattcctgacctcaggtgctctgcccgcctcggcctctcaaagtgctgggattacaggcgtragccaccatgcctggcctttgtttttgtttttttttttgagatggagtctcgctctgtcacccaggccggagtgtagtgctgctgtcttggctcactgcaggctccgcctcccggggtcaagtgattcttgtgcctcaccctcccaagtagctaggactacaggcatgtgccaccacacccaaccaatttttttatttttagtagagacgggggtttcgccatgtgggccaggctggtctcgaactcctaacctcaagtgatccacccgcctcagcctcccaaagtgctggattacaggt

SEQ ID NO: 1939 - DNA, 601 bp, Human
gaactatacttagcatttaacagagtctcaactgtcttcagagcacttggttagtaggtgtgaggaattgtaaagaaaacattttccggccggatacagtggctcacacgtgcaatcccagcactttgggaggccgaggtgggcggaacagttgaggtcaggagttcgagaccagcctggcccacatggtgaaaccccgtctctactaaaaatacaaaaattagctgagcatggtggcgggcacctgtaatcccagccacttgggaggctgaggcaggagaatctcttgaacctgggaggtggaggttgcagtgagccatggtcactccactgcactccagcctcggtgacaaagcaagactccgtctcaaaaaaaaaaccaaacattttcctgggtgtctttctgtctggtcctgttgtcttgctagtagtggcaatgggagaaaagtagcctgaacataaacattgaaaaaattggcatcctcctagagctttccgtccattccaccttctccttgtgaaagaggacaccagtcggctggagaagtagggtggtggtaggtttcttccatttgagagggccttttccccccagcccgac

SEQ ID NO: 1940 - DNA, 601 bp, Human
agaacagttttatttagtgttagaacagctcagagtagtgggtagctcctctctgtaggcaggtcatccgtcgagtgttcagctgtcagcagaggaggccctggagagggtggctcctctctgcaggcaagtcacttggacatctctgcaggtctctgaagctctcagcagagagcatagatcctctctgccctctccgtcctctggctgtcctctcgccttctctgactgagcccagggcttttatggacctcaagagggaaggaaggatgtgccaattggtccatgggtggccatgggygggcctggaataggtaccatgagtcctcactctggtccacaggactggcagcccagctgccagccttcaggcccttcctggccttccactgtccccttccactcaggactctgtctgcctcccgctgccattcatggccctggggcttggctccaatcccactctgagatccgagtgggtgctgggcgctgagagaggccaggcagtggaagcagacacccatgaccctgcagggatggtgtgggggttgtccttcctggggcgcctgagggtgcaggctgcagagtgggagggcagcta

SEQ ID NO: 1941 - DNA, 601 bp, Human
ctgccctctccgtcctctggctgtcctctcgccttctctgactgagcccagggcttttatggacctcaagagggaaggaaggatgtgccaattggtccatgggtggccatgggcgggcctggaataggtaccatgagtcctcactctggtccacaggactggcagcccagctgccagccttcaggcccttcctggccttccactgtccccttccactcaggactctgtctgcctcccgctgccattcatggccctggggcttggctccaatcccactctgagatccgagtgggtgctgggmgctgagagaggccaggcagtggaagcagacacccatgaccctgcagggatggtgtgggggttgtccttcctggggcgcctgagggtgcaggctgcagagtgggagggcagctacagctgcacccaagagctcccgacccaccacctcagaagaggccaggctcctgcttgttcccggctcctgcctgcttcgtggagcaggaagcccaggtctgcagccacagatctggcggctgcagctgcacgcggaaaggcagatcctacctgttcccggctcccctaagagcaccgggagacgcag

SEQ ID NO: 1942 - DNA, 601 bp, Human
tgggtggccatgggcgggcctggaataggtaccatgagtcctcactctggtccacaggactggcagcccagctgccagccttcaggcccttcctggccttccactgtccccttccactcaggactctgtctgcctcccgctgccattcatggccctggggcttggctccaatcccactctgagatccgagtgggtgctgggcgctgagagaggccaggcagtggaagcagacacccatgaccctgcagggatggtgtgggggttgtccttcctggggcgcctgagggtgcaggctgcagaktgggagggcagctacagctgcacccaagagctcccgacccaccacctcagaagaggccaggctcctgcttgttcccggctcctgcctgcttcgtggagcaggaagcccaggtctgcagccacagatctggcggctgcagctgcacgcggaaaggcagatcctacctgttcccggctcccctaagagcaccgggagacgcagatccacagctgcagtttgggcggctgtagccccgcccttctggagcaggaggcctgggtctgtagctgtgaccctgtgtctgggctgcagcggccactc

SEQ ID NO: 1943 - DNA, 601 bp, Human
ccatgaccctgcagggatggtgtgggggttgtccttcctggggcgcctgagggtgcaggctgcagagtgggagggcagctacagctgcacccaagagctcccgacccaccacctcagaagaggccaggctcctgcttgttcccggctcctgcctgcttcgtggagcaggaagcccaggtctgcagccacagatctggcggctgcagctgcacgcggaaaggcagatcctacctgttcccggctcccctaagagcaccgggagacgcagatccacagctgcagtttgggcggctgtagcccygcccttctggagcaggaggcctgggtctgtagctgtgaccctgtgtctgggctgcagcggccactctacctcagaaggggcggggctcccactggcttcatggagtgtgcagccacagccagggttccctgctgcagccggcatgatggcagcagccactgccatcagaacctccctgggagcagggaggacaggcgtgggaggacgcttattcagtggcttcttccagggagaggttctcgagatgtccttaaaggaggtcttcatcctctggaaagcctttgggtggaggaagtttgg

SEQ ID NO: 1944 - DNA, 601 bp, Human
agagtaggatggtttcggggaaaacattgggtggcattccctggagacagtaggatggtttcggggaaaacattgggtggcgttccctggagagagtaggatggtttcgggggaagacgttgggtggcattccctggagagagtagaatggtttcgggggaagacgttgggtggcgttccctgcagagagtaggatggtttttgggggaggacgttgggtgacgttgcgctgagtgttttgggtttgcagttggtactgatcatcgcgtcctgtcctcattttgttggaattaaaaatacrttaatcacagaggtctggtaagtttccagagggaaggtctctgaagtggagctgggtactgccccagggttttggtggggttggtgagccgtagtggtgcagagggtgggctctggcaccaggtggcccgggcaggtcctggctctgcagctcacccgggcagctgtgggctggcagcctcctctgtctcacccttcttacatgtaatatgggagtcataacagtagccacctcatgaggttgttataaggatgaagggagttaatccacatctggcacacccagcagtgcctggcgcct

SEQ ID NO: 1945 - DNA, 601 bp, Human
tgctcacagttggagcatgttggagtgtgttcgttccctgttatggctgtgacaaatgaccacaagcttagtggctgacaacaacagattttctgacctccagaaacgacaatctgggggtcagatgtccaaaatcagactcaccggcttaaaatcaaggtgtgggtggggttgcttcttctggaggatccaggggaaaacccatctcctggtcttttccggctcctagaggccattgcttgacttgttgccctttcctctgtctatgaagccagccgtgttacgtcttcaaatctctccyctcggtgaccttctctgactgaccctcgcatgcccccttataagacccttgggttatcacctgggtcatccagggtcgcctccccatcccaggatccttaacttcatctcagctgcagcgtccctgttgtcctgtaagggaacattcacgggccttggcgattggatgtaggtgcctttggggctgtgattcagccaaacccgccccttggttacttctgggtcagaatccaggggagagttgggtcctgaggtttggggcctgtcctcctcacttgctgtggttcacacctggactctg

SEQ ID NO: 1946 - DNA, 601 bp, Human
ttattgattgaggggcatattgggtgtctgctgggtgccacactggtttctggcagtgtgctcatggtgcagcttctgtccttagtaagttcacgtcaggcaaagcacaggcaagagagtctgcagaggctcagaggcgtgagtgtgctgtcagggagcaggtggctggggtggcagctgggggcgcagggtgggctgggaatgatcaggacatcctgccgaggaggtgaagccccctgcagcccagagctggcctttagcctccatgcacggagccgcggggtgtggtggtcgtggctgyggtttctgtgctgctgtggtgtgtgggctttcccatttgggatgagcattgttcccagaagcaggtttagtgaacgggctttgtgagacattctcagaaggcagaaagcaggtgaggcctggctagaagctatgggggaaagaagggaaggtcctggaaggtttcttgtgctttctccctggtgccagctgcagccacaccccaggcggcccctgaggctgggcttagaaggaaaggagcgacagaacccagtcgggttccccagagccccactcagtcagccgtggcagccagatgcca

SEQ ID NO: 1947 - DNA, 601 bp, Human
catattgggtgtctgctgggtgccacactggtttctggcagtgtgctcatggtgcagcttctgtccttagtaagttcacgtcaggcaaagcacaggcaagagagtctgcagaggctcagaggcgtgagtgtgctgtcagggagcaggtggctggggtggcagctgggggcgcagggtgggctgggaatgatcaggacatcctgccgaggaggtgaagccccctgcagcccagagctggcctttagcctccatgcacggagccgcggggtgtggtggtcgtggctgtggtttctgtgctgcygtggtgtgtgggctttcccatttgggatgagcattgttcccagaagcaggtttagtgaacgggctttgtgagacattctcagaaggcagaaagcaggtgaggcctggctagaagctatgggggaaagaagggaaggtcctggaaggtttcttgtgctttctccctggtgccagctgcagccacaccccaggcggcccctgaggctgggcttagaaggaaaggagcgacagaacccagtcgggttccccagagccccactcagtcagccgtggcagccagatgccagggcaggtgtggcat

SEQ ID NO: 1948 - DNA, 601 bp, Human
tctgctgggtgccacactggtttctggcagtgtgctcatggtgcagcttctgtccttagtaagttcacgtcaggcaaagcacaggcaagagagtctgcagaggctcagaggcgtgagtgtgctgtcagggagcaggtggctggggtggcagctgggggcgcagggtgggctgggaatgatcaggacatcctgccgaggaggtgaagccccctgcagcccagagctggcctttagcctccatgcacggagccgcggggtgtggtggtcgtggctgtggtttctgtgctgctgtggtgtgtgrgctttcccatttgggatgagcattgttcccagaagcaggtttagtgaacgggctttgtgagacattctcagaaggcagaaagcaggtgaggcctggctagaagctatgggggaaagaagggaaggtcctggaaggtttcttgtgctttctccctggtgccagctgcagccacaccccaggcggcccctgaggctgggcttagaaggaaaggagcgacagaacccagtcgggttccccagagccccactcagtcagccgtggcagccagatgccagggcaggtgtggcatcacggtgccac

SEQ ID NO: 1949 - DNA, 601 bp, Human
gaccggaggatcaacgtggctgtcacccgtgcccgacgccacgtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctacgtccaccaggaccggaagccagcggcaggagggaggccaggaggctgcagcacctgccagacagggcyggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttccggggaagggaagaggaggttcatcactgtgagcaagagggccccgcgaccccgagcagccctgg

SEQ ID NO: 1950 - DNA, 601 bp, Human
caccaggaccggaagccagcggcaggagggaggccaggaggctgcagcacctgccagacagggccggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttcyggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcgcaggggcagcccgccagcaaggagcagcaggcctcagggcagcagaaacttccagaaaagaaaaagaaaaaagccaaaggtaag

SEQ ID NO: 1951 - DNA, 601 bp, Human
ccttcttttcccagaccctgtgtgggactcggcaagtaggcagcactcagagcatgtctgcagcagcaggaggggcctggaagagcaaacatggatggctccctggagcccctcgggaatggagcgatcacggggtcccatgcaacatgtggccctggagggtggaggtcttgcacagcgaaagggtgcactctgcctggaagttgtcctgggcaaaatgctcagaaccacaggggctggctgagcgcaaaaccattcttgcccttgggccatgtggagtccctgggtgggctctgccccrtttgccacatcctgcattgtgcccaccccgcaggagctggctaggcgtgcagtgggagttggccaggcatacgctggcagagcgtgtagcggtcttggggaactcctgctactgccattttcctcagcaagagcatgcaggagttccagcttgcattgattcattgaattcctgaagcgaagctacaccagcacatgggtggctttgaaaggggcctcccagagcctggggctccagaggaattcactccccaaacctttgttgagcagctactgtatgccacgctttgtgctagaggac

SEQ ID NO: 1952 - DNA, 601 bp, Human
ccagcttgcattgattcattgaattcctgaagcgaagctacaccagcacatgggtggctttgaaaggggcctcccagagcctggggctccagaggaattcactccccaaacctttgttgagcagctactgtatgccacgctttgtgctagaggacaggactgatgccacccctgcccccaggcactgacagggtagcagagggaagacacatgagctgctttttaattttttttagaattaatagagacggggtctcactctgtcactatgttgcccaggctagttttgaactcctggcckcaagcagtcctcctacctcagcctcccaaaatgctgggattacaggtgtgagccaccgtgcttagccatgaattgattttaaaaccttaaatgaggggccaggtgttgtctttccgtttgcctgagtgacgcgggtcttctccaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctc

SEQ ID NO: 1953 - DNA, 601 bp, Human
ttcctgaagcgaagctacaccagcacatgggtggctttgaaaggggcctcccagagcctggggctccagaggaattcactccccaaacctttgttgagcagctactgtatgccacgctttgtgctagaggacaggactgatgccacccctgcccccaggcactgacagggtagcagagggaagacacatgagctgctttttaattttttttagaattaatagagacggggtctcactctgtcactatgttgcccaggctagttttgaactcctggccgcaagcagtcctcctacctcagcytcccaaaatgctgggattacaggtgtgagccaccgtgcttagccatgaattgattttaaaaccttaaatgaggggccaggtgttgtctttccgtttgcctgagtgacgcgggtcttctccaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgaggtatg

SEQ ID NO: 1954 - DNA, 601 bp, Human
cgggtcttctccaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgaggtatgtcggcctcccctcctgcgatcaaacagtggggaggggtggtgggttccgtctccaggaagcagaccctgggcagacttgttccagtcggaacagttagctccttacaakctccagataccttcagaaacagaaatcagacactgactcatgatcggttttcagcacatcagggcacaagcaaacaaaatgccttatttgctgagctgcagccacgttagtgggaattctgggcagagggaattttgtcccagtgtccttgggttctgtcagtggcctaatctggtctgtttggcataggggaggtgggaggcagagcctccagcccgtcatctgagctggccatggcccggctgctgtgtcattcattccttgagccggggttgatgagaaccccctgggccaggtgtg

SEQ ID NO: 1955 - DNA, 601 bp, Human
ctgtcagtggcctaatctggtctgtttggcataggggaggtgggaggcagagcctccagcccgtcatctgagctggccatggcccggctgctgtgtcattcattccttgagccggggttgatgagaaccccctgggccaggtgtgggcgcctgtggaaagccgaggtctgaaccagccttgtctctaccctggaggatgctgggcctggtgggggacctgggtaagagaccagcatacagtaccaggtgttgagtgctctgaggaagaaaacccagggccagggtggcagcagggtcaccyacccagatgcagcagtcagggtgggcttcctggaggaagtaacactggagctgagacctgtgggacagaaggtgggagctgggctgggaaggacagggccgatggcgggtgggcaggcaggctatccacccttagaacatgcataaagccccaggcccagtcagagagttgggagtagagtgtgaggcagatggctagagttgaggctgggcatgtcctggcgagctgcctggaggagtcaggcctgatctgaaggcagtggggtaccctctagggtgtcagcagggctgtgatgtcacc

SEQ ID NO: 1956 - DNA, 601 bp, Human
acccacccagatgcagcagtcagggtgggcttcctggaggaagtaacactggagctgagacctgtgggacagaaggtgggagctgggctgggaaggacagggccgatggcgggtgggcaggcaggctatccacccttagaacatgcataaagccccaggcccagtcagagagttgggagtagagtgtgaggcagatggctagagttgaggctgggcatgtcctggcgagctgcctggaggagtcaggcctgatctgaaggcagtggggtaccctctagggtgtcagcagggctgtgatgtyaccagtcttggctgcagtgtggattaggtaggcggaggctgggaggcagtgggaagtggccgcagggactgtgtggtcagtcagggtggtgccatttcctgtgtgcacactcgggggctcccgccacaccagggtgcagaccaccccgccgctctcccgccaggcagcctgcagggtgaaggactgacatggcgggaggagtggccttctctgttggggcgcctgtggccccccagctctttgatgggcagagctgcaggatctgcctccttgcccctgtgagcccagcagtgattcttg

SEQ ID NO: 1957 - DNA, 601 bp, Human
gagcccagcagtgattcttgtgtcctccccagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccccgcggagctctctccatggtagcccagggcgctggcagaccatgctccrcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttcccctcactccccgccaaaacccacatcccagcctctggatcctggggaaggttccagtccctggagaatacccagggcctcaaacttgaagtcactcctccaatgtctgggacttgccagc

SEQ ID NO: 1958 - DNA, 601 bp, Human
gctcagcaaccagaggaccagccggaggaaggagagggggacgtgaccggccgcatccttgcacgccccgcggagctctctccatggtagcccagggcgctggcagaccatgctccgcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttcccctyactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtg

SEQ ID NO: 1959 - DNA, 601 bp, Human
taggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagccggctctcccacgtggytgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacgttgcacactgccccagtgtgtctgctgcgggtctaaggggcgcgccctttgcctgttctgctcagctgctgtgccctccccgccgcgtctctcaagccccctctccttctgacctctctgc

SEQ ID NO: 1960 - DNA, 601 bp, Human
atttgagagatcagggtggtagggagacgctccaccatatactctgcagccttgcaatgttgaccatgtgaatctttagtacttatgcaaaaaataaatttaaattaaaaaatacttaatgtcagctaggtgcagtggctcacgcctgtaatcccagcactcagggaggccgaggtgggtggatcatctgaggtcaggagttccagaccagcctggcctacatggtgaaaccccgtccatactaaaaatacaaaaagtagctgggcgtggtggtgggcacctgtaatcccagctacttggkaggctgaggcaggagaatcacttgaacccgggaggcggaggttgcagtgaacggagatggcgccactgcactccaggctgggcgacagagtgaaactccgtctcaaaaaataaataaaataaataaatacttaaggttcaaactattgggtactatgctcaccaactgggtgacagttcaatcgtactccaaacctcagcatcacacaatatactcatgtaacctgtacatgaactccctgaacctaaaataaaagctaaaattattaaagacaaaatacttaatgtgtaatttttttct

SEQ ID NO: 1961 - DNA, 601 bp, Human
attttatcctacagatatgaataaaacaacacatgtacaaagttattcactgcattgtttttaacagtaaaaggctgaaacaacctgattatgatgggacactagttaaatgatggtataccaaaaccatgtaaatgtaaatacttgtagccatttaaaaaaaatgaggaagctctatatgtacagaaacataaagttatctaaaatacattgttacattgttaaggtacagaacaacgcatttgctattatttgtgggcaaaacaatatacaagaaaacaaaacacacattcgttttttwatatatgcacagtatctctaggaggataaaagttcaaatactggctgtgacagggtatttgagagatcagggtggtagggagacgctccaccatatactctgcagccttgcaatgttgaccatgtgaatctttagtacttatgcaaaaaataaatttaaattaaaaaatacttaatgtcagctaggtgcagtggctcacgcctgtaatcccagcactcagggaggccgaggtgggtggatcatctgaggtcaggagttccagaccagcctggcctacatggtgaaaccccgtccatacta

SEQ ID NO: 1962 - DNA, 601 bp, Human
aataaaaatacaaaaattagccaggcgtggtggcggccgcctgtaatcccagctactcaggaggctgaggcagagaactgcttgaacctgggaggcggaggctgcagtgagccgaggtcacaccactgcactccagcctaggtgacagagcgagactccgtctcaaaacaaagttcagaaaaaaggcagccatcagggtttttgctgataagaaacgcagaaatgttagactcatgggtttcctatcaagttgtaactaaaaaatggtgaattttattgtttataaattagaccttaaaaacaaacaaaatctgcccagataaggtataaccaaaagaaacgagtgcttaatacctccaaagacatctacaagaatgtttacagaagttttattcaaaatagatgaaaaataaaatcaaccaaatatctattaacactaggataaattatggtatattcaagtaattgaatcacagcaatgaaaaataacaacagatacatgcatcatggatgaatctcatatataatacagaatgaaagaaatcagacaggttgggtgcagtggcccacacctgtcatatcagcactttgggaggctgag

SEQ ID NO: 1963 - DNA, 601 bp, Human
ggtgaaaccctgtccctaataaaaatacaaaaattagccaggcgtggtggcggccgcctgtaatcccagctactcaggaggctgaggcagagaactgcttgaacctgggaggcggaggctgcagtgagccgaggtcacaccactgcactccagcctaggtgacagagcgagactccgtctcaaaacaaagttcagaaaaaaggcagccatcagggtttttgctgataagaaacgcagaaatgttagactcatgggtttcctatcaagttgtaactaaaaaatggtgaattttattgtttayaaattagaccttaaaaacaaacaaaatctgcccagataaggtataaccaaaagaaacgagtgcttaatacctccaaagacatctacaagaatgtttacagaagttttattcaaaatagatgaaaaataaaatcaaccaaatatctattaacactaggataaattatggtatattcaagtaattgaatcacagcaatgaaaaataacaacagatacatgcatcatggatgaatctcatatataatacagaatgaaagaaatcagacaggttgggtgcagtggcccacacctgtcatatcag

SEQ ID NO: 1964 - DNA, 601 bp, Human
ccagcactttgggaggctgaggcgagtgaatcatgaggtcaggagttcaagaccagcctgaccaacatggtgaaaccctgtccctaataaaaatacaaaaattagccaggcgtggtggcggccgcctgtaatcccagctactcaggaggctgaggcagagaactgcttgaacctgggaggcggaggctgcagtgagccgaggtcacaccactgcactccagcctaggtgacagagcgagactccgtctcaaaacaaagttcagaaaaaaggcagccatcagggtttttgctgataagaaaygcagaaatgttagactcatgggtttcctatcaagttgtaactaaaaaatggtgaattttattgtttataaattagaccttaaaaacaaacaaaatctgcccagataaggtataaccaaaagaaacgagtgcttaatacctccaaagacatctacaagaatgtttacagaagttttattcaaaatagatgaaaaataaaatcaaccaaatatctattaacactaggataaattatggtatattcaagtaattgaatcacagcaatgaaaaataacaacagatacatgcatcatggatgaat

SEQ ID NO: 1965 - DNA, 601 bp, Human
tactcgggaggctgaggcaggagaactgtttgaacccgtgaaacagaggttgcagtaagcccagatcatgccactggactccagcatgggcaacagagcgagaccccgacacacacagacacacacacacacacacacgccaggtgtggtggtgtatgcctgcagtcccagctactcatgaggcttgaggcaggagagctgtttgaacccggaaggcaggggctgcagtgagctgagatggcaccactgcactccagcctgggcaacaaagcgaaattctatttaaaaaaaaaaaaagacyacatttgtcaaaattcactgaattctgtgtcaactgtttcaaaggcactgagattttaccttactttcaagctaacaagtcagcctaccacagtgtcatggatactggcaaaaggcatgacatttttgcgtcagaagcaaaggactgtattactcataacagtagtcagagtatcagcattttcttgcgccagctgcttgagtcccaactgtcacagggcattgtgaagtcagatgacacctgaacaggctgcttcacaggaaagaaagacagatcttaagtaaccctaaacttgaaaaa

SEQ ID NO: 1966 - DNA, 601 bp, Human
gcaaaactaaggtgacagaaagcagatccagggttgcctagggctgaggtagagaaggcacacgtaaaagggcataaaggaaatctggggtgataaaaatactctatgacttgattgtggtggtgactataagactctatacatttggcaggacgcgatggctcacgcctgtaatcccagcactttgggaggccgaggtgggcagatcacttgaggtcaggagttcgagacgagcctggccaacatggtgaaaccccatctctattaaaaatacaaaaagtagcttggcgtggtggcgggygtctgtgatgccagctactcgggaggctgaggcaggagaactgtttgaacccgtgaaacagaggttgcagtaagcccagatcatgccactggactccagcatgggcaacagagcgagaccccgacacacacagacacacacacacacacacacgccaggtgtggtggtgtatgcctgcagtcccagctactcatgaggcttgaggcaggagagctgtttgaacccggaaggcaggggctgcagtgagctgagatggcaccactgcactccagcctgggcaacaaagcgaaattctattta

SEQ ID NO: 1967 - DNA, 601 bp, Human
gcccaggctgtctcaaactcctgggctcgagcaatcctcctgcctcagcctcccaaagcactgggattacaggcatgtgcctcagaaattcttgatacggcaaaactaaggtgacagaaagcagatccagggttgcctagggctgaggtagagaaggcacacgtaaaagggcataaaggaaatctggggtgataaaaatactctatgacttgattgtggtggtgactataagactctatacatttggcaggacgcgatggctcacgcctgtaatcccagcactttgggaggccgaggtggrcagatcacttgaggtcaggagttcgagacgagcctggccaacatggtgaaaccccatctctattaaaaatacaaaaagtagcttggcgtggtggcgggtgtctgtgatgccagctactcgggaggctgaggcaggagaactgtttgaacccgtgaaacagaggttgcagtaagcccagatcatgccactggactccagcatgggcaacagagcgagaccccgacacacacagacacacacacacacacacacgccaggtgtggtggtgtatgcctgcagtcccagctactcatgaggctt

SEQ ID NO: 1968 - DNA, 601 bp, Human
caggtatttctttatagcagtgtgagaatggactaatacttggctaattaaaaaaaaaaattgtagagatggggccttgctttgttgcccagactgaattcctggactcaagttattttcctgcctatgcctcccaaggttctgggattacaggtgtgagccaccatgtccagccagtattctattttaaatgtaatacaggcaactaagagaagaatcagtagggtaatcagcatgcacagggttaaaaaccagatcctatagaatgattagatatctgggtaactgtaatttggggacraggacttacagacacaggaaagcagcccttcaatacctgaagagcatgtagtatgaatgacgtaaaatttaacaagatttaacaaattttctcctattcatttactgaagaaaaaaaaaaaaacccacacacttctttccttccccattttaaagttattgttagtattgatatacagcatttaagattactgacttaaattactgacttagcatgtaagatgactgttacaactcaaattatacaaaaacagattatcaagaatatttttattaaaatcaatttaagatattattctct

SEQ ID NO: 1969 - DNA, 601 bp, Human
caaatctcatgtcgtatcataatccccagtgttggaggtggggcctggtggagaggtgattaaatcataggggtggatttctcacttggtactgcctcgagatggtggatgaggaatgagttattgtgagctctggtcatttaaaagtttgtagcaccttccctttctctctctcttcctcctgttctcgctatgtgagatgcctcactccccctttgtcttctgccatgactggaaacttcccaaagcctccccagaagcagatgccaccatgcttccgcacagcctacagaactgtgartcaattaaaccttttctttataaattacccagtctcaggtatttctttatagcagtgtgagaatggactaatacttggctaattaaaaaaaaaaattgtagagatggggccttgctttgttgcccagactgaattcctggactcaagttattttcctgcctatgcctcccaaggttctgggattacaggtgtgagccaccatgtccagccagtattctattttaaatgtaatacaggcaactaagagaagaatcagtagggtaatcagcatgcacagggttaaaaaccagatcctataga

SEQ ID NO: 1970 - DNA, 601 bp, Human
gtattattcatacacacacacacacacacatacacacacacacacacacacacacacgtacacataaatatttttacgagacagggtcttgctctgttacccaggatagagtgcaatggcgtgaccatggctcactgtgacctcgaggtccagggctcatgattctcctggctcagcctcctgagtagttgggactagaggcatgatatggtttgaatctgtgtccccacccaaatctcatgtcgtatcataatccccagtgttggaggtggggcctggtggagaggtgattaaatcatargggtggatttctcacttggtactgcctcgagatggtggatgaggaatgagttattgtgagctctggtcatttaaaagtttgtagcaccttccctttctctctctcttcctcctgttctcgctatgtgagatgcctcactccccctttgtcttctgccatgactggaaacttcccaaagcctccccagaagcagatgccaccatgcttccgcacagcctacagaactgtgaatcaattaaaccttttctttataaattacccagtctcaggtatttctttatagcagtgtgagaatggact

SEQ ID NO: 1971 - DNA, 601 bp, Human
tttttcataaagaaacttttattcaaagacaacaataacctttataataaatatgcagtaactatcatttttataatgcttactgtaggccaaacactgtccaaatatttcctctatattaacttatttttggttgttttttgagatagggtctcagtctgccaccctaggctggagtgcagtggcacaatctccacacaccgcaacctttgcctcccgggttcaagtgactctcccacctcagcctcccaagtagctgagactttcaggcatgtgctaccaagctcagatttttttttttggaaacagggtttcactctgtcacccagactggagtgcagtggtgcaatcttggctcactgcaacctccgcctcccaggctcaagcgattctcctgcctcagcctcctgagtagtggggattacaggcgtgcggcactaccgcctggctaatttttgtatttttagtagatacggggttttaccatgttggccaggctagtcttgaactcctaacctcaaatgatccacccatctcggcctcccaaagtgcttggattactggcatgagccaccatgcctggcctctatattaacttctt

SEQ ID NO: 1972 - DNA, 601 bp, Human
tgccaacacttcggatgaaaatgttgggatttaaaattatgctgaaagagtagaacaccaggctaaaactgataaaatgaaattagcaacagaggaaatatatcctatttaggtaataagaaatatacattgggtgagggagaactagtttaagagtaactcatgtaaaaaccacctgagaattttcactgatcactagctcaacatgaaacaagggtatatctcagctaccacatagttacgtaactttataaaaatgatgttcagatcaaagtaagtatgagtgccactgtagtcagaytggttttggtatattacgtttatttttttcataaagaaacttttattcaaagacaacaataacctttataataaatatgcagtaactatcatttttataatgcttactgtaggccaaacactgtccaaatatttcctctatattaacttatttttggttgttttttgagatagggtctcagtctgccaccctaggctggagtgcagtggcacaatctccacacaccgcaacctttgcctcccgggttcaagtgactctcccacctcagcctcccaagtagctgagactttcaggcatgtg

SEQ ID NO: 1973 - DNA, 601 bp, Human
caaacaactgccaacacttcggatgaaaatgttgggatttaaaattatgctgaaagagtagaacaccaggctaaaactgataaaatgaaattagcaacagaggaaatatatcctatttaggtaataagaaatatacattgggtgagggagaactagtttaagagtaactcatgtaaaaaccacctgagaattttcactgatcactagctcaacatgaaacaagggtatatctcagctaccacatagttacgtaactttataaaaatgatgttcagatcaaagtaagtatgagtgccactgyagtcagattggttttggtatattacgtttatttttttcataaagaaacttttattcaaagacaacaataacctttataataaatatgcagtaactatcatttttataatgcttactgtaggccaaacactgtccaaatatttcctctatattaacttatttttggttgttttttgagatagggtctcagtctgccaccctaggctggagtgcagtggcacaatctccacacaccgcaacctttgcctcccgggttcaagtgactctcccacctcagcctcccaagtagctgagactttca

SEQ ID NO: 1974 - DNA, 601 bp, Human
aataataccatcccatgtcaaattaatcccattttacagggctaccaggctgagattaaattgtaaaaagaaagtattttaattaagaaaggtatctgataaagttattttgaatgtttatagggcaagatgaagaaatgtgaattagaatacactataactgggttggacgcagtgactcacgtctgtaatcccagcactttgggaggccgaggtggatggatcacctgagatgaggagttctagaccagcctgaccaacatggtgaaatcccgtctctactaaaaatacaaaaattacycgggcgtggtgacctgcacctgtaattccagctactcaggaggctgaggcaggagaattgcttgaacctggggggcagaggttgcagtgagctgagattgtgccactgcactccagcctaggcaacgaaacgagattccatctcaaaaaaaaagaaaaaaagcaaaaaaaaaaagaatatactataaccgatattacaatgaacattatgaaattgctgatattttgctacttttataggttcatactcaaatttatatttgattacccatatataaaaaaactgacttaagaaaaaagt

SEQ ID NO: 1975 - DNA, 601 bp, Human
gtggcacacgcctgtagtcccagctacttgggggtgagggtcgtgtgctgaggcaggaggattgcttgagcccaagaggtcaaggctgcagtgagcccagaaaaaattaaaaacagtttttgcagtcaaaattgtatccccaaatggaatcccaggacctctcacaaagcctgtaaaacccagagctggaatgtgtatttctttgtttcaaacttataatgtggtctgtttatatcatcttgctgttatttataaatgcctactgtaaatcttagtgcatatattactctcaatttccaayagcatggtccttcatccagtggagaatctctactaagttactctctgatactgggtcagaccttacaattccctagacatcactttattctttggcaaaatcacttgttatactttctctaaagtaatcatagggatgttaaatatgaaatatactctagagttctaaaaagatataattagagactcagtatgaataatttttaatcacacagaataagagaaatattaaaaatgggcaaatgggctgggcgcagtggctcacacctgtaatcccagcactttgggaggccgaggtggg

SEQ ID NO: 1976 - DNA, 601 bp, Human
gggatgatggcttgagcccaaggggtcaaggatgtagtaagccactgcactccaccctggacaacagagtgaaaataaatgcatgggataggatcccctatttaaaaacaaagaatcagcctaaccaacatgctaaaacccagtctctactaaaaatacaaaaattagctgggtgtcatggtgggcacctgtaatcccagctgcttgggaggctgaggcatgagaatcacctgaacccaggaagtggaggttgcagtgagatcacgccactgcactccagcttgggagacagagtgagacmgagtctcaaaaaacaaaacaaaacaaaacaaacaaaacaaaacacaaagaatcagattgggtaaaagagaattaaacacaactacatgctttacctatcacctactccacattgatgacatctcaatccctatctctagcactaaacccccatgctttcaatagcccattagacatatatctacctgagatatcccatagctatttttaaatgagcatgtccaaaactattatgtatcataatcttttcaaacttattattttttattcttatttctctgcctctgctaacagcaccact

SEQ ID NO: 1977 - DNA, 601 bp, Human
ttttaagaataaatgcatggccctgggtatgatggtttgcgtctataatctcagcacttttgggaggccgaggcaagaggatcgctcgagctcaggagtttgaaaccagcttgggcaacatagggagatgccatctgtactaaaaacaaaaaaaattagccgagcatggtggtgcacgcctatagtcccagctattcgggaggctgaagtgggatgatggcttgagcccaaggggtcaaggatgtagtaagccactgcactccaccctggacaacagagtgaaaataaatgcatgggatargatcccctatttaaaaacaaagaatcagcctaaccaacatgctaaaacccagtctctactaaaaatacaaaaattagctgggtgtcatggtgggcacctgtaatcccagctgcttgggaggctgaggcatgagaatcacctgaacccaggaagtggaggttgcagtgagatcacgccactgcactccagcttgggagacagagtgagacagagtctcaaaaaacaaaacaaaacaaaacaaacaaaacaaaacacaaagaatcagattgggtaaaagagaattaaacacaactacatgct

SEQ ID NO: 1978 - DNA, 601 bp, Human
atcacctgaggtcaggagtttgagaccagcctggccaacatggcgaaaccccatttctactaaaaatatgaaaaattagccgggcgtggtggctcatgcctgtagtcccagctacttgggaggctgaggcaggaggattgcttgaacccgggagggcagtgagctgagatgatgccactgcactccagcctgggtgacagagcgagactctgtcaccaaaaaaaaaaaaaggatttactccagtatttgttcgctttcttcaggtagctgctttacacgtgcattttctcagcaattaagrgatactgagaattaccatcattatgtcaattcaacaatactttcctgtggtggggggggtctcatgtcaaatatttctctagtaaagtgaaactgcttgactttcaggaaagacaggagacttgtggttcctacttctaagcttattttttaaaaaccaaacatgtccaagtcactaagtccacaagttactacattttataaagatgaaaggacaacattaaaaatgcagttcaatagtcatgacaaagtctgaaataagacaaaaacaaaacttacagcctgaaattattgtgattcc

SEQ ID NO: 1979 - DNA, 601 bp, Human
gacctcaagttatctgcccacctcagcctccgtaagtgctggagttacaggcatgggccgccgcgcctgggggattacaggcatgagccaccgcgcctggcctctacttttacatatatttgaaatgttacagaataaaaaattaaatgttttaaaatagcatttaatattattacttggtaaaataaaaattccagcaaaaatgactaactttaataaatctaacatgaaacaaatttaaaataacgtaccattcagattttaaagtgaagtttgtctccaagtgtgtttcccttccacsatcccactcacacctcattttcttcccctcgttcacaatgcaactcaaatttttaggtttttctggaggcactaaaagggattaattagcatctttcagaaagctttatatccacaaatattatgcaatttatatactacccaaggcatttgcgatctaaattagatgaaaaaaatcaaacccaagcaaaaagtatggacacaatgaaaggctgatgacaatttcttttctatcccaactcttacacttcttttcaggaagtaatatatatacatccatcctaactgtcatcaactggtt

SEQ ID NO: 1980 - DNA, 601 bp, Human
gtacaatgtataacagtttaacaactgaaatgtaagaaaaaagaacaaatagaacctataatttaagagacaagacataaattcacaaagtatggagcttattcgaatcttgactgaaacaaatgtaaaaaaaattatacatataggcatattcatgagacaataggggaaatcaacactaactgaaaatgtaatattttatatctgagtgtaacagtggtatgttgttatgcttttttttaaaatgtcctcatcttttagagacgcatactgaaatatctttggatgaaatatgatgccygcgattctctcttcaagacaatataggcaaagagtacctttgaaataagactggtcatgagctgaccagtgttgaagctgagtgatgggtatgtatgggtattctactattctttctacttttattttttatttatttattttttttgagatggagtctcactctgttacccaggctggagtgtagtggtgcaatccgggctcactgcaacctccgcctcctggatttaagtgattctcctgcctcaacctccgagtcactgggattacaggcacccgccaccatgcctggctaattttt

SEQ ID NO: 1981 - DNA, 601 bp, Human
gttgcagtgagcagagatcatgccactgtactccagcctaggtgacagagcaagactccatctcaaaaaaaaaaaaaaaaaaaaaaaaaaaaaaaaaaagacaagggaatatgttaaacaatgtacaatgtataacagtttaacaactgaaatgtaagaaaaaagaacaaatagaacctataatttaagagacaagacataaattcacaaagtatggagcttattcgaatcttgactgaaacaaatgtaaaaaaaattatacatataggcatattcatgagacaataggggaaatcaacaytaactgaaaatgtaatattttatatctgagtgtaacagtggtatgttgttatgcttttttttaaaatgtcctcatcttttagagacgcatactgaaatatctttggatgaaatatgatgcccgcgattctctcttcaagacaatataggcaaagagtacctttgaaataagactggtcatgagctgaccagtgttgaagctgagtgatgggtatgtatgggtattctactattctttctacttttattttttatttatttattttttttgagatggagtctcactctgttacccaggctg

SEQ ID NO: 1982 - DNA, 601 bp, Human
ggcaggagaattgcttgaacctgggaagcggaggttgcagtgagcagagatcatgccactgtactccagcctaggtgacagagcaagactccatctcaaaaaaaaaaaaaaaaaaaaaaaaaaaaaaaaaaagacaagggaatatgttaaacaatgtacaatgtataacagtttaacaactgaaatgtaagaaaaaagaacaaatagaacctataatttaagagacaagacataaattcacaaagtatggagcttattcgaatcttgactgaaacaaatgtaaaaaaaattatacatatakgcatattcatgagacaataggggaaatcaacactaactgaaaatgtaatattttatatctgagtgtaacagtggtatgttgttatgcttttttttaaaatgtcctcatcttttagagacgcatactgaaatatctttggatgaaatatgatgcccgcgattctctcttcaagacaatataggcaaagagtacctttgaaataagactggtcatgagctgaccagtgttgaagctgagtgatgggtatgtatgggtattctactattctttctacttttattttttatttatttatttttt

SEQ ID NO: 1983 - DNA, 601 bp, Human
acccaaatctgatgaaatctgtagatctaaaagcaattttttggaaagaaaaagacaagggggccaggcgcggtggccacgtctatcatctaagcactctgggaggcagaggcagccagatcacgaggtcaggagttcaagaccagcctgaccaacatggtgaaaccctctctattaaaaatagaaaaaaattagctgggcatggtggcacatgcctgtaatcccagctactcaggaggctgaggcaggagaattgcttgaacctgggaagcggaggttgcagtgagcagagatcatgccmctgtactccagcctaggtgacagagcaagactccatctcaaaaaaaaaaaaaaaaaaaaaaaaaaaaaaaaaaagacaagggaatatgttaaacaatgtacaatgtataacagtttaacaactgaaatgtaagaaaaaagaacaaatagaacctataatttaagagacaagacataaattcacaaagtatggagcttattcgaatcttgactgaaacaaatgtaaaaaaaattatacatataggcatattcatgagacaataggggaaatcaacactaactgaaaatgtaatattttata

SEQ ID NO: 1984 - DNA, 601 bp, Human
agatagattgagagatggagagaaggatgcatagataaataggtgataaagcaaagatagtaaaatgttaattgtagaatctagggtatgcaagagtgttcactgtaaaactctttcaacttttctgtttggaaaaaacaaatgggaaacttagtaaataaaggaataaggctgacaacacccgaaaccactgctcaatcttagtatcagaaaaaagaaaaacagtgaaacattatctggtctttcctgacagaagtacacatcactcctacaaaatatttttttggggaaaaaaaaaaaatcaaacccaaatctgatgaaatctgtagatctaaaagcaattttttggaaagaaaaagacaagggggccaggcgcggtggccacgtctatcatctaagcactctgggaggcagaggcagccagatcacgaggtcaggagttcaagaccagcctgaccaacatggtgaaaccctctctattaaaaatagaaaaaaattagctgggcatggtggcacatgcctgtaatcccagctactcaggaggctgaggcaggagaattgcttgaacctgggaagcggaggttgcagtgagcagagatca

SEQ ID NO: 1985 - DNA, 601 bp, Human
actctagttcatgtaaatactgaagtgattaagaatgaggtatattaatgactgtaactcactatgaaatactgaagtgattaagggtgaggtatattaatgactgcaactcactatgaaatacataaaaaagagatagattgagagatggagagaaggatgcatagataaataggtgataaagcaaagatagtaaaatgttaattgtagaatctagggtatgcaagagtgttcactgtaaaactctttcaacttttctgtttggaaaaaacaaatgggaaacttagtaaataaaggaatraggctgacaacacccgaaaccactgctcaatcttagtatcagaaaaaagaaaaacagtgaaacattatctggtctttcctgacagaagtacacatcactcctacaaaatatttttttggggaaaaaaaaaaaatcaaacccaaatctgatgaaatctgtagatctaaaagcaattttttggaaagaaaaagacaagggggccaggcgcggtggccacgtctatcatctaagcactctgggaggcagaggcagccagatcacgaggtcaggagttcaagaccagcctgaccaacatggtga

SEQ ID NO: 1986 - DNA, 601 bp, Human
tgggcaacaagagctaaactccatctcaaaaaaaaaaaaaaagacagccagttcctggaaggaagcagggaaaatcaacatgccaatttcacttttcttctgtcttctctcctgcctagtcccttccttccattaaccacagtcacaaggaagctagaaagaatggaaacccacagatgaaatctatacaggtcagcatgacacaacaaagagaagggtagagcgtagatgtggacaggcaaaaggaagatatccagcccaatcaagaaaaacaaaagttttcctggcttttaaacttggytttcagaaaaaaagaggagattaaatacagataaataactggtcatattactctgataatttagtattagatacaaaataaacatcagtcttttttgtagcactgaattaagattctatacttaataccacattttgaagaacttcaggtatgtatattctctgtacaacatgaagcattaatccaattttgttttattgctttttctgattgtattctgagcactttagataagtggggtaaggagagaagtagtaaagtcattagcccaattccctaacaagctcactgtgaccagag

SEQ ID NO: 1987 - DNA, 601 bp, Human
ccattttaaatttggttctaaaataaaactagtacatactaaatgaagagtaaaagcatgacctcaactaaaaaagggtaagtagcatcattccgttagcttttggttctgtatcaattctgcactgtggctatgtaggtctaaattatttattttatgcttgagtatttttctaccttcttttttagtatgatctactcatgcacttaccagcatacattttgattatcacaaacttttattattttctgagttactctggaaaattccaaagtacaaaaacaacattcctcttcttatrgaacttatactttcacagaactgtacttaaatacctataaggtattatttgtagtttatgaacctgacttctatataatattaatacatataaagcattacctttctatttagtaaaaatagtaatcaaatgctttgctattaaaatgaataaaaatttatctatttaaaagacctccattcataataccatacaaaatgtatttataagggctgggcgcggtggctcatgcctgtaatcccagtactttgggaggccgaggcaggcagaacatgaggtcaagagatcaagatcatcctg

SEQ ID NO: 1988 - DNA, 601 bp, Human
gcatatacttccttgcctaaaagcactttattataacttacaggtaaagtagtcaatttttaaacttagattttgcttccccgctgggcactgtggctcattcctgtaattccaacattttacgaggccaaggcaggtggatcacttgacatcaggagttcgaaaccagcctggccaacacggtgaaaccccgtctctactaaaaatacaaaattagccaggcattgtggtgcgtgcctttaattccagctacttgggaggctggtgcacaagaatcgcttgaagccaggaggcagaggcygagatcgtgccattgcactccagcctaggcgacagagcaagactgtctcaaaaagaaaaaaaaaaatttgctttccctaaattcttcaaatgctttcggtttgtaattgcaatttttcttctttgaaagctacgaataaagctacagataaacgtttcagtcatatgtatacaaagttctcaaaatcttgaaataatattttaaaaaccaggtaagtaatcagaatatgcttaaatgaatgaagtagcttactgtgaagtttaagtgagcatgtagtgatggaaatgttcttgcatcctg

SEQ ID NO: 1989 - DNA, 601 bp, Human
ttaacaaatttgaaatttccatattttacagtcatttccaaaacatgtgatttatcaatttttgtagcatatacttccttgcctaaaagcactttattataacttacaggtaaagtagtcaatttttaaacttagattttgcttccccgctgggcactgtggctcattcctgtaattccaacattttacgaggccaaggcaggtggatcacttgacatcaggagttcgaaaccagcctggccaacacggtgaaaccccgtctctactaaaaatacaaaattagccaggcattgtggtgcgygcctttaattccagctacttgggaggctggtgcacaagaatcgcttgaagccaggaggcagaggctgagatcgtgccattgcactccagcctaggcgacagagcaagactgtctcaaaaagaaaaaaaaaaatttgctttccctaaattcttcaaatgctttcggtttgtaattgcaatttttcttctttgaaagctacgaataaagctacagataaacgtttcagtcatatgtatacaaagttctcaaaatcttgaaataatattttaaaaaccaggtaagtaatcagaatatgcttaa

SEQ ID NO: 1990 - DNA, 601 bp, Human
ggtaaaataaggtaattttctataatgattcaaaatgtagggggagcaagaaagaatgttggttaagtttgctttagggaagatacagaagagccagatgatgaggtgaagacctcactgggggcaatgcactaagaaaagagaagttagcatgaggagcttgcagttgaagaaaatgatgatgaaagggtacgcacaatcaacaggacttgacactcagcttatgtgagagaaaaatatacaaatacatttattgtaatcacatttaaatttatggctttggcatagaacgagggagggraaatgtatttgggaaggaaagagaagatggctaaagccatggacagagtttgaataggcaagtaagaaaacagggtcaagaggccgggtgcggtggctcatgcctgtaatcccagcactttgggaggccgaggcaggtggatcacctgaggtcaggaggtcgagaccatcccagccaacatggtgaaaccccgtctctacaaaaatacaaaaaattagccaggcatggtagtgggcacctctaccccagctacgtgggaggctgaggtaggagaatcacttgaacctgggaggtggaggt

SEQ ID NO: 1991 - DNA, 601 bp, Human
gccaaatctaatttaggcagaaactttgctttattaaacatctgcttttatgttttcaagcctgtgcctttgctcatgctgctctctaagatgccaccttcttcctatttgtccacatactaactcaaggctcaagtattttcttcttcataaaacctttgaaggtaaaattatccactactggtatatttaaattcctactctatttactgtctacatagtccacaggttctcctttttctgatttacttatgcaaaatttcttcaactaagctgtaaggtcctcgttggcaagactcawgccatgtgaagaagccataatggatccatgagactacagatagagaattgaaaaaaggtaggttataaaataatactaagtataatttaattttaggaaaaaaatatatacaaagaagacactaaaaggatacacaaatatgttattttggggtaagggactaggactaatttttcttcctctctacattttactgtacagtctaaattccctataatgaacacctatgtaataaaaaaattttaggctgagcatggtggctcatacctgtaatccggcactctgggaggctaaggcagg

SEQ ID NO: 1992 - DNA, 601 bp, Human
agctttataaaagtgatgaaaatgttctatattgtgattatggtggtagttatacatctgtatgtaattacaaaaattcatcaaactgtacacttaaaatggataaattttattgcatgtaaattcagctcaataaagctgggggaaaatgcaaaaatatgaataaagttacttacaggtctcgcttattaaagcagaacagcactcccagaagagttgtcaataggaatgctaagcaaacaggcacgactatggcttcaatttctccttgagcttaaaaaaaaaaaaaaaaaaaaaaaaagaggtgtgatgggaaataatgttgacatatgaactaagaagacataatacaacttcccaaccagacttactgttgaaaagataaaatacaatcctaattatttttcaaggtctcttcagacttgatgatttttaccctcttctctctttggtaaatcacatcccaaccatttatgtcttatacattaacctggccgcatagcataaaatatatgttggttgggggataaaaatgatcagtgtatcgggtaatctactgggttagagctttcaaacataaccatttgtaacatttatgatc

SEQ ID NO: 1993 - DNA, 601 bp, Human
tgcagttctctctcggccttagcgccatttttttggaaacctcggcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcawaaacaaaatgcccatgttggtcctctgccctggacctgtgacattctggactatttctgtgtttatttgtggccgagtgtaacaaccatataataaatcacctcttccgctgttttagctgaggaattaaatcaaaaaaaaaaaaaaaaaaagactgcagttctctcctatagattcaattaaatctgacctatagattcaataaaatcccaatcaaaactatagttttaaaaaagttgacaagctgaattaaaatgtatatgaaaaggcaaagaacctagccaaaataacttctttaaa

SEQ ID NO: 1994 - DNA, 601 bp, Human
agcaatacttttactcagacttcctgtttctggaacttgccttcttttttgctgtgtttatacttcccttgtctgtggttagataagtataaagccctagatctaagcttctctgtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggtgagtcatttctaasttttcttatggattttggattatctgtagcatggtttcaggttattcagttccctaacagacctgagtcaggcactgggtttgaatgcagtttgagaatttcccacatattcagtcattttttttaatgttctaaccaccatgacagggggcaggggatcaatactatgggtggtttataagacctcagtattctcaagaaggaatgcatttcactcccaagtgtagatcttaaatgttgaatgattactctgctcttacaaaaagaatgctcatgtagatgctatgactgtacttgtag

SEQ ID NO: 1995 - DNA, 601 bp, Human
tatacttcccttgtctgtggttagataagtataaagccctagatctaagcttctctgtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggtgagtcatttctaagttttcttatggattttggattatctgtagcatggtttcaggttattcagttccctaasagacctgagtcaggcactgggtttgaatgcagtttgagaatttcccacatattcagtcattttttttaatgttctaaccaccatgacagggggcaggggatcaatactatgggtggtttataagacctcagtattctcaagaaggaatgcatttcactcccaagtgtagatcttaaatgttgaatgattactctgctcttacaaaaagaatgctcatgtagatgctatgactgtacttgtaggaaaatgtccaaagtaattttaccttgtcaggagatcaaactggattcattttgtttg

SEQ ID NO: 1996 - DNA, 601 bp, Human
agtataaagccctagatctaagcttctctgtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggtgagtcatttctaagttttcttatggattttggattatctgtagcatggtttcaggttattcagttccctaacagacctgagtcaggcactgggtttgartgcagtttgagaatttcccacatattcagtcattttttttaatgttctaaccaccatgacagggggcaggggatcaatactatgggtggtttataagacctcagtattctcaagaaggaatgcatttcactcccaagtgtagatcttaaatgttgaatgattactctgctcttacaaaaagaatgctcatgtagatgctatgactgtacttgtaggaaaatgtccaaagtaattttaccttgtcaggagatcaaactggattcattttgtttgactttttaagaaatcctgaaagcataa

SEQ ID NO: 1997 - DNA, 601 bp, Human
tcagttgctgcttgttgaaagttgtcaattttctgatcatcacaaggatgatcaagagaagaaagggatactttttaaaaatccaaatcatttacactattaatcaactaactccattcagtaggaagaagacttctagatgacactggcttgcctatgatacatattccacacaatttaaatttttatggataaatatgtctagatacctatttaaatatgaataatattaattattgagcatttaaagaataatagattaactcattattcaaaagctctatgtaatttcaaaaccatrgtaattataacaccgtcaattgacataaactttttaaagagaagctcaaatgtttcatgtatattttcagaattagaattcttattttaccttttcattacttatttctcagaaaatattatactcatagctaatccctattaaatccttactgtgttctaagctacctctttgtaaatatccattcagtgattgctcatagcacgagtttacatattagaacacatgtcttagagaagttgcctacctgacagaggaccacaggtagagtatccagaatttaaacgcacatctgtccag

SEQ ID NO: 1998 - DNA, 601 bp, Human
gcagaactggatgactactcattctcatgctatagccagttggaagtgaatggatcgcagcactcactgacctgtgcttttgaggacccagatgtcaacatcaccaatctggaatttgaaatatggtgagggatggtggttttaatggttgcttagacatcctctgtctctcttttcatatgctctttttagtagccacaaaagaaagaatatgtggcctaattaacaaatgttaacatctaaggaattcccaaaggcctcctgaaactccttgtccttcaccaaaaacactcatacaaakctcctctcacggttcagctttcagaccctgagactcagtcaaatgatgctctggatcttggggatcccacatccctcccaacttcatatcagaatttaaatcctgcgtctcctacaacacttctcaccaaaaatctgtttgcccaacacgagacaatccagtgtcttcaagttgcatctgagagttaaactgccttgtttccaatcccaataccagtgcttactagttttttgacctagagaaagttatgtaatgtatctatgcctcagtttcctcacctgtaaaatgagataacctgcc

SEQ ID NO: 1999 - DNA, 601 bp, Human
atgtaatgtatctatgcctcagtttcctcacctgtaaaatgagataacctgcctcacaggaaggctgtgatggttaaataatttcatcatataaatcattccaaatagtcggccagtgaataacgagtaatggggaagcaacattaaattataattctgtgaatattgacctaacttctaccatcttgacacaatttgacttcagatgatcctctcaatgtaaattttccaaaaatccacaggaataagttggcattttgtttcacaaggtctcacagaaaagacaaaggaaaagagtcttggtttgaaagtttactaaaggtctcagggaactttatcttctccttctccttcatccataagtcatctcttgttgccaagggttactatctctggtgatttgagaaactactctagcttgaaattctgacctgaggctatctccaaattcatatccgaatgacctactttttagttagtgtcctagtgagcaaagtaaatcaagatccaccagtagtaatagaaggcttcctacattccatagacactgagacaattctccacagtctatagtccaaacaagccctgaattccagttttt

SEQ ID NO: 2000 - DNA, 601 bp, Human
tattgtcctagtttctccacatcccatgtttacctaaaattcagaaatgggaccccgctcccagtctccccttctatatttatttatcaaatcgtgacaacattaccatcttcagatctttccacctgatgtttgtcctaagcttattccctggtatctgtctagcttacccaaaaattcggtttttatttttatcctgttccaagttgggaaagcctatctaccccaacaaggaacacaactccctagtaactttgagacacacacacacatacacacctactctttaaagcctaaacartcgcacactctaaaagatagcagttaacaaaagtaacgatttgggagaacagttttaaggaatgtccccaaaataatcaatacatttagccagttaattaacttaacatttcttcaccaatctctagttttcatgactgtaggagcttaaccagtcactctcagaccacaataaaccaaaggtgaaagattctgtaacgaaagctagggcactctcccctgcatttaacctcctggccagctcactcgaagccagacaaacaggttcctctttttgtgcagagtccaggaaccattctcg

SEQ ID NO: 2001 - DNA, 601 bp, Human
tctgaggatcttcaaacccaggtgtgaaagatagtgtttgtgcaaacctacatgaagtggctaactggagctgggcttcctgtcatccatcacaggtgtcctttccttccttatctgtcctttccttccttacctgtccttctcccaaattccttgtggtcttctccccaaatccccacaacattctgagtaagtttagctaacttatcaagttattttaaaaagcatatatgccttctctattagtcagagttttctacaaaaaaaaaagggaatcaataggaggatagatagatagatsattgataggagagatttctattaagaaattgacttttgtggttgtgggaactggcaatcgcaaaaatccataaggcaagccagtaggctagaaattcaggaaagagtgcagtattgagcctaaattccgcagggcaagaaactcaagcagattttctgtattgtactcttgagacagacttgcttcttcttcagggaacctctgtctttgctctagaggccttctactgatgaggtgatgcccaccacatcacggaaggcaatctactttactcaaagtttactgatttaaatgttaacc

SEQ ID NO: 2002 - DNA, 601 bp, Human
cagacccttcatgtcactgtagctgagacgaggtgcaaggttcacagcatataacctaattttattacaagaatgaagactcagagtttaaatactcctgctttggggctcattagtaacaagttctccaatattcaaaaggcaaagtggatgtgttttagtgtaaaattaacactagctgctgtaacaaataagcccccaaacatatgatatctcaaacaccgtaggtttatttctcactcacatcagagtcaaaatggatgtttctaacctgcagctggggcttctcccagcagtattmggggcactttccatcttgtggctccaccgtctgtaatgcaggactccaagtggtggaagaggacggagcagaggagtcacacatgggtgtgtgtctggcccagggtggaagtggatgtgcatttcttctgcccacctcactcacaaggccacaccccactgcaagagaggctggagaatgcggactggatttaaacccaagaagaagaaatggttttctgaatagttggccatttactgacacaaaaagggtcaaagtgacttgcagaggagatgaattttaaatactataattatttcc

SEQ ID NO: 2003 - DNA, 601 bp, Human
gtcacacatgggtgtgtgtctggcccagggtggaagtggatgtgcatttcttctgcccacctcactcacaaggccacaccccactgcaagagaggctggagaatgcggactggatttaaacccaagaagaagaaatggttttctgaatagttggccatttactgacacaaaaagggtcaaagtgacttgcagaggagatgaattttaaatactataattatttccttggctgccctttagacagaatttatttctttttcttttccagttaaacctgaggctccttttgacctgagtgtcrtctatcgggaaggagccaatgactttgtggtgacatttaatacatcacacttgcaaaagaagtatgtaaaagttttaatgcacgatgtagcttaccgccaggaaaaggatgaaaacaaatggacggtatgtagttcaactacattaataaaataaaaacttatgaatgttttctattttgttggcctagtagtgcatttcccctgggagggcccaacaattttgctttcaaaatctaccttctactgaaagaatctcccaatattggccccatgaaaacctggatcttccctgatgcata

SEQ ID NO: 2004 - DNA, 601 bp, Human
ctgcaagagaggctggagaatgcggactggatttaaacccaagaagaagaaatggttttctgaatagttggccatttactgacacaaaaagggtcaaagtgacttgcagaggagatgaattttaaatactataattatttccttggctgccctttagacagaatttatttctttttcttttccagttaaacctgaggctccttttgacctgagtgtcgtctatcgggaaggagccaatgactttgtggtgacatttaatacatcacacttgcaaaagaagtatgtaaaagttttaatgcaygatgtagcttaccgccaggaaaaggatgaaaacaaatggacggtatgtagttcaactacattaataaaataaaaacttatgaatgttttctattttgttggcctagtagtgcatttcccctgggagggcccaacaattttgctttcaaaatctaccttctactgaaagaatctcccaatattggccccatgaaaacctggatcttccctgatgcatactcttctagctctggttgttttcttctgctctaattttggtcttcagaatgtttctacattagtgagttggataacaatatag

SEQ ID NO: 2005 - DNA, 601 bp, Human
ttgcaaaagaagtatgtaaaagttttaatgcacgatgtagcttaccgccaggaaaaggatgaaaacaaatggacggtatgtagttcaactacattaataaaataaaaacttatgaatgttttctattttgttggcctagtagtgcatttcccctgggagggcccaacaattttgctttcaaaatctaccttctactgaaagaatctcccaatattggccccatgaaaacctggatcttccctgatgcatactcttctagctctggttgttttcttctgctctaattttggtcttcagaatrtttctacattagtgagttggataacaatatagattgaggccaaattaatcctctgtattcaggggcctcaaaaagtgtcatgtctagtgccactttcataggcaaatcaggcaaaatgtatatctgcttatgatcaccaagtcgtagccacattctggcttatgagattcatgggaccagcatgaggtaaagaaaagaggcataatgtttgcctttgttttgtttttattttaaagcccaaggtctttgtttttgaagtaacagcttaatttttacccttcataatcaggagagttactt

SEQ ID NO: 2006 - DNA, 601 bp, Human
aggtttatatatgtcaacacacacaataatcaaaaatcaaaaatgcaaatttaaaagtaagcttaaattgccacataaacagctgatagatggttagtatcattaatagataaaggactcttataaatcattaaaaaaacaaatatcacaatagaaaaatgagcaaaaaaattgggaaaaatctcataaagtatggaatagataaattcaataaatatatgaaaatgaactaattatcaaataaatacagatataaatagcaatggacttctttttatctgtcaaattgatagagtggtttttttttaatcttaaagataatacgctgtgtggtggagacttttgtctctttatcactattcacaatgtaaaatggcgtctttctggagagaaatgattcctgctcactaacctaacctaacctttcatctccccttaatatgtgaaaggatagagagaaaagaagaagatattgaagtgtggaaagggagatcctgggcagtgcctaactcacctgaataagacccatcatttcactctcctccttgaccactcacaacatcctttataagctcagattctgtccctaattttgctgttg

SEQ ID NO: 2007 - DNA, 601 bp, Human
aataatcaaaaatcaaaaatgcaaatttaaaagtaagcttaaattgccacataaacagctgatagatggttagtatcattaatagataaaggactcttataaatcattaaaaaaacaaatatcacaatagaaaaatgagcaaaaaaattgggaaaaatctcataaagtatggaatagataaattcaataaatatatgaaaatgaactaattatcaaataaatacagatataaatagcaatggacttctttttatctgtcaaattgatagagtggtttttttttaatcttaaagataatacrctgtgtggtggagacttttgtctctttatcactattcacaatgtaaaatggcgtctttctggagagaaatgattcctgctcactaacctaacctaacctttcatctccccttaatatgtgaaaggatagagagaaaagaagaagatattgaagtgtggaaagggagatcctgggcagtgcctaactcacctgaataagacccatcatttcactctcctccttgaccactcacaacatcctttataagctcagattctgtccctaattttgctgttgactcctttacgtatcagagctcct

SEQ ID NO: 2008 - DNA, 601 bp, Human
tggtagaaagtcaagaagggaagagagcattggtacctttgatgctagatcacgtttacatttcaagtggcagatgctctgggcctggtcacccaagtcaatgccttttaaaccaaaatccctccataaagctgtcaaatatgtctcttaactgaaaagcaactttcaggaaataataagtgggcccacattactaagtaaatgcaaagcaccctgagaccctacccccactgcatggctactgaatgctcaccacaatctattcttgctttccaggggagatggatcctatcttactaaycatcagcattttgagttttttctctgtcgctctgttggtcatcttggcctgtgtgttatggaaaaaaaggtgaccttcttcaactaataaagagggtgattgtgtgggatcacggacagtcagagcttaagccccatttattgatgagaaaaccacaaaggggattaaggcatttcacgaatttagtgcccagtatccctatctatcctcagcgaatttccacagttaatttcataagaggcaaaaagatattaactggacattaggcaaacgctgtccccaaagtaagaattccgtaat

SEQ ID NO: 2009 - DNA, 601 bp, Human
aatgcacaatgtacttgaagtcttgactttaagcatataaattcatgggattttttatactaatccatgctaaggctatgtttgtttcatcataaaaatgatgttttaaacatgcacttgttaaattacttactattctaggagaatgcccttggcagaaggctacatatccccaggattacaaataccctaatttgaaaagtactgcctggaaagtactaagcaatttccctgggtaatttgaaaatattcccccacttccaccaaaattagctgccagagttgctgtcagtaaagagargaaataaaaagacaacacttaaattgggagtaaacaacggggttaaatttacttccatagctgcaccaaaattacctccttgcaagccttggtgttccttccctctagggctttttcccagaggtatattattgtcatgtcttgttcacagaatggattgatatctgtggtctctggtccaacccctccttgaattgatagggccccgaggcccagagaaagccagtctcttgaccatggtcacccacctaattgtgttagagccaagactagaaatctgttcttctgattccaagctca

SEQ ID NO: 2010 - DNA, 601 bp, Human
ttccatagctgcaccaaaattacctccttgcaagccttggtgttccttccctctagggctttttcccagaggtatattattgtcatgtcttgttcacagaatggattgatatctgtggtctctggtccaacccctccttgaattgatagggccccgaggcccagagaaagccagtctcttgaccatggtcacccacctaattgtgttagagccaagactagaaatctgttcttctgattccaagctcagaataagtgggaagactcagtgtgcctgtgccctctgccattcacttcatctwtcaatgttctctgatttcaggattaagcctatcgtatggcccagtctccccgatcataagaagactctggaacatctttgtaagaaaccaagaaaagtgagtgtttttggtgcttaaaaagtgttgtgttggcaacatcccagtggccaagaatgatattccaggacaaggaacagttgaacctcaccttttggtatttgattcatcctgtaactagggtccctcctaagaccctagctgcagtagggaactgaaataagatacacatctcagaacttctgggctccctggggctggagg

SEQ ID NO: 2011 - DNA, 601 bp, Human
gtccattgaggaacatgctggcaattctgtgacattccctgtcagaaaactctatagacctactcctgaactgaacatttgatggtgtgtctctctggtgccatcttaataccctttctcctttttctgtgcagaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccamctgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagc

SEQ ID NO: 2012 - DNA, 601 bp, Human
ttgtatttttagtagaaacggggtttcaccatgttggccgggctgatctggaactcctgacttcaagtgatcctcccgcctcggcctcccaaagtgctgggattacaggtgtgagccaccgtgcccggcccccactggtgtgtttagcctcagacctcagcacagatcccttgacccctgagatggggtcttctctctgtgcagccttggcagggtgggggagggaggaaggtggggtggcaagggctactcactaatgcatttgagactgggggttgtccagtgggcgacattcgtggcyttgttcaacacgcactccgtcaggctggacgtgccggctttacgcttgaaaccagagttacaaatgtaccgctccctggagtacaagctgtagctcttgacccagatgtctgcgtgttccacggacatggggggagggcacgtgatgcctgcgaaagtgcagaggacaggggacggtgaagaggtttccacttgtaagaggcgttctccaggcacacgcagcggtagtcagtgtccagcttatcctaggggtgcctcaggacaagccccaggtgccaggcacgtggaggatgtacaggaa

SEQ ID NO: 2013 - DNA, 601 bp, Human
tgactgagcaaagggcagccctgctccagggcctgtgcccatccccggggctgggtactgagagaggagcagtgatggcttccaacatccaccttctcatgggaaatccaaacatttctcacactagcgtgctcatgagtgcccgcccagctctgcagccaaattctcttgccagcatcgtctcaaatcaaagcactacatgtaataagagttaatatttaccagggttcacgccaccctcccacagcccgcagtgtggatatcaagtccgttttccagatgaccagccagagtgccagawtatcacaagagctgcccaaggcctcctgggtggtaggcggcaaagccaggatttaaacccagaatcctgtgaccccagcacctgtgtgtttccaacgccaggagctgttgctgaggatcacactggtgtctttctttttttctttcttttttgagatggagtcttgctgtgtcacccaggctggagtgcagtggtgtgatcgcggctcactgtgacctctacctcccgggttcaagcaattctcctgcctcaaccctcccaagtagctgggattacaggcgcctgccaccacgcccggct

SEQ ID NO: 2014 - DNA, 601 bp, Human
atgttgagggctaacacacatgcaacctcaaacctcagtctgctttcagttcttgacaaagataagtgtctacaactaaatttgatatgacatattagtgagttttaaaccactattaattctgcacatataacacctggatatcaagcaactttgatttgaaaaagaaaattaagttggacgttcttattcttgattgaataagacgtttgcgctattgcctaagtctgcagtggcacaccacagaggtccgtgagtctgcaggattggtgagcgggcctctgggtgttgggagggaatraatgtcctcgagaagtttctgaccttcctaccttttccagaaggggagaggctctctggctgtggggtcacccctgccgtcgttactgtggagggtggcgctggcctttggtgaaccagggcagggtctcctagagagaggataaccacatggcacttatgatcctgagcctggaacctgggctggcttcagaacgggatacaaataaaatatatcaacacatgaacttacagtggaggcctctggcttcctcagacaggttaaaagcataagaaacaatgtttccccacccgaatgcaa

SEQ ID NO: 2015 - DNA, 601 bp, Human
aaatgtgtcttccattgtgacagccacggaatctaggaaacgtgaggccaagcgctgtggctctctggacgcactgttgttgccgcgttcccatggtctcccagccacacaggtcatgagaaggcctcacgccccttaatcctgtgtcaccacctttcatataacttgccctacgctcactgccaatgctccagggctccctgcacaggacgcaccaaggcatcctcagccaagtgcccacggtcgtgccagctcgggtcaaaggctgctgtcacatcggggcttctgactgcaccattgygtctcgacaatggccatcggaccaggtattggggatgcgaaggtggggctgggagagcctacttgatcattctcctccttgggtgaaccaggtgtgactcagatcaaaggggttgtagaattacttcaagtttaaatggagccagcccctcaaccccttcctccctgtgcaggtgactcactaggagggaaccttgtttagctgcttcttcctcccttaagatgcaggcctcagccttggccacttaagaaccacctgtgggctgggtgcagtggctcacacctgtaatcccagcacttt

SEQ ID NO: 2016 - DNA, 601 bp, Human
aattacaggtgtccaccaccacgcccagctaatttttgtatttttaatagagatggggtttcaccacgttggccaggccggtctcaaactcctgaccttaggtgatccacccaccttggcctcccaaagtgctgggattacgggcgagagccactgtgccctgccgcaagaccctgtttctacaaaaataagaataacgataaattatccaggtgtggtgggcatgtgcctatagttccagctatctgagaggctgaggcaagagaatcaccttagcctaggagtttgaggctgcagtgasctataattgagccattgcactctagcctgggggacagagtgagacccctgtctcttaaaaaaaaaggtggggggaagaaaagaaaaggtgtcaaagatctgagtcgttcagcttgtttactagagaaggcaggcccaacgctggaggctcagctgagagcaggtgaagctgcgctggccgaggacgctcggagcggctgcgtgtgaaacacgggaagcctgggctctggcctgaactctccgggctgtgtgggaggaaagcgtcctgatgagcttgctctcaggaacagaggctgccttg

SEQ ID NO: 2017 - DNA, 601 bp, Human
agaaaagatcagccagacacagtgggtcatgcctataatcccaacactttgggaggctgaggtgtgaggatcacttgagcccaggagtttaagaccagcctgggcaacacagcaagaccctgtttcttttccttctttttttgagatggaatcttgctctgttgccaaggttggagtgcagtggcgcgatctcagctcactgcaacctctgccttccgggttcaggcaattctccctgcctcagcctcccaagtagctggaattacaggtgtccaccaccacgcccagctaatttttgtayttttaatagagatggggtttcaccacgttggccaggccggtctcaaactcctgaccttaggtgatccacccaccttggcctcccaaagtgctgggattacgggcgagagccactgtgccctgccgcaagaccctgtttctacaaaaataagaataacgataaattatccaggtgtggtgggcatgtgcctatagttccagctatctgagaggctgaggcaagagaatcaccttagcctaggagtttgaggctgcagtgacctataattgagccattgcactctagcctgggggacagagt

SEQ ID NO: 2018 - DNA, 601 bp, Human
ctctgccatgcgggtgataaggctggccctgtcacatcttgggggggtgtgggcttgcttttgcagctgccccagccacagagaaagccacggagaaagaggtcaggccaggacgccgtggctggtggccggggccagcaggctgcccagtgaatcctgactttggattgatggtataaagctgccttgtgccggatctcagccccgatctcagaagcagcaatggggaactgacctctcctggggcaaagcgagtgctaacctggcggctggtgggaggcggatgctgtgagttcccagktcttggctgttgtctgagagggggtgccgtgggaggactcatgactgcttatctctgtggttcctgtggaaggtgattttgaaggcatcagctgggagcccgggacaatagctgctgttgtggccgctgtgttgtttgagctgggagatgaagctgcgggctctgtaggagagtccaaggcagggacaacatcagtgtgcagactcccctcctctcagctgcagcacggggtgatgtgggagctgccatagtgagtcaccctgaccagccctccctctctcacagccaactgctccttga

SEQ ID NO: 2019 - DNA, 601 bp, Human
gcaattctcctgcctcagcctcccgagtagctgggactacaggcaggtgccaccatgcccggctaatttttgtatttttagtagagacagggtttcactatgttaggcaggctggtcttgaactcctgacctcgtgatccgcctgccttagcctcccgaagtgctgggattacaggcgtgaaccaccacgcctggccaactttttcttttcttcttctttttttttttttttctgcgacggaatctcactgtgttgcccaggctggagtgcagcggctcgagtttgctcactgcaacctcyccctcccaggttcaaacgattctcctacctcagcctcctgagtagctgggatttcaggcgcctgccaccacacctggctaatttttgtatttttggtagagatggtgttttgctatgttggccaggctggtctcgaactcctggcctcaagtgatctgcccaccttggcctcccaaagtgttggaattacaggcatgagccacagcgcccggctgattttttaatctaataaaagtcatgaactagcaaaagcagattatagattatagcccatcatcaaatagttgttggaaaatgtat

SEQ ID NO: 2020 - DNA, 601 bp, Human
aacctccagctccagtgttcaagcaattctcctgcctcagcctcccgagtagctgggactacaggcaggtgccaccatgcccggctaatttttgtatttttagtagagacagggtttcactatgttaggcaggctggtcttgaactcctgacctcgtgatccgcctgccttagcctcccgaagtgctgggattacaggcgtgaaccaccacgcctggccaactttttcttttcttcttctttttttttttttttctgcgacggaatctcactgtgttgcccaggctggagtgcagcggctsgagtttgctcactgcaacctccccctcccaggttcaaacgattctcctacctcagcctcctgagtagctgggatttcaggcgcctgccaccacacctggctaatttttgtatttttggtagagatggtgttttgctatgttggccaggctggtctcgaactcctggcctcaagtgatctgcccaccttggcctcccaaagtgttggaattacaggcatgagccacagcgcccggctgattttttaatctaataaaagtcatgaactagcaaaagcagattatagattatagcccatcatc

SEQ ID NO: 2021 - DNA, 601 bp, Human
aaactcctgacctcaagtgatccacctgcctcagcctcccaaagtgctgggtttacaggcatgagccactgcgtccagtctacctacaactttttctttctttctttctttttgagatgaagtgtcattttgttgcccaaactggagtgcagtggcgtgatctcagctcactacaacctccagctccagtgttcaagcaattctcctgcctcagcctcccgagtagctgggactacaggcaggtgccaccatgcccggctaatttttgtatttttagtagagacagggtttcactatgttrggcaggctggtcttgaactcctgacctcgtgatccgcctgccttagcctcccgaagtgctgggattacaggcgtgaaccaccacgcctggccaactttttcttttcttcttctttttttttttttttctgcgacggaatctcactgtgttgcccaggctggagtgcagcggctcgagtttgctcactgcaacctccccctcccaggttcaaacgattctcctacctcagcctcctgagtagctgggatttcaggcgcctgccaccacacctggctaatttttgtatttttggtagagatg

SEQ ID NO: 2022 - DNA, 601 bp, Human
agaatgccatttgaggctttaatcaaagaataataatactgcctaaagattaaaaaaatgagaaaaattaaaaaagttagcaagtggcagaaatatttttgccagaaatgctgagatgcagaatttcaatgattagaaatacaaaattaaggctaacatgaatcagtatatttataagaaggcatacccctattcaatgaggactttcaagaatatattcatgagggtatcacaagaagaatgggtaggactgcacgcgttggccacctggtgcactttctctggccgccccatttctacyatgagcaggggtagggggcacttgggcttgggcctagctcactgctcctcggctctggcactcattggctcctagagaaggggtgtgtgagagccgatggccaggaaaggcgtccttcttgggagggggcattctggaatcactatggtggggctcttttctttttcttttttttgagacagagtcttgctctgttgcccaggtaggagtgcagtggcgcaatcttggctcactgcaacctccgcctcccgggttcaagcgattctcctgcctcagcctcccgaatagctgggattacag

SEQ ID NO: 2023 - DNA, 601 bp, Human
tggaatgctggaatactggttactaattgatagaagtacaaaatgaaggctagaatgccatttgaggctttaatcaaagaataataatactgcctaaagattaaaaaaatgagaaaaattaaaaaagttagcaagtggcagaaatatttttgccagaaatgctgagatgcagaatttcaatgattagaaatacaaaattaaggctaacatgaatcagtatatttataagaaggcatacccctattcaatgaggactttcaagaatatattcatgagggtatcacaagaagaatgggtaggwctgcacgcgttggccacctggtgcactttctctggccgccccatttctaccatgagcaggggtagggggcacttgggcttgggcctagctcactgctcctcggctctggcactcattggctcctagagaaggggtgtgtgagagccgatggccaggaaaggcgtccttcttgggagggggcattctggaatcactatggtggggctcttttctttttcttttttttgagacagagtcttgctctgttgcccaggtaggagtgcagtggcgcaatcttggctcactgcaacctccgcctcc

SEQ ID NO: 2024 - DNA, 601 bp, Human
aatacaaataatatataatgtatagatataatagacaaggaagtataaatataaacgcatatattcgtaaaatggcactgagttgagttttcttcttcctgaatccttcaatggagaggattcgctgggctcagcatctctcccacctttcccaggtccctgtccatgtgtgcagagcagctggagacagggtggttagaagcccaaacgctggtgtcttccctgtagacgtctcccacgccaggagaagccttgtaattgacagagagctttgggtatgtcacttttctctgtgaactgmaagttaggatgagggacggaagattcggggcagggtttttatttcattaccacatgtattccaggcagctcacactgtaatgaaataaaaatcctgctcagaagcctttggtctctcctgggaagctgggccctgggtccaaggcacgacaggcaggcaggtggtgcccatgggaatgcggagaacctgctccctcgcgcaggaggcgccgacccggcagtccgtgagatcctgctgggacttctgagaggcctggtgagcttgctcctggagcccgcttccttgcacctcttctcagtc

SEQ ID NO: 2025 - DNA, 601 bp, Human
ttccatccatggcaatgctctagcaggaagttatttctggagtctgccctgcatgcatccctctcatggcaccctcaacttctatgtcctttccatctcctcccattctaagcagagacagacagtctccctcccttggggaattcagcccttggaagaagcaggggagccagaggccctggggctggatcaaggatgcaagttgggggaaaggcccagaagaaggagatggttcgctgccaagacaagaaccttgctttccaactcatccctaaagcaaaatactggtctcagggccggsaagtgcagcttcagacgcaagccagatgaggcaaggctccaggttgggatgtgggatgtctgtgggcagtctaggtcttggtggggctagaaaacagagaaatgaggaggcccacagagtggggagggggacgatctgtggctcgggcatggcgactctgggcgggtgcggtgactcaccagctctggggtcggggctgcaactgccggtgcagggccacagagaagccgaagaggctgcctggctcgccctccttgcgcaaggcacccatcacgtccagattgaaggcgacagcccgtg

SEQ ID NO: 2026 - DNA, 601 bp, Human
ggactcatagagatacccagtgtcacagctggtcagtgcatagctaagcacccagataagttatccttgttctatgttcacatctcctctggaggccaaaagtagggaggaggggaggggcccatgtggaagaaagaagctgagtgcatagatatgcccagtccgctcttggtggagaagagaccaatcgatccttagtggaacaagagcacccagcagcatcctctctagtccctccacctctggtccagccacacacactccttcctggcttcatgccatacgccctaaccaccccagkcttctggacagccacagtgtagccactgcagagagaaaagcaaaaaaaaaaaaaaaaaagtgttggcagctggggggcagagggaccccctgggagctcagctaagtgaagacaaaggagtagcccacgaccactgcacttctcgattctccacacactccagggccccagcccaagtccagcccctctttggcccctctcaatctgggtggccctctggggaggatgcttggcctggaaggctggctcagccagggaggccctctagccaagcctttggatccagaatctctgtaaggc

SEQ ID NO: 2027 - DNA, 601 bp, Human
ttatatctccctgatgtacttggaatcataccatattcctaacttgtgttctctaagcacacctatgcgtatgcacacaccataaacacacacacacacacaccccatccgtgcattcagtcatgagaagcaatactcacaacaatcttgcccccaggcccctggctccgaacactgactcccaaccactggttctccttgctttccttttgcatatcagctagaggcaggacactgggaattaggggagggaagaggagcccaagtcctctcctccccgctcacacgcttcccccactcygttcatgcagggccacacctccctggtcgatgtccactctgtagcagtcagtctcctccaggctcaacgggcaagcgaagaggcctccagtgcgattcgcctgctgcccaggaagagccagggcctggggagcacccaccagcagcctgcaagatggggcaggggcagggacagggacaggagttagaggtcagaatgacccaatctcattagagctgcccaggcccaacccctcagtactaaagagagtgttcaaggactaaagagaaggggcaaatgtcagttttctcaaaccctggc

SEQ ID NO: 2028 - DNA, 601 bp, Human
gatctccttacctcgtgatccacccacctcggcctcccaaagtgctgggattacaagcgtgagccaccgcacccggccacgcccggctaatttttttgtatttttaggagagacagggtttcgccatgttggtccggctggtctcgaactcctgacctcaggtgatccacctgcctcggcctccgaaagtgctgggattacaggcatgagccttcccctgtagtaactagcacaatgcctgatgcttaaaaggttctcagtaagagtttgacaaatggatggatgaatgaatggacagacrtttttacatttataaggacaaggaccatgtctcacacctttttatatctccctgatgtacttggaatcataccatattcctaacttgtgttctctaagcacacctatgcgtatgcacacaccataaacacacacacacacacaccccatccgtgcattcagtcatgagaagcaatactcacaacaatcttgcccccaggcccctggctccgaacactgactcccaaccactggttctccttgctttccttttgcatatcagctagaggcaggacactgggaattaggggagggaagagga

SEQ ID NO: 2029 - DNA, 601 bp, Human
agagagagagagagaaacagagagccctggttttttcgtttgtttgtttggttggttttgagacggaactttgctcttgtctcccaggctagggtacaatggtgcgatctcagctcactgcaacctcctccacccaggttcaagtgattctcctacctcagcctcccgagtacctgggattacaggcgcctgccaccacacctagctaatttttttttttttttgagacggagtctcgctctgtcacccaggctggagcgcagtggcgcgatctcagctcactgcaagctccgcctctccrgttcacgccattctcctgcctcagcctctctgagtagctgggactacaggcgcccgccaccacgcccggctaattttttgtgtttttagtagagacggggtttcaccatggtctcgatctccttacctcgtgatccacccacctcggcctcccaaagtgctgggattacaagcgtgagccaccgcacccggccacgcccggctaatttttttgtatttttaggagagacagggtttcgccatgttggtccggctggtctcgaactcctgacctcaggtgatccacctgcctcggcctccg

SEQ ID NO: 2030 - DNA, 601 bp, Human
agtgatctgtattggtaattgtgtatctatgcgtgttactgaaagatagagagagagagagaaacagagagccctggttttttcgtttgtttgtttggttggttttgagacggaactttgctcttgtctcccaggctagggtacaatggtgcgatctcagctcactgcaacctcctccacccaggttcaagtgattctcctacctcagcctcccgagtacctgggattacaggcgcctgccaccacacctagctaatttttttttttttttgagacggagtctcgctctgtcacccaggcyggagcgcagtggcgcgatctcagctcactgcaagctccgcctctccggttcacgccattctcctgcctcagcctctctgagtagctgggactacaggcgcccgccaccacgcccggctaattttttgtgtttttagtagagacggggtttcaccatggtctcgatctccttacctcgtgatccacccacctcggcctcccaaagtgctgggattacaagcgtgagccaccgcacccggccacgcccggctaatttttttgtatttttaggagagacagggtttcgccatgttggtccggc

SEQ ID NO: 2031 - DNA, 601 bp, Human
ggagactagaccactcacttaacatgaaccagattctgccccacagtgatctgtattggtaattgtgtatctatgcgtgttactgaaagatagagagagagagagaaacagagagccctggttttttcgtttgtttgtttggttggttttgagacggaactttgctcttgtctcccaggctagggtacaatggtgcgatctcagctcactgcaacctcctccacccaggttcaagtgattctcctacctcagcctcccgagtacctgggattacaggcgcctgccaccacacctagctaatttttttttttttttgagacggagtctcgctctgtcacccaggctggagcgcagtggcgcgatctcagctcactgcaagctccgcctctccggttcacgccattctcctgcctcagcctctctgagtagctgggactacaggcgcccgccaccacgcccggctaattttttgtgtttttagtagagacggggtttcaccatggtctcgatctccttacctcgtgatccacccacctcggcctcccaaagtgctgggattacaagcgtgagccaccgcacccggccacgcccggctaatttt

SEQ ID NO: 2032 - DNA, 601 bp, Human
tacacacacacccctatgccggcaccactcaagcaccattaccctgccagtgttacacaggtccatgcataacccagcaacctgtctgcacccacttccttgccctcaaatggagatctccttgttccacattctgcctggagccaaaagacacaattaagccaccacataggatgtgtgtctccctgatcatgtcacagtcctccaaaatgccaagcttggccctgtccctggacctttgtaagtgtcaccatctcatctgcaaagaacttcctgtccgcttcactctccaagtattacttttttttttttttgaagcaaggtctcactctgtcacccaggctggagtgcagtggcacaatcatggctcactgcagcctcgacctccagggctcaagtgatcctcccacctcagcctcctgtgtagctgggactacaggcatgcaccaccatgactggctaatttgtttttattttttataaagatgaggtcccactatgttgcacaggctaggtattacctattattaaagcctggctcaaatcatcccctctgcagaagtcttctctctactcctcctttggacttttatagactgga

SEQ ID NO: 2033 - DNA, 601 bp, Human
atttgggcccaatgtatgtctccctgggtgtgtgttgggggaggaggagattataaggcaccaaaggtcgagttccctggggaaggaggggaggctgggccatgcccctagagtccaggaggtgggagcttacaaacctaagtagctattgagggccaagtctccggctggtcctgggagccggtcagcagggtccaaagttttatacaccagctggtcggggtctgagctatcaatgttggtcacaaaaagcaaccctgtggggggtggggtgagacaccagggaggggacatccagagkaggggccacagagtagggagacagagccacagaaaggccagaaaatggtggaagaagaagaggtggagagagaaaaagagaccagagagatcacagccagagacagaaagacagagagagacaaggtgagagacagaaacagagacagaaggatgggagcatggagagagaggacaagagagaggagcagagggttagagcagttctgggccggggagaggtccctaccaaagtagctgttggcagggaccgggatgaggcgggggtcctgctccttctctccccccgcctcgtagggac

SEQ ID NO: 2034 - DNA, 601 bp, Human
ccacaaagctcagctcttctgcacgcaccagacctttccccgagtcaatagagaagcctgggggaagggtgacttacccctaagtcttcaccccaagactcagaagctggggtgtgtcacagctcccccagcccctgccccctccctacaggttaagagccaagtcacagctcccctgcaccctgccccctcccctaggttaagagccaaaagataggtccccccaagtcatcagcaccacagctggatagctcttcctccccacagggcctggcagcctcccacacccaccaggcccagrgacaagcttggcacaaaaagtgcagtgaggtcagcctcagggactgggcaagagagagaaaggtgatggctgagaaggccaggagcccaggtaggaggctgagcacagtggcctcaccctgcccacacccagggagctagaagagctagaggtccctctcaggcccgaatcccacccagtgcacctctttcccccaactccctcatcctggcagggaggggaagtcttcacatggatgagggggagacaagggggagtgagagagcgcctgcttcacccaaacatctcccaggcctggtt

SEQ ID NO: 2035 - DNA, 601 bp, Human
cagtgtgggtcctccctggccagaggagccagcaggaggctaagtggcctcagccagactggggctactagacccagcctccctcaggtggcacggccctctacccactcacccatcactgttgaggtcagccacagccagtgagtagccaaagccggaggtcaggcgctccccagacagcataacctcgggcaccaggcgactggcgctgtccttgcgcaggatgaccacagcacccttgtggttggcgcggggggctccagccacaaagctcagctcttctgcacgcaccagacctttycccgagtcaatagagaagcctgggggaagggtgacttacccctaagtcttcaccccaagactcagaagctggggtgtgtcacagctcccccagcccctgccccctccctacaggttaagagccaagtcacagctcccctgcaccctgccccctcccctaggttaagagccaaaagataggtccccccaagtcatcagcaccacagctggatagctcttcctccccacagggcctggcagcctcccacacccaccaggcccagggacaagcttggcacaaaaagtgcagtgaggtcagcct

SEQ ID NO: 2036 - DNA, 601 bp, Human
ggatgggtctggccctgggattggggagtcaagagcacaagaaacatgagaacatgaggctgggaaacactcttcagcattagatttggcactgaggtcggggtcagagtcacagggaggggctgacggcctcagggagggaaaaggttgagaggggctcacctgaagagcactgcggtgtcagccagggagcccaccagcaggtcagggtattggttcccatccatatccaagctgcctgacagggagtagccgaagctcttgatgcccacagcctcgccctccagcacctagagaaccrgctgtcagcctccctcaatcccacctcccgcaggcctctgcctcccctgatgcctctgctgattccacccacacccattccctcatcccagcgactcccctcacctgtgaaggtttggcgacaacccccaggctgctcccatggtagatgaagactttcccatcaccatcaaagggggcacccactgcaatatctgcagggcacagggaaaaggcagtcacgctggctgggggccttgcagacaagatccaggcctcaactccccccagtcactcaggtatgttttctattttattgaga

SEQ ID NO: 2037 - DNA, 601 bp, Human
ctgggccagccataaaaaccatgcaagcaaggggcctcatgttctcccttccagctgaatgggatgaatgtgacttcaagagcttgaaggccgcatttgaagattacagaatcccatcaacctgagccccctgaatgactacatggagtagaggagctctgtccccttgactaggaacatggtcatttaggcacctagagatatgaggaattactggagtagcatacgtgaaagggctctgtgagctgtgaattggtgtcactggggagggaccatgatctttgccctcccagctcctccycctgggctaaaccagaacccatgctcacctctgcccgctgggtgctgggctggtgggcattgaggatgggggccactggaggcagcccctggccaggagcctgtcgccggagccgaggggtctggagactgtaggacaaggtcactacaatggcccgaagcttgtctttgacattttcctaggaagaggaaggtctattcctcactggaacaatccccaggcctcagccctgctcagtgccccagccagacctaggaccaattctaaaacttggaaagaatattagggagatgaatgaga

SEQ ID NO: 2038 - DNA, 601 bp, Human
aatccttgaactcttgccctcccacccccaccctgctctctgcccccctcacatgggcagaggttggaattccgtgtcgctgacccgggtacagaagcgggcgcggaccagctgcagattgctctggcagatcttgtcttcaccacagccttgcttcaggaagtggatctggggagagacatgagataaggggcattcctagggggcaaggcagggggcaaacctgtcaccatggcatatggtgggttagagtatcacaggattaaacaacctgtcctcaactctcagatctgctgcttaytagccatgtgatcctgaactgggtcctctcctctgggtcctctcatcatggtagtgatgggagcactaccatgccatggtagagactagcagcaagtcaagagctgggccacactgccccagctcacatgcatgtaactgagttccggatttagaacgggaaaagatgtcaagggcaccacttctgggccagccataaaaaccatgcaagcaaggggcctcatgttctcccttccagctgaatgggatgaatgtgacttcaagagcttgaaggccgcatttgaagattacagaatcccat

SEQ ID NO: 2039 - DNA, 601 bp, Human
ccaatgagatgtatgtagactgcatattattagtgtactgtgaaggattgctattccttgccatgggagcccccgtggccccatcactgaccctcatctcagtctccaagtccatcggcaggtcctcttccaccttctgccttttctgcaggctcagcccttccctctgactggtcctcctgagagggctttctctcaatccttgaactcttgccctcccacccccaccctgctctctgcccccctcacatgggcagaggttggaattccgtgtcgctgacccgggtacagaagcgggcgyggaccagctgcagattgctctggcagatcttgtcttcaccacagccttgcttcaggaagtggatctggggagagacatgagataaggggcattcctagggggcaaggcagggggcaaacctgtcaccatggcatatggtgggttagagtatcacaggattaaacaacctgtcctcaactctcagatctgctgcttattagccatgtgatcctgaactgggtcctctcctctgggtcctctcatcatggtagtgatgggagcactaccatgccatggtagagactagcagcaagtcaagag

SEQ ID NO: 2040 - DNA, 601 bp, Human
acacgactgggagtcaggggacctccgttctcatctcagctccaccattacttaccttggccaagtaacttaacctctctaggcttcagttctccatctataaaatgagactaatataattcctacctcacagaggtttgaagactaaccaatgagatgtatgtagactgcatattattagtgtactgtgaaggattgctattccttgccatgggagcccccgtggccccatcactgaccctcatctcagtctccaagtccatcggcaggtcctcttccaccttctgccttttctgcaggytcagcccttccctctgactggtcctcctgagagggctttctctcaatccttgaactcttgccctcccacccccaccctgctctctgcccccctcacatgggcagaggttggaattccgtgtcgctgacccgggtacagaagcgggcgcggaccagctgcagattgctctggcagatcttgtcttcaccacagccttgcttcaggaagtggatctggggagagacatgagataaggggcattcctagggggcaaggcagggggcaaacctgtcaccatggcatatggtgggttagagtatc

SEQ ID NO: 2041 - DNA, 601 bp, Human
gacagtggcagctcaatgaagacacgggctcgtgcagagactggatgcagctcctgctcactgatcctggtgagtgggcaggggcaagtatgggcatcaggcacaggcacctcccaaggggtcagatgaggtcaatatgactacccccacctcacccttccggccccgcctggcttacgtggccaacagcagctctacctccagttccgtggtctcaatgctgatcccggaggtgctaaggatgaggtagaaggtgacctaggccaagggtggaaagagattagagtcaggggtggtctaygggcttatggagaggctactcacgtagggataagggcagatgtgccaacctgggcacctctcttcatggggttccccagctcacactcaacatgggaggcattctcattggacaggcagagtggcttctcctggaatgggagagaaggcaaggtcagtctgggttactggagcccctcaagaccccaccccatcctgcccccaggtcctcaccgcagggtccagggcccggacccctgagtagtgcagtgagtcaggaagcatgaccaggagctgggcttcatgggcatcatccccatca

SEQ ID NO: 2042 - DNA, 601 bp, Human
ttctggcgtggagaggtcagaacaggggtgagaaggtctggggcctggctcaatgaaggcagggccctggccaaggtttggaaatgtcaatgccccctccctccaatggaggtgcccccttgggccaggctcaccctgcaatggacagtggcagctcaatgaagacacgggctcgtgcagagactggatgcagctcctgctcactgatcctggtgagtgggcaggggcaagtatgggcatcaggcacaggcacctcccaaggggtcagatgaggtcaatatgactacccccacctcacccytccggccccgcctggcttacgtggccaacagcagctctacctccagttccgtggtctcaatgctgatcccggaggtgctaaggatgaggtagaaggtgacctaggccaagggtggaaagagattagagtcaggggtggtctacgggcttatggagaggctactcacgtagggataagggcagatgtgccaacctgggcacctctcttcatggggttccccagctcacactcaacatgggaggcattctcattggacaggcagagtggcttctcctggaatgggagagaaggcaaggtcag

SEQ ID NO: 2043 - DNA, 601 bp, Human
gccccatcactgcactcactacccttactccccataacatctgtccccacatctaacccccacccccacctaagcctcaccaggtggaggatgttgggcctgggagagcaaagccctttctgcccaggcccctgcccgccctccagctcaacctgcattgggtacagcaaccacttcccattggcaatctcatgaggccacatgatgttgaggaaggcagagcccagggttctgagcgactggccttggttggaaacctgtgggaaaaagagagtatgaggggagagacctcagtttttcttttttttttttttttaattttttgtagagacaggatctatgttgcccaggcttgtctctaactcctgggctcaagtgatcctgccaccttggcctcctgtagtgctgtgattacaggcatgagccaccgtgcccagccaaggaactcagctttcaagtggatcctaaatccacagagatggaaggaacaagggctgaagagaaggccctcaggaaacacaatttcaacaaatactcaggatcctagaccccaccaggcaccattctctccacccaccaaatccgggaaaccctggaagtg

SEQ ID NO: 2044 - DNA, 601 bp, Human
attgaacaatgagaacacatggacacaggaaggggaacatcacactctggggactgttgtggggtgggggcagtggggagggatagctttaggagatatacctaatgctaaatgacgagttaatgggtgcagcacaccagcatggcacatgtatacatatgtaactaacctgcacattgtgcacatgtaccctaaaacttaaagtataataataataaaattaaaaaataaaaaataaaaaaataaaataaaataaaaaagaatctactttagacattatgttaagcaaagtaagccagaytcagaaagataaatactgcattatctcacttatatgtggaatctgaaagttgaactcatagaagtagagagtagaatagttgttacctagggctggagtggaggcggggtgtggctggggagatggaggagatggtggtcaaaagatacaaagtttcagttagacagaaggaagagatatctatttaagagatctaatgcacaacatggggactgtagttaataacaacatattgtattcctgagaatcactaagagaatagattttaagtgttcttaccacaaaaataagtatgtgagg

SEQ ID NO: 2045 - DNA, 601 bp, Human
cccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcattctcactaaactatcacaagaacaaaaaaccaaacaccgcatattctcactcataggtgggaaytgaacaatgagaacacatggacacaggaaggggaacatcacactctggggactgttgtggggtgggggcagtggggagggatagctttaggagatatacctaatgctaaatgacgagttaatgggtgcagcacaccagcatggcacatgtatacatatgtaactaacctgcacattgtgcacatgtaccctaaaacttaaagtataataataataaaattaaaaaataaaaaataaaaaaataaaataaaataaaaaagaatctactttagacattatgttaagcaaagtaagccagatt

SEQ ID NO: 2046 - DNA, 601 bp, Human
cctcacgacccatttgcctgaaagttatgttatattcatcacaccacgatccagacacagaagaatggctttaagagtgtctgaattatttgagttatcttttattttgccacttttgagccattcaagaatccttagccaagctgtctaaaagcaaggccttctgcctttttagtaaaagaatctactttagtactagtaccaaaacagagatatagatcaatggaacagaacagagccctcagaaataacgccacatatctacaactatctgatctttgacaaacctgagaaaaacaascagtggggaaaggattccctatttaataaatggtgctgggaaaactggctagccatatgtagaaagctgaaactggatcccttcctaacaccttatacaaaaattaattcaagatagattaaagacttaaatgttagacataaaccataaaaaccctagaagaaaacctaggaattaccattcaggacataggcatgggcaaggacttcatgtctaaaacaccaaaagcaatggcaacaaaagccaaaattgacaaatgggatctaattaaactaaagagcttctgcacagcaaaagaaa

SEQ ID NO: 2047 - DNA, 601 bp, Human
cccaatcaccacctcacgacccatttgcctgaaagttatgttatattcatcacaccacgatccagacacagaagaatggctttaagagtgtctgaattatttgagttatcttttattttgccacttttgagccattcaagaatccttagccaagctgtctaaaagcaaggccttctgcctttttagtaaaagaatctactttagtactagtaccaaaacagagatatagatcaatggaacagaacagagccctcagaaataacgccacatatctacaactatctgatctttgacaaacctragaaaaacaaccagtggggaaaggattccctatttaataaatggtgctgggaaaactggctagccatatgtagaaagctgaaactggatcccttcctaacaccttatacaaaaattaattcaagatagattaaagacttaaatgttagacataaaccataaaaaccctagaagaaaacctaggaattaccattcaggacataggcatgggcaaggacttcatgtctaaaacaccaaaagcaatggcaacaaaagccaaaattgacaaatgggatctaattaaactaaagagcttctgcac

SEQ ID NO: 2048 - DNA, 601 bp, Human
ggacaaaggaagactccgtctcaaaaaaaaaaaaaaggggggggatgctgcatttggacagtgaggaaggaggaggagaaatgagtcctggaggggctttggaggaagaagaaacacagactagagccgagtggtatcctcacctccagaaaggtgctgttccagagacggccccagacatgcagcacagccgcgcggtcaaagctgtagagtgggcagctgaacaccacacagttggccgtgccccgggcgcagtcctagggataaggacagacaggggtctaagccactcagctcaacsctgctgagactgccatctctcccattttccttacttgacctcaaactcccctcctccaggaagtcttctcaaactaatcttatatccaaaatagctgcctgccccaaatctgagctattcagctttgaaatgcgtggagggggcagcatggaagggaatctcttacttgacagcacaggcagagtagcttccccaagtgatgcttatgttacctaatgacagtcccatttattgagcacctactacttgtcaggcacttatctcacttaagcttcgcaatagtcctacaaggtgcacatt

SEQ ID NO: 2049 - DNA, 601 bp, Human
ggaggccaaggagggtggatcacctgaggtcaggagtttgagatcagcctggccaacatggcaaaaccccgtctctatgaaaaatacaaaaatatcgggtgtggtggcacgtgcctgtaatctcagctactcaggaggctgaggcaggagaacctcttgaacctgggaggcagaggttgcagtgagctgagatcgcaccactgcactccagcctgggggacaaaggaagactccgtctcaaaaaaaaaaaaaaggggggggatgctgcatttggacagtgaggaaggaggaggagaaatgrgtcctggaggggctttggaggaagaagaaacacagactagagccgagtggtatcctcacctccagaaaggtgctgttccagagacggccccagacatgcagcacagccgcgcggtcaaagctgtagagtgggcagctgaacaccacacagttggccgtgccccgggcgcagtcctagggataaggacagacaggggtctaagccactcagctcaaccctgctgagactgccatctctcccattttccttacttgacctcaaactcccctcctccaggaagtcttctcaaactaatcttat

SEQ ID NO: 2050 - DNA, 601 bp, Human
ttaagagtatgctgcgtttgggctgggcacagtggctcacacctgtaatcccagcactttgggaggccaaggagggtggatcacctgaggtcaggagtttgagatcagcctggccaacatggcaaaaccccgtctctatgaaaaatacaaaaatatcgggtgtggtggcacgtgcctgtaatctcagctactcaggaggctgaggcaggagaacctcttgaacctgggaggcagaggttgcagtgagctgagatcgcaccactgcactccagcctgggggacaaaggaagactccgtctcaaaaaaaaaaaaaaggggggggatgctgcatttggacagtgaggaaggaggaggagaaatgagtcctggaggggctttggaggaagaagaaacacagactagagccgagtggtatcctcacctccagaaaggtgctgttccagagacggccccagacatgcagcacagccgcgcggtcaaagctgtagagtgggcagctgaacaccacacagttggccgtgccccgggcgcagtcctagggataaggacagacaggggtctaagccactcagctcaaccctgctgagactgccatctctcc

SEQ ID NO: 2051 - DNA, 601 bp, Human
ttttttttgagacagagtcctgctcagtcccccaggttgcagtgcagtggcgcaatcttggctcactgcaacctccacctcccgggttcaagcgattctcctgtctcagcctcccaagtagctgggattacaggcaccccccaccatgcccagctaattttttttatttgtttgtatttttaacagagacaggatttcaccatgttggccagcttggtcttgaactcctgacctcaggtgatccactcacctcagcctcccaaagtgctgggattacaggcatgagccaccatgcccggcttttttttttttttttttttttgagatggagtctcgctctgtcacccaggctggagtgcaatggcgccatctcggctcactgcaaccccacctttcgagttcaatcgattctcctgcctcagcctcccaagtagctggatctacaggtgcgtgccaccacgcccagctaattttgtattttaagtagagatggggtttcaccatgttgtccaggctggtctcgaactcctgacctcaagtgatccacctgcctaggcctcccaaagtgctgagattccaggcatgagccactgcacccagc

SEQ ID NO: 2052 - DNA, 601 bp, Human
acttgccaaagggtggctcagtctctgattggtcccaaagagcaggcacaggcaggggcagttctccagagccccaaggacatgtgtggttctgaacatagcccccgatgtggcagatggctcagcatatgaccccggtgatgtatgtgattccgtgtactgacgtgtgcatgtgcatacttttacattgagccctggataccagtatgattcggtatacagctctgggtgtacaagaatgcttccatgcagagcctggtatgtggaagctctgagttccgccatgagggcagtcccctgsaggccgttctccgtgcttgttggccttcttggccacatttacctttccagttttcactgccacattctagttaagtcagatcacacttctctgcctccacgactttgcctaccatggtcctgctggaccccacctacctcatccccttacatcctcaccctactaccccaccttcctctgaggactggttccagtgctacctcctctcaagcttttttccctctaaactcccactccattttctcaactcaacacttcctgccttgtccttgactacaggctcaccactcccatcccact

SEQ ID NO: 2053 - DNA, 601 bp, Human
acactaggatgtcgagggagaagcagggcagaggaagcagaggatggaaagattgaggaaggacaggatcccctatctctgctctgtcttccttccatgggagcagggagcaagcatcctgggaccagtttcacagaggcatcaatctcccctaagactgggaaggttcccaacagcttggatgccactccagagcctggtctactgatgattcacacttgccaaagggtggctcagtctctgattggtcccaaagagcaggcacaggcaggggcagttctccagagccccaaggacatgkgtggttctgaacatagcccccgatgtggcagatggctcagcatatgaccccggtgatgtatgtgattccgtgtactgacgtgtgcatgtgcatacttttacattgagccctggataccagtatgattcggtatacagctctgggtgtacaagaatgcttccatgcagagcctggtatgtggaagctctgagttccgccatgagggcagtcccctggaggccgttctccgtgcttgttggccttcttggccacatttacctttccagttttcactgccacattctagttaagtcagatcac

SEQ ID NO: 2054 - DNA, 601 bp, Human
tctcatgcaatctcatttttcaccctgaacattcctgatcccctgaatgctgggaattctccttatattcacacacatacatacccacacacactagacacatgcacacacacaacagttaccccacagtccctggacccccaacttccatggctgaaggctgcacagccagacaggcccggtgatagttggtgggaaaagatgagctctggctgctccgatggaagaagccacactaggatgtcgagggagaagcagggcagaggaagcagaggatggaaagattgaggaaggacaggakcccctatctctgctctgtcttccttccatgggagcagggagcaagcatcctgggaccagtttcacagaggcatcaatctcccctaagactgggaaggttcccaacagcttggatgccactccagagcctggtctactgatgattcacacttgccaaagggtggctcagtctctgattggtcccaaagagcaggcacaggcaggggcagttctccagagccccaaggacatgtgtggttctgaacatagcccccgatgtggcagatggctcagcatatgaccccggtgatgtatgtgattc

SEQ ID NO: 2055 - DNA, 601 bp, Human
tctcacctcacatcactctcatgcaatctcatttttcaccctgaacattcctgatcccctgaatgctgggaattctccttatattcacacacatacatacccacacacactagacacatgcacacacacaacagttaccccacagtccctggacccccaacttccatggctgaaggctgcacagccagacaggcccggtgatagttggtgggaaaagatgagctctggctgctccgatggaagaagccacactaggatgtcgagggagaagcagggcagaggaagcagaggatggaaagaytgaggaaggacaggatcccctatctctgctctgtcttccttccatgggagcagggagcaagcatcctgggaccagtttcacagaggcatcaatctcccctaagactgggaaggttcccaacagcttggatgccactccagagcctggtctactgatgattcacacttgccaaagggtggctcagtctctgattggtcccaaagagcaggcacaggcaggggcagttctccagagccccaaggacatgtgtggttctgaacatagcccccgatgtggcagatggctcagcatatgaccccg

SEQ ID NO: 2056 - DNA, 601 bp, Human
tttgaagaatcccatctataaggacaccaggccagaccatgaggagcctgaagagctgcggtccctggagcagatgcctagcgcggcacagctcctcaccctcaccatccctgctgcggcagaaaggaaataggctgaatagcatctggtgtggtgggcagcacccacggtgctcccatcagtgctgtgtccccaggttctcattcacagcaagagagagaccagaagggcgtccaagaggcaggaccaagggtatctcccttggcccctgaaagagggccttgagggtggagcatcaggwccggactcaagatttgtaccccctctagcttcttaagagacccaatagtgtcccccagaacacaaacaagacctgaggaagaaaatggcttcctagtcccctgcatctctggaatgatacctctcaagcctcataaacatgcaccccgtgtacttgtaccttgggcggcacgccccttacagcaataccctcttgtccatcaatacagtagtctagccccaccctaaatgaggaccatgctggcccttacacaccagggtgggaatgtgcccctgcacactcacactcagaggcccagga

SEQ ID NO: 2057 - DNA, 601 bp, Human
gagccatctctggggaagggatggagggcagccacaggccaggctgggacatgggaacctaggcggtgcctggccctggatgcccatcggggcccagctcgggatgcccgtcagcagccaggatggggtgtgcatccgggccctcccgccgggggctgccccagttgttcctcaggatggtgcccgtcttctcctccttgaactgctgtcggtcttcccgaggaatcttcaccgcatggtactggggcacggtggcctcggggtgcttcgcccgtttgaagaatcccatctataaggacascaggccagaccatgaggagcctgaagagctgcggtccctggagcagatgcctagcgcggcacagctcctcaccctcaccatccctgctgcggcagaaaggaaataggctgaatagcatctggtgtggtgggcagcacccacggtgctcccatcagtgctgtgtccccaggttctcattcacagcaagagagagaccagaagggcgtccaagaggcaggaccaagggtatctcccttggcccctgaaagagggccttgagggtggagcatcaggaccggactcaagatttgtaccccctct

SEQ ID NO: 2058 - DNA, 601 bp, Human
tggctgacagaactggcaacacgaagcctcagccgcccttcccaacaagcctggggccctgacccaccgagcaagactcctttcctggaggagctgccactctctaacctctggctctaactgagccccatcagagacagacagtcaaggctgtagtctgcagacacctggctggagctgagggcacagcagcccctcgaagcagcgggtgagaggacttactggctatgcagagcagagtgtggaagagccacatccttgctggagcagaggcggctgtgtgggagccgaggcgagtgcracacatgggccgtggcccactcagcttcccctcagccaggaggccaggaggcggggacagaagcacacacaccagcaaggacccacagaccggcactttcaaccaaacagagacactccggctcgtacacaaccagccgtgtggcttcctcagttgtgggctggaccctaggagcttaggggccactgtcagccccactctaccacccacactttgacccacactttcatggaatagggagctgaggtttggccagggccacagttctaggtgtcctcagcagatgctggaggtgcagga

SEQ ID NO: 2059 - DNA, 601 bp, Human
gactgggtaggatggatagagtttaatgagtgaatcaggttcattcattcattcattcattcattcattcaaatggcatttattgagtacctaatatatgtcaggccccatgctagttactagggtggccacagttagactgaatatgtagggggtgaattgcactgaggtgtgatgacttgcatcaggaagggctagagtttcgaatcagccaccaacactaaaagtgtgaactttgtcatactggcaaccaaaagacctacattctctgaactgtagcttcctctcttataaatggcgyggttttgaggatgaaaacagaatgactcagaggactgccgggcacagggtgggcacgcaatacgctgtaggtatcatttctgttgctaggactgtgtcaggaaaggtggctggggattaggattgggttggggtgggactgggcattgggatggaatcttgctgtgggttatgctggagtctaggggtgaacgggctggatgaggcagggctggggttggaatggtttgagtttagatgagggggattttgctagaaagggggtcctggggagcattccctggagttggggctgacttac

SEQ ID NO: 2060 - DNA, 601 bp, Human
ctcagagaagcctctagaaagctagagcgggggccttcaaggtcaggactggacacgttcagggccgagtgcccatccccggggctcatttgctgaccctttcaacacgtgcccattgacgtctgctctgtgcccagccttgtgagcgtggtgatgggcgtccagcaacagcggatgcctgctgcttttcctcagtgggtttggtcgggcaggtgggtggagaagcactgcctggtgggtatgtaagtgccaaggaatgtgcaagataccgtgggactggctgtgtggaccaaggaacccsccagcctcacagacccatcctggggaatcttactgcccccagcctcaggggcagaaatggtagctccttcctcgtcctccccactgtcagcctcaggatactgtcttatttttcagtcatggaatcactcagtcaaccctgctggactgagattgagtctgttcaactcagtgcctctcagacaaggattttttttttttttttttttttttttgagacagagtcttgctctgtcgcccaggctggagtgcagtggcgcaatctcggctcactgcaagctccgcctcccaggttcacgcc

SEQ ID NO: 2061 - DNA, 601 bp, Human
ggaggaggaggggactctgggaggcagagacccgaagccaaggtcagagggcacagagccaccttggtcaggcccccatgaggaactgttggccactcagagaagcctctagaaagctagagcgggggccttcaaggtcaggactggacacgttcagggccgagtgcccatccccggggctcatttgctgaccctttcaacacgtgcccattgacgtctgctctgtgcccagccttgtgagcgtggtgatgggcgtccagcaacagcggatgcctgctgcttttcctcagtgggtttggtygggcaggtgggtggagaagcactgcctggtgggtatgtaagtgccaaggaatgtgcaagataccgtgggactggctgtgtggaccaaggaaccccccagcctcacagacccatcctggggaatcttactgcccccagcctcaggggcagaaatggtagctccttcctcgtcctccccactgtcagcctcaggatactgtcttatttttcagtcatggaatcactcagtcaaccctgctggactgagattgagtctgttcaactcagtgcctctcagacaaggattttttttttttttttt

SEQ ID NO: 2062 - DNA, 601 bp, Human
attcccgagccacagccacattctcacccccattccagaactcagtggctcaaccaggcagggggcacaggaagagctggcccacccctcaccgggtgtaggagtcagtgttggcatcaaggccgaggccgacacctgcaggagtgtgctgggtcacagggaatacctaggtcagccctggtatcagggtggtcagagctacagtcagccctggggttggcaccagggagacgctagactcagcctcgggaacagcatggcagtcagaactggtctcaacaccagggtcaaccacgagggstagcaccagcctccctaaggccctccctcctctcgctcctgcactcaccaaaacaccgtggtggctccggacaacggtcactccccggtgcctccccttggggatggggacatgctctgaaaaagttaagcccaggtgaggaggaggaggggactctgggaggcagagacccgaagccaaggtcagagggcacagagccaccttggtcaggcccccatgaggaactgttggccactcagagaagcctctagaaagctagagcgggggccttcaaggtcaggactggacacgttcagggcc

SEQ ID NO: 2063 - DNA, 601 bp, Human
tgtgggagggaagagagggtggggaaacaccaggtcacctcccgattcccgagccacagccacattctcacccccattccagaactcagtggctcaaccaggcagggggcacaggaagagctggcccacccctcaccgggtgtaggagtcagtgttggcatcaaggccgaggccgacacctgcaggagtgtgctgggtcacagggaatacctaggtcagccctggtatcagggtggtcagagctacagtcagccctggggttggcaccagggagacgctagactcagcctcgggaacagcrtggcagtcagaactggtctcaacaccagggtcaaccacgagggctagcaccagcctccctaaggccctccctcctctcgctcctgcactcaccaaaacaccgtggtggctccggacaacggtcactccccggtgcctccccttggggatggggacatgctctgaaaaagttaagcccaggtgaggaggaggaggggactctgggaggcagagacccgaagccaaggtcagagggcacagagccaccttggtcaggcccccatgaggaactgttggccactcagagaagcctctagaaagc

SEQ ID NO: 2064 - DNA, 601 bp, Human
ccagtgaatgtccaatccttaccaaggtcgaagaagttggcctgagcctggggacggaggtcagggcccaggaggctacaggtgcctgtgagttctgagctgaggctgtgaggccgccggaccagcacttgaatgcatatctgtgggagggaagagagggtggggaaacaccaggtcacctcccgattcccgagccacagccacattctcacccccattccagaactcagtggctcaaccaggcagggggcacaggaagagctggcccacccctcaccgggtgtaggagtcagtgttggcrtcaaggccgaggccgacacctgcaggagtgtgctgggtcacagggaatacctaggtcagccctggtatcagggtggtcagagctacagtcagccctggggttggcaccagggagacgctagactcagcctcgggaacagcatggcagtcagaactggtctcaacaccagggtcaaccacgagggctagcaccagcctccctaaggccctccctcctctcgctcctgcactcaccaaaacaccgtggtggctccggacaacggtcactccccggtgcctccccttggggatggggacatgc

SEQ ID NO: 2065 - DNA, 601 bp, Human
ccgtcacaaaatctatcaggcaagtgctattatttttctttcttttttagagacggcgtctcactctgtcacccaggctggagtgcagtggtgtgatcatggctcactgcatccttgaacttctgggctcaagcaatcctcctgcctcagcttcctgagtagctggaactataggcacaagccactgctccaagctgtgagtactattattattctcattttatttatttatttttattattattattattgagatagatggagtctcgctctgtcacccaggctggagtgcaatagcacsatctcagctcactgcaacctctgcctcccgagttcaagcaattctccctgcctcagcctcccgagtagctgggattacaggcacctgccaccacacccagctaactttgtattttgagtagagacggggtttcaccatgttggccaggctggtcttgaactcctgacctcaggtgatccacctgtgttggcctcccaaagtgctgggattacaagcatgagctaccacgctcagcctatttttctcatttttaaagtgaggaaactgaagcacaggtcacaaggtccttcagtttgcccg

SEQ ID NO: 2066 - DNA, 601 bp, Human
atagaacagggtctggataagctgcttacagaaaagcccccatcgacaaccctggcttctccccaccccaggctgtgcaggttcaggaggtgtctcccggctcctggctcttaccccaatggcaaagcgctcaacaccctgcattttgggggagttgatgactgtcgtaaggttgagggggtcctcgaatatgccaccatcggtgagcaccaccatgaccttggatgcctttctcctggagccgtggcttgaggtgaagatgctgtctctaagcaggggagagtaaatgaagaagagagcwttgccagaaggatgaccgagctccaggagagactttattctctgacctgtattagaattgggagggttcacaatcctcccgaaagacccagagaagggggtgatgcccccttaagtcacgcagcgaggctgggcagagggagggctgcaacacaggtgttcttgcttctcacctgctcccagcaggaaggtactgcctggcagtccattcctcttgtgtgcgtacaggaagactcatgatattaaaacgatagataatactcacatggcacttatcatgtgccaggcactgttgtaaaca

SEQ ID NO: 2067 - DNA, 601 bp, Human
ctccctgttctacccatactctgggcaaaattccagttttaccaaagtacacctgttctcctgaatacaccaagctcctcctcacctctgcacatgctgttccctctgcctgcagggcccctctctgcctcccctgtgccctaggccagctactcccatttgtctggcaggactcagcttggcaccacggtcctccaggaaccctccttggtgtgtttcctgtggctctcccaccactatttggccagtaagctgtgaccaccatggggaaatgagccctctctgggatgacagagcatgragagaagaggagcatttgcaaatagaacagggtctggataagctgcttacagaaaagcccccatcgacaaccctggcttctccccaccccaggctgtgcaggttcaggaggtgtctcccggctcctggctcttaccccaatggcaaagcgctcaacaccctgcattttgggggagttgatgactgtcgtaaggttgagggggtcctcgaatatgccaccatcggtgagcaccaccatgaccttggatgcctttctcctggagccgtggcttgaggtgaagatgctgtctctaagcagggg

SEQ ID NO: 2068 - DNA, 601 bp, Human
gcgagtcagcgctgcgtggattccccaggcccagggagagagctgagcccctccatctggcctctggggccctccattacctgtctccttccttcctttctcctcctttccctgctccctgttctacccatactctgggcaaaattccagttttaccaaagtacacctgttctcctgaatacaccaagctcctcctcacctctgcacatgctgttccctctgcctgcagggcccctctctgcctcccctgtgccctaggccagctactcccatttgtctggcaggactcagcttggcaccrcggtcctccaggaaccctccttggtgtgtttcctgtggctctcccaccactatttggccagtaagctgtgaccaccatggggaaatgagccctctctgggatgacagagcatgaagagaagaggagcatttgcaaatagaacagggtctggataagctgcttacagaaaagcccccatcgacaaccctggcttctccccaccccaggctgtgcaggttcaggaggtgtctcccggctcctggctcttaccccaatggcaaagcgctcaacaccctgcattttgggggagttgatgactgt

SEQ ID NO: 2069 - DNA, 601 bp, Human
tggccgcgggtctccgggccagcgcggctaacctggctgggagcaggggggcgttcggtggtctagtgcccgcctggccagagatgcaggcgggaaggtgagatggccaacactgggctcctgcctcgtgcccttgcactccctcctccgggagaagcaagcagcttggttgataagctgacccaggccgagtcctgttgcctggtctgtattcaggggaacaactggatgtttgagcacacagaaaaaagcgacctcctgtcatcaatatggccacccttttgttgcagtgagccgagaytgcaccgctgcactccagactgggcgacagagcaagactccgtctcaaaataaataaataaattaattaattaaaataaaatcgctcttttacaggaatcaccacaggtagggcagagccctggatgggaggcaggagtccctgaatcctaggtgtcctgggcccctcaccaatgggcaagcctgcctggtgctgagtcagccacgtacctcatccaggatctgagcactgaagccaatctgtgccagctggtagtgaagggcgtctccaaccgtgcctgcaagccaagaagcccagtga

SEQ ID NO: 2070 - DNA, 601 bp, Human
agaagagtggaggagcagcccaggccccacagcggaggaaactgcctagcaatcagacatgcagagctgaagcagagccctcgagctccactcaggagcctgagtttcacccagcccgggccctggcccactgtgcaccgtgggacccactcctttcccttgggggcctccagattccccatcggtcataaggggtggaggctttccccagcaggtacctgctctccctccagcactggcaggaagctggcctctctgccctccttctggagctcaaacacggccccatgatgtttgtacygtggagcccccgcgacgtaggagaggctgcaggtcttgtgcagcacggccacagcgtaacctggggcaagggtggtgtggctgtgaacacaccgtgtgctcccacctggcctctctcttggccccggcaccttcccagtcaggccttcaaagtggcctggggaggggggcaaaataggagagactgtctttctcactatgttaaaaatcggcatcagcgagcactctcactttgccagtcacacacatccccatcacacagatatgatgcacacgctgtctgtcacgtatgcagctttgc

SEQ ID NO: 2071 - DNA, 601 bp, Human
gggcgaggtggcttacgcctgtaatcccaacactttgggaggccgaggtgggtggatcacctgaggtcgggagttcaagaccagcctgaccaacatggagaaaccctgtctctaccaaaaatacaaaattagccgggtgtgtggcccatgcctgtaatcccagctacttggtaggctgaggcaggagaattgcttgaaccccggaggcagaggttgcggtgagccaagatcctgccattgcattgcagcctgggcaacgagagcaaaactccatctcaaaaacaacaaccacaaaaaaagrgatattagagatattatcatcaacgatcacccttgggtaagaaagtgggtgcggagagcgatgccgctgccccgcccagccgccatccagcctgagcacctccccatcactgcccactggtgccaggcagggccagggcactcccagcctccatcacctctgtgtcaggctgagtgccacagcctcagcaagctcatgaagatggagactctcccacctgctcgctgagacggtacacgtagactctgccttcttctccatgaacgtggtaaaatggagcagccaccagcaagaagtccg

SEQ ID NO: 2072 - DNA, 601 bp, Human
cgtgccaaggagaaagaaccatcctgtaaagcaaacaaacagctcagccctcaagaaggggtgctaggtgcccactccattgccaccccgatgcacgctcactgggccggtgggtgcccactccattgccacccaggatgcacgctcgctgggccggtgggttcccactccattgccacccaggatgcacgctcactgggccggtgggtgcccactccgttgccacccaggatgcacgctcgctgggctggtgggtgcccactccgttgccacccaggatgcacgctcactggccagggamcttcccaaggccatacagtgagcaccaggggaaagctggggtcctcctacctggaagttcaggagtcagagcccgcccccctctagttccatgggcaggggtgcattgctgcaaatgggaggcctgggtttcactcgtggctctgccacacacatgccaggtacacttgagcaagtctcggcatcactgaggctcgccgagccccagcttcctcacccgtaagatgagagtggcagctacctcccatagttactatgagaaacaagtgagatcctggactaaacgggctttgccaaccat

SEQ ID NO: 2073 - DNA, 601 bp, Human
caggtaccgccacaacctcccccgaacctgaaggggccgaggtgaagccctggtctggaacctccccccaacctgaaggggctgaggtgaggccctggtctggaagctccccctagcctgggggacttctttctttcactgggcattcccaacccccgagacctgcccagcacttaggactgaagccgacttggggcttgggtcatcatatctgagagaggtcagagccccagaggagaggaaggagagggccccatgggtcacctgcgaggggctggcggagaggccgtcccagtgtccrttgtagatatacacactgccgaagctggcaccatcatctgccccaaaaccttccaggggggccccgatggccacatctgtgagcttatcctgactgagatcccccatagccgccatggcaaagccaaagcgggcattggtgaacccggggtgcccactcagtatgcgtgccaaggagaaagaaccatcctgtaaagcaaacaaacagctcagccctcaagaaggggtgctaggtgcccactccattgccaccccgatgcacgctcactgggccggtgggtgcccactccattgccaccca

SEQ ID NO: 2074 - DNA, 601 bp, Human
cgtgtgggagtgagatgcctgggggccatccaggtggaggtgctcatgaggagctggaggtgggtggaagtgcctgttaatacatgcagtgtgagaggctggcaagggagccctggggaatgagagataaggcgcggaggtgctgggtgggagacaggagcgagggacagaaagagaggaagcagggacccgaggcaggtgggtggaaggagggggtataggccagggaaggagacaggtaccgccacaacctcccccgaacctgaaggggccgaggtgaagccctggtctggaacctccycccaacctgaaggggctgaggtgaggccctggtctggaagctccccctagcctgggggacttctttctttcactgggcattcccaacccccgagacctgcccagcacttaggactgaagccgacttggggcttgggtcatcatatctgagagaggtcagagccccagaggagaggaaggagagggccccatgggtcacctgcgaggggctggcggagaggccgtcccagtgtccattgtagatatacacactgccgaagctggcaccatcatctgccccaaaaccttccaggggggcccc

SEQ ID NO: 2075 - DNA, 601 bp, Human
gaggagcatcagttctaggggaagcaggtgctctcagatgggccgtgtgggagtgagatgcctgggggccatccaggtggaggtgctcatgaggagctggaggtgggtggaagtgcctgttaatacatgcagtgtgagaggctggcaagggagccctggggaatgagagataaggcgcggaggtgctgggtgggagacaggagcgagggacagaaagagaggaagcagggacccgaggcaggtgggtggaaggagggggtataggccagggaaggagacaggtaccgccacaacctccccygaacctgaaggggccgaggtgaagccctggtctggaacctccccccaacctgaaggggctgaggtgaggccctggtctggaagctccccctagcctgggggacttctttctttcactgggcattcccaacccccgagacctgcccagcacttaggactgaagccgacttggggcttgggtcatcatatctgagagaggtcagagccccagaggagaggaaggagagggccccatgggtcacctgcgaggggctggcggagaggccgtcccagtgtccattgtagatatacacactgccga

SEQ ID NO: 2076 - DNA, 601 bp, Human
atatcaaagccaccagccatggacatgccgaagtactggagtcctggggccaccgtggaggctctgatccgctgtggaggcagaaacacaaggcgtggggcgagggaagggagggaaacggggcggggagtcctttcatgatctatcccgatcagcatcgcaggcaccatccagccccagggagccccgagtctagaaccaggaaagagggagcaagctttcccagaggaagtggcatttggatggagcctcgtagggcaggtgggacttgacaggggagagtaagggaaagagtgaggcrtggggaaagagcagggccttctgagaagcagccagggccagggacggggtggaccacaggggattggggtacaaggaggcttgatgtggggcttggggatggggggtgtcaacaaaggttctgttgttttgaagtgacataatcaggataacactttagaaatggcactgaagacatggggtggaagatggagaggaggaggaagctgggtgggctgggagtgggatggcaaggcctgagctgggaccgcaggggtggggatagagagaaggggctggagttgggagacagctagaatca

SEQ ID NO: 2077 - DNA, 601 bp, Human
cctggcccagagtgcccacggtgatgtcggcaaggccgtcgccactaatatcaaagccaccagccatggacatgccgaagtactggagtcctggggccaccgtggaggctctgatccgctgtggaggcagaaacacaaggcgtggggcgagggaagggagggaaacggggcggggagtcctttcatgatctatcccgatcagcatcgcaggcaccatccagccccagggagccccgagtctagaaccaggaaagagggagcaagctttcccagaggaagtggcatttggatggagcctcgwagggcaggtgggacttgacaggggagagtaagggaaagagtgaggcatggggaaagagcagggccttctgagaagcagccagggccagggacggggtggaccacaggggattggggtacaaggaggcttgatgtggggcttggggatggggggtgtcaacaaaggttctgttgttttgaagtgacataatcaggataacactttagaaatggcactgaagacatggggtggaagatggagaggaggaggaagctgggtgggctgggagtgggatggcaaggcctgagctgggaccgcagg

SEQ ID NO: 2078 - DNA, 601 bp, Human
tggggcacaaaaactctgcaattcttggccaggcatagtggctcatgcctgtaatcccagcactttgggaagccaagatgggtggatcacgaggtcaggagttcaagaccagcctggccaacatggtgaaaccctgtctctactaaaaatacaaaaattagccgggcgtggtggcagacacctgtaatcccagctcctcaggaggctgaggcagaagaattgcttgaacctgggaggcggaggttgcagtgaaccaagattacaccactgcactccagcctgggcaaaagaggaagactcygcctcagaaaaaaaacaaaaaacaaaaaactctgcaatcacagccatcgctgagcactgtgctaaatactttgtatatattcgcttgcatgatcctcatagctctgggaggtaggtgctcttataattcctaggtaaggtcttagagttaaataacctgcccaaaggctgagagggctgagagctgaggttcaaacccagacgggcagactccagagcctgtgcccacaaccacggtgctggctccctccctcagtgcctaatgtctgcatggagctatttagagcagggcaaatgggtg

SEQ ID NO: 2079 - DNA, 601 bp, Human
gagtgaagggatagggctgctgctgtgtggagaatggagcgcaggggctggaagcaggaaaggctgtggcagcagtgtccagggagtgaagacagtgcctgcactggtctggaggcagagccaactaagacttgttgatgtggtggagaggaaggaaaagaggcatcaaagatgacgcctacgttttcatcctgaattgctgggtggatgatgatgccatttgctgagacagaaagcctgagggcaggatagatttgggggaatgaagggtggggggagataaaagctctgtttttctttytttttttttggagacggagtctcgctctgtcgcccaggctggagtgcagtggcgcgatctccgctcactgcaagctccgcctcccgggttcaccattctcctgcctcagcctcccgagtcgctgggactataggcgcccgccaccatgcccggctaattttttgtatttttagtagagatgaggtttcaccgtgttagccaggatggtctccatctcctgaccttgtgatccacccgcctgggcctcccaaagtgctgggattacaggtgtgagccactgcgcccagcaaaagctctgtt

SEQ ID NO: 2080 - DNA, 601 bp, Human
acagccagtgccaagggcctgtggcaggaacacttttggtttgtttgaggagcacaaaggtcagcatgcctggaatctaattagtgagacagaggatgggaggaggagatgggaatggaggggcgggaagggccaggccacgaagagccctgtaaagccatggtgaggaattgggattttactctaaataggagccgtggaggagtttcaggcagcagagtgaagggatagggctgctgctgtgtggagaatggagcgcaggggctggaagcaggaaaggctgtggcagcagtgtccaggragtgaagacagtgcctgcactggtctggaggcagagccaactaagacttgttgatgtggtggagaggaaggaaaagaggcatcaaagatgacgcctacgttttcatcctgaattgctgggtggatgatgatgccatttgctgagacagaaagcctgagggcaggatagatttgggggaatgaagggtggggggagataaaagctctgtttttctttttttttttttggagacggagtctcgctctgtcgcccaggctggagtgcagtggcgcgatctccgctcactgcaagctccgcctc

SEQ ID NO: 2081 - DNA, 601 bp, Human
gagaaacagggagatactatgtattggcaaggctatgagaaaaattaaaatactgttggccgagtgcggtggctcacgcctgtaatcccagcacttgggaggccgaggcgggaggatcacctgaggtcaggggttcgagaccagcctggccaacttggtgaaacatcgtctctactaaaaaactcaaaaattagctgggtgtggtggcgggcgcctgtaatcccacctacttgggaggctgaggcaggagaattgcttaaacctgggaggcggaggttgcagtgagccgacatcctgccayggcactccagcctgggtgacagagcaagactccatctcaacaacaacaacaaaaatacggtaataaggaccgagggctactgagactgggtggtcacagatggcgtggctgatgaggaggcatttcggttgagatttgttaacaagaaagagccagctgtgtgaggatctggggaagagcactccaggaagaaagcacagccagtgccaagggcctgtggcaggaacacttttggtttgtttgaggagcacaaaggtcagcatgcctggaatctaattagtgagacagaggatgggagga

SEQ ID NO: 2082 - DNA, 601 bp, Human
gagtctcagggtacagtggggaaagagacaagtttctgctttggtgggaaagcagacaacaagcaaataaacgagagaaacagggagatactatgtattggcaaggctatgagaaaaattaaaatactgttggccgagtgcggtggctcacgcctgtaatcccagcacttgggaggccgaggcgggaggatcacctgaggtcaggggttcgagaccagcctggccaacttggtgaaacatcgtctctactaaaaaactcaaaaattagctgggtgtggtggcgggcgcctgtaatcccacytacttgggaggctgaggcaggagaattgcttaaacctgggaggcggaggttgcagtgagccgacatcctgccacggcactccagcctgggtgacagagcaagactccatctcaacaacaacaacaaaaatacggtaataaggaccgagggctactgagactgggtggtcacagatggcgtggctgatgaggaggcatttcggttgagatttgttaacaagaaagagccagctgtgtgaggatctggggaagagcactccaggaagaaagcacagccagtgccaagggcctgtggcaggaa

SEQ ID NO: 2083 - DNA, 601 bp, Human
tcctttctgggaacagtctcctaatgagtttcaggtaaggaaagagaaaccaggcctccaacaggtgatccaatcccacctgggccggaggcacatagtgaggagggaaggggagaagacacaagtcagagagaaagaggagggtgtgtctcagaagcccccgcacacacgcacacacgtgggcatggagaaatggctgcctttttctgagtcttttttttttttctgagacggagtctcgctctgtcgcccagcgtggagtgcagtggtgcgatctcagctcactgcaagctccgtctcctgggttcatgctattctcctgcctcagcctcccgagtagctgggattacaggcacctgcccggctaattttttgtatttttagtagagacggtgtttcaccatgttaggcaggatggtctcgatctcctgaccgcgtgatctgcccgccttggcctcccaaagtgctgggattacaggcgtgagccaccgcgcccggccttctgagtcttttttttcagaaactcaacccttcaaccctgaggaagggccccagtgtccctcttcccaacagtgtcagctctaaaccccttctgagtgtg

SEQ ID NO: 2084 - DNA, 601 bp, Human
aagagaatggagagggaaagagggactctgaggagaaaaaccccaggacggcacagctggaagcaccgtggagatcccggggccgcctctcttactgtacagaacagaaccagctcagctagggagagacacttgcccagcatcgcacagcccatcgagctctgtgtcctggaagggacaggtctgttattttcttttttttttcttttttctttttttttttcctttgagacagagtctcgctgtcacccaggctggagtgcagcggcgcgatcttggctcactgcaagctccgcctccygggttcacaccattctcctgcctcagcctcccccgtagctgggactacaggcgcccgccaccacacctggctaattttttgtattttgtttagtggagacggcgtttcaccatgttagccaggatggtctcgatctcctgaccttgtgatccacccgcctcggcctcccaaagtgctgggactacaggcatctgtcaccacacctggctaatttttgtatttttagtagagacggggtttcaccgtgttagccaggatggtctcgatctcctgacctcgtgatctgcccacctcggcctc

SEQ ID NO: 2085 - DNA, 601 bp, Human
agacagaaggcccccagcctgcctgaggttccttgtggcccctcctgaacagtgtccccatgcaggtacttccctgcggctggactcctgcgtcggtttttcaaagatatttttctcaccgtcttctgacacctgaccagggtctctgagtgctcccgccccaaacccggagcagcacattcccaggactgagtcagccttctttagggaaggagggctcgggaaggggatcgagattgaagaagaaaataaggaggaagagagacaacaaagagaatggagagggaaagagggactctgmggagaaaaaccccaggacggcacagctggaagcaccgtggagatcccggggccgcctctcttactgtacagaacagaaccagctcagctagggagagacacttgcccagcatcgcacagcccatcgagctctgtgtcctggaagggacaggtctgttattttcttttttttttcttttttctttttttttttcctttgagacagagtctcgctgtcacccaggctggagtgcagcggcgcgatcttggctcactgcaagctccgcctcccgggttcacaccattctcctgcctcagcctc

SEQ ID NO: 2086 - DNA, 601 bp, Human
agcgtgaagttgagaagtgcctcacggaggcctgggaatgaagaccagaccttcccgatgaggtggggatgagccagccgcagacagaaggcccccagcctgcctgaggttccttgtggcccctcctgaacagtgtccccatgcaggtacttccctgcggctggactcctgcgtcggtttttcaaagatatttttctcaccgtcttctgacacctgaccagggtctctgagtgctcccgccccaaacccggagcagcacattcccaggactgagtcagccttctttagggaaggagggctygggaaggggatcgagattgaagaagaaaataaggaggaagagagacaacaaagagaatggagagggaaagagggactctgaggagaaaaaccccaggacggcacagctggaagcaccgtggagatcccggggccgcctctcttactgtacagaacagaaccagctcagctagggagagacacttgcccagcatcgcacagcccatcgagctctgtgtcctggaagggacaggtctgttattttcttttttttttcttttttctttttttttttcctttgagacagagtctcgctgtcacc

SEQ ID NO: 2087 - DNA, 601 bp, Human
taaggaaggctgtagactttaatccaattaacaatcactttgggggtaaatgtgtattcagaagaagaattcatgcatttgtttattggaataaacgatccatatagatccaaagttcgagatcctgtcagggtttgagtcccgacatactttttttaccccatgtctctgggcacctttgccaggagtaaacctttctagatggtcgtttctatctttttattcttccttttagttgttcacttttttgatgccaactgacattcaggccctcggtcctagttattatcaggtgaggtckgataacgcatgccaagaacactggcattcctgagttattaccaagaaaaacgtcagcaatgacagcatctccatcttccgtgccattacgtggttcttgatttattattattattattttgagatggagtcttgctcttgttggccaggctggagtacagtggcatgatttcggctcactgcaacctccctcccctggattccagcgattctcctgcctcagcctcccgagtagctgggattacaggcacccgccaccacgcccggctaatttttgtgtttttagtggagacagggtttc

SEQ ID NO: 2088 - DNA, 601 bp, Human
ctttctactttgatgtcatcataagaagaaataaacaataaaagtggtgagtcagaagtcctaagcatcttccaaataagccaggctgaagggacacgtccttcaagcaagctgccaagtgctttgggaaaaatctccttcattctactacggttttgtgtctatagctgctatggttcttatcccagtcacaaaggggtaaagaactggctcagacagaagggaagagtcacagccacacctgggtttatcaagttctttctctctcttttttttttttttttttgagatggagtctcgytctgtcgcccaggctggagtgcagtggctcgatcttggctctctgcaacctctgcctcttaggttcaaggttctcctgcctcagtctcccaagtagctgggactacaggtgcatgccaccacgcctggctaatttttgtatttttttttagtagagacagggttttaccacattggtcaggccggtctcgaactcctgacttcaggtgatcctcccacctcggcctcccaaagtgctgggattagaggcgtgagccactgcgcccaaccaaccaagatctttctcaaagcaacatggagg

SEQ ID NO: 2089 - DNA, 601 bp, Human
tccaaatatgagccactgcaccttgcaagaatactttctactttgatgtcatcataagaagaaataaacaataaaagtggtgagtcagaagtcctaagcatcttccaaataagccaggctgaagggacacgtccttcaagcaagctgccaagtgctttgggaaaaatctccttcattctactacggttttgtgtctatagctgctatggttcttatcccagtcacaaaggggtaaagaactggctcagacagaagggaagagtcacagccacacctgggtttatcaagttctttctctctcttttttttttttttttttgagatggagtctcgttctgtcgcccaggctggagtgcagtggctcgatcttggctctctgcaacctctgcctcttaggttcaaggttctcctgcctcagtctcccaagtagctgggactacaggtgcatgccaccacgcctggctaatttttgtatttttttttagtagagacagggttttaccacattggtcaggccggtctcgaactcctgacttcaggtgatcctcccacctcggcctcccaaagtgctgggattagaggcgtgagccactgcgcccaa

SEQ ID NO: 2090 - DNA, 601 bp, Human
tttccaaatatgagccactgcaccttgcaagaatactttctactttgatgtcatcataagaagaaataaacaataaaagtggtgagtcagaagtcctaagcatcttccaaataagccaggctgaagggacacgtccttcaagcaagctgccaagtgctttgggaaaaatctccttcattctactacggttttgtgtctatagctgctatggttcttatcccagtcacaaaggggtaaagaactggctcagacagaagggaagagtcacagccacacctgggtttatcaagttctttctctctcttttttttttttttttttgagatggagtctcgttctgtcgcccaggctggagtgcagtggctcgatcttggctctctgcaacctctgcctcttaggttcaaggttctcctgcctcagtctcccaagtagctgggactacaggtgcatgccaccacgcctggctaatttttgtatttttttttagtagagacagggttttaccacattggtcaggccggtctcgaactcctgacttcaggtgatcctcccacctcggcctcccaaagtgctgggattagaggcgtgagccactgcgccc

SEQ ID NO: 2091 - DNA, 601 bp, Human
ctaatttttgtatttttagtagagacagggtttcgccatgttggtcaggctggtctcgaactcctgacctcaagtgatccacccgcctcagcctcccaaaatgctgggattataggcgtaagccaccgcgcccggcctcttttctttttttttttttttaagataaggtctcactcactctgtcacccagtctggagggcagcagcaccatgatggctcactgcagcctcaaccacctgggctcaagcaattcacccaccttggcctcccaaagtgctgggatttccaaatatgagccacygcaccttgcaagaatactttctactttgatgtcatcataagaagaaataaacaataaaagtggtgagtcagaagtcctaagcatcttccaaataagccaggctgaagggacacgtccttcaagcaagctgccaagtgctttgggaaaaatctccttcattctactacggttttgtgtctatagctgctatggttcttatcccagtcacaaaggggtaaagaactggctcagacagaagggaagagtcacagccacacctgggtttatcaagttctttctctctctttttttttttttttt

SEQ ID NO: 2092 - DNA, 601 bp, Human
aaaaatgttaatgtcattaaaagacaagggaagactgagtgagaaacccttccagattaaaggagactaaagataaataactgtagaacgctatgaatgatcctggaccagaaccttttttttcttttgctataaaggacattaataggacaactggcaaaatttgaataaagtttgtaaattagataatagtattttatcaatgtgaatttcctgattttgattattgtactatgttaagacaatgcctttgtttttaggaaatatatattgaaggtttgtggtttttttttttttttttgagacggagtctttctctgtcactcaggctggagtgcagtggcacgatctcggttcactgcaaccactgtctcccggggtcaagcaattctcctgcctcagcctcctgagtagctggaactacaggcatgcaccaccacactgggctaatctttgtattttttaaaatttattttattttttatttttttgagatggagtctcgctctgttgcctaggctggagtgcaatggcacggccttggctcactggaacctctgcctcctgggcaaaggattcaaatgattctcctgcctcagcc

SEQ ID NO: 2093 - DNA, 601 bp, Human
acaatcgcaaggcatctcaccataaaatgagacgtgcttattaatgacacaggcaaacagcactaggaatggacaagtccacattaggtgcctcctgagatggtgtactgagaaggacacactttacttctgtgatattcctgacaaaaatgcataacctggccaggcatggtggctcacgtctgtaatcccagcactttgggaggccgaggagggtagatcacctgaggtcaggtgttcaagaccagcctggccaacatagtgaaaccccgtctctactaaaagtacaaaaattagccgrgcatggtgatacatgcctgtaatcccagctactcgggaggctgaggcaggagaattgcttgaacttgggaggcagaggttgcagtgagccgagatcacgccattgcactccagcctgggcaacaagggcgaaactctgtctcaaaaacaaaacaaaaatgtataacctgaatctaattatgaagaaatatcagacaaattgaggaacattctacaaaaggactggcctgtacccttcaaaaatgttaatgtcattaaaagacaagggaagactgagtgagaaacccttccagattaaagg

SEQ ID NO: 2094 - DNA, 601 bp, Human
gcttgaaagggaactttctacttcctgcggaagggggatgccatttgcagaagtcaaagcgtggcgctctctctaagtgggtcaacagtttcatgcagggttttttgttgtattttttttttttttttttttttttgagacggagtctcgctctgtcgcccaggctggagtgcagtggcgcaatctccgctcactgcaagctccgcctcccgggttcacgccattctcctgcctcagactcccgagtagctgggactacagctgcccgccaccacgcccagctaattttttttttttttttgtatttttagtagagacggggtttcactgtgttagccaggatggtctcgatctcctgacctcatgatccgccagcctcggcctcccaaagtgctgggattacaggcgtgagcccccgcgcccggccttttgttgtatttttaatatagccacatagcctgatctcttccacccagccccagtgaaagagaatggggttaagccatctaaactcccagccagaacgcactctctggtaacaccgatgtgcctaataccacgtggttttttcctcacccattttatacggggaataactttt

SEQ ID NO: 2095 - DNA, 601 bp, Human
ggccacctcggcagctgtctgcaggtctgttcccacggcctagagggggaatgacagcccagggcttgaaagggaactttctacttcctgcggaagggggatgccatttgcagaagtcaaagcgtggcgctctctctaagtgggtcaacagtttcatgcagggttttttgttgtattttttttttttttttttttttttgagacggagtctcgctctgtcgcccaggctggagtgcagtggcgcaatctccgctcactgcaagctccgcctcccgggttcacgccattctcctgcctcagmctcccgagtagctgggactacagctgcccgccaccacgcccagctaattttttttttttttttgtatttttagtagagacggggtttcactgtgttagccaggatggtctcgatctcctgacctcatgatccgccagcctcggcctcccaaagtgctgggattacaggcgtgagcccccgcgcccggccttttgttgtatttttaatatagccacatagcctgatctcttccacccagccccagtgaaagagaatggggttaagccatctaaactcccagccagaacgcactctctggta

SEQ ID NO: 2096 - DNA, 601 bp, Human
tgttttttcggttgtttgtttgtttgttttcagatggagtctcgctctgtcatccaggctggagtgcaatggcgcgatctcggctcactgccatctctgcctcccggattcaagcgattctcctgcctcagcctcccaagtagctgggattacaggcatgtgccaccacgcctggctaactttgtatttttattagagaaagggtttcgccatgttgaccaggttggtctcaaactcctgacctcaggtcatccacccaccttggccttccaaagtgttgggattacaggtgtgagccacygcgcccggcctggctagtcgtctctgtaagctaactatttcccttgcctacacataatcgactaattctgaaagccacatttcaaaaggccccatggaggttgaaaagctccagttcgtgtttttaaaaattccagtgttctaaagtagctgggtctgtttttgtattatgaaggaaggcagccagctcctcggctggagagcctctgcacttcgcacttctctcccggtggccacctcggcagctgtctgcaggtctgttcccacggcctagagggggaatgacagcccagggcttgaa

SEQ ID NO: 2097 - DNA, 601 bp, Human
acatttacatcatgcgaattcagcagcaacacacagctcacgactttgagcattcagggagcagacacctacgcgaagagaagcttccttagtcctttcggatataggcagaacagcccgggcaggagtgggggatgcctagccaaatatcgtcaaggtccaggccttggaggttccttcctcatggctagtcatctgttttttcggttgtttgtttgtttgttttcagatggagtctcgctctgtcatccaggctggagtgcaatggcgcgatctcggctcactgccatctctgcctccmggattcaagcgattctcctgcctcagcctcccaagtagctgggattacaggcatgtgccaccacgcctggctaactttgtatttttattagagaaagggtttcgccatgttgaccaggttggtctcaaactcctgacctcaggtcatccacccaccttggccttccaaagtgttgggattacaggtgtgagccactgcgcccggcctggctagtcgtctctgtaagctaactatttcccttgcctacacataatcgactaattctgaaagccacatttcaaaaggccccatggaggttga

SEQ ID NO: 2098 - DNA, 601 bp, Human
cctggatctgtcctataacatgggcacactgtgacccagtcctttgaccaaggtaaaaactggggtgaccttcacggaatgttaggggtgcccatgacatttacatcatgcgaattcagcagcaacacacagctcacgactttgagcattcagggagcagacacctacgcgaagagaagcttccttagtcctttcggatataggcagaacagcccgggcaggagtgggggatgcctagccaaatatcgtcaaggtccaggccttggaggttccttcctcatggctagtcatctgttttttyggttgtttgtttgtttgttttcagatggagtctcgctctgtcatccaggctggagtgcaatggcgcgatctcggctcactgccatctctgcctcccggattcaagcgattctcctgcctcagcctcccaagtagctgggattacaggcatgtgccaccacgcctggctaactttgtatttttattagagaaagggtttcgccatgttgaccaggttggtctcaaactcctgacctcaggtcatccacccaccttggccttccaaagtgttgggattacaggtgtgagccactgcgcccgg

SEQ ID NO: 2099 - DNA, 601 bp, Human
aggatcctgctaagctgcatgagtgtgtcactcctctgacttcccagctcacagcaaaagcccttctgagggcttaagaagccccatggcctcttcccccttcctccccttccctcattacaccccgccccactccactgcagccactagctcctcaccctgccccccacccaccaggcaggcttccaacccagggtacctgcagctgctcttcccttagacacccatccacatagctcgttcccctacctcctccagtgtgtgccaaagtgtcaccctccgtgaccaccccattgaaaacttcagcatcagctgccacccaacactccttcccaccttccctgtgtcttcaacgttcatctcatcaacatggaatttacctacttaccatcttctccccctaagagcaccaggagggcagggatttttgtctgtgttgttcacagaagtatccccagcacctagagtgcttggcacaaagtagatggtccagaaatatttgattgattagttaatttggccaagaggtgggccgggaaagaggttacctctaactgaggtagaggtcagcctggctgtgaagaacgctgggttctgaata

SEQ ID NO: 2100 - DNA, 601 bp, Human
tccctccgcctccattctgtcagcacgtgctacgtatgagctgtcactttaaactgttactcccgtcatggcccagcccacaccgcctctcacctgagtggttacaaagggagcaagtgccgcttctcttctcagctaagcagcaagaaggatcctgctaagctgcatgagtgtgtcactcctctgacttcccagctcacagcaaaagcccttctgagggcttaagaagccccatggcctcttcccccttcctccccttccctcattacaccccgccccactccactgcagccactagctyctcaccctgccccccacccaccaggcaggcttccaacccagggtacctgcagctgctcttcccttagacacccatccacatagctcgttcccctacctcctccagtgtgtgccaaagtgtcaccctccgtgaccaccccattgaaaacttcagcatcagctgccacccaacactccttcccaccttccctgtgtcttcaacgttcatctcatcaacatggaatttacctacttaccatcttctccccctaagagcaccaggagggcagggatttttgtctgtgttgttcacagaagtatc

SEQ ID NO: 2101 - DNA, 601 bp, Human
acggcaactccagccagctggccaacagaatcacaatacatacacaacactagtcgccaaggacgcttgtttgttttgttttgttaccctccccccctccccgtttttggagtcttgctctgtcacccaggctggagtgcagtggagcgatctcggctcactgcaccctccgcctcccgagtttgagcgattctcctgcctcagcctgcccagtagctgtgattacaggcgcccaccaccatgcccagctaatttttgtatttttagtagagacggggttttaccatgttgaccaggcttstctcaaactcctgacctcatgatccgcctacctctgcctcccaaagtgctgggattacaggcatgagccaccgcgcccggcctggggggcattctaagaccactacatgtctaaacccacactcatgtgcttggcaacactgtcattctggaattcagtgtggtccaatagaacgtctgcagcgatggagacaggcggtatctgcgctgcccaacaccaccagccacaggcggccactgagtctttgaagtgtggctaatgtgactgaggaacaaaatgtttcattgtgattaattttaa

SEQ ID NO: 2102 - DNA, 601 bp, Human
ggggaactgcgttcttccccatatacggcaactccagccagctggccaacagaatcacaatacatacacaacactagtcgccaaggacgcttgtttgttttgttttgttaccctccccccctccccgtttttggagtcttgctctgtcacccaggctggagtgcagtggagcgatctcggctcactgcaccctccgcctcccgagtttgagcgattctcctgcctcagcctgcccagtagctgtgattacaggcgcccaccaccatgcccagctaatttttgtatttttagtagagacggrgttttaccatgttgaccaggcttgtctcaaactcctgacctcatgatccgcctacctctgcctcccaaagtgctgggattacaggcatgagccaccgcgcccggcctggggggcattctaagaccactacatgtctaaacccacactcatgtgcttggcaacactgtcattctggaattcagtgtggtccaatagaacgtctgcagcgatggagacaggcggtatctgcgctgcccaacaccaccagccacaggcggccactgagtctttgaagtgtggctaatgtgactgaggaacaaa

SEQ ID NO: 2103 - DNA, 601 bp, Human
gtgatcttctaaggagaggggtctgtagtcttcattagattcttttggggatctatgtcctcaggtcaaaaaccactgagacagctggacaccgacgaccaggctcactagcgtttttgaaagagaagcgtttgcttgctatgtacactagggggcgatgtagggcaagccatgcgtgctgtatctctactacccccagtagctggctgggaggttggttcttggctgtaattaattccctgctggaaacagctgtgcctgcttgttagcctggattccagagcatttgaaagtcttcaaytggtcctgcaaatgtctatgaaagggctgaccaggacttggggaactgcgttcttccccatatacggcaactccagccagctggccaacagaatcacaatacatacacaacactagtcgccaaggacgcttgtttgttttgttttgttaccctccccccctccccgtttttggagtcttgctctgtcacccaggctggagtgcagtggagcgatctcggctcactgcaccctccgcctcccgagtttgagcgattctcctgcctcagcctgcccagtagctgtgattacaggcgcccacc

SEQ ID NO: 2104 - DNA, 601 bp, Human
ctgtctcaaaagaagaagaagaagaaaaaagacaacagtagtggagaaggaaagaagtcagagacagtaaagcaaatgaaacgaaaaagaggcaggggaggggggacagaggagttaagggcaagttctgagtttctagctcaggtggctgagtggtgccggtggctgagtggtgccggtggctgagtggtgccattgactgagggaggtaacatgggaggaagacccaagggtggaagaagatgcgttcaatcggggacatgacaagaggtgcatataggataacaaagcagagatgctracatgtcagctggacacacatcttagagctcaggcgtgagacctcagtgtcatcagaatattaacagcgttgcctaatctgaggcctagggaccgtctcagagggcccggaatgccaaaatttatgtatgcacatgtgatcttctaaggagaggggtctgtagtcttcattagattcttttggggatctatgtcctcaggtcaaaaaccactgagacagctggacaccgacgaccaggctcactagcgtttttgaaagagaagcgtttgcttgctatgtacactagggggcgatgtaggg

SEQ ID NO: 2105 - DNA, 601 bp, Human
aattcactgtgaccctaggtgaggtactctatgacacaaattcatccatgccacaatatttatggggcactgctgtgcactggagaacagtgtgcataagacatactgtcctaccccgtttcttggcctcagcttcctacccacaaaatcattcagacccttcccattaaaaggctgtggtttaagacatgggtccacatgtcctggaaaagagggtcctggggatgtgtgaaagggtcctccagaatgctgaggtatcacagggacccagagtgcagaaccactctcagtagctgagatygacagaaaaacatattagcaataccgagaaaactgttttccatctgaaatgtccaaagatgagatgtgcagatctaggaagtatggcctcccaaagtgctgggattacaggcgtgagccaccacgcccggcctaggaagtaatgtgaggtgtgttttgttcccattgtttggttttggtttggtttttatcccagctgagaagaggctggattgactggagggagagacaggaagcagagacagagcctgctgtctccacccgagagatgatacatgcctgaaataaggaaacagtagtg

SEQ ID NO: 2106 - DNA, 601 bp, Human
taggacattcaccgaggctagagcgtggtgctgtggtgcaatgatcacggctcaccgcagcctccacttcctgggttcaagtgatcctcccacctcagcctcccgagtagctgggactacaggtgtttaccaccatgcccagctaatatttttcttatttttatttttttgagacggagtttcgttcttgttgcccaggctggagtgcaatggcacgatctcggctcactgcaacctccacctcccaggttcaagcaattctcccgtctcagcctcctgagtagctgggattacaggcacrcgccaccatgcctggctaattttgtatttttattagggacggggtttctccacgttggtcaggctggtctcgaactcctgacctcaggtgatccgcctgcctcggcctcccaaagtgctgggattacaggcgtgagccacccagcctggccaatgtgcagctaatttttgtattttttgtagagacagggtctcgccatgtggaggcgggtcttgaactcctgggctcaagtgatccacctgccttggcctcccacagtgctgggattacaggtgtaagccaccgcacacagcccagaat

SEQ ID NO: 2107 - DNA, 601 bp, Human
agaaaagcaggcatgcagcgagggaggggcgtgagggacctgtttccacagccaccgtcacagtcaccttttgcatcctcttcaactgcaggtttctggggtaattcaaggccatgcttgtcatgtaggaatcttccccggagttagttaggttaatgttcagggtcagctcctttgtgagacccaccaccaactcctgcctgcacagggtacagataaaaatgttacagtttatttcatctgtaaaaacctcaacgcaatacaataggacattcaccgaggctagagcgtggtgctgtgrtgcaatgatcacggctcaccgcagcctccacttcctgggttcaagtgatcctcccacctcagcctcccgagtagctgggactacaggtgtttaccaccatgcccagctaatatttttcttatttttatttttttgagacggagtttcgttcttgttgcccaggctggagtgcaatggcacgatctcggctcactgcaacctccacctcccaggttcaagcaattctcccgtctcagcctcctgagtagctgggattacaggcacgcgccaccatgcctggctaattttgtatttttatta

SEQ ID NO: 2108 - DNA, 601 bp, Human
gtcctcgggaaacagactgtttcctagtatctgtgtctgtatccagccttgggaatggcagggcagattttcactttcccagtctaagctaatttttactttctcagtgtcttagggcattagactcacttctctctcagaaccctggtgaagaaagggccgcacatagggagggtggtactgcagcagaatatggtgcctcgggaggcatggagctggactggcggggatttatctagttattaaccatctgttggttggaccaggaggaggctggaggcaggggtgccagtgagggggycaccacagaaaagcaggcatgcagcgagggaggggcgtgagggacctgtttccacagccaccgtcacagtcaccttttgcatcctcttcaactgcaggtttctggggtaattcaaggccatgcttgtcatgtaggaatcttccccggagttagttaggttaatgttcagggtcagctcctttgtgagacccaccaccaactcctgcctgcacagggtacagataaaaatgttacagtttatttcatctgtaaaaacctcaacgcaatacaataggacattcaccgaggctagagcgtggt

SEQ ID NO: 2109 - DNA, 601 bp, Human
caccgttcccggcccaaagttttctgatctgtgattttagagaataaaatttctcagtgcagtgatacttgtcagccacagggtgtcctcgggaaacagactgtttcctagtatctgtgtctgtatccagccttgggaatggcagggcagattttcactttcccagtctaagctaatttttactttctcagtgtcttagggcattagactcacttctctctcagaaccctggtgaagaaagggccgcacatagggagggtggtactgcagcagaatatggtgcctcgggaggcatggagcyggactggcggggatttatctagttattaaccatctgttggttggaccaggaggaggctggaggcaggggtgccagtgagggggtcaccacagaaaagcaggcatgcagcgagggaggggcgtgagggacctgtttccacagccaccgtcacagtcaccttttgcatcctcttcaactgcaggtttctggggtaattcaaggccatgcttgtcatgtaggaatcttccccggagttagttaggttaatgttcagggtcagctcctttgtgagacccaccaccaactcctgcctgcacaggg

SEQ ID NO: 2110 - DNA, 601 bp, Human
tctcggcctcccaaagtgctgggattacaggtgtgagccaccgttcccggcccaaagttttctgatctgtgattttagagaataaaatttctcagtgcagtgatacttgtcagccacagggtgtcctcgggaaacagactgtttcctagtatctgtgtctgtatccagccttgggaatggcagggcagattttcactttcccagtctaagctaatttttactttctcagtgtcttagggcattagactcacttctctctcagaaccctggtgaagaaagggccgcacatagggagggtggyactgcagcagaatatggtgcctcgggaggcatggagctggactggcggggatttatctagttattaaccatctgttggttggaccaggaggaggctggaggcaggggtgccagtgagggggtcaccacagaaaagcaggcatgcagcgagggaggggcgtgagggacctgtttccacagccaccgtcacagtcaccttttgcatcctcttcaactgcaggtttctggggtaattcaaggccatgcttgtcatgtaggaatcttccccggagttagttaggttaatgttcagggtcagctc

SEQ ID NO: 2111 - DNA, 601 bp, Human
gtatcactgaacaatggaaaaggcggttattaaaggactccagggaagggtggagttcagatgaaatgtaaataaagtcctgttttgatggtaaagcagggctgagtgtcaaggagtcagtcaccagcaggccagcctgtgaatcagacccagggcccgcttcctgggaaaccattaatatggagtagaaagttgacagacactgtatctgaagctctctacctcaggtggaaacagactcttctcttggtcaaaatgacttacactctccaggcaagagggataggggttcataattacygacgtaactacttcaaacagcaaagttttctttcttgttttttcttttgagacagactcttgctctgtggcccaggctggagtgtagtggcgcaatctcggctcactgcaagctccgcctcccgggttcacgccattctcctgcctcagcctcccgagtagctgggactacaggcacccgccatcgcgcccagctaatttttttttgtatttttagtagagacggggtttcaccgtgttagccaggatggtctcgatctcctgacctcgtgatccgcccgtctcggcctcccaaagtgct

SEQ ID NO: 2112 - DNA, 601 bp, Human
ctagatgcctaggagattgttttttgcttttgttttcatttttttgagatggagtttcactctttcgcccaagctgcagtgaagtggcgcgatctcggctcactgcaacctccacctcccgggttcaagcaattctcctgcctcagtctcccaagtagctgggattataggtgcccaccaccacgcccggctaattttttgtatttttaatagaaacagggtttcaccatgttagccaggctggtctcgaactcctgacctcaagtgatccacccacttcagcctcccaaagtgatgggaktacagccgtgagccacggtgcccggcctaggagattgcttcattcatataatggatactgtcctagcccaaatagcctaagatgaccggggacaaatctacagtccaacaaattcaaatttattgactcactgcaatgaggaaaactacactttggttttgtttgtttgtttgtttgtttttgagacagagtcctgctctgttgcccaggctggagtgcagtggcgcaatctcagctcactccaatctccacctccgggttcaagtgattctcgtgcctcagcctcccgagtagctggga

SEQ ID NO: 2113 - DNA, 601 bp, Human
gccggcacacaccagcactgccacgtagccaccagggctccccacctggacccccgaggggcaggtgatgactgcagtgagttttcttaattctcccagggacggtccatccctagttcccctctagatgcctaggagattgttttttgcttttgttttcatttttttgagatggagtttcactctttcgcccaagctgcagtgaagtggcgcgatctcggctcactgcaacctccacctcccgggttcaagcaattctcctgcctcagtctcccaagtagctgggattataggtgcccamcaccacgcccggctaattttttgtatttttaatagaaacagggtttcaccatgttagccaggctggtctcgaactcctgacctcaagtgatccacccacttcagcctcccaaagtgatgggattacagccgtgagccacggtgcccggcctaggagattgcttcattcatataatggatactgtcctagcccaaatagcctaagatgaccggggacaaatctacagtccaacaaattcaaatttattgactcactgcaatgaggaaaactacactttggttttgtttgtttgtttgtttg

SEQ ID NO: 2114 - DNA, 601 bp, Human
gctgtgtactggaaagctctcgtccccatcaccccctactttcagagccagcttagccactgtaagcactgctggggacacactgcagtcaagcgaagcgcaaagctggaaccgagagattgagatgagaccaagatgcagaagacgccaactgcagggtggtgagaagagcgaatcggtccaaaccgactcacagatgacctcttgaggacggggtgaccaatcctgcagttcatgatcaggacagaagcaaccggctgagggtcatcacactgaatgtttggagagggaggctgttaamagagcagatgacattctcttaaagagccaaacaaaacaaaacaaaaacgtggtttcctcacagcaattcagcaaacattcactaatttttctgcctgtcagacaccctgccaggagctaaagaaataaagtccacttggtccctgtcttcctcacaagccggacaggcagggtcagcagtagatccccgaggaatttaaatacaaggtcgaaggggtgcttctgtgagggagctgcagagaacagcagtggagaaatatgaattccaactcggaggaattcgtaaggtcttcctggggaa

SEQ ID NO: 2115 - DNA, 601 bp, Human
ggtgacagaatgaaactccatctcaacaaacaaacaaacaaaaaaactttttgtctgacacgccctccatactacccacaacttcactctgcttcacggaggtgagcaggcagttcacctagggctgtgtactggaaagctctcgtccccatcaccccctactttcagagccagcttagccactgtaagcactgctggggacacactgcagtcaagcgaagcgcaaagctggaaccgagagattgagatgagaccaagatgcagaagacgccaactgcagggtggtgagaagagcgaatcrgtccaaaccgactcacagatgacctcttgaggacggggtgaccaatcctgcagttcatgatcaggacagaagcaaccggctgagggtcatcacactgaatgtttggagagggaggctgttaaaagagcagatgacattctcttaaagagccaaacaaaacaaaacaaaaacgtggtttcctcacagcaattcagcaaacattcactaatttttctgcctgtcagacaccctgccaggagctaaagaaataaagtccacttggtccctgtcttcctcacaagccggacaggcagggtcagc

SEQ ID NO: 2116 - DNA, 601 bp, Human
cagaattgtctctagaagaccacacttagaagaatactgattttaaaagggcttctcagcctccacactattgacgttttgggccagttagttcttggttgtgggggctgtcctgtactgctctgcgtgatgtttggcagtattcctggcctctacccaccagatgtcctactgaacacccccctccccaagtcatggcaatcaaaacaggcacagcctctggtgggcagaatcacctccctttgagaactcttcccagcagcgttccccaccttaccccccaacacagaggtcttgcagrtaacatagctatcccaagctattccaaagctgagtgaacgagaaccagaactccagggctcattccaccaggctgtaccacagttttactttgtgtgtgaacaaaagaacattttcattatctctggtaacaagaagagaaagtcgagtccctgcagggaaacagatgccttctgtgggctcactggggtttcctttctccctgggctgtaagggggccgttcctctcacagcgtgcatgtggcagggagatgtcttccggggtcatagcctgactctgctgtgacccaggcagtactta

SEQ ID NO: 2117 - DNA, 601 bp, Human
cgcagtggctcatgcctgtaatcccagtgctttgggaggccaaggctggtggatcacgaggtcaggagttcaagaccagcttggccaagatggtgaaaccccatctctactaaaactacaaaaattagctgggcgtggtggcgggcgcctgtaatcccagctactcgggaggctgaggcagagaactgcttgaacctggaggcagaggttgcagtgagccgagatcacgccacagcactccagcctgggcgacagagcgagactgtctcaaaaaaaaaaaataaataaaaaataaataaataaataaataaataaaaggctttcagagataagcaattggagttcagaattgtctctagaagaccacacttagaagaatactgattttaaaagggcttctcagcctccacactattgacgttttgggccagttagttcttggttgtgggggctgtcctgtactgctctgcgtgatgtttggcagtattcctggcctctacccaccagatgtcctactgaacacccccctccccaagtcatggcaatcaaaacaggcacagcctctggtgggcagaatcacctccctttgagaactcttccc

SEQ ID NO: 2118 - DNA, 601 bp, Human
gctctcagaggctgggcgcagtggctcatgcctgtaatcccagtgctttgggaggccaaggctggtggatcacgaggtcaggagttcaagaccagcttggccaagatggtgaaaccccatctctactaaaactacaaaaattagctgggcgtggtggcgggcgcctgtaatcccagctactcgggaggctgaggcagagaactgcttgaacctggaggcagaggttgcagtgagccgagatcacgccacagcactccagcctgggcgacagagcgagactgtctcaaaaaaaaaaaataaataaaaaataaataaataaataaataaataaaaggctttcagagataagcaattggagttcagaattgtctctagaagaccacacttagaagaatactgattttaaaagggcttctcagcctccacactattgacgttttgggccagttagttcttggttgtgggggctgtcctgtactgctctgcgtgatgtttggcagtattcctggcctctacccaccagatgtcctactgaacacccccctccccaagtcatggcaatcaaaacaggcacagcctctggtgggcagaatcacctccc

SEQ ID NO: 2119 - DNA, 601 bp, Human
ctgggagtcagataagaaaaggctctcagaggctgggcgcagtggctcatgcctgtaatcccagtgctttgggaggccaaggctggtggatcacgaggtcaggagttcaagaccagcttggccaagatggtgaaaccccatctctactaaaactacaaaaattagctgggcgtggtggcgggcgcctgtaatcccagctactcgggaggctgaggcagagaactgcttgaacctggaggcagaggttgcagtgagccgagatcacgccacagcactccagcctgggcgacagagcgagaccgtctcaaaaaaaaaaaataaataaaaaataaataaataaataaataaataaaaggctttcagagataagcaattggagttcagaattgtctctagaagaccacacttagaagaatactgattttaaaagggcttctcagcctccacactattgacgttttgggccagttagttcttggttgtgggggctgtcctgtactgctctgcgtgatgtttggcagtattcctggcctctacccaccagatgtcctactgaacacccccctccccaagtcatggcaatcaaaacaggcacagcctc

SEQ ID NO: 2120 - DNA, 601 bp, Human
gtgtgtgctgttcccctccctgtgtccatgtgctctcactgcagaacaggtgcttctgcacctggctccccagggtcactgggagtcagataagaaaaggctctcagaggctgggcgcagtggctcatgcctgtaatcccagtgctttgggaggccaaggctggtggatcacgaggtcaggagttcaagaccagcttggccaagatggtgaaaccccatctctactaaaactacaaaaattagctgggcgtggtggcgggcgcctgtaatcccagctactcgggaggctgaggcagagaaytgcttgaacctggaggcagaggttgcagtgagccgagatcacgccacagcactccagcctgggcgacagagcgagactgtctcaaaaaaaaaaaataaataaaaaataaataaataaataaataaataaaaggctttcagagataagcaattggagttcagaattgtctctagaagaccacacttagaagaatactgattttaaaagggcttctcagcctccacactattgacgttttgggccagttagttcttggttgtgggggctgtcctgtactgctctgcgtgatgtttggcagta

SEQ ID NO: 2121 - DNA, 601 bp, Human
cctctcagaaggacagtgtccacattcatcctgaccaccagctccatctacgagagagagcccaaagctgccccctgggcgatggagtcacaccgctgctggcctcttgggagtactcacttggacagaactgcaacgaagccatgcctgaattgaagggtgtgggtctcgttggccaaagaccatctttcattggaactaggaataagagtgttagttcatagcacacctgctttgtacatagcaagtgcttcttaaaaagggcttcgctctgttgcccaggcaggagtgcagtgttgcygtctcagctcactgcaacctccgccccccgggttcaagcaattctcatgcctcagcctcctgagtagctggaattacaggcgtgagccaccatacccagttaatttttgtatttttagtagagatggggtttcaccatgttggccaggctggtctcgaactcctgacctcaagtgatctgcctgccttggcctcccaaagtgctgggattacaggcgtgagccactgcgcctggctatttttttaagttccagggtacatgtgcagatgtgcaggtttgttacataggtgaacgtgtgcc

SEQ ID NO: 2122 - DNA, 601 bp, Human
cttttgtagcacgactagttggcaatacacctcctttgatgaccacagtggggtttttgtgacccaaatgttagcaccctagagatcaatatcagagcctgggttctaagcaggctcctctcagaaggacagtgtccacattcatcctgaccaccagctccatctacgagagagagcccaaagctgccccctgggcgatggagtcacaccgctgctggcctcttgggagtactcacttggacagaactgcaacgaagccatgcctgaattgaagggtgtgggtctcgttggccaaagaccrtctttcattggaactaggaataagagtgttagttcatagcacacctgctttgtacatagcaagtgcttcttaaaaagggcttcgctctgttgcccaggcaggagtgcagtgttgctgtctcagctcactgcaacctccgccccccgggttcaagcaattctcatgcctcagcctcctgagtagctggaattacaggcgtgagccaccatacccagttaatttttgtatttttagtagagatggggtttcaccatgttggccaggctggtctcgaactcctgacctcaagtgatctgcctg

SEQ ID NO: 2123 - DNA, 601 bp, Human
tgcactccagcctgggcgacagagtgagacttcgtctcagtttaaaaaaaaaaaaaaaaggaataaaagctgaatgtcaaaatataaagtggtcgtagcgcagttggggtgaggtggaatatttgaattctgtatcgttgggctggttcattttctaattatccctcaaatggccttactcatcccctccttacttcccagtcccacagctgccttcttccctccacagcgtcatattaattcccttttgtagcacgactagttggcaatacacctcctttgatgaccacagtggggtttytgtgacccaaatgttagcaccctagagatcaatatcagagcctgggttctaagcaggctcctctcagaaggacagtgtccacattcatcctgaccaccagctccatctacgagagagagcccaaagctgccccctgggcgatggagtcacaccgctgctggcctcttgggagtactcacttggacagaactgcaacgaagccatgcctgaattgaagggtgtgggtctcgttggccaaagaccatctttcattggaactaggaataagagtgttagttcatagcacacctgctttgtaca

SEQ ID NO: 2124 - DNA, 601 bp, Human
ctcccaaagtgctgggatgacaggcgtgagccaccgcacctggccttctctttttgaatgaactcgactgctttcaactgaatacattaggacagagggcaccagacctttaccaggaatgaggccgggtgcagtggttcatgcctatcatcccagcactttgggaggccgaggcaggcggatcacctgaggccaggagttcaagaccagcctggccaacatggtgaaatccccgtctctattaaaaattttttaaaaattagctgggcctggtggtgtccacctgtagtctcaactactygggaggctgaggcaggagaatcgcttgaacctgggcggcagaggttgcagtgagccgagatggcaccactgcactccagcctgggcgacagagtgagacttcgtctcagtttaaaaaaaaaaaaaaaaggaataaaagctgaatgtcaaaatataaagtggtcgtagcgcagttggggtgaggtggaatatttgaattctgtatcgttgggctggttcattttctaattatccctcaaatggccttactcatcccctccttacttcccagtcccacagctgccttcttccctccacagcg

SEQ ID NO: 2125 - DNA, 601 bp, Human
cggggtttcgccatgttagccaggctggtcttgaactcctgacctcaggtgatccacccacctcagcctcccaaagtgctgggatgacaggcgtgagccaccgcacctggccttctctttttgaatgaactcgactgctttcaactgaatacattaggacagagggcaccagacctttaccaggaatgaggccgggtgcagtggttcatgcctatcatcccagcactttgggaggccgaggcaggcggatcacctgaggccaggagttcaagaccagcctggccaacatggtgaaatcccygtctctattaaaaattttttaaaaattagctgggcctggtggtgtccacctgtagtctcaactactcgggaggctgaggcaggagaatcgcttgaacctgggcggcagaggttgcagtgagccgagatggcaccactgcactccagcctgggcgacagagtgagacttcgtctcagtttaaaaaaaaaaaaaaaaggaataaaagctgaatgtcaaaatataaagtggtcgtagcgcagttggggtgaggtggaatatttgaattctgtatcgttgggctggttcattttctaattatcc

SEQ ID NO: 2126 - DNA, 601 bp, Human
gcacagtggaacaatcatggctcagtgtagcctcaacctcccaggctcaagtgatcctccacctcagcctgcgaaagtgttgggatgacaggcatgagccactacactcatcccttttttttttttttttttttttttttgagctggagtcttgctctgttgcccaggctggagtgcagtggtgcgatctcagctcactgcaacctctgcctcctgggtttaagtgattctcctgcctaagcccccaagtagctgagattacaggcgcctgccaccacacctggctaattttcatattttyagtagagacggggtttcgccatgttagccaggctggtcttgaactcctgacctcaggtgatccacccacctcagcctcccaaagtgctgggatgacaggcgtgagccaccgcacctggccttctctttttgaatgaactcgactgctttcaactgaatacattaggacagagggcaccagacctttaccaggaatgaggccgggtgcagtggttcatgcctatcatcccagcactttgggaggccgaggcaggcggatcacctgaggccaggagttcaagaccagcctggccaacatggt

SEQ ID NO: 2127 - DNA, 601 bp, Human
tacttacatggaagaggaattctttgtggtgagaaagcccctggcctgtgttcacgtacattatggatggtctgcaattgacaggacatgcgtcagcccttgaggagtctttctcccttttttggagacagggtctcactctgttgcccaggctagagcacagtggaacaatcatggctcagtgtagcctcaacctcccaggctcaagtgatcctccacctcagcctgcgaaagtgttgggatgacaggcatgagccactacactcatcccttttttttttttttttttttttttttgagstggagtcttgctctgttgcccaggctggagtgcagtggtgcgatctcagctcactgcaacctctgcctcctgggtttaagtgattctcctgcctaagcccccaagtagctgagattacaggcgcctgccaccacacctggctaattttcatattttcagtagagacggggtttcgccatgttagccaggctggtcttgaactcctgacctcaggtgatccacccacctcagcctcccaaagtgctgggatgacaggcgtgagccaccgcacctggccttctctttttgaatgaactcgac

SEQ ID NO: 2128 - DNA, 601 bp, Human
tggaaagaggtgtgactgataaagaactgcctttaaatacctgagtcctcgtcagcttcttcactgctacaacctggagacctcgtaatttggttgggacgcaaatttgcaactggtattctgctccaaagaggttctccccatgtacctgcaaattaaaatcagagtaggaaatcaaagctggtattgctttgccatctacagctttacaataataagtacttacatggaagaggaattctttgtggtgagaaagcccctggcctgtgttcacgtacattatggatggtctgcaattgasaggacatgcgtcagcccttgaggagtctttctcccttttttggagacagggtctcactctgttgcccaggctagagcacagtggaacaatcatggctcagtgtagcctcaacctcccaggctcaagtgatcctccacctcagcctgcgaaagtgttgggatgacaggcatgagccactacactcatcccttttttttttttttttttttttttttgagctggagtcttgctctgttgcccaggctggagtgcagtggtgcgatctcagctcactgcaacctctgcctcctgggtttaagt

SEQ ID NO: 2129 - DNA, 601 bp, Human
ccaaaaaagagtctcaggggagaagaagggaagctagtaagcaacttatagggggcagtgtaagaaatgtcacatgttacatcactcacacagagaagcagaatttatcaattttcaaagggaaaatgtctctgtctactgacaaggttttaatttttgcttttttttttttttgagatggagtctcactctgtctcccaggctggagtgcagtggcaggatctcggctcactgcaagctccgcctcccgggctcacaccattctcctgcctcagcctcccaagtagctgggactacaggygcccgccaccacgcccggagaattttttgtatttttagtagagacggggtttcaccgtgttagccaggatggtctcgatctgctgaccttgtgatccacccgcctcggcctcccaaagtgctgggattacaggtgtgagccaccgcacctggccaatttttgcttatttttcctcaaagggaggaaaactgacaggttgctttaagagctgagtgattgagagtccttctgaacaggacttcgggaatttactcctaatcttttcccatggttaacttgtcttcactctgtttctagaac

SEQ ID NO: 2130 - DNA, 601 bp, Human
ccaggcttcagcttcatactgagcagagcctgttgcttcaggtatcaaggctagctttgggaaccagactacagatgagacaactgaaagcaaagaggctgaggcaaagcagagaccaaaaaagagtctcaggggagaagaagggaagctagtaagcaacttatagggggcagtgtaagaaatgtcacatgttacatcactcacacagagaagcagaatttatcaattttcaaagggaaaatgtctctgtctactgacaaggttttaatttttgcttttttttttttttgagatggagtckcactctgtctcccaggctggagtgcagtggcaggatctcggctcactgcaagctccgcctcccgggctcacaccattctcctgcctcagcctcccaagtagctgggactacaggcgcccgccaccacgcccggagaattttttgtatttttagtagagacggggtttcaccgtgttagccaggatggtctcgatctgctgaccttgtgatccacccgcctcggcctcccaaagtgctgggattacaggtgtgagccaccgcacctggccaatttttgcttatttttcctcaaagggagga

SEQ ID NO: 2131 - DNA, 601 bp, Human
aaaaaaaaatgcccaggcttcagcttcatactgagcagagcctgttgcttcaggtatcaaggctagctttgggaaccagactacagatgagacaactgaaagcaaagaggctgaggcaaagcagagaccaaaaaagagtctcaggggagaagaagggaagctagtaagcaacttatagggggcagtgtaagaaatgtcacatgttacatcactcacacagagaagcagaatttatcaattttcaaagggaaaatgtctctgtctactgacaaggttttaatttttgcttttttttttttttgagatggagtctcactctgtctcccaggctggagtgcagtggcaggatctcggctcactgcaagctccgcctcccgggctcacaccattctcctgcctcagcctcccaagtagctgggactacaggcgcccgccaccacgcccggagaattttttgtatttttagtagagacggggtttcaccgtgttagccaggatggtctcgatctgctgaccttgtgatccacccgcctcggcctcccaaagtgctgggattacaggtgtgagccaccgcacctggccaatttttgcttatttttcc

SEQ ID NO: 2132 - DNA, 601 bp, Human
acctataagccctctttctaattgtcagcagagtcctttctgtaaattcctttccgttttttgagccttaacacttatgtagtctgagcaaaaaaaaaatgcccaggcttcagcttcatactgagcagagcctgttgcttcaggtatcaaggctagctttgggaaccagactacagatgagacaactgaaagcaaagaggctgaggcaaagcagagaccaaaaaagagtctcaggggagaagaagggaagctagtaagcaacttatagggggcagtgtaagaaatgtcacatgttacatcrctcacacagagaagcagaatttatcaattttcaaagggaaaatgtctctgtctactgacaaggttttaatttttgcttttttttttttttgagatggagtctcactctgtctcccaggctggagtgcagtggcaggatctcggctcactgcaagctccgcctcccgggctcacaccattctcctgcctcagcctcccaagtagctgggactacaggcgcccgccaccacgcccggagaattttttgtatttttagtagagacggggtttcaccgtgttagccaggatggtctcgatctgc

SEQ ID NO: 2133 - DNA, 601 bp, Human
ctcaccttgtgatccacccacctcggcatcccaaagtgctgggtgattacaggagtgagccatggcacctgacctataagccctctttctaattgtcagcagagtcctttctgtaaattcctttccgttttttgagccttaacacttatgtagtctgagcaaaaaaaaaatgcccaggcttcagcttcatactgagcagagcctgttgcttcaggtatcaaggctagctttgggaaccagactacagatgagacaactgaaagcaaagaggctgaggcaaagcagagaccaaaaaagagtytcaggggagaagaagggaagctagtaagcaacttatagggggcagtgtaagaaatgtcacatgttacatcactcacacagagaagcagaatttatcaattttcaaagggaaaatgtctctgtctactgacaaggttttaatttttgcttttttttttttttgagatggagtctcactctgtctcccaggctggagtgcagtggcaggatctcggctcactgcaagctccgcctcccgggctcacaccattctcctgcctcagcctcccaagtagctgggactacaggcgcccgccaccac

SEQ ID NO: 2134 - DNA, 601 bp, Human
aagcaattctcctacctcagcctcccgagtagctgggattgcaggcatacaccaccatgcccggctaattgtttgtatttttttagtagagatgggggtttcaccatgttggccaggctggtctcgaactcctcaccttgtgatccacccacctcggcatcccaaagtgctgggtgattacaggagtgagccatggcacctgacctataagccctctttctaattgtcagcagagtcctttctgtaaattcctttccgttttttgagccttaacacttatgtagtctgagcaaaaaaaaaatgcccaggcttcagcttcatactgagcagagcctgttgcttcaggtatcaaggctagctttgggaaccagactacagatgagacaactgaaagcaaagaggctgaggcaaagcagagaccaaaaaagagtctcaggggagaagaagggaagctagtaagcaacttatagggggcagtgtaagaaatgtcacatgttacatcactcacacagagaagcagaatttatcaattttcaaagggaaaatgtctctgtctactgacaaggttttaatttttgcttttttttttttttgagatgga

SEQ ID NO: 2135 - DNA, 601 bp, Human
aatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccatccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcrcagtggcgtgcgcctgtagtcccagctactcgggaggctgaggcaggaggatcgcttgagcccaagagttcatatctagcctggtcaacatagcaagacccctgtctctatttttttaaataaataaactacatgtgaaaacaaacgtttatatttataaaccctcttttttttttttttaattttattgagacagagtcttgctctgtcacccaggctagagtgcagtggtgcgatctcagctcactgcaacctccgcctcccgggttcaagcaattctcctacctcagcctcccgagt

SEQ ID NO: 2136 - DNA, 601 bp, Human
gctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccrtccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcgcagtggcgtgcgcctgtagtcccagctactcgggaggctgaggcaggaggatcgcttgagcccaagagttcatatctagcctggtcaacatagcaagacccctgtctctatttttttaaataaataaactacatgtgaaaacaaacgttt

SEQ ID NO: 2137 - DNA, 601 bp, Human
gaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaacagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgyctgcttttggaccaaaaccagggcttccttcagtttccacaagaagaaaattgtgactgatgtgtcagaggtctgcagcatctataccactgccacttctctctctggatccctcctatcagaatgttcaaaccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcagtcagaagggtcctgtcccctttagccattg

SEQ ID NO: 2138 - DNA, 601 bp, Human
ccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaayagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgcctgcttttggaccaaaaccagggcttccttcagtttccacaagaagaaaattgtgactgatgtgtcagaggtctgcagcatctataccactgccacttctctctctggatccctcctatcagaatgttcaaaccggcctgtcatgaacag

SEQ ID NO: 2139 - DNA, 601 bp, Human
cggcaggcgggcgcgtccgcgtcgcacggaagtctcgcgatgtttgcgtttgaacctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggwgaggcggcggcggaggtgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgcggcccgctccgacttccgcccttccccagccgcgactccggccgcctcagcccggacctcagcgtgtgcggccagcccagggacggcgacgagctgggcatcagtgcctccctgttcagctctctggcctcgccctg

SEQ ID NO: 2140 - DNA, 601 bp, Human
tcaccaacatggagaaaccccatctctactaaaaatacaaaattagccgggtatggtggcgcatacctgtaatcccagctacttgggaggctgaggcaggagaatcgcttgaacccgggaggcggaggttgcagtgagccgagatcgtgccattgcacaacaagagcgaaactccgtcttgaaagaaagaaaagaaaagaaaagaacacctaggtcgggtgcggtggctcacgcctgtaatcccagcactttgggaggctgaggcgggcgatcacctgaggtcaggagttcgagaccagcytggccaacatggtgaaaccccctctctactaaaaatacaaaaattagctgggcgtggtcgccggcgcctgtaatcccagctactcgggaggctgaggcaggagaatcacttgaacccgggaggcggaggttgcagtgagtagagatcgtgccactgcactccagcgagggtgacagagcaagactccatctaaaaaaaaaaaaaaagaaaagaaaagaacacctgagctaaatttaagaagaaaccacctacgtcaggacctagaggaagagcagtgtcaagcaaaggaacagcaagtac

SEQ ID NO: 2141 - DNA, 601 bp, Human
ggcatgatcatgggtcactatagcctcaaccttccaggctcaagtgatcctcccacctcagtctcctgagtagctgagaccacaggtgcaccccaccacactgggctaatttttgtattttttgtagagatggggttttaccatgttgcccaggctggtctcaaactcctgggctcaagcaatccacccaccttagcctcccacagtgctgagattacaggcatgagccaccacacccagcttattcattttatttaacgtaagagatttttcctttttttttttttttttttttttttttgagacaaggtctcactctgttacccgggccggaatggagtggctcaatcatagctcactgaagcttcaaattcctgggctcaaacgatactcctgcctcagcctcccaagtagctgggactacaggcatgagccaccatgcgtggctaatttatgtatttatttatttttaagaaatggggtttcactatgctgcccaggctgatcttgaactcctggcctcaagcaatcctcccgcctcagcctcccaaagtgttgggatgacagatgtgagccaccacactcacaattcttttttttt

SEQ ID NO: 2142 - DNA, 601 bp, Human
agctgccgcgcctggccttttcttcaacttcttttcccttgtgccatccaaagtcagttcttgactgactgacttatttttgagacaggatctcgctctgtcacccatgctggagtgcaatggcatgatcatgggtcactatagcctcaaccttccaggctcaagtgatcctcccacctcagtctcctgagtagctgagaccacaggtgcaccccaccacactgggctaatttttgtattttttgtagagatggggttttaccatgttgcccaggctggtctcaaactcctgggctcaagyaatccacccaccttagcctcccacagtgctgagattacaggcatgagccaccacacccagcttattcattttatttaacgtaagagatttttcctttttttttttttttttttttttttttgagacaaggtctcactctgttacccgggccggaatggagtggctcaatcatagctcactgaagcttcaaattcctgggctcaaacgatactcctgcctcagcctcccaagtagctgggactacaggcatgagccaccatgcgtggctaatttatgtatttatttatttttaagaaatgg

SEQ ID NO: 2143 - DNA, 601 bp, Human
cggacatggtggctcatgcctgtaatcccagcactttgggaggtcaaggcgggcagatcacctgaggtcagaagttcgagaccagcctggccaacatggtgaaatcctgtctctatttaaaaaaaataaataaattagccaggcatggtggtgggcacctgtaatcccagctactcgggaggctgaggaagaagaatcacttgaactggggaggtggaggttgcagtgagccgagatggcaccaacggactccagcctgggtgacacagtgagattcttcctcaaaaaaaaaaaaaaaaaraaagaaaagaaaagaaaaagaaatacactacttaaaaataaaaggaaatgttatattggcatgtctagagaattgctcctttctcctcctccagggaggaaaacagaggaccttatatttagcaatccagcatcactctcctgacattccctctagtagagaatcatgcctaactaaagagctcagagctcacagatagatcacctctgaagccatgtccaggcaagggtcaacaagaatgaaaacacagggtaacacacaaagcattcagtccacaaatcacaggcatcagtctgactt

SEQ ID NO: 2144 - DNA, 601 bp, Human
tttccctctattttctgtattagaaatacactacttagccggacatggtggctcatgcctgtaatcccagcactttgggaggtcaaggcgggcagatcacctgaggtcagaagttcgagaccagcctggccaacatggtgaaatcctgtctctatttaaaaaaaataaataaattagccaggcatggtggtgggcacctgtaatcccagctactcgggaggctgaggaagaagaatcacttgaactggggaggtggaggttgcagtgagccgagatggcaccaacggactccagcctgggygacacagtgagattcttcctcaaaaaaaaaaaaaaaaaaaaagaaaagaaaagaaaaagaaatacactacttaaaaataaaaggaaatgttatattggcatgtctagagaattgctcctttctcctcctccagggaggaaaacagaggaccttatatttagcaatccagcatcactctcctgacattccctctagtagagaatcatgcctaactaaagagctcagagctcacagatagatcacctctgaagccatgtccaggcaagggtcaacaagaatgaaaacacagggtaacacaca

SEQ ID NO: 2145 - DNA, 601 bp, Human
actgtgaggctgtcacgccgctacactgctctatgtccctgagccccgtgcctatgctctttaaaatgatgacttcctttaaatgatctccaagtcctttccaactccgttctgacggctctttttgatcttgcacagatccctaaaggctttggtaatacactttccccacataaaatatgacaaaagtactggtcttcccctcaccagactaaaaagtgtgtattacctaagggacataataaatgcaaattatatccatgtgtactacttgcagagctcagctattagaagtcatcckcaggttttgttttccaaaggctctcccaatttcgggagtctaatctctcttctggcagggctcagctagaaagttcaggagatgtccttcctgagacccaggtatggcccttccaagttgtggccagaggaagttcccaggacttaggtggggccagagagccaacaagacttctctgcctgcccagagcaacccttcacgtgtatgtttaagcaccaaggtcaggggtgctttggagaggtttctgtacggggtgaagggctggacaaacttacctttaaggcctcttccaattaagtt

SEQ ID NO: 2146 - DNA, 601 bp, Human
atctttcaggaagacgacagtgatctagacaagacaaagagatcgcccaataaatcaggtgaagcaaacgaggaaaaaatcctacatgttattttaaggagcaaaatacgaggacttggcaacaacccgtgtattgatcaaagctgatgacagtaaagcaaaaagctagatattccctgatgcagcattttagatcatctaaaactatccaatcacccaaatacttcgtaagaaactattctggccccttatctagaagggctaggtctgtcaggagattatgaccttctgttaaagatgytctgacagcttgaaagagggtcccacggaatccggtctcaacacaggactgtgaggctgtcacgccgctacactgctctatgtccctgagccccgtgcctatgctctttaaaatgatgacttcctttaaatgatctccaagtcctttccaactccgttctgacggctctttttgatcttgcacagatccctaaaggctttggtaatacactttccccacataaaatatgacaaaagtactggtcttcccctcaccagactaaaaagtgtgtattacctaagggacataataaatgcaaat

SEQ ID NO: 2147 - DNA, 601 bp, Human
cctgtaatcccagctactcaggaggctgaggcaggagaatctcttgaacccggggtcagggcggggggacggggaggttgcagtgagccgagatcgcaccaccgcactcaagcctgggcgaaagagcggaactccgtctcaaaaaaaaaaagaaaaaaaagcaacacttaagggcagagacgggtagcggacagaggagaggatcttaaatagcagtagaagagtttgcacattaagacgggaaggcaaggaaaagatttcaacaggggaacaacagtcacatctgttttaaggccttacygttaaggcctcttccaagtaagttataaatgctggcctagggttgaccttccaggccctattgaactcacaggtaaccgaacataacagtattaagttctgggccttgagaatagggaggtaccaaagaaatatatataaaatcactctttattactcagagttttctcttttcagacagatactgttttactcatttgtctaaatgggggtgtgcagttgaaggaggagaaaaaagtggccacgaggccagggcagctgctctaagtcagaggttggctgtcctaaggagttctgtgcc

SEQ ID NO: 2148 - DNA, 601 bp, Human
atatggtgaaaccccgtctctactaaaaatacaaaacaattagccaggcatggtggcacattcctgtaatcccagctactcaggaggctgaggcaggagaatctcttgaacccggggtcagggcggggggacggggaggttgcagtgagccgagatcgcaccaccgcactcaagcctgggcgaaagagcggaactccgtctcaaaaaaaaaaagaaaaaaaagcaacacttaagggcagagacgggtagcggacagaggagaggatcttaaatagcagtagaagagtttgcacattaagaggggaaggcaaggaaaagatttcaacaggggaacaacagtcacatctgttttaaggccttaccgttaaggcctcttccaagtaagttataaatgctggcctagggttgaccttccaggccctattgaactcacaggtaaccgaacataacagtattaagttctgggccttgagaatagggaggtaccaaagaaatatatataaaatcactctttattactcagagttttctcttttcagacagatactgttttactcatttgtctaaatgggggtgtgcagttgaaggaggagaaaaaagt

SEQ ID NO: 2149 - DNA, 601 bp, Human
tacgaggctgcagtgagcccttaactgtgccactgaactccagcttgggggacaaagaccctggtgtttatttttaaaaaagaggctgggagtggtggttcatgcctgtaatcccagaactttgggaggccgaggcgggaggatcacaaggtcaggagtttgagaccagcctggccaatatggtgaaaccccgtctctactaaaaatacaaaacaattagccaggcatggtggcacattcctgtaatcccagctactcaggaggctgaggcaggagaatctcttgaacccggggtcagggyggggggacggggaggttgcagtgagccgagatcgcaccaccgcactcaagcctgggcgaaagagcggaactccgtctcaaaaaaaaaaagaaaaaaaagcaacacttaagggcagagacgggtagcggacagaggagaggatcttaaatagcagtagaagagtttgcacattaagacgggaaggcaaggaaaagatttcaacaggggaacaacagtcacatctgttttaaggccttaccgttaaggcctcttccaagtaagttataaatgctggcctagggttgaccttccaggccctat

SEQ ID NO: 2150 - DNA, 601 bp, Human
atgagaagatcgctcgagccccggagtttgagaccagcctgggcaatatagggagacctcatctccacaaaattaaaattaaaaaattagctgggtgtggtggcatgcacctgagtaacagtcccagttactcaggagactaagatgggaggatcacctgagcctaggagtacgaggctgcagtgagcccttaactgtgccactgaactccagcttgggggacaaagaccctggtgtttatttttaaaaaagaggctgggagtggtggttcatgcctgtaatcccagaactttgggaggcygaggcgggaggatcacaaggtcaggagtttgagaccagcctggccaatatggtgaaaccccgtctctactaaaaatacaaaacaattagccaggcatggtggcacattcctgtaatcccagctactcaggaggctgaggcaggagaatctcttgaacccggggtcagggcggggggacggggaggttgcagtgagccgagatcgcaccaccgcactcaagcctgggcgaaagagcggaactccgtctcaaaaaaaaaaagaaaaaaaagcaacacttaagggcagagacgggtagcggac

SEQ ID NO: 2151 - DNA, 601 bp, Human
taaccccaccacttcgggaggccaagatgagaagatcgctcgagccccggagtttgagaccagcctgggcaatatagggagacctcatctccacaaaattaaaattaaaaaattagctgggtgtggtggcatgcacctgagtaacagtcccagttactcaggagactaagatgggaggatcacctgagcctaggagtacgaggctgcagtgagcccttaactgtgccactgaactccagcttgggggacaaagaccctggtgtttatttttaaaaaagaggctgggagtggtggttcatgmctgtaatcccagaactttgggaggccgaggcgggaggatcacaaggtcaggagtttgagaccagcctggccaatatggtgaaaccccgtctctactaaaaatacaaaacaattagccaggcatggtggcacattcctgtaatcccagctactcaggaggctgaggcaggagaatctcttgaacccggggtcagggcggggggacggggaggttgcagtgagccgagatcgcaccaccgcactcaagcctgggcgaaagagcggaactccgtctcaaaaaaaaaaagaaaaaaaagcaaca

SEQ ID NO: 2152 - DNA, 601 bp, Human
gcacgaacctatttagggaatagtttgacttgttgggagaaaaaagcaaggtcaggtgcttatgcctgtaaccccaccacttcgggaggccaagatgagaagatcgctcgagccccggagtttgagaccagcctgggcaatatagggagacctcatctccacaaaattaaaattaaaaaattagctgggtgtggtggcatgcacctgagtaacagtcccagttactcaggagactaagatgggaggatcacctgagcctaggagtacgaggctgcagtgagcccttaactgtgccactgarctccagcttgggggacaaagaccctggtgtttatttttaaaaaagaggctgggagtggtggttcatgcctgtaatcccagaactttgggaggccgaggcgggaggatcacaaggtcaggagtttgagaccagcctggccaatatggtgaaaccccgtctctactaaaaatacaaaacaattagccaggcatggtggcacattcctgtaatcccagctactcaggaggctgaggcaggagaatctcttgaacccggggtcagggcggggggacggggaggttgcagtgagccgagatcgca

SEQ ID NO: 2153 - DNA, 601 bp, Human
cctgacaagaaaagcagcctacgcgtacgcagaggcacgaacctatttagggaatagtttgacttgttgggagaaaaaagcaaggtcaggtgcttatgcctgtaaccccaccacttcgggaggccaagatgagaagatcgctcgagccccggagtttgagaccagcctgggcaatatagggagacctcatctccacaaaattaaaattaaaaaattagctgggtgtggtggcatgcacctgagtaacagtcccagttactcaggagactaagatgggaggatcacctgagcctaggagtasgaggctgcagtgagcccttaactgtgccactgaactccagcttgggggacaaagaccctggtgtttatttttaaaaaagaggctgggagtggtggttcatgcctgtaatcccagaactttgggaggccgaggcgggaggatcacaaggtcaggagtttgagaccagcctggccaatatggtgaaaccccgtctctactaaaaatacaaaacaattagccaggcatggtggcacattcctgtaatcccagctactcaggaggctgaggcaggagaatctcttgaacccggggtcagggcgg

SEQ ID NO: 2154 - DNA, 601 bp, Human
ggaaaaagagataattacaatacagtgtgatgactgccatttggaagggtttctagaagggagctcacagcaaacacacagaagccagcacagaggactcaggagtctctagaccgctttcagggaagacagtgagtgaagtgagcagtcatggagggcattcctgacaagaaaagcagcctacgcgtacgcagaggcacgaacctatttagggaatagtttgacttgttgggagaaaaaagcaaggtcaggtgcttatgcctgtaaccccaccacttcgggaggccaagatgagaagatsgctcgagccccggagtttgagaccagcctgggcaatatagggagacctcatctccacaaaattaaaattaaaaaattagctgggtgtggtggcatgcacctgagtaacagtcccagttactcaggagactaagatgggaggatcacctgagcctaggagtacgaggctgcagtgagcccttaactgtgccactgaactccagcttgggggacaaagaccctggtgtttatttttaaaaaagaggctgggagtggtggttcatgcctgtaatcccagaactttgggaggccgaggcgggag

SEQ ID NO: 2155 - DNA, 601 bp, Human
atacttactactcccttctcctaacttactctgaatctctcctggagagtccaatccttcaagacctctggtgctcatccctcaatcagaactgactccaccttcctctgaaccctgctctcccgagcagttgaacctttttaacttattttgcaaagcatgataatttcggctgtactggatctaatcttatttatgcaaaaatactcagtatagcctatgatgctgaagacagaaggagatcaagtacagcttcctacatcaagctcatcatctagtaggaaaaagagataattacaayacagtgtgatgactgccatttggaagggtttctagaagggagctcacagcaaacacacagaagccagcacagaggactcaggagtctctagaccgctttcagggaagacagtgagtgaagtgagcagtcatggagggcattcctgacaagaaaagcagcctacgcgtacgcagaggcacgaacctatttagggaatagtttgacttgttgggagaaaaaagcaaggtcaggtgcttatgcctgtaaccccaccacttcgggaggccaagatgagaagatcgctcgagccccggagtttga

SEQ ID NO: 2156 - DNA, 601 bp, Human
gctgggccttcctgatgctctccaagttcagttgttgatattttcttttaaaaaagccacactgaaacaaaggaaggaaaagtccagttacaggccaaagatagccatctgtttcagaaaaccggcattctggctgttgcctaaatagcccctatattcctctgcttctcatacttactactcccttctcctaacttactctgaatctctcctggagagtccaatccttcaagacctctggtgctcatccctcaatcagaactgactccaccttcctctgaaccctgctctcccgagcagytgaacctttttaacttattttgcaaagcatgataatttcggctgtactggatctaatcttatttatgcaaaaatactcagtatagcctatgatgctgaagacagaaggagatcaagtacagcttcctacatcaagctcatcatctagtaggaaaaagagataattacaatacagtgtgatgactgccatttggaagggtttctagaagggagctcacagcaaacacacagaagccagcacagaggactcaggagtctctagaccgctttcagggaagacagtgagtgaagtgagcagtca

SEQ ID NO: 2157 - DNA, 601 bp, Human
gggacaatgtatggttaaaaactaatattctaccaacagctccatgctgctctagatcatcctgaaggaaaaagtaatgcaaaggatgctgggtctccaagtcccaggactggctgatagcctctcccagtggatagcaggtcctaattctcttcttcgagcagattctctgatttcagctgggccttcctgatgctctccaagttcagttgttgatattttcttttaaaaaagccacactgaaacaaaggaaggaaaagtccagttacaggccaaagatagccatctgtttcagaaaacyggcattctggctgttgcctaaatagcccctatattcctctgcttctcatacttactactcccttctcctaacttactctgaatctctcctggagagtccaatccttcaagacctctggtgctcatccctcaatcagaactgactccaccttcctctgaaccctgctctcccgagcagttgaacctttttaacttattttgcaaagcatgataatttcggctgtactggatctaatcttatttatgcaaaaatactcagtatagcctatgatgctgaagacagaaggagatcaagtacagc

SEQ ID NO: 2158 - DNA, 601 bp, Human
ggtgggcacctgtaatcccagctactcaggaggctgagtcaggataatcacttgaacccaggaggtggaggttgcagtgagctgagatcccgccactgcactccagcctgagtaacagagcaagactcggtctcaaaaaaaaaaggtaggaaatgggcaggcactcatgccaaggacccccgcaatgggtcaggccttgactgaggccctacaggcttggagcagggtctaccaggaatagatgctgagcctcagtcctgcagagggctgaacactggaatagggctgtctgcataaagcygaacagcacaatgagctgctgtgctactaaaaccagaaacagaaaaactccagctactggtctaggaaagcagcacggaagctgaccatctaccatgaatgagatgaattacccataaaaactgtaactccaggcctgagcaattggaatacactgcttttatggtgaagacatctccaattgaaaaattaacagaaaaactagtcccacggtgaacctggagattctcgacaacggcaaacataaaactgctctgcagggatgcccccacaacctccaaggaagagctaatgaaaagct

SEQ ID NO: 2159 - DNA, 601 bp, Human
aagcttagaaagtaaatcccagaaacgaagaggaaaccattcaataaatgaatggacctttcagaagtatttggttttggcaaaaaaaaaaaaaaaaaaaaaaaaagaaaacaccaaaaaacaaatgaatggacttaaaagaataggtgggggctgggtgcagtggctcacgcctgtaatctcagcactttaggaggctgaggcaggcagatcacctgaggtcaggagttcaagaccagcctggccaacgtggtgaaacgccatctctactaaaaatacaaaaattagctgggcatggtgstgggcacctgtaatcccagctactcaggaggctgagtcaggataatcacttgaacccaggaggtggaggttgcagtgagctgagatcccgccactgcactccagcctgagtaacagagcaagactcggtctcaaaaaaaaaaggtaggaaatgggcaggcactcatgccaaggacccccgcaatgggtcaggccttgactgaggccctacaggcttggagcagggtctaccaggaatagatgctgagcctcagtcctgcagagggctgaacactggaatagggctgtctgcataaagccg

SEQ ID NO: 2160 - DNA, 601 bp, Human
aagacaccagacctaggcaaatccagaaaacaatctaatgcctcaggagaatatcatggatcaagctgacatggaaaggctctccatgtcatggaacaggaatgaaaacatcttatctgcttcttctaactctaaacatatacaactgctggataaaatgtaatttaaaattttttaatatatagcctaggctggaagcttagaaagtaaatcccagaaacgaagaggaaaccattcaataaatgaatggacctttcagaagtatttggttttggcaaaaaaaaaaaaaaaaaaaaaaaaagaaaacaccaaaaaacaaatgaatggacttaaaagaataggtgggggctgggtgcagtggctcacgcctgtaatctcagcactttaggaggctgaggcaggcagatcacctgaggtcaggagttcaagaccagcctggccaacgtggtgaaacgccatctctactaaaaatacaaaaattagctgggcatggtggtgggcacctgtaatcccagctactcaggaggctgagtcaggataatcacttgaacccaggaggtggaggttgcagtgagctgagatcccgccactgcactccagc

SEQ ID NO: 2161 - DNA, 601 bp, Human
tttgaagacaccagacctaggcaaatccagaaaacaatctaatgcctcaggagaatatcatggatcaagctgacatggaaaggctctccatgtcatggaacaggaatgaaaacatcttatctgcttcttctaactctaaacatatacaactgctggataaaatgtaatttaaaattttttaatatatagcctaggctggaagcttagaaagtaaatcccagaaacgaagaggaaaccattcaataaatgaatggacctttcagaagtatttggttttggcaaaaaaaaaaaaaaaaaaaaraaaagaaaacaccaaaaaacaaatgaatggacttaaaagaataggtgggggctgggtgcagtggctcacgcctgtaatctcagcactttaggaggctgaggcaggcagatcacctgaggtcaggagttcaagaccagcctggccaacgtggtgaaacgccatctctactaaaaatacaaaaattagctgggcatggtggtgggcacctgtaatcccagctactcaggaggctgagtcaggataatcacttgaacccaggaggtggaggttgcagtgagctgagatcccgccactgcactc

SEQ ID NO: 2162 - DNA, 601 bp, Human
aaaggctttataatctaattcaagctgcatacatgggaaagaaaacagccttagcaacagctaggaggaccctgccttaaatgctgtcaaaaagcagactcaccagggcaggtctgggcaggctcccttctgtaaaggggcaatctttggttctctaaggggctattccattccctctcagggctacagtcccttctccatccacacagtcacaacagcacagcacagagtccccagcaacaggcccaccctgcacagaatcaatcagccccactcctgtgatagtcgcgctctccctctyggggccggcggcagcgatgggatctccctgcctggctttcctttgtgtttctcccttctcctttcccgaagtcttcatgaacaccttgtacttggacaggtggaactctcttttaacctcagcctcgggccacccaaactttccattacctcctcattttgtcatgaaaagaacaatcatggaaattacattcccagctggaagaaggaactgaggtcccatctgtagctatttggcaagtggatcataggcccagaaggaagtaagtctatccaaactctccccctctctcttcctcca

SEQ ID NO: 2163 - DNA, 601 bp, Human
tccaagtggccctattcctgaagggagttactttccattacagctctaagagtttcagcttgatctagaactaataaagttggaagagagagcttatattgttttaccaatgggttcacaaagtaaagggaagaggggagagtgtcccagccagagaagagcatgtgcaagagtcctgtggcagaagggagcacagagcccaaggacagagggaggtcggggggctgtggtgcagagtaacgggtgaggatgggcgaggaggagcctgggaggcaggctgggccagactgtgcagggtctscagccatgttaaggaagtcgctctttcaggataaatgatggaaaacgagcactaacaggcctgagggaaaggctttataatctaattcaagctgcatacatgggaaagaaaacagccttagcaacagctaggaggaccctgccttaaatgctgtcaaaaagcagactcaccagggcaggtctgggcaggctcccttctgtaaaggggcaatctttggttctctaaggggctattccattccctctcagggctacagtcccttctccatccacacagtcacaacagcacagcacagagtcc

SEQ ID NO: 2164 - DNA, 601 bp, Human
atgcaagatcttgatcattgttgggtctgggtgatgggcatgtagggttcattttactggtctattattatatatctttgaaattttgcacaaattctttcaaattgcatagttgtggttatagactgttgggagtagatggtccttgggacctctcattccatgcagaacacttctgcccaccaccactaacactgacaggcaactcaccacctctgggagcccacgtctagaagtcaggaagtcctgccccataacttctataccagttgtgacttctgcaggggcacagcacccaccstcctttaagacaccctccccactatgagatctatcctgtttcccctgggccacccgtatcccaaccaaacacttcccatttagacgcacattgacagaaagatgaaccagctacagaaatccctgagaaatgttgtaagtcaattaggagttccggaaacccagttggagaagactgaataatgaaacccaaccccaagaagggatcagaaagccagtgaatactgagggccagaggaaggtttcaaggctgggcaagtactaagaccacgggcagggtcacaagagaggcaacagggag

SEQ ID NO: 2165 - DNA, 601 bp, Human
gccagggaagcaccttttccttaggtggccccttagagtcccttaataactaagccttcttggtagctcctgaactaaggaactgagtagaggagaccctcaaggaaaggaccctctggcattcaccaaactagattcactcctctcaccccagagtggagaggtgatgagtggaggttttccatatcttgtctgtgtctccatcctttcagcagggagggggactagtggggacgccctagagaacagccaccacatcctaccctctgtcatcagtgcctcttacctgtcctctctcctstaagacttttcctccctgcctccttgccctattttccttctcctatgcctaaagcttaggtctgccaacatcccccacaggtcctgcttcatcctgcttgtggctcagacgggcagaggagggtgccgagctctggactaaaagttgggccatggggcaggggtgcagaaagaggaagaagagaggaagctaagaggcagtttaacagtgtcctgagggattttgaggactaatgatgggtacaggggcccgcatctggtgaggtcctacagttatagtccttttttcagattccattat

SEQ ID NO: 2166 - DNA, 601 bp, Human
agatcaagactgggctatattccacccctcctttgaatttcccccagataggcagagttgtaaacactcctcaccacccacttcaccccacaaatcactagcctccctccctcccagcataccttgtacagcatataatggttttttgtcactgcaaagatgaggttgatgttgttctctgccaatttctctccaagcaaggcaagggatggatagtcctagggccaaggcaaaagtcaaggctatgacattcctaacaggtgtagataccagcacctggctccaatgcacagtcagcagmcagcatttgccagggaagcaccttttccttaggtggccccttagagtcccttaataactaagccttcttggtagctcctgaactaaggaactgagtagaggagaccctcaaggaaaggaccctctggcattcaccaaactagattcactcctctcaccccagagtggagaggtgatgagtggaggttttccatatcttgtctgtgtctccatcctttcagcagggagggggactagtggggacgccctagagaacagccaccacatcctaccctctgtcatcagtgcctcttacctgtcc

SEQ ID NO: 2167 - DNA, 601 bp, Human
tccaggagttcaagatcagaccaaccagggcaacatagtgagacctcatctctctatatatatttttaaattaaaaacaaaaataaaaaaatggattgtcgattctcccatgttagtctgcagctctaccctgagctccatgagcctgagggattcccgccctgccactgtgaggtgagctcagcatgcgaacttttcacttcttgcagtgtggtcctgtggctggtggatgctctgctccctcaggcagagaatacggtggcagcgttagcctgggcactgggtaggtggagaataccaytgcctgcctatgcgaggtgtcagaacctaagcacttcccaggccaccagcctgagtctgagccactccttggctcactgagatctgcagatgagagtcaagatggcagaggtgagagggagactcatcaagcaaggatgggtttctccaccctgaccctgagtgaagcaggaagaagataccaaactcaaggggatgggggagcagagccaagaagagcagcacggagaactgcccacctgagcccgcggcagctgcagggcctcagtgggagagggtggaagggaggtggcagtggggg

SEQ ID NO: 2168 - DNA, 601 bp, Human
gcttggaatgtgaaagtgattcctaaaccacctctataagaacttacacttattatattagggccaatttcacatgatatgttacaatagcacagaatttaatagccccattcacgaaccctctgaaaggacttcattacaatcacatcttaagtaggtaggcaaaaacattgattctttggccaggcatgatggctcatgcctgtaaagccagcactttgggaagctgaggtgggaggactgcttccaggagttcaagatcagaccaaccagggcaacatagtgagacctcatctctctmtatatatttttaaattaaaaacaaaaataaaaaaatggattgtcgattctcccatgttagtctgcagctctaccctgagctccatgagcctgagggattcccgccctgccactgtgaggtgagctcagcatgcgaacttttcacttcttgcagtgtggtcctgtggctggtggatgctctgctccctcaggcagagaatacggtggcagcgttagcctgggcactgggtaggtggagaataccactgcctgcctatgcgaggtgtcagaacctaagcacttcccaggccaccagcctgag

SEQ ID NO: 2169 - DNA, 601 bp, Human
acttagttttaacaggaagatgcactctgaatgccaatttagaaattacctggcgccttgagcaggtgggtaggcaatggatgccataaccatcttgggacccacaagagaagggatagcagaaggtccacacttcccaacacaagagctctgcctgccgtttgcctgacagaaggtaggtctgagtcaagtacttttggggtgttatgaatcgagggaaaggagggtaggaaagagaaaggcttgggaggtgagtctgtggatgcgtggcttggaatgtgaaagtgattcctaaaccacmtctataagaacttacacttattatattagggccaatttcacatgatatgttacaatagcacagaatttaatagccccattcacgaaccctctgaaaggacttcattacaatcacatcttaagtaggtaggcaaaaacattgattctttggccaggcatgatggctcatgcctgtaaagccagcactttgggaagctgaggtgggaggactgcttccaggagttcaagatcagaccaaccagggcaacatagtgagacctcatctctctatatatatttttaaattaaaaacaaaaataaa

SEQ ID NO: 2170 - DNA, 601 bp, Human
tattacccaggaaactacaatggtcttggaaactctgtgtcgggaaccagcgttaaagaccaaatataataacaaaagattctcctagtgtccttatctataaaggttttaggggctttatattaggaactaggggcagagacctatatatatatcttatcgtaccacagtatcacaggttctaatcaacacaggaaaccaacatacccctgacatggctttgaccaactgaacttgcttcaaatatcttgcagttttacatttctatatttaatatatatattttaaatttcacctgaasggaggggtggaagaagggaattatcaagggtcactttttggagtaatgaacatgttcagtatctctatggtggcgacggtttcacaggtgtatacctgtgccaacactcatattatacactttaaatcagtacagtttgctgtatgttaattatatgtcaataaggctttacaattcttttccaatttaaaaaaaaaaaaaaaagagacagagtctcactctgtcacccaggctagagcacagtgatacaatcatagctcactgcagccttgaactcccgggctcaggcgatcctcctgc

SEQ ID NO: 2171 - DNA, 601 bp, Human
agagccagtgagcttggttccctggccctccctcatcctttcccttctctctgcactcacacaacatcttgctagacccagcctgaggtctccctctgtgagtttggagaagttgatagtggttgacctgccatatgatattatctgcttcaaacgggttatgccccatcccctgcttgcttctccagagccacctctcatccccatcctcggcttcagacacgcagttcctcaatcttgcagtgtgtactccaggctttgagcctttccatgtgcccagggcaatgatcctttgcacaayggctcctctctctcctcctcctggctggctccttatcatccttcaaaatcagctcagcaggcactttctccaggaatacaccctgtcattcacatccatacctatccccatcagatgaggtccatatgcctgagtttgaaactacataatgagagactccaatcttatgtgtggattatattcttaagacagtgaatcaaacaaaaatcaagtcaaaattacctatcagaatagaaaaaaagtaaagtttttttctattatttcccaacactaagaacatcaagtgttgggaaaggatgt

SEQ ID NO: 2172 - DNA, 601 bp, Human
ctaaagtgcttgctggggacacttacctgagcagaggactcccttgttcctggcacaggagaagttgtcgcactcacagaaaggcccatagatcttgccaaactcgctctcgaagcaggagcactggttgcagctgcagtccccacgcccgctgcacagtggcttgccctctgcctcccggcacaggttctggtacacgctctggttctccccatcctggcactcgcacctggtgcccaggtagccggggctgcactcacacaggccgcagacataggtcccgctcccgttgcacctggcrctgttgggttccagccccacgctgcagccgcacgtgcagttgtaggtgacccccacctccaggctgtcccggaatcccaccggccgcagggcaaacacatgctccgtgtgtctgctgggacagcttcgggcctccaatgatacttcaaaagatgcctgggcagaaggaagagaagggatatcatggctgcggcaagccagggtctcccattcacccaggggcagggcccttgatgaagagcagctgcgaactccagccctctccacgcactcaggtagaaccaccaagatggccggagta

SEQ ID NO: 2173 - DNA, 601 bp, Human
ctggctcagagctaaagtgcttgctggggacacttacctgagcagaggactcccttgttcctggcacaggagaagttgtcgcactcacagaaaggcccatagatcttgccaaactcgctctcgaagcaggagcactggttgcagctgcagtccccacgcccgctgcacagtggcttgccctctgcctcccggcacaggttctggtacacgctctggttctccccatcctggcactcgcacctggtgcccaggtagccggggctgcactcacacaggccgcagacataggtcccgctcccgytgcacctggcgctgttgggttccagccccacgctgcagccgcacgtgcagttgtaggtgacccccacctccaggctgtcccggaatcccaccggccgcagggcaaacacatgctccgtgtgtctgctgggacagcttcgggcctccaatgatacttcaaaagatgcctgggcagaaggaagagaagggatatcatggctgcggcaagccagggtctcccattcacccaggggcagggcccttgatgaagagcagctgcgaactccagccctctccacgcactcaggtagaaccaccaaga

SEQ ID NO: 2174 - DNA, 601 bp, Human
cgaattctgagagtccacaatttatggcaataccttctgctttcgtattctgcacacagatccccacctcctgcctacgggtagcaaggcttgcccactgtcttctccaaggagagccatggtagtgacactttctaccaccactgagtaaaaggcaggctttgggagggtgtcctaacggcatcttggcctggctcagagctaaagtgcttgctggggacacttacctgagcagaggactcccttgttcctggcacaggagaagttgtcgcactcacagaaaggcccatagatcttgccraactcgctctcgaagcaggagcactggttgcagctgcagtccccacgcccgctgcacagtggcttgccctctgcctcccggcacaggttctggtacacgctctggttctccccatcctggcactcgcacctggtgcccaggtagccggggctgcactcacacaggccgcagacataggtcccgctcccgttgcacctggcgctgttgggttccagccccacgctgcagccgcacgtgcagttgtaggtgacccccacctccaggctgtcccggaatcccaccggccgcagggcaaacaca

SEQ ID NO: 2175 - DNA, 601 bp, Human
gcgttcctcagccaaagagaagcgacgtttgtattatgatttgtttctgatcctctgtgtcccttcctccttagcatgggtaatgatgacacagctgtttctccagcaaactccaagagcaaatgtcactcctgctttccaggggcatcattctgtaattccctctcatttgcactctggtggagcatgcggggctgagcaggaggaggtcagcacggctatgggaggccatggccgagtcagcgaaggctggggcccaggtctagacaatctctgcattcagcagcagcacagagcccgygttctattatctgtataaatggagcagaaaattcaaaagccatttgcagtggtttctggcatgccttatctaggtcgggtgcctttctctccaatttacttttttttttttttttttttgagacggagtctcactttgttgcccaggctggggtgcagtggtgcgatcttgcaatctccgcctcccaggttcaagccattctcctgcctcagcctccggagcagctgagattacaggcacgtgccaccacaccccgctaatttttgtatttttagtagagacgggtgtttcaccatgttg

SEQ ID NO: 2176 - DNA, 601 bp, Human
tatattgtagtcatgtactaaaataagtctgccttttaaaaaaattaagttgtttagagacactttgctcttgagagcctgttaactgaaatcagctgggtgttgagtgtgaactcacccaaagtgaaaagtgtggttagttagatccagaaaacgaagactggctgccctgaaacccccagaaaaaaaaggatgtaggacattcaaaacctggtgcctcctaacaagcagcaagtagaaaaaacagactctgatgtaagtcaccatcaaaaggacttcgtttaaaaagaaaaaaaagttycacctaggctgtgaaagagacagagggtcagtgtggcccagagacaaataagaaggaatagtgggctgggtgtaatggctcacacctgtaatcccaacactttgggaggctgaggtgggagaattgcttgagttcagacgtttgagaccagcctggtcaacatagcaagaccctgtctctacaaaaaaataaaaattagccaggtgtggtggtacaagccaatagtcctagctacctgggaggctgaggcaggaggatcacttgagcccaggagttcaaggctgcagtgagctgtgatgg

SEQ ID NO: 2177 - DNA, 601 bp, Human
aagagggctgctttctctcccggccaggattctctgtccctgccatctgattctctgttgttaaaccatagctccaggctgcttccaggaaacactccctaagtatccatgtggacatatcagtctaactcatatgccccatgtactggttgaaacttgtaatatattgtagtcatgtactaaaataagtctgccttttaaaaaaattaagttgtttagagacactttgctcttgagagcctgttaactgaaatcagctgggtgttgagtgtgaactcacccaaagtgaaaagtgtggttrgttagatccagaaaacgaagactggctgccctgaaacccccagaaaaaaaaggatgtaggacattcaaaacctggtgcctcctaacaagcagcaagtagaaaaaacagactctgatgtaagtcaccatcaaaaggacttcgtttaaaaagaaaaaaaagttccacctaggctgtgaaagagacagagggtcagtgtggcccagagacaaataagaaggaatagtgggctgggtgtaatggctcacacctgtaatcccaacactttgggaggctgaggtgggagaattgcttgagttcaga

SEQ ID NO: 2178 - DNA, 601 bp, Human
ctggcctcccagagctcctcacactcccatggtcagagctcaatgccccaacattgtcctagttccccacatcacgccctggtcatcacccagggcggggatctcaaccctcctgcacgttcaactctccagggagctttcaagagaaactcccagtacctgggcccaaccacacctccggggactgggcttcctgggcaattctgatgcatgtcgagggctgagatccactgtcccggagaatctcgggctccagcccccttctccctctcagatagagcccatctgccaggtcccccgkggcctgctgcccacttacccacgaatcagtctacactaggctctggcacaggctctagggtgatggctcctcccagggaacccttgttctttaacaggggcctcctctagaaaatggatgagcagccaaaaagtgacaccttgagcctctctcctcccacctcaggctaacagcaggtggtggctcagatagtgggtgaaaatgcttaactacaacgttcaattaaatggtcattattatactttatatcatcaaaaccaagttgcacacattctttgtctgtcttcggagacatctggg

SEQ ID NO: 2179 - DNA, 601 bp, Human
aaaagaggagataaaggtgggtgtcagataatgtagaacagtcccacacctgtccctgagctcctgacagtgcaggacctgggaaggctttcacttctttccagctgcagatgttcagcctcagggaatgtttctgctctgcctttcttcttgttatgggaggaagcccaagggttcttggaggagcctgtgtgagtttagtggcatgtcttgtctacatgtcaggttgcagacctttcaaattctgacaccaggagacaaatccatctgcactctggtccatctaatgcctggtgaggartctgctccaagccagaggtttctgggtgataaaacagtattcctggcctcccagagctcctcacactcccatggtcagagctcaatgccccaacattgtcctagttccccacatcacgccctggtcatcacccagggcggggatctcaaccctcctgcacgttcaactctccagggagctttcaagagaaactcccagtacctgggcccaaccacacctccggggactgggcttcctgggcaattctgatgcatgtcgagggctgagatccactgtcccggagaatctcgggctccagcc

SEQ ID NO: 2180 - DNA, 601 bp, Human
accctcctccccaggaaggagaaaaaccgtgactgcccgggtggtggcagcacactcaccgatggtgtccacccatgtgatcacctcatccctgcataggctgtggcaggtctggttgtcaggtttcccagagtggagcagcaggcactcgacgcaatctctttggaaaagaggagataaaggtgggtgtcagataatgtagaacagtcccacacctgtccctgagctcctgacagtgcaggacctgggaaggctttcacttctttccagctgcagatgttcagcctcagggaatgtttcwgctctgcctttcttcttgttatgggaggaagcccaagggttcttggaggagcctgtgtgagtttagtggcatgtcttgtctacatgtcaggttgcagacctttcaaattctgacaccaggagacaaatccatctgcactctggtccatctaatgcctggtgaggagtctgctccaagccagaggtttctgggtgataaaacagtattcctggcctcccagagctcctcacactcccatggtcagagctcaatgccccaacattgtcctagttccccacatcacgccctggtcatcaccca

SEQ ID NO: 2181 - DNA, 601 bp, Human
catttttgtacgtatttttacatggacatatggacctaatcctctaggctgtatacctgggagtggaattggcacattgtatggtgattctacgtttgactttttaggaaactgccaagctgctttccaaagtccgtaccattctacattcccatcagctgtggatgatggttccagcaccgggtcctcatggggagcccacagttatgcccaggaagcctgggcagtgcctcctgactcaaggctaaaactaccctcctccccaggaaggagaaaaaccgtgactgcccgggtggtggcrgcacactcaccgatggtgtccacccatgtgatcacctcatccctgcataggctgtggcaggtctggttgtcaggtttcccagagtggagcagcaggcactcgacgcaatctctttggaaaagaggagataaaggtgggtgtcagataatgtagaacagtcccacacctgtccctgagctcctgacagtgcaggacctgggaaggctttcacttctttccagctgcagatgttcagcctcagggaatgtttctgctctgcctttcttcttgttatgggaggaagcccaagggttcttggag

SEQ ID NO: 2182 - DNA, 601 bp, Human
gcgaataatgctgctgtgaacatttttgtacgtatttttacatggacatatggacctaatcctctaggctgtatacctgggagtggaattggcacattgtatggtgattctacgtttgactttttaggaaactgccaagctgctttccaaagtccgtaccattctacattcccatcagctgtggatgatggttccagcaccgggtcctcatggggagcccacagttatgcccaggaagcctgggcagtgcctcctgactcaaggctaaaactaccctcctccccaggaaggagaaaaaccrtgactgcccgggtggtggcagcacactcaccgatggtgtccacccatgtgatcacctcatccctgcataggctgtggcaggtctggttgtcaggtttcccagagtggagcagcaggcactcgacgcaatctctttggaaaagaggagataaaggtgggtgtcagataatgtagaacagtcccacacctgtccctgagctcctgacagtgcaggacctgggaaggctttcacttctttccagctgcagatgttcagcctcagggaatgtttctgctctgcctttcttcttgttatgggagg

SEQ ID NO: 2183 - DNA, 601 bp, Human
aaagtgtacaatcagtcgttttactcaactcacaatgttgtgtaaccattcccactaattctgaatatttccatcaccacagaaagaaatccacacctgttagtagtcaatgccaattttcccttctccctagcatcaggacaccactaatgtactttctgtctccatggctttctctgtgttggacatttcatatgaacagaaccatataatacatggcttcttttgctccgcactgtggtcaggcctcaccgtgccgtagcgtgtttcagtgcttcacacctcttagtggctcaatagygtccactgtatagatggaccacactttgttttcttttctatttatccgttgatggacatgtggttcatttccacctttggctatagcgaataatgctgctgtgaacatttttgtacgtatttttacatggacatatggacctaatcctctaggctgtatacctgggagtggaattggcacattgtatggtgattctacgtttgactttttaggaaactgccaagctgctttccaaagtccgtaccattctacattcccatcagctgtggatgatggttccagcaccgggtcctcatgggg

SEQ ID NO: 2184 - DNA, 601 bp, Human
gcagaagccagaggtgaagatagaggggaagcctgccagtgaggggagcctgagacacagattccctttcaaggtgcataatttccccctcaccatttaaaccattttaaagtgtacaatcagtcgttttactcaactcacaatgttgtgtaaccattcccactaattctgaatatttccatcaccacagaaagaaatccacacctgttagtagtcaatgccaattttcccttctccctagcatcaggacaccactaatgtactttctgtctccatggctttctctgtgttggacatttcrtatgaacagaaccatataatacatggcttcttttgctccgcactgtggtcaggcctcaccgtgccgtagcgtgtttcagtgcttcacacctcttagtggctcaatagtgtccactgtatagatggaccacactttgttttcttttctatttatccgttgatggacatgtggttcatttccacctttggctatagcgaataatgctgctgtgaacatttttgtacgtatttttacatggacatatggacctaatcctctaggctgtatacctgggagtggaattggcacattgtatggtga

SEQ ID NO: 2185 - DNA, 601 bp, Human
tggactgcttgaccccaggagtttgagaccagcctgggcaacatggtgaaactccgtctctacaaaaacaaaaatttgccaggcatggtggcacatgcctgtggtcccagctacttgggaggctgaggaaagaggtttgcctgagcccaggaggtcgagacttccagtgagctatgatggtgccactgcactccagcctgggtgacagagaccctgtctcgagacaaaaaaccctcagaagccgtgactgtagtcagtcaaaataggcaggtgggaacaaggaagtctacaaaagatgtamgttaggaccaagacagacaggcagctgggggccaggagtttgcagaagccagaggtgaagatagaggggaagcctgccagtgaggggagcctgagacacagattccctttcaaggtgcataatttccccctcaccatttaaaccattttaaagtgtacaatcagtcgttttactcaactcacaatgttgtgtaaccattcccactaattctgaatatttccatcaccacagaaagaaatccacacctgttagtagtcaatgccaattttcccttctccctagcatcaggacaccactaat

SEQ ID NO: 2186 - DNA, 601 bp, Human
acagaaggtgaacactagggcggtaaatgctttccagctcttgcctttttaaccttttcaaccttgctgctagacggagctgtaacctggaagcagatgaattagtgtggttatcagacacgaaagcctggactttctgtctcagctcccttctgggctgggtgagtatgagtgagcatgtgagtgtgtgtatgaaaaaagcttggaagaaagaagaaaaagggtaaatgatggattggaacataagctttctctgctgctctctcagaggactgggttgggaagcagctgtgcatgaacrgctgtcactgctataaaccaagcgaaccagtccttgggccacaggaaggcattgtttccttctctgaccatgtgtgcctagttaggggcaaccagcccaggtctgctggcagaacctgaggtcggccaggccctgagctgcaagatagaagcaggggcaggaagacaggcatgtgaggaaccagactgtggtccactccccacagtctcctaaggagatagacagcacctggcacacagtaggcgctcaacgaatatgtgctggatgcatatatagctcaaatattaagaaggagctggg

SEQ ID NO: 2187 - DNA, 601 bp, Human
ggtggccatgcctggagataaagtgagacagtgtggaactcaggctgtccccagcctggccctgaacgtggcccggcctccctcctccatattaagaagccccttcctcaagctgcctcagcaactccctgcccccttgctgccattccccaaggtgggggtgtcacagtcccctgtccaggcattacctacattccaaggcttccctgggagagggttagcgggctgttttttggagagaaaggaactaggggaagtgcaaagtgaggcaaggggtgaggaaatgcagtggcaatggcartgggtcctggggaggaacagaaggtgaacactagggcggtaaatgctttccagctcttgcctttttaaccttttcaaccttgctgctagacggagctgtaacctggaagcagatgaattagtgtggttatcagacacgaaagcctggactttctgtctcagctcccttctgggctgggtgagtatgagtgagcatgtgagtgtgtgtatgaaaaaagcttggaagaaagaagaaaaagggtaaatgatggattggaacataagctttctctgctgctctctcagaggactgggttgggaa

SEQ ID NO: 2188 - DNA, 601 bp, Human
gcttgagtggggcttcatatttgagaaacagcccaggccacttggggctgagagctggccacagaggccaagaggcagcaactccttcctgggatgcaaaatcaaaaagaaccacagggcagtgaggacactgggtgagaggctggtgcccaccgtggtggccatgcctggagataaagtgagacagtgtggaactcaggctgtccccagcctggccctgaacgtggcccggcctccctcctccatattaagaagccccttcctcaagctgcctcagcaactccctgcccccttgctgccrttccccaaggtgggggtgtcacagtcccctgtccaggcattacctacattccaaggcttccctgggagagggttagcgggctgttttttggagagaaaggaactaggggaagtgcaaagtgaggcaaggggtgaggaaatgcagtggcaatggcaatgggtcctggggaggaacagaaggtgaacactagggcggtaaatgctttccagctcttgcctttttaaccttttcaaccttgctgctagacggagctgtaacctggaagcagatgaattagtgtggttatcagacacgaaagcc

SEQ ID NO: 2189 - DNA, 601 bp, Human
ggtgaagggattggccacggaaattaaagggataaagaaagaaagaaaaaccatcccagccccctttgaggcttgagtggggcttcatatttgagaaacagcccaggccacttggggctgagagctggccacagaggccaagaggcagcaactccttcctgggatgcaaaatcaaaaagaaccacagggcagtgaggacactgggtgagaggctggtgcccaccgtggtggccatgcctggagataaagtgagacagtgtggaactcaggctgtccccagcctggccctgaacgtggcccrgcctccctcctccatattaagaagccccttcctcaagctgcctcagcaactccctgcccccttgctgccattccccaaggtgggggtgtcacagtcccctgtccaggcattacctacattccaaggcttccctgggagagggttagcgggctgttttttggagagaaaggaactaggggaagtgcaaagtgaggcaaggggtgaggaaatgcagtggcaatggcaatgggtcctggggaggaacagaaggtgaacactagggcggtaaatgctttccagctcttgcctttttaacctttt

SEQ ID NO: 2190 - DNA, 601 bp, Human
aattgtatccctcctctccctgcagtttcaaaaggccgatgaggacagaaagggcagtggtcccagagcagagaatggcatcagaaatcagaactgagggctggctgagtgggccgagcccttgcagccctcacctacctggctccctgaggacggtcaggttggacttcccactggggagctccacataggtgaacatcatgacgcagtccttggcggttttgtagaaacatagcacagcctcctggtcatctttcactggaagaaaaccaagcgggaatggcctgagtctctctgagcrgcccacagccactgatggtcggggcagggagccgagtgccttgaaaaaggaaagggcatggggggtgtgggcagaaaatcttaaggggaggctgggcctttgaagatgagttcagttttctcacaccaagaatgcaggcccagggctgaatttagatggctttggggacacgtggaacacattagaggatctccaagcctctgaagtgttagtcgggggtgatgtgaaataacagaaggttttaatggtttcggggtggggacgggtgaagggattggccacggaaattaaagggataaa

SEQ ID NO: 2191 - DNA, 601 bp, Human
gggtccaagcagaggcagaatgttggtatttggattaaagcttgacctcttcagtggtgctgggagctgagcatgggagcagcaggaatgttgaacccagtgctccgttgtccttggaatccatgctgggaagcagcagtggccccgcccaggctgtgtgtggagctggatgctccctgacttgagtgataccctgcccagccctggtggtctagatgccctgcaccctccctgcagaacacagcagctccttgctgcctttggctgtgcagggtaggtatgttctgtggttactttcacktctgtgctcctccaagatgagaccctccccagggacagggccctatccttctataactcccattgccctgactcacgctcccactagcgcttgccccaagaatgggcccccagctgcacattcatctttcttctaaactctaggagtggagcagcagtgacctcagatctggtcttcatgagaaattgtactggttaggtgcagtggctcaaacctgtaatcctagcactttgtgaggccaagacaggtggattgtttgagcccaggagttcgagaccagcctgggcaacatggtgaaaa

SEQ ID NO: 2192 - DNA, 601 bp, Human
gaagagagcaaatctttttctgctccacccctgcctccctacccccaagaagaatgtaaggggtgatatcagatattccagttactccaaggcaaaggctattggtccctgggtccaagcagaggcagaatgttggtatttggattaaagcttgacctcttcagtggtgctgggagctgagcatgggagcagcaggaatgttgaacccagtgctccgttgtccttggaatccatgctgggaagcagcagtggccccgcccaggctgtgtgtggagctggatgctccctgacttgagtgatrccctgcccagccctggtggtctagatgccctgcaccctccctgcagaacacagcagctccttgctgcctttggctgtgcagggtaggtatgttctgtggttactttcacgtctgtgctcctccaagatgagaccctccccagggacagggccctatccttctataactcccattgccctgactcacgctcccactagcgcttgccccaagaatgggcccccagctgcacattcatctttcttctaaactctaggagtggagcagcagtgacctcagatctggtcttcatgagaaattgta

SEQ ID NO: 2193 - DNA, 601 bp, Human
ttggaaacaaagcctcattcttacaggcgtgcatcctaggctggtaccacacttctctctgcctctggcctcaggaaggcacattatgtggttgggctcaatttggaaaaatagtttgcagtgctgtcgattgaagagagcaaatctttttctgctccacccctgcctccctacccccaagaagaatgtaaggggtgatatcagatattccagttactccaaggcaaaggctattggtccctgggtccaagcagaggcagaatgttggtatttggattaaagcttgacctcttcagtggtkctgggagctgagcatgggagcagcaggaatgttgaacccagtgctccgttgtccttggaatccatgctgggaagcagcagtggccccgcccaggctgtgtgtggagctggatgctccctgacttgagtgataccctgcccagccctggtggtctagatgccctgcaccctccctgcagaacacagcagctccttgctgcctttggctgtgcagggtaggtatgttctgtggttactttcacgtctgtgctcctccaagatgagaccctccccagggacagggccctatccttctataact

SEQ ID NO: 2194 - DNA, 601 bp, Human
agccacatgaagccacttccacaaggtctgggctgggggccaacatttgtaagcctttagcgtggtgtcccttggagtaaatgtgcttgttttcaaagaacctcagacacagcattggaaacaaagcctcattcttacaggcgtgcatcctaggctggtaccacacttctctctgcctctggcctcaggaaggcacattatgtggttgggctcaatttggaaaaatagtttgcagtgctgtcgattgaagagagcaaatctttttctgctccacccctgcctccctacccccaagaagaaygtaaggggtgatatcagatattccagttactccaaggcaaaggctattggtccctgggtccaagcagaggcagaatgttggtatttggattaaagcttgacctcttcagtggtgctgggagctgagcatgggagcagcaggaatgttgaacccagtgctccgttgtccttggaatccatgctgggaagcagcagtggccccgcccaggctgtgtgtggagctggatgctccctgacttgagtgataccctgcccagccctggtggtctagatgccctgcaccctccctgcagaacacagc

SEQ ID NO: 2195 - DNA, 601 bp, Human
ttcccctcatgggcagcacccacatcccgcctggcccagtctccattgcaggatgctggacccgctcagctttcgtgtacatggtttcaggagcagactgggcaggcaggaggtaccatgaagccacatgaagccacttccacaaggtctgggctgggggccaacatttgtaagcctttagcgtggtgtcccttggagtaaatgtgcttgttttcaaagaacctcagacacagcattggaaacaaagcctcattcttacaggcgtgcatcctaggctggtaccacacttctctctgcctcyggcctcaggaaggcacattatgtggttgggctcaatttggaaaaatagtttgcagtgctgtcgattgaagagagcaaatctttttctgctccacccctgcctccctacccccaagaagaatgtaaggggtgatatcagatattccagttactccaaggcaaaggctattggtccctgggtccaagcagaggcagaatgttggtatttggattaaagcttgacctcttcagtggtgctgggagctgagcatgggagcagcaggaatgttgaacccagtgctccgttgtccttggaatccat

SEQ ID NO: 2196 - DNA, 601 bp, Human
cctcaggagggtttccccaatgtacaaaaaatgaaagattcaaaagggacagtgactgttctaaagtcacacagcaagtgtggcaaagtctagatgagggccctggggcagggctgcctttcccctcatgggcagcacccacatcccgcctggcccagtctccattgcaggatgctggacccgctcagctttcgtgtacatggtttcaggagcagactgggcaggcaggaggtaccatgaagccacatgaagccacttccacaaggtctgggctgggggccaacatttgtaagcctttagygtggtgtcccttggagtaaatgtgcttgttttcaaagaacctcagacacagcattggaaacaaagcctcattcttacaggcgtgcatcctaggctggtaccacacttctctctgcctctggcctcaggaaggcacattatgtggttgggctcaatttggaaaaatagtttgcagtgctgtcgattgaagagagcaaatctttttctgctccacccctgcctccctacccccaagaagaatgtaaggggtgatatcagatattccagttactccaaggcaaaggctattggtccctgggtc

SEQ ID NO: 2197 - DNA, 601 bp, Human
tccacactctggggggaccagaagcatggtaagcaaagccactagcatcaccatgcccctctcacgcaactgcaggcatttctgagatgaaagttgcaccccttccaaaggccttctcctcggctctcccttagatcctcaggagggtttccccaatgtacaaaaaatgaaagattcaaaagggacagtgactgttctaaagtcacacagcaagtgtggcaaagtctagatgagggccctggggcagggctgcctttcccctcatgggcagcacccacatcccgcctggcccagtctccaytgcaggatgctggacccgctcagctttcgtgtacatggtttcaggagcagactgggcaggcaggaggtaccatgaagccacatgaagccacttccacaaggtctgggctgggggccaacatttgtaagcctttagcgtggtgtcccttggagtaaatgtgcttgttttcaaagaacctcagacacagcattggaaacaaagcctcattcttacaggcgtgcatcctaggctggtaccacacttctctctgcctctggcctcaggaaggcacattatgtggttgggctcaatttggaaaaa

SEQ ID NO: 2198 - DNA, 601 bp, Human
cagaacacggcggggaagaggatgaggacacatgttagctcacacactcaaaccgacagacgcaggccctaggatcccttcccaggtcagccccctgcgacagcagcaggcagagcactcaggaggagacggccgtgggctctaggacagctctgtgttccccaggaaagccatcgccttctctaagctttcactatccacctctggaaggaggagttgggtcagaaggtctctgaagtcccttccagctttaacagaaaccaagcccaggttcagcagaaactgactgcgctcagtcctytgggcatttgcagtctgcctggggtgaccagactgcaggtgtgagtgttgtaatggaccataagaatctgagctttcctgttggtctgtgctctctctgagactggtcagactcttcctgaggcacgcccagcgcctctgcccccatgaccttcctgacctgggtctggaacagggatctgtgcagctcactctgcactggggctgtgcaattctctctctccagaactgggcacagcgtttctggtgttgattcttttgtttttaatgccaaagacattagtgagcctctattgctaac

SEQ ID NO: 2199 - DNA, 601 bp, Human
agtatcagaccagcctgtgtcccatccctgaggaagtacacggccgcttcaatccccactgggggcaccattttaagtccgctcagaaagaaagaaacacacagagagtatcagacaaacacaaattcttttggttttaatctttacttccaatcccaaacaatcttgtttcttttcattataaaagtactaaacaaacacggacaggagaggaaactgacatttgcaaacgatgtaccttcaacaggcatctcaacagccccatcaccaacacctgtgtgcaaggcatagccatcacgcrgaaaagtctcaggactcagaactacaccataaatgcaggatctttttatttcatataaaaatgatcaatgtgaaaaaagccaaactgtatgctggttttacagactccgacccttcctgacagtcttcttgtctggccaggctgggggcccagcattcctggaagggagagacagcccagcatctcagtatttcattgggacaacaagctggatgtggcagggaaagctgagagcgccaaggtccccttgctttatcccaagctcggagggacgcagcctggcatggctctggcctagca

SEQ ID NO: 2200 - DNA, 601 bp, Human
ttaaatattccttagttcatacatgtaaaatatttttccttccttccttccatccttccttccttcctccttctctttttctttctttctttttctttctttcctttcctttctctctttctttttctttctctcctttctttctctctctttcttcttttctttctctttctttccttccttccttccttccttcctttctttctttctttctttctttctttctttctttctttctttctttctttctttctttctttctttctttcttttcttttcttttgtctttctttcttccttytttccatccctgtagagcaggggtaaccaataggcagtgtgcccagggtagcctaaagtgttcagagtcttttaaccaaggctcagtaagacaagtgatgtttgcttttcatgctaacttgattgaaaaaaataaatgtatgaggtttaaattttttttcccaaagttgtgattatctacaggcaagccatgcaacacccgttaaacattaatataaaactactgctcatctttaaagcaatgatttaaagccataaatgtaacaggaagatctaattctggaagacatacaaatgccga

SEQ ID NO: 2201 - DNA, 601 bp, Human
tggagtgtactgtgtctgggaggaatgtactcctgtactgtgtttctgtggcaccacgtgacattagaattaatgaagttacaatgaatcactacaggggtccggcggacgttagctatctggaaatacctacctatggctgttctccatttgagtttaaaaagtatgtgaaatcatctcatttcattattctaaaccttccaatggcttttcatcaggcaaatctgagtctgtagaatggctcatatgtccctatttaagctggcgcccacttctgttggatgttatcactcacatctctctggttttgttgactgccttagacacaatcaccatgctacagagtgaccacagcctcaacagtttagccagagtccaatagtggtttcacattttgccctcaccccatctggcctccatacgctcactctccacgcagatgcctcctacaataccacaggcgtgttttcatttcgatgtgtttgcacttgttggtcaccttcctagaaggcttctctctcaggggcttatgtctttgtccctcacttctgtcaggttttgactcaatgtcatcttctcagggaggccttccttgattatt

SEQ ID NO: 2202 - DNA, 601 bp, Human
cgttagatgtgatcaaagattatgggaggaaccataatacactggggtcagggttgtaacatatggattatcgtctggtactatttaggacatgctgtatcagtggaggggggcagggaggagtagatacctagaggagactccaaggccccagggatatatctgaatgtgaggaaaccaagcttggtaatattggcctagaacttctaatgagagctggtgtgatacaagaatgtctacatgcagtcaataagcccaagacagcactggcatggctttccttccagttttatatatgtaygttatttcacctttctgtctcttctcttccccaccgttttcttccttgaaactctaagtttgtttgtctagtggagaaagctctgtatagtcactattttaagtgttaacttaattctatttatttatttatttatttttgagacggagtttcactcttgttgcccaggctcatggtgcaatctcagctcaccgcaacctccgcctcccaggttcaagcaattctcttgcctcaacctcccgagtagctgggattacaggcatgcgccaccacgcccggctaattttgtatttttttttt

SEQ ID NO: 2203 - DNA, 601 bp, Human
tttctaatttatctgaagctattgatttatttgtattgtctattcctttttattttttctaatattattccatgtaagtgattacttgctatgagttacatgttaaaaaatttagcatcagatatactataatattatcctttagtctctttatatgtttcagaacggccatgaagccatttctacttttaatggtacagtatccttgaggattaagttgtgcagtccagtttgcagacctgataatctctcacattaggatgctcacactgatataagtgaatcagctctctctaaaacrgccctgaggagatagaatttagtagcgttagatgtgatcaaagattatgggaggaaccataatacactggggtcagggttgtaacatatggattatcgtctggtactatttaggacatgctgtatcagtggaggggggcagggaggagtagatacctagaggagactccaaggccccagggatatatctgaatgtgaggaaaccaagcttggtaatattggcctagaacttctaatgagagctggtgtgatacaagaatgtctacatgcagtcaataagcccaagacagcactggcatgg

SEQ ID NO: 2204 - DNA, 601 bp, Human
cagttgagacaagaggaaggcatctgtctcctgcctgtccctgggcaatggaatgtctcggtataaaacccgattgtatgctccatctactgagatagggaaaaactgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctctsgagaaacacccacaaatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacagagatgctctaagatacgtaatggaagtagagtaagtattatgaaacagatgatggtgccccacttacctgaaacactcaacccagtaacaaccaagacaagg

SEQ ID NO: 2205 - DNA, 601 bp, Human
ctgtgctgaggaggattagtaaaagaggaaggaatgcctctttcagttgagacaagaggaaggcatctgtctcctgcctgtccctgggcaatggaatgtctcggtataaaacccgattgtatgctccatctactgagatagggaaaaactgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgacmctctccccacaattgtcttgtgaccctgacacatccccctctcgagaaacacccacaaatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacagagatgctctaagatacgtaatggaagtagagtaagtattatgaaacagatgatggtgcc

SEQ ID NO: 2206 - DNA, 601 bp, Human
aaggatgtcactagtacataaggaaaaacaagagtattaaatgctgaaatgtgtggtggagtggatatattatatttgttactttaggaaactagataatctcaacacgcttgaatatggacagaaaataaaagtattagcgaagtggtaaaaaaaaaaaaaagatctcacctacaggaagcatacagaaacaaataagaaaaaacaaaacaggtggactcacacaggcattaggttgcctgtatctactaggtaagtcaatctaaggggattacttaagctcttaaattgcctacagtcycacctgaactttatcatcttcaaaatgagtctaattgtgcctgttccaagggagagattgtctactgcaatctggaattttagtaagtacattataaaccataaataactggaaatttttcttttctttgttatcatcaattgtgatttttttcaaaagttcttgggccacatatataataccccgtgatgactctcagggcagttaggaagacaaatatgaaaggctggtatccaaagtggatatggactgactgttagaaacattgtttcatgactttttattcattgattttacact

SEQ ID NO: 2207 - DNA, 601 bp, Human
gattgttatgaattgtgcctaaggtaacacatgaaatctaccaaatattaacagttattcttaggaaattgaagccacacaattacctgttgttttattcctgctctgttgaatgtccacactgcatttttctattgatgatttctgtattaaggatgtcactagtacataaggaaaaacaagagtattaaatgctgaaatgtgtggtggagtggatatattatatttgttactttaggaaactagataatctcaacacgcttgaatatggacagaaaataaaagtattagcgaagtggtaaaaaaaaaaaaaagatctcacctacaggaagcatacagaaacaaataagaaaaaacaaaacaggtggactcacacaggcattaggttgcctgtatctactaggtaagtcaatctaaggggattacttaagctcttaaattgcctacagtctcacctgaactttatcatcttcaaaatgagtctaattgtgcctgttccaagggagagattgtctactgcaatctggaattttagtaagtacattataaaccataaataactggaaatttttcttttctttgttatcatcaattgtgattt

SEQ ID NO: 2208 - DNA, 601 bp, Human
taatttaatgtgcccgtttcaaataagttagtctatttcctgtcccctaaaactccattgcagataaaaatatattttctcataaagagctgatatcttttcatatatagaactttccaaccaactttgaaatcatccatgttcttagcctattcagaacttcttgagtttttaaaccaaattaaaactacaaaactcaatcttcagtgttactaccttgcagtgtaaacctgatataaattgaatattaaagttagctcatctaatactcactcattagaatttaaaaaagagccgtttrtccacttccagttcttttctgataatgaaaaatttaatccaatccaaaacagaattgctttgtcacgtatcaggttctgtgtgtgtatctataaatggaacagaaaaatattgaatctgcttatctattcctggtttgatcccctaaaacctagttcaagcatcacctcatctctgaagtctttcctaactcgtcgtcagcattaattattccttctttgtgatatttctgtctatgtttttatttctattattgtattcatcaccttatatttaattatttgtttacatatccacgtag

SEQ ID NO: 2209 - DNA, 601 bp, Human
tttttaatttaatgtgcccgtttcaaataagttagtctatttcctgtcccctaaaactccattgcagataaaaatatattttctcataaagagctgatatcttttcatatatagaactttccaaccaactttgaaatcatccatgttcttagcctattcagaacttcttgagtttttaaaccaaattaaaactacaaaactcaatcttcagtgttactaccttgcagtgtaaacctgatataaattgaatattaaagttagctcatctaatactcactcattagaatttaaaaaagagccrtttatccacttccagttcttttctgataatgaaaaatttaatccaatccaaaacagaattgctttgtcacgtatcaggttctgtgtgtgtatctataaatggaacagaaaaatattgaatctgcttatctattcctggtttgatcccctaaaacctagttcaagcatcacctcatctctgaagtctttcctaactcgtcgtcagcattaattattccttctttgtgatatttctgtctatgtttttatttctattattgtattcatcaccttatatttaattatttgtttacatatccac

SEQ ID NO: 2210 - DNA, 601 bp, Human
gtcacaaatataatggtatgaacttttaagatagagctaatgtaaacctctggaacttccaagttcatcttcattggaaaagaatccctctaacaagaaacttcacaattacattaaaaaaagaaagaaactttggaaactggggattcagtcttcttattgttctactaacaggtcacattaaaaatgtttcctaactttactgagccacagttttattaaatatttaggctatagccacctaatatttaggggaggcatggagatgaaatatgaaaatgtggcaatacttcaaaaataygtgctgagtaaatatgataaatatctagaggcatgatggatattcagggtctatagaatttggaagcagtgagaaaaagtggctcagttcatggttatgtagtcagaggttcctttcattctcattccaaacagaggtgaacaggtgtctgcagaaacataatattagtttcaaacagacatgagtcctgtggctcactgcaggtaggaggtgatgatataattcaaacaaagggacaggctgtattggggttgagttgcaaggacggtgtgagttcaagactctcctatttgtctcaaa

SEQ ID NO: 2211 - DNA, 601 bp, Human
ttctttttggcagatccatctgatttctgtactacagtactcagaatacacagatgtctgtgagatggaaatacagctgttttctttagcatcacctctaatttctaagctgtggagcaaaagaaaagtctgtcttagcatttatgattttctcagagctattctcacttagccattatttcctaggactctcaggaagcagtagaatgataaactattaaacaaagaaggcacacggtcacaaatataatggtatgaacttttaagatagagctaatgtaaacctctggaacttccaagwtcatcttcattggaaaagaatccctctaacaagaaacttcacaattacattaaaaaaagaaagaaactttggaaactggggattcagtcttcttattgttctactaacaggtcacattaaaaatgtttcctaactttactgagccacagttttattaaatatttaggctatagccacctaatatttaggggaggcatggagatgaaatatgaaaatgtggcaatacttcaaaaatatgtgctgagtaaatatgataaatatctagaggcatgatggatattcagggtctatagaatttgg

SEQ ID NO: 2212 - DNA, 601 bp, Human
ctgcacgcctctcagctgcccggcggcccccacggtcaccaccacgctggtccccgcgtacgccccgtcacattgtgtctgtgtgggcccatgccggccgctggccccgcaggtagaaaacagccaagacccctcggtgcctgagagcaaggagcgaggcaagggtcgtcgagcccctagctgggccagaggggtctggtatggtgagcgaaagaggaaggaggcgtctaaagctcacccggagaattcagcggggaggctggctccaagatactaggcggggcgctgactttcgggtccygggggctgggacttgccagcggcaggggcgaggaccgcagaaaagtctcctgggaccccgggctagagcagagaatggcgcctgaaaggtgttgggagaaggcgcaggacgttaaggcgggtggaaataggatatgaaagaaagagagaaccccgcaacagctgcccttgcggtcgcggccacacccgtcacccggcccagccgcgctctcagcctggaagccactacccgactccggtcgcagaagccccgcgggtgcgcgctgataggtctgccagtttctctcctcgagcgcctttc

SEQ ID NO: 2213 - DNA, 601 bp, Human
caagtcggtgcgcacgtggacttcgttaccctgagggtgaaacctccaactagcaggtcactgtccaccctacctccgccgtgcacttacagatactggccagggcccggcacgcgccacagctgcacgcctctcagctgcccggcggcccccacggtcaccaccacgctggtccccgcgtacgccccgtcacattgtgtctgtgtgggcccatgccggccgctggccccgcaggtagaaaacagccaagacccctcggtgcctgagagcaaggagcgaggcaagggtcgtcgagcccctrgctgggccagaggggtctggtatggtgagcgaaagaggaaggaggcgtctaaagctcacccggagaattcagcggggaggctggctccaagatactaggcggggcgctgactttcgggtcccgggggctgggacttgccagcggcaggggcgaggaccgcagaaaagtctcctgggaccccgggctagagcagagaatggcgcctgaaaggtgttgggagaaggcgcaggacgttaaggcgggtggaaataggatatgaaagaaagagagaaccccgcaacagctgcccttgcggtcgcg

SEQ ID NO: 2214 - DNA, 601 bp, Human
gaagacgccatgcgcccgcgacaggtggttcttggcgcctttgccgcccgcggctccgtaggctgagatcctgcggggaacggacggtgagtccccggccttcggtgctcaggccggccgctccgggcagaagttggcgacagaggaggctccagaattattttttatctgagggacttggaggctgcaatcgactctgacgggatgggaagggtaggtttgcacaccgaaaaatcagatattacacttatttcaggagggttcgtggaaatgtggggaggctcaagcaccccttggcgcygccctggttgggggccttccgctcggtgtaagaggttccgggtaagggctaactcggtggcgactactgccaccttgaagggcactcaaggtggacctccccgcggaatagtccaagacgcaagtcggtgcgcacgtggacttcgttaccctgagggtgaaacctccaactagcaggtcactgtccaccctacctccgccgtgcacttacagatactggccagggcccggcacgcgccacagctgcacgcctctcagctgcccggcggcccccacggtcaccaccacgctggtccccgcg

SEQ ID NO: 2215 - DNA, 601 bp, Human
acctgccgccccgcctctcccgccgctcccgggcgcctccgagcggttctccagtttctcgggggaggcctgagtccggcctcggtcccgcggcctcaggtaggcccgaccgccgcctccggccgccaccagcaacggttccagctcgccagcgcgcacctgtggggccagcggcgtgttccaggaagcgccctccagctgtccaggggcactgccactgggagagggctcccgcccagggggcctggataagggcaggggcccccagcccagcccaggccagcccagcccagcgcaggggatagggggaccccaagggacggacggagagccggtgcgtgagcgcccctggggagaggattgggaccccaacgctgagcgccgaagggagcacgtacccggaaaacgtaggtggcgcccccgccacccccgccacctcccgcccagcgccgcgaccccgggaccccttcgctcccatccatcgccgcgtgctcttcaacggctcgagactccccgaggcagacgagctggctctccgggctaccctgcgggcagcgggggagggaatcggcggggcccgggagcctcccctcgctgtgct

SEQ ID NO: 2216 - DNA, 601 bp, Human
cctcacctgccgccccgcctctcccgccgctcccgggcgcctccgagcggttctccagtttctcgggggaggcctgagtccggcctcggtcccgcggcctcaggtaggcccgaccgccgcctccggccgccaccagcaacggttccagctcgccagcgcgcacctgtggggccagcggcgtgttccaggaagcgccctccagctgtccaggggcactgccactgggagagggctcccgcccagggggcctggataagggcaggggcccccagcccagcccaggccagcccagcccagcgcaggggatagggggaccccaagggacggacggagagccggtgcgtgagcgcccctggggagaggattgggaccccaacgctgagcgccgaagggagcacgtacccggaaaacgtaggtggcgcccccgccacccccgccacctcccgcccagcgccgcgaccccgggaccccttcgctcccatccatcgccgcgtgctcttcaacggctcgagactccccgaggcagacgagctggctctccgggctaccctgcgggcagcgggggagggaatcggcggggcccgggagcctcccctcgctg

SEQ ID NO: 2217 - DNA, 601 bp, Human
ccgccgcccaaagtgttgagattacaggcgtgagccaccgcgccccgcctctcttagcaattttcaagaatacatcgtcattaactacagtcaccatgtagtacagtagattctggaaggtattcctcctatttaactgccattttgcattgttttgaccagcatctccccaaccttcccccaactcccaggataatttccattgttttttttttaatctttgagacagaatttccctcgtcgcccaggctgaagtgcaatggagtgatctcggctcactgcaacctccgcctcccaggtwcaagcaattctcctgcctcagcctccagagtagctgggattacaggctcccgccaccacgcccggctaatttttgtatttttagtacagacagggtttcacaggttggccagactggtctcgaactggtgacctcaggtgatccacctgccttggcctcccagagtgctagaattacaggcgtgagccaccaggcccagctgataatgtgcatttcgaacaacttaggttgtggggatattacctgttcctggaccacactttgagaaccactgacttaacccaatcctgcctttctgcc

SEQ ID NO: 2218 - DNA, 601 bp, Human
ctttttttttgagacagagtcttgctctgtcacccaggctggagtgcagtggcacgatcttggctcactgcaacctccgcctcccgggttcaagcgattttcctgtctcagcttcccgagtagctgggactacaggcatatgccaccacgcccggctaatttttgtatttttagtacagatgggggtttcaccatattggccaggctggcctcaaactcctgacctcaagatccacccgcctccgccgcccaaagtgttgagattacaggcgtgagccaccgcgccccgcctctcttagcrattttcaagaatacatcgtcattaactacagtcaccatgtagtacagtagattctggaaggtattcctcctatttaactgccattttgcattgttttgaccagcatctccccaaccttcccccaactcccaggataatttccattgttttttttttaatctttgagacagaatttccctcgtcgcccaggctgaagtgcaatggagtgatctcggctcactgcaacctccgcctcccaggttcaagcaattctcctgcctcagcctccagagtagctgggattacaggctcccgccacca

SEQ ID NO: 2219 - DNA, 601 bp, Human
ggggttggggccaatacctgccagaggctgcaggaagagctcgctgctggggtgtatgaaggatactccatcttccccatcagcccagaggttgtcagtctctgaagcgtcgccccctggaagtggagagtgatggagagtttgactacaaaaatgggggatgggggagaagctggaatctcccggtggaaatcccagtgtggccctctcttctccagcatcatgatgcaaatgctgtctgttcacaagtgggagtgaaggaggtgaggagggggtaatcagctggagcctgaaggcctckctgaggctggctgggatgcctcctgcctgcctgagcccctcctgtcccatgtcctcacagtccctttctgtgagaatgtagatcatgtgtgtatgtatgagcagtacagcccagacaggcacaaaggcatttacactagttatttgatcaaaacacagatgactgggactctcccttacagtttctgattcagtatgttagagaagggctgagaattcgcatttctttttaaaaattaatttttaattaaaaataaaaattcagggccaggtgtggtggctcacgcctgtaatcccagca

SEQ ID NO: 2220 - DNA, 601 bp, Human
aggttcgaagcttgctcagctcaagctcagggctcggcagcctcatctcctgcaggccctgccacttcttctgcttcactgggggtgggaagaataacggcacaccctccacctgcccatcaactctccctcccccacctgcccaggacacccctccagatgctcattaaggtaaacgttttccccaggcctccccagctccttcctatcttagaatcccagaggagtctaccacggctctgctgcggtgagtggtcttgaagtcagccccgggaccccgcagaaacccatcccagctcaytggagaggagcagccttgaatcaactgtgcctgctagacgcttcgtacccagaatcaggaccccacacaccataaggaggctcagtgttgaggttgccaccacagccaccatcagaaccagagggcctgggggcttgtgcaggtctagggagaaagagagacacctccagtgggaaggtcttctctgttcctttaccctcaagttttacccacgcttcaagactcagctcaagtgttaatttttccatgatgccttcccccattatcctgggcaaaagcaacctctccctcttgaacacc

SEQ ID NO: 2221 - DNA, 601 bp, Human
aggcgccagatcatattctttttttattgagacagagtctcactctgtcgccctggctggagtgcaatggcgcaatctcggctcaccacaacctccgcctcccaggttcaagtgattcttctgcctcagcctcccacgtagctgggattacaggcatgcgccaccatgcccagctaattttgtatttttagtagagatggggtttctccatgttggtcaggctggtctcgaactcccgacctcaggtgacctgcctgcctcgacctcccaaagttctgggattacaggtgtgagccaccaygcccagctgagagatcatattctaagaactgggacggagaggtgacattgagcaagttacttccccttctggagcttctcagggcctccctctcccttacacaagggatgtgggccagattttttctgggacttataattcactacagcagggagagaatcagaggtggggattcagagtgcataggttctcagaaggaggcagaagacttacctgagcagagtaacattggctggggaaacctcggtgacacctggtggcagaggccaggactgggccgggccaagccccacctggcaa

SEQ ID NO: 2222 - DNA, 601 bp, Human
agacgccctgggcgggaggcaatccctgggctccaagagtcatgattttttttcttttttaaacgaagtctcactctgtcatgcaggctggagtgcaatagcgcgatctcggctcactgcaacctctgcctctcgggttcaagtgattctcctgcctcagtctcccgagtagctgggactacaggcaagcgccacaacgcccagctattttttgtgtttttagtagacacagggtttcaccatgttggccaggctggtctcgaacccctgacctcaggtgatccacctgccttggcctccsaaagtgctgagattacaggcgccagatcatattctttttttattgagacagagtctcactctgtcgccctggctggagtgcaatggcgcaatctcggctcaccacaacctccgcctcccaggttcaagtgattcttctgcctcagcctcccacgtagctgggattacaggcatgcgccaccatgcccagctaattttgtatttttagtagagatggggtttctccatgttggtcaggctggtctcgaactcccgacctcaggtgacctgcctgcctcgacctcccaaagttctgggatta

SEQ ID NO: 2223 - DNA, 601 bp, Human
ggcaccatggcccagggctctgcaggaagacacgttggaagggagtgggcaggcggcctggagaagagtcctagagagtctagtaccccctttacctcccctgcccctgccatatgcccagctgaccctatatagactctctccataccatggcatgtccccaggtagaagccctgcaagggtggtgctcactggcatagagccagggcaaaaaagagggcagatgcgggccagagtcaaggtgggagtgcatgatgaggacttccctggtccctgcagacgccctgggcgggaggcaatycctgggctccaagagtcatgattttttttcttttttaaacgaagtctcactctgtcatgcaggctggagtgcaatagcgcgatctcggctcactgcaacctctgcctctcgggttcaagtgattctcctgcctcagtctcccgagtagctgggactacaggcaagcgccacaacgcccagctattttttgtgtttttagtagacacagggtttcaccatgttggccaggctggtctcgaacccctgacctcaggtgatccacctgccttggcctcccaaagtgctgagattacaggcgcc

SEQ ID NO: 2224 - DNA, 601 bp, Human
aaatcactgccagaatctagaagttcttgctcttcctgatctatttccttaaaagctgtgtggaagggctgttccttggggagggagttgggatgggggtcccctgagccaggactgctcctaacctgtggatgaagtgattttcctccaggtagtggcagccctgggctatgtcctgggccagttgcagcaggtcccgcatgaccagaggtgatggctggccctgggtcaggcagagggggcatcagtccatgtaggtctcagacacatggacagggtctttagaggggcctggggggggctaagacaagggtctcaccaggtgtggccgactgtgcctcaggaaactcttcatgtcccctccagacatcagttccagcagaatgaggcgaggggtggccctgaggctgagccccacacaccgcacaatgttctgatggcgaaacttgctgagtggggtgggggacatatcccgttaccaggagggagacggaaaccatgttttaggctccacaaagctggagaggccctctgtgtcccctgacttgctacctcagcctcagggtgaagagaaactgttcccgggcattcccctcccgcc

SEQ ID NO: 2225 - DNA, 601 bp, Human
tgccctccaggaaggcctctgggggcatccacttgactgggagcaaggcccggtcccccctgcggtaataactggccctacaggagggaggaggtgaatgatgagttgttcaccaccaaggtgcggggaaaacccccttggagcaagagccttcccacctcccaagtcccgcaccggtagatatctcgtgccatcccaaagtccccaatcttggccactcggctgggtccagcgcagctcagcaggcagttccgggcggcaatatccctacagagtaggcaaaaaaaatcactgccagaayctagaagttcttgctcttcctgatctatttccttaaaagctgtgtggaagggctgttccttggggagggagttgggatgggggtcccctgagccaggactgctcctaacctgtggatgaagtgattttcctccaggtagtggcagccctgggctatgtcctgggccagttgcagcaggtcccgcatgaccagaggtgatggctggccctgggtcaggcagagggggcatcagtccatgtaggtctcagacacatggacagggtctttagaggggcctggggggggctaagacaagggtct

SEQ ID NO: 2226 - DNA, 601 bp, Human
tgctgccaacactgggtcatgatgcggtacctggggagaggcaggagttcatgcccacccatggttgtgaaggacctcccttcccgggcagcactcaactcacacaggccctgggcagcccctaggagggtccatccggcctcctccaacgacgaagtccagcacctcctggttggtgcgcccaggatagggcatgtagcccagtgagaagatctcccagagcagcaccccaaaagacctgcatcacaagtgggggaaccaagtgaggcccgtcaggtgtagcctcccctcacatgaggtkgctggaaaggacaggattagcctcaggggaggggaacagtggggaaggggaggggaagggtgttatcaccaggaatctgtcttggatgtgaagatgccctccaggaaggcctctgggggcatccacttgactgggagcaaggcccggtcccccctgcggtaataactggccctacaggagggaggaggtgaatgatgagttgttcaccaccaaggtgcggggaaaacccccttggagcaagagccttcccacctcccaagtcccgcaccggtagatatctcgtgccatcccaaagtcccc

SEQ ID NO: 2227 - DNA, 601 bp, Human
gagcgataagtgggattccaaaggttctgaggttggaggcccctggatttgaggggcttgaggccagaggacagccaggggccaagagggctacctccccagcttttcaacttctctggactcagttcctggggctgtgggggtcttaggcactccaaagatctgttccccagcccagaagtcccttcctcctctggggtgggccccagctccattggcaggagtgaattcagcacatccgggtcctgtaatggaagagtcagggagcaggggggcatagagttttctggccctccctccwgacccacaagaccaggatgttagattaggtcgggggcacacctgagtgcagtactgcagacgctccaagatgctggcaaagctagggcggagctcaggctcgtgctgccaacactgggtcatgatgcggtacctggggagaggcaggagttcatgcccacccatggttgtgaaggacctcccttcccgggcagcactcaactcacacaggccctgggcagcccctaggagggtccatccggcctcctccaacgacgaagtccagcacctcctggttggtgcgcccaggatagggcatgta

SEQ ID NO: 2228 - DNA, 601 bp, Human
tctccaaaataaatcttgcattccaaagtatcaaaaattacagaagaaaaaagaagtctgctcctgcaggagacgtgcccatcacccttgttggaaacagcccctctcctgccctgtagtcttgctgctgtctttcccgggcattctgctttgtgtgctggatcccaaacaggtgaactggggaagcagcagctttgccttcctttgcagtttgcagttctggatttttcaaaatttttgtagaatccaatggattagctacatttctttatacagtggaaaaagcaggagttaggagtcygagattgaaacactaaaacactacaggagaggtgtggagtagctatgttaaagtggagctgccaaacttcctaacaaactgctacatctctgaatatagatgtttttctcagactaatcccttgtttgaaccaagtatgcaatttcaatgtgacacttatagtggtcacttagtacagatcttaattattgatatacttaaaggaaacttattagcctccatatataaggtatgtataaacatacattagatagggagagtcctatcctttcatgatgcttccccgtatctttctttaac

SEQ ID NO: 2229 - DNA, 601 bp, Human
catgcctcagcctcccaagtagctgagattacaggtgcctgccaccacacccgggtaatttttgtatttttagtagagatggggtttcaccatgttggccaagctggtctcgaactcctgacctcaggtgatccacccacttcggcctcccaaaatgctgggattataggcatgagataccgtgcccagccacatccctcacactttcttctttgacattcctctgccattttctacttgatggacacaggctgggaagacagtcaacaaaaaaggaaaatgtgctataagattactactyacactttctctcatggccttctcccacaattcaatagctactcagatctctgatctacatcttttccaaagtattctctcttgcctctccaaaataaatcttgcattccaaagtatcaaaaattacagaagaaaaaagaagtctgctcctgcaggagacgtgcccatcacccttgttggaaacagcccctctcctgccctgtagtcttgctgctgtctttcccgggcattctgctttgtgtgctggatcccaaacaggtgaactggggaagcagcagctttgccttcctttgcagtttgc

SEQ ID NO: 2230 - DNA, 601 bp, Human
tttagcttaaatgatctttaagagaagaagaaagccactgtaaagctagggaaatttgtaaagaaaggcaaggggaaataataggacttagaggacataattatatgcatatcgacatttggtgtaatttagagcaacataatgaaaaatatttgcttgggagatagctaattacatttaatggttaaaaaaataaatctactcattctttaacttagaaattagttgcaatccagtccctagactcagggctaagtccatggtccgctccccgcaaggcaatattaatatacttattttsggaagcaactgaaaaactccactcttaaaatgctgaatcataaatataaacatcaaaatttggttgccatgcaaaaatgaaaataaataagaaaatccactcaaaattttcccattttattcaaaatccgtaggcaagaaaaaatatatttttcctccttctccttcttttcttttttaaggatgggtgtctcactatgttgcccaggctgaagtgcagtggctattcacaggcgtgatcattacacactacagccttgaactcctgtgtgctcaagtgatcctgctgcctcagtctctc

SEQ ID NO: 2231 - DNA, 601 bp, Human
gctaaattacgctaactattcactaagcattttgttcccacacattctttgctgatgctggcctcttacacaccatgggcttccttagcaagacagactttcctgggaagaatcttctctgaatgtgcaaatttatgatgatagcatccttaaaacaacagctttattatgcaatagttacaaatttgtgagatgaggtgattatgcagaaaactagcaaattaatgtcatcagtaacatgagacaaaatagtttcaatggataaagaggttgttggcaggcttctaagagttgcccagamttctgatagttctgcagccaccctgccacaaaaagtccatttcctctgcgtgattcaccaaacattcaaaatttgaaaagtgctagtgagatcaaggtatcttaatgatattaatgtacacctgggtgctagtcaaaagcagttcactcataaaatttatacaacttcagttttctctgagatgaacacgactcacacaggataggagttggggtgagaggcaacccaaggcacagtgataaattaatgttcttgtatcacaagtgaaaacttggtttatactgctaaagccaaggggga

SEQ ID NO: 2232 - DNA, 601 bp, Human
tcagctgcaagtgacaggaatgagaatgggctctctctgattagactcttgacctataaggacaacttgtgacatcagcgggtgccttctcaagtttcaagttaaatttcatagctcaaagctgggcttcaattaataagctctctaagtcacaatatatgctttgaagaatgataagcatacaaccaccacaccagaagcagctaaattacgctaactattcactaagcattttgttcccacacattctttgctgatgctggcctcttacacaccatgggcttccttagcaagacagackttcctgggaagaatcttctctgaatgtgcaaatttatgatgatagcatccttaaaacaacagctttattatgcaatagttacaaatttgtgagatgaggtgattatgcagaaaactagcaaattaatgtcatcagtaacatgagacaaaatagtttcaatggataaagaggttgttggcaggcttctaagagttgcccagacttctgatagttctgcagccaccctgccacaaaaagtccatttcctctgcgtgattcaccaaacattcaaaatttgaaaagtgctagtgagatcaaggt

SEQ ID NO: 2233 - DNA, 601 bp, Human
tctcccataagagttcccatctctggtatagatctctgggttggagaggaagttggggaaaagagagttaaaaactgggtagtcagcgtcaggtggctaatttctaaaactgtttttaaaagaaacgttgtttagaatacaatatccgagtgtaggaattcagagcatgggtgctgtcaggtctggatatgaatgctggctccctgctaacccactgtttgcctgtgggctagctatccaacctctagtagcctctgtttctgcttttgcaaactggggatagcgttcagtgatcaaccaygtgaagcttcacttactgtggtgtgatgaggcgctgaaagagcctggcttgatcaggtgagggtctactaactctgctgtgggccgcagagcacttcaccagaaagggtgccctggctgaggttacatttacctctattttcttttctttagaaagtgttggagccagaaaaattccttggaaccactgagggtgggtgtggactttggaaccacctgcggcattagaaagatggacaaatagtcccattgttcagagactggaggtagaattgagactgtggtttttgaggaagtaaaa

SEQ ID NO: 2234 - DNA, 601 bp, Human
ccaaactctgcttattatcaattatagctgaagaaaatactggctttttctattttagtaggtaggttacaggtgttgagaagcctgggcctctaattagatatgtaatcctccaagtgtggttcccagaccagcattatcagcactacctggaaacttgccaaatttggggggcccaccaaaaatctactgaatcagaatctctgggccctagatatctgtgttctaacaaactctccatgtgattctgttgcaccctgaaatcttaagtcttaacccagtataatctctccaagctctycaagagcttctgcattctgaagctcacattcccgaaggagggatcagcattactaataccacctggctagctactcaatgagtcagcctagtgtagctgtttgggacaaggacttcatagccagacttcctgggtttgaattctagttctgatatttattagctgtgtgatcttaggcaagttacatatctcccttgtgcctcactgtgatcatctgtaaaatggggataaagtatggtacctttcagggttgctgtgaggactgaatgagttaatgtatattgagagcctgaaacagta

SEQ ID NO: 2235 - DNA, 601 bp, Human
acctcagtctccagagcagctgggactacaggcacatgccaacagccaattaaaaaaaaatttttttttttgtagagacgtggtctcactttgcccaggctggtttcaaacccctggcttcaagtaatcctcctgcctttaccttttaaagtgctggcattgcaggtgtgagccaccgcacccggccaattcctctttaatgaatctatgattcaatacaattccaatcaaagttccaatagggtttgttattgaaattaacaaggtgatacttaaattcttatgataggataaatggtcttttaaagtttttatttattcttatctattaagttttcataattaaaaattaaaaaattaccactaccatcccccaaacaaaacaaaacaaagtcctacccattctgtgtccatgttattaaatccactttaagatttagtaaaacactccttgcccctgaggactgtaccctttcactcaatgtaaggatgtttactgaggccatctagtgtaacttaaccatcttccttcccttcctttaattctctatttttcaatgttcaaagagtttaattattcgctttttgaaaatcctttcat

SEQ ID NO: 2236 - DNA, 601 bp, Human
cactcaggctggagtgcagtgatgccatcatagctctctgcagcttcaatctcccaggctcaagcaatccttctacctcagtctccagagcagctgggactacaggcacatgccaacagccaattaaaaaaaaatttttttttttgtagagacgtggtctcactttgcccaggctggtttcaaacccctggcttcaagtaatcctcctgcctttaccttttaaagtgctggcattgcaggtgtgagccaccgcacccggccaattcctctttaatgaatctatgattcaatacaattccartcaaagttccaatagggtttgttattgaaattaacaaggtgatacttaaattcttatgataggataaatggtcttttaaagtttttatttattcttatctattaagttttcataattaaaaattaaaaaattaccactaccatcccccaaacaaaacaaaacaaagtcctacccattctgtgtccatgttattaaatccactttaagatttagtaaaacactccttgcccctgaggactgtaccctttcactcaatgtaaggatgtttactgaggccatctagtgtaacttaaccatctt

SEQ ID NO: 2237 - DNA, 601 bp, Human
ataccttttatttatttattttttaagacaaggtcttcctctatcactcaggctggagtgcagtgatgccatcatagctctctgcagcttcaatctcccaggctcaagcaatccttctacctcagtctccagagcagctgggactacaggcacatgccaacagccaattaaaaaaaaatttttttttttgtagagacgtggtctcactttgcccaggctggtttcaaacccctggcttcaagtaatcctcctgcctttaccttttaaagtgctggcattgcaggtgtgagccaccgcaccyggccaattcctctttaatgaatctatgattcaatacaattccaatcaaagttccaatagggtttgttattgaaattaacaaggtgatacttaaattcttatgataggataaatggtcttttaaagtttttatttattcttatctattaagttttcataattaaaaattaaaaaattaccactaccatcccccaaacaaaacaaaacaaagtcctacccattctgtgtccatgttattaaatccactttaagatttagtaaaacactccttgcccctgaggactgtaccctttcactcaat

SEQ ID NO: 2238 - DNA, 601 bp, Human
acaaagtccttgccctcatgagaatttcaatctagtagaaggagacagacatggatccccatatgatcaagtttttctgggactgggtcagaaatatgtataggagctgtttcatagacaatggaatatatatatatattatatataatataacatatatatatgtggcttatggctctagggcccaaagggtcctgtttagactagagatacagaatgagagtgagagtcacacacacacacacacacacacacacacacacacacacgtggtacagtggagatagatcattcaaatttrttatttgatgaccagatgctatcagcaattaagaaagatagaaggcgggtggatcacctgaagtcaagagtttgagaccagcctggccaacacggtgaaaccctgtctctactaaaaatacaaaaattagccaggtgtggtggcgtgtgcctgtaatcccagctactcaggaggctgaggcagaagaattgcttgaacccaggagacagaggttgcagtgagccgatattgtgccactgcactccatcctaggtggcagagcaggactctgtctcaacaacaacaaaaaaaaaaaaaaaa

SEQ ID NO: 2239 - DNA, 601 bp, Human
ccatggtgtggttcagcttggcaataacagtaccacaattaagaatggtttaggaagaaaaaattcttctgagaggtaaccatagtaagagctgccaagatgtgaaacttttctaagctattggtgagtgagaagcttttgcttttttgaagatttgttctgtgcagagggggtagggaaagagcagttacctggatcccagttgagaaagtttaatggtttgtggtctgaccattcccagcctctagcagagtatagctgatttaaaccaatccagaaaatcttagcaatgccttctttwtctgtaagaattaaaaaatttttaaaaagtgacaaagttgcctaagttattatctaaattagacttattctactaataacaaacaaatctgcagaccttgattgtaaggcagcaatccctgtagagggctgtttatgcatcaaaggtaggcaatgctaatagacaaaagtcttcagactattgagaaacccaaaggctgataagttaattcagttctgctctcctattagcttgtcaaattccctttcatctaaggtaaggacagaagcttcttagagtagctgtctcactatctatttt

SEQ ID NO: 2240 - DNA, 601 bp, Human
gcggataattccatattagagttcagctgcagatgaaacacagcatgggtgagttatagacatgccaagtcctttagggacatagaatggctcctgggccatgtggtggagctcattttgctcttacataaaaatgtagggttgttctaaaggtctagaggttcaaatgctcagttgtccatggtgtggttcagcttggcaataacagtaccacaattaagaatggtttaggaagaaaaaattcttctgagaggtaaccatagtaagagctgccaagatgtgaaacttttctaagctattrgtgagtgagaagcttttgcttttttgaagatttgttctgtgcagagggggtagggaaagagcagttacctggatcccagttgagaaagtttaatggtttgtggtctgaccattcccagcctctagcagagtatagctgatttaaaccaatccagaaaatcttagcaatgccttctttttctgtaagaattaaaaaatttttaaaaagtgacaaagttgcctaagttattatctaaattagacttattctactaataacaaacaaatctgcagaccttgattgtaaggcagcaatccctgt

SEQ ID NO: 2241 - DNA, 601 bp, Human
tgaggtatttatttgtattataaaatacaaccattatattgtcagtacttgggtgctatagtggggagagaccccaagagtttgaaaacgagcggataattccatattagagttcagctgcagatgaaacacagcatgggtgagttatagacatgccaagtcctttagggacatagaatggctcctgggccatgtggtggagctcattttgctcttacataaaaatgtagggttgttctaaaggtctagaggttcaaatgctcagttgtccatggtgtggttcagcttggcaataacagtrccacaattaagaatggtttaggaagaaaaaattcttctgagaggtaaccatagtaagagctgccaagatgtgaaacttttctaagctattggtgagtgagaagcttttgcttttttgaagatttgttctgtgcagagggggtagggaaagagcagttacctggatcccagttgagaaagtttaatggtttgtggtctgaccattcccagcctctagcagagtatagctgatttaaaccaatccagaaaatcttagcaatgccttctttttctgtaagaattaaaaaatttttaaaaagtg

SEQ ID NO: 2242 - DNA, 601 bp, Human
gcaaactaaattaactaaagtggctaatttgaattttattgctcttaactcagttttcctactatgtgtgcaggcagctttatactgaaattagtgttaactttaggttctacatttgtcataagcctaagattttatttttcaaagttgtctaatccttcctttgggaagaatgctttttggctaagtggcattttgcttgttttattccctaaaagactttctttgaggtatttatttgtattataaaatacaaccattatattgtcagtacttgggtgctatagtggggagagacccyaagagtttgaaaacgagcggataattccatattagagttcagctgcagatgaaacacagcatgggtgagttatagacatgccaagtcctttagggacatagaatggctcctgggccatgtggtggagctcattttgctcttacataaaaatgtagggttgttctaaaggtctagaggttcaaatgctcagttgtccatggtgtggttcagcttggcaataacagtaccacaattaagaatggtttaggaagaaaaaattcttctgagaggtaaccatagtaagagctgccaagatgtgaa

SEQ ID NO: 2243 - DNA, 601 bp, Human
tgcactgggcctgtcttaaaagggaacatttttcaaagcattagaatgagaaagttagggccaggatggtgtcagaaagaataatttgtattcctaattttatgcttttatgggaactcatattatagttaaaacttaactaaattgaaacgtataagcctcaatgaataattatgtgcttaaatatgtctttcttctaaaatatagaatctaaagggaaaacatcatgatatgttgtagttaattttaaaaacaaaaaccaaactttttcctcaaatgacttccaggccatattctatgsttagtagctcttaatctgctactccataaaataaaaatattaatttatcattgtcatgccattaaggccttgagttaaagattaaattatctttaaatattctatttactgaaataataaaagtattacttcatttgctggtaaggaaatttagcaaactaaattaactaaagtggctaatttgaattttattgctcttaactcagttttcctactatgtgtgcaggcagctttatactgaaattagtgttaactttaggttctacatttgtcataagcctaagattttatttttcaaag

SEQ ID NO: 2244 - DNA, 601 bp, Human
gccttcggccatgattgtgagacctccccagccacgtgagattgtaaggtccattaaacctctttttcttcccagtcttgggtatgtctttatcagtagcatgaaaacggatgaatacatccctccagctttgagtattagtttctctcatttggtgaggatgtaattaaataccaggtatacatcaggccctgtgcttgacagtcaatacactcctcttctccattctttcaaaaactcctcacacccttccactcctcaaaaacttcagctgttcttgtgtcactttcatccccaaacrccctggaaaaacccccttattgtacacattttgtccctctgcacctctccttttttacttgatttttcaatgcaaagacttgcctgacagagaaggatagaagagggctgggtgctgtggggcacaaggtagagaagcctgggcttactcctgtgtctataggttttgcctcattacggaggcatgaactgcagtggttctcagacttgaatacgcatcagaaccacctggaaagtttcttaaaatacagattgctggaccccatcctgtagtttctgatgtagcaaatctggggtgggt

SEQ ID NO: 2245 - DNA, 601 bp, Human
attgtgaatcaataacattgcaaattcttttttcttgaataatgagagtcctggaaaactggggacgtgatgtcagatgctacggtgacatgaattcatgtggtgcctaccacataaatgaggtatatatagcatcataggaattcccgctgggattcagaaaatgatgtgactttaacatgcttcaatgtgctatatggctgagcacagactattaagggcttggacacagtcaagggagattgcccttagtccaagtagacagtagaaagatgtgccttaagtcattttctgacaaatyttttcctggatatggaatttgttaggtttccctccagtctctgtccttgagaagattataagagggcaagcctccttttcttgtatggccagcttagcaaggggatgtagattaacgctcaccgttgaacaaaggacaggcagagatttaagggacagaataagacatttatacacttcgcatccaagagatgagagggcaaaggttacccctggacttctttcctcccctctgctagacagatggtcctcatggaattagtgattctgttttgaccatgagaaagctcacaatcgaagg

SEQ ID NO: 2246 - DNA, 601 bp, Human
tcataatagggttcaccctcctaggagaatctaatgctgctgccaatctgacaggaggcggagttcaggcagtaatgcttgcttacccgccgctcacctcctgctgtgcggcccaattcttaacaggtaatggtccgtggctctgtaccctgatccagagtgctcttaccttttcttttccagcttatacgcaaacttcccaaccaaagaagtcttaatattatcattaggtaaaacagtaagaatataaagaaaccacaggaggtttcgtacctctcctaagtaggaaacacagttgggygtcttattgtagggaacatttggctcattctcatcccaatatgttagagtaacttcagtaccatctgaccactgaaataaagttggtatgtttatgttcttaaggcctatccacacttcttctttgatatctaaaagaaaaatgtattatttgtttggttttgctcaattaaatactgtaatatgtacattgttatacaaatttttatattctgatatggagttttaagagcctttgtagtattcttaattcggttattaatatgttgatacgacaggcaggttgggtaatgaaggcttt

SEQ ID NO: 2247 - DNA, 601 bp, Human
aacttttgtgggcattttctatttcaaataacatgttcaattgtaagctcatattttccaatctctgtgttataaaaaatagtcttcatgatcacattagaccaacacaataaaatataaataattcacagggtgaaaagtagaatgctttatactgctgtcttattcaaagccactggcttaaaaatcaggaactctggatttcattaattcaataaccagatgatctttgtcaagtaaatcaccttttaaagtctctgttttcttaactctaaaagtatttctgaggtcctttccggcktaagtgttctgattctatggcaaattatggtcaatgctttaggctggttggagaaagaggaaataactttcaaaataaataagaagccaggcacagtggctcacacctgtaatcccagcactttgggaggctgaggcagatggattacttggggtcaggagatcgagaccagcctggccaacatgttaaaaccccatctctacagaaatacaaaaagtagctgggcatgttggcatgcacctgtaatcccagctacttgggaggctgaggcagaagaatcacttgaacctgggaggcaga

SEQ ID NO: 2248 - DNA, 601 bp, Human
cagtgagctgtaatcatgccactgtacctcagcctgagtgacaaaacaagactccgtctcaaaaaacaaaacaaaaagcaaatctggaaaatatagaaattttcaaagaaaacattctattcatttattttttacagacagcatctcactctgttgcccaagctggagtgcagtggcactatcttgtctcactgtatccttgaactcctgggctcaagtgatcctcctgactcagcctcctgagtaaccaggactacaggtgtgtgccaccatgcccagctaattctttttttttttttttaaatagagatagggtctccctatgctacccaggctggtctcgaactcctggtttcaagcaatcctctcacctcaggcccccaaagtgctgggattacaggcataagccaccacacccagcccatagaaaagactttaaaaatcactcaaaatcttacttcctagagatataatagccattaccctttttgcagtctagttttaaatgtaaatagtatattttttactctttgataatctgtcttttcctctgcttaatatatataaacatttacacattatagtattgtttttatcttaa

SEQ ID NO: 2249 - DNA, 601 bp, Human
gaaaaagattagaattatgactatgcaaagcaaactgtgtcctctaagcatgagttaatgttcaaaactataaatagtaattcagattaccggccctctctggctggggcagtactgactacaaggaacaagagattcctgagccagtgactctgccactcccctacactcacagggaaggaaaaagccaccctcatcacctcatcccataccagtcgctcaccttccttgcctggagaaattttgtctcacttgaagatgtatagagaagaagctggcacttaaataattaactaaatgyattagtgacaaggtaaaagcagctttggttaaatttcagttttcttaactcacctggattgtaccagtctggtgtttttggagtacggcctgtatgaggaagaaagcaagtggcattagtattccatgacagatcagggtatactataagtacggcctttaatgtagctcgaaaggacttgcagtattgttgaggcttgtccatttctggccaacccacttcacgttttgatcactttagttgtattttgtagggccgatgctaaacctgcttcaggagaaatccaaaaggcagatacgt

SEQ ID NO: 2250 - DNA, 601 bp, Human
tttgtgctacatgtgcagaggttagtgatgcgaattagtaggagactagcattctttgttgggctctgaaatgaatgagaagtgcttgagacatctatctaggatcagcacttgagatggaggaaaacactattcaacctccttttcagagttgcttaattttactttgctgaattttttcttcttaaactagagactggggttttgctatgtagtccaggctggatttgaactcctgggctcaagttatcctcttgcctccagagtaaatgggactacaggtgtgcaccacggtgcccarccatgctgctgatgttgaaagggatggaagctggttgtggtggctcacacctctaatcccaacactttgggagcctggggcgggcggatcacttgaggtaaagagttcaagaccagccttgccaacatggtgaaaccccatctctattacaaatacaaaaattagctgggcgtgttggcgcatgcctgtaatcccagctactgaggaggctgaagcatgagaatcacttgaaccttggaggtggaggttgcagtgagccgagattgcaccactgtactccagcctgggtgacagaacaag

SEQ ID NO: 2251 - DNA, 601 bp, Human
cagcttccccatctcctggcttgctctgggttaatttaatttaattaattaattaatttttttatttagagatggagtctcactctgtcgcccaggctggaatgcagtggtataatctcggctcactgcaacctccacctcccaggttcaagtgattctggtgcctcagccttctgagtagctgggattacagacgcccgccatgatacccagctaatttttgtatttttagtagagacagggtttcaccatgttggccaggctggtcccaaactcctgacctcaagtgatccacccactwtggcctcccaaagtgctgggattacaggcatgagccaccatgcccggccgatctgggttaactttagaataccctgtggctcagagagactattctttaagctattcctaaatgctacttttaattgagcttttgataacaattcttgtttttccatccattcttcagttcaattctgagtcttcaatcgcattttttccatgcatccctagacccatcctggtatactttgggatataccatggctgagaaaagaggtggcctataatgccaataggaataccacagctttatttaaaa

SEQ ID NO: 2252 - DNA, 601 bp, Human
atttttaggtactggcattacaggtgactttaattttgttcttttaattactgacaaattttctacattgcaatactgtttttgtctcaaaagatttagggtgactgaaactaggaaatgtaatcacctattgtttcctcacaacagacacaacaaagcgtttcacagaatttccaatgctgaagataaagcaagtaaatgcaatgctataaaacaattgagactgtgaggactgagtaagcagcttccccatctcctggcttgctctgggttaatttaatttaattaattaattaatttwtttatttagagatggagtctcactctgtcgcccaggctggaatgcagtggtataatctcggctcactgcaacctccacctcccaggttcaagtgattctggtgcctcagccttctgagtagctgggattacagacgcccgccatgatacccagctaatttttgtatttttagtagagacagggtttcaccatgttggccaggctggtcccaaactcctgacctcaagtgatccacccactttggcctcccaaagtgctgggattacaggcatgagccaccatgcccggccgatctgggtt

SEQ ID NO: 2253 - DNA, 601 bp, Human
tgtttatttttaggtactggcattacaggtgactttaattttgttcttttaattactgacaaattttctacattgcaatactgtttttgtctcaaaagatttagggtgactgaaactaggaaatgtaatcacctattgtttcctcacaacagacacaacaaagcgtttcacagaatttccaatgctgaagataaagcaagtaaatgcaatgctataaaacaattgagactgtgaggactgagtaagcagcttccccatctcctggcttgctctgggttaatttaatttaattaattaattwatttttttatttagagatggagtctcactctgtcgcccaggctggaatgcagtggtataatctcggctcactgcaacctccacctcccaggttcaagtgattctggtgcctcagccttctgagtagctgggattacagacgcccgccatgatacccagctaatttttgtatttttagtagagacagggtttcaccatgttggccaggctggtcccaaactcctgacctcaagtgatccacccactttggcctcccaaagtgctgggattacaggcatgagccaccatgcccggccgatct

SEQ ID NO: 2254 - DNA, 601 bp, Human
gtctgagcttccccatggtgctgccagagaccttacatacccactggtgggcctggtgctggcctaacagacccactgagctaagctttcctgagtcccaagacaatctgcatcactagtttatttgaaatatggaacgaagcgacacagtctccttagtaaaccataaacagcaacacagtcaagcctcaacaccactcgctgcttcattctgaaatgttcatgaccagagttccagctgtaatcctagcccctaacctaacccagttagggcctaagccactgtggcctccagtgtggyccttcggccatgcgactttgcctgcactcattcagactgccctgcatttcttcccctttgctgcactccccacctaaccctgtccctgatcctttggaatttccattccatctaaataaatcatcccacaccttttatctttttactgaatacaaagtatgaagactataaatatcttttcactaaattcttgatcttaattgatcttaatttaactctggcttttccagggaatgctcacacattgttggtgggattataaattagttcagcccctgcggaaagtagtttggagatttc

SEQ ID NO: 2255 - DNA, 601 bp, Human
cagaagtacatttcaggtggcaatattgatgttaaccctttgtattattttgactcccatggtcaatctaatgatttttaatttttttaatatttaatacacatttacataccatttactacataacaagcattgttctaaatgctttacaaatattggcttacttaatccttgtaacaaccatataggagaggtactattattatctccattttaaagatgaggaaactaaaggtatgtaacttgtgcaaagtcccacagaatacaaaccacagtgctgggcctttctgccaggctgtcratccccagagtctatgtcctaaccattatgctacgctgcctcacacataattggatccactggttatcagaaatcagaaagctaaaatggggtgaggatcactataagtactgattagatcagagaccacctggcatagtggaaagaatatgggctacggagctaaacctacatggttttgaatcctgattcagtcacttactagctttcatgtgccatctctccaaatttccatcccctaccaagttaagtgtgacacttaacttcgtggggctggaattaatgggataacatgtgtaa

SEQ ID NO: 2256 - DNA, 601 bp, Human
acatgcctaaaatgacccattaataataatatatgtaatatataattctacttgaatacaaattttcacaacaaatgttgccataaaaagacatgactataatttcttcacaattccaaaaccagattttataaaaccactcctcagaaattctaccacttatgggactgttaataatttaagaattaaaagatctgaaattcacatacttcctgaatagtagcaaatagcacctggttgattgtcattgcaatcaactgttttccagaatccatcagtgtctaatactacacagtcttcragttgcccattagtttcagcccagcgactaaaatgaagacgtttcccatctgaccaaccaaagttgagttcatcctgtaaggagcagaagtacatttcaggtggcaatattgatgttaaccctttgtattattttgactcccatggtcaatctaatgatttttaatttttttaatatttaatacacatttacataccatttactacataacaagcattgttctaaatgctttacaaatattggcttacttaatccttgtaacaaccatataggagaggtactattattatctccatttta

SEQ ID NO: 2257 - DNA, 601 bp, Human
caagaccatcctggccaacatggtgaaaccccgtctctaccaaaaatacaaaaaattagctgggcatggtggggcgtgcctgtaatcccaggtacttgggaggctgaggcaggagaatcgctggaacccaggaggcagaggttgcagtgagctgagatggcgccactgcactccagcctgggtgacagagcaagactccatctccaaaaaaataaataaataaataaaataataaaataaaataaaaattggagaaaatagacaaatatcctgtgcagaagaatttcaagtaatttatatmgatactcccctcataggaaggtggaggataactttctaccctattaagtgtggactcaacatagtgacttccttggaaagaagacagtatggaaaggaggaaaagaggtaactttgcagcagagaacctaacaaacactaccttgggccaggtggccagtgataagtcatatgaatagtacatgctgtccatgtgaagtgagaatgctccctcacatctttggtcttccctcaaaaacttataaccccagtttaatcatgagaaaaacatacgccaacccaaactgagggacgttctacc

SEQ ID NO: 2258 - DNA, 601 bp, Human
aaagagaaacacttcccaagaaactcaaaatgggaagactatttttgaattttccttgaatttataatcttaacttgccatgcttttaaaaaaaaatcttccccactctgttctaaagattatttaaattaaaactacaactctagtctcaatagataaccattttttgtacacaagaccctactgtaagtacataaatgattaaataatatgattcaaatagtggcacagatgtctttactagcagaattaatcctaagtagtataattttctagaggaaaagtgggaagaaggtatacrtttattagtcctaaccatgtggagaattttagatggtactttgtataaacttttgtgttaaaatctcagtgaaattattattaccctgattttctacatgaggaaataaggttgcaaaggttaatgatcacccagcacataaatggaagatctgctactggtactcaaactcagggttttctgattctatgctatttcatttttatcagctttccaatttgtctgtcccaaataggctatagaggtgttgttgagatagtcatccactgggcccttgggatggcctgatcatttgtccta

SEQ ID NO: 2259 - DNA, 601 bp, Human
tcaaaacttgattcacttccctgttgtaagaacaatagagataacctgaatccagatgtttgacttcaaaaagaatacaaagaacaacatacatactttaagaaatattataatggaatattaattatttgcttacagtattgtaggtctgaacctactattattgtaggtctgatttacttctgatgcattgatttgggacatttgctctgatacagtttatggagaactttaaacttacagacagagttactacacctggtcttcagatttttttgaaggatgagtttatgtgacactygaaattaaacaacatgcaaatggcttccatttgtcataattacaaatttacaatcccaaccttcatattgttctgaatattgttttctgtgttttatagttttgtgttttgtgtctctggctacatttttcacactacagaggacaccaagcagtagggagctagaaaagagaaacacttcccaagaaactcaaaatgggaagactatttttgaattttccttgaatttataatcttaacttgccatgcttttaaaaaaaaatcttccccactctgttctaaagattatttaaattaaaa

SEQ ID NO: 2260 - DNA, 601 bp, Human
cacaaattctagggtagaatttacctggtgacagaacaaatgaaagtcattgggaataaattccctgagtgcttatactgtatttgtttccatttacaaagtatcaaaattattttcacaaaaattatttgtgaatacatctttttttttttttttttttttgagacggagtcttgctctgtctcccaggctggactgcagtggcgcaatctcggctcactgcaagctccgcctcccgggttcacgccattctcccgcctcagcctcctgactagctgggactacaggcgcccgccaccaygcccagctattttttttgcatttttagtagagaaggggtttcaccttgttagccaggatgatctccatctcctgacctcgtgatccgcacgcctcggcctcccaaagtgctgggattacaggcgcgagccactgcgcccggcccttgtgaataaatctttaaataaaaattccactgagcttttaattatgtgcataaattatgtcacattttcataaatgtactgttactgaaattgaagtcttacattttgtaggtttataacaaatagcaccatccttaacagagttgcatttttca

SEQ ID NO: 2261 - DNA, 601 bp, Human
aactttaaggatcatataaatttggaaaatgcttggttacacaaagttaaacagacttcattattacagaaactctcttagaacctttggccaggcgtagtagctcacacctatactctcagcactttgggaggctgaaacaggaggattgtttgagcctaggatcctagttcaagaccagcttgaacagcattgtgagaccctaactctacaaaatattttaaatattagctgggtgtggtggcatgtgtatgtggtcccagctactcaggaggctgagttgggaggactgcttgagccyaggaggtcaaggctgcagtgagccatgttcatgccactgcactccagtctgggcaacagagctgaaaccctgtcaaaaaaaaaaaaagaaaaagaaaagataagaaaagaaaaaagaaaagaaaagaaaggaaaagaaaagaaaagaaaagaaactctcttagaaactttaatacggtaaatcacatgaggtgttccccaaatttatatgttgtgggacccttttttgaaataagcatctcagcctttgaaaaacattgctaagtgaaattagaattcacaaattctagggtagaattta

SEQ ID NO: 2262 - DNA, 601 bp, Human
accagagtcttcggaaaccaatgccaccaccccccagcctgtcctgcaggcctctgcagtccccggtagtttgtttttttgtggtcttcctcaaggttcatgctttatccaccaggggtgaccctaagtccagcctctaatggaagaggctcttcccttaaactttaaggatcatataaatttggaaaatgcttggttacacaaagttaaacagacttcattattacagaaactctcttagaacctttggccaggcgtagtagctcacacctatactctcagcactttgggaggctgaaayaggaggattgtttgagcctaggatcctagttcaagaccagcttgaacagcattgtgagaccctaactctacaaaatattttaaatattagctgggtgtggtggcatgtgtatgtggtcccagctactcaggaggctgagttgggaggactgcttgagcctaggaggtcaaggctgcagtgagccatgttcatgccactgcactccagtctgggcaacagagctgaaaccctgtcaaaaaaaaaaaaagaaaaagaaaagataagaaaagaaaaaagaaaagaaaagaaaggaaaagaaaa

SEQ ID NO: 2263 - DNA, 601 bp, Human
tacccactaaacaataactccccatattcccctccatctagtccctggtaactgccattccacttcctgtctctatgaatttgacaactctgggtactacctcatataaatggaatcatagagtatttgtctttttgtgactggcttatttcacttagcatactgtcttcagggttcatctgtgttgcagcatgcatcagcatttccttcctttttaaggcttcttatccattcgtccatccatggacacttgggttgctttcatcttttggctattatgaattatgctgctatgacatgrttgtacaaacacctgtttgaatccctgctttcagttgttttgagtatatacctgaagtgctggatcacatagtaatcttatgtacatgtttttgaagaattgccacaccattttgcacagtggttacactgttttatattcctaccagcagtgcataagggttccattttctccacatcttcactaatgcctgttattctctgttttgttttttttttttttgaagatccagtttttaaagttagcccttgtattcgtttccttgggctgccataataaattccacaaaattggtggctt

SEQ ID NO: 2264 - DNA, 601 bp, Human
aaatagttggttgggcaaaggtatattgctgattactcattgttgcactgggctcaattgttaatgcaaaacttgttgaacattgattattatggcatcattaggatagggaacttttctgaatggtttgacctttttttttttaacattacttcttgcactggcaacataaggaactgccttatctttggtctatttgtttctagtatagtctgcaactggggtctcttaggctgcgtacatttttttttcttcttgttcttcatgaagttttgcttccaactcttttttttttttttttctgtaagggcttgcatcgtggtaagtgtgttacattcctgttcaagaagatccattttttttaattgtggtaaaatacacataacataaaatttaccatcttaaccattttggttttgttttgtttttagagacagggtcttattctgtcacccaggttggaatgcagtagtgcaatcatagctcactgcagtctcaaactcttgggtgcaatagatcctcctgcctcagtttcccaagtagctgggattacaggcatgtactactgtgtccagctaatttttacacgtttttgtagaga

SEQ ID NO: 2265 - DNA, 601 bp, Human
tggactcctgggtaagtttcccagctgctgcagatcaaaatgcatttgccaaattcatctatacaatctataaaacttctcacaactcctcatcaatgctgctgttgaaaagaaatgttactagtaagttcttgtttttaccaccttatgaaaatagttggttgggcaaaggtatattgctgattactcattgttgcactgggctcaattgttaatgcaaaacttgttgaacattgattattatggcatcattaggatagggaacttttctgaatggtttgacctttttttttttaacatkacttcttgcactggcaacataaggaactgccttatctttggtctatttgtttctagtatagtctgcaactggggtctcttaggctgcgtacatttttttttcttcttgttcttcatgaagttttgcttccaactcttttttttttttttttctgtaagggcttgcatcgtggtaagtgtgttacattcctgttcaagaagatccattttttttaattgtggtaaaatacacataacataaaatttaccatcttaaccattttggttttgttttgtttttagagacagggtcttattctgt

SEQ ID NO: 2266 - DNA, 601 bp, Human
gtaaaggctttttctgtttttttctccaaatctccacttggcagagtccttatttgtggtctctgtgattagagaggaatggcggctactgtgagactctttagtggcccttagttccttctgctgcttctctatcttctgttagaaaccagacttgatctttttgaacttcggttatttgattggcttttgcctccattcttctcactaacacaccaatttgagtactaagtcttcagttcagcagttggactcctgggtaagtttcccagctgctgcagatcaaaatgcatttgccaawttcatctatacaatctataaaacttctcacaactcctcatcaatgctgctgttgaaaagaaatgttactagtaagttcttgtttttaccaccttatgaaaatagttggttgggcaaaggtatattgctgattactcattgttgcactgggctcaattgttaatgcaaaacttgttgaacattgattattatggcatcattaggatagggaacttttctgaatggtttgacctttttttttttaacattacttcttgcactggcaacataaggaactgccttatctttggtctatttgttt

SEQ ID NO: 2267 - DNA, 601 bp, Human
tcactcaaacaaaaaaagactaggagtggcttcttagctcttaaaaatgcccctggtttccatttaaattgatttttaattgtgctgagtaacagaagcagcctgaggaatgcagcttgtgccctttaacacctgtttttaattccaaccgaagagcatatgaaaactggaaagtaaattgtcaatgtcgtattagtgcggtacagcttatctgaatcaaatatctgacctggtaccagtcagtaatctcaacccaaactattgctttgtaatgcattctgtatgatctttatgtccttcmgtaagtaaaggctttttctgtttttttctccaaatctccacttggcagagtccttatttgtggtctctgtgattagagaggaatggcggctactgtgagactctttagtggcccttagttccttctgctgcttctctatcttctgttagaaaccagacttgatctttttgaacttcggttatttgattggcttttgcctccattcttctcactaacacaccaatttgagtactaagtcttcagttcagcagttggactcctgggtaagtttcccagctgctgcagatcaaaatgcatttg

SEQ ID NO: 2268 - DNA, 601 bp, Human
tgagaaagacagactagaaaaagaagtaaagacaggccaggcagacctgaaagtactctgaaataataattaaaattatttctttctttggattcctttttttgtttattattattttttttagtagagacgaagtttcaccatgctggccaggctggtttcaaactcctcacctcaagtgatttgcctgcctcaggctcccaaagtgctgggattacaggcgtgaccccacagcgcctagcccgttggattcctttttattttgataatctaaataaatctagttttacttagtcataaraagaactattttttaaaaatagctaatttgttttacaaagcataatacatcagcaccgcaacatcactcaaacaaaaaaagactaggagtggcttcttagctcttaaaaatgcccctggtttccatttaaattgatttttaattgtgctgagtaacagaagcagcctgaggaatgcagcttgtgccctttaacacctgtttttaattccaaccgaagagcatatgaaaactggaaagtaaattgtcaatgtcgtattagtgcggtacagcttatctgaatcaaatatctgacctggtacc

SEQ ID NO: 2269 - DNA, 601 bp, Human
ccagctaatttttgtatttttagtagagatagggtttcaccatgttggccaggatggtcttgatctcttgacctcatgatctgcccgccttggcctcccaaagtgctgggattacaggcgtttttaatggctattccaatatttcattgagttcctatgtcatcagatacttaaccatttccctaccactgggcaattagtttatagcgctattagaaatggaaagtgctttaaaaatattttcaaaaatacaatcattgcttcaaattatatccttaagaaacatttctaaaaattattragtcataagaaaatcaacaaattttaactcaccatgttttgaacacaattttttggcctctgaaaaactgtgcaatgcctgatcagacttgtaacagtgacccttgtactggatccaccgtgacccattctcttttgctgctggacatcttgatgaatatgtaagacgggacagctttttagctataaaaatgttagacacagttgtaacaatgcatggaaaaaaaagactgcctttcaaaatctacttcaatgtccctgattggaactgttgcgtttgtggttgagtagcatttaactc

SEQ ID NO: 2270 - DNA, 601 bp, Human
ctacttcttccaacttattattttccatgtacttattattaacattgataatttttttttgagatagagtcttgctctgtcacccaggctggagtgcagtggtgccatctcagctcactgcaacctccgcctcctgggttcaagcgattctcctgcctcagcctcccgagtagctgggactacaggtgtgtgcgaccacacccagctaatttttgtatttttagtagagatagggtttcaccatgttggccaggatggtcttgatctcttgacctcatgatctgcccgccttggcctcccwaagtgctgggattacaggcgtttttaatggctattccaatatttcattgagttcctatgtcatcagatacttaaccatttccctaccactgggcaattagtttatagcgctattagaaatggaaagtgctttaaaaatattttcaaaaatacaatcattgcttcaaattatatccttaagaaacatttctaaaaattattgagtcataagaaaatcaacaaattttaactcaccatgttttgaacacaattttttggcctctgaaaaactgtgcaatgcctgatcagacttgtaacagtg

SEQ ID NO: 2271 - DNA, 601 bp, Human
acaagatttttcaatcagtcaagtgtctccacaacggttatcagaataaattagataaatgccatccatctacctggctaatttgctacccaaggaagcaggtaaacaagttttggtctttgaaatactctaggtagtttccctagaagtcattttacagtttgactatggatcaaatttgtcacgggaaagagccaatcattgctactctttctaaaatagctaaatctgaaggcaaaaagcactgccctttatggtggtcagaggatgtggccaatcctattgcagaacggatggacamccatactactttgatttgttaccctggtgaggctaagcttatgtattaataactaagcaatggaacaactataatttttatttactacttagctaactttacaaaaattttacctcttaattcctttttctaagcatatctagctataggtaaaaccgtttccaatcatttgtcagtatttttacttagcagttcacttagccacttttattttattattttacatttattattatttttattatttattttatttatttatttatttttgagatggagtcttgctctgtcgcccaggct

SEQ ID NO: 2272 - DNA, 601 bp, Human
gactgttcagatgagaaaagagaaagagttgtgtaacctcccaatgccacttagctaggatatgtgggaactgggatttgaacccagaccctcatgcctccaagtcttaagtgcttaacctacatattagttttacagtaaaccattctgttttctcctttaggagaaaaaggtttatgactttcaaaacatacatatatcttacaacagtttccatcatgtgtattcaggtataaaaccgaatggttcccacacaaaagttcccggtaactacaagatttttcaatcagtcaagtgtctycacaacggttatcagaataaattagataaatgccatccatctacctggctaatttgctacccaaggaagcaggtaaacaagttttggtctttgaaatactctaggtagtttccctagaagtcattttacagtttgactatggatcaaatttgtcacgggaaagagccaatcattgctactctttctaaaatagctaaatctgaaggcaaaaagcactgccctttatggtggtcagaggatgtggccaatcctattgcagaacggatggacaaccatactactttgatttgttaccctggt

SEQ ID NO: 2273 - DNA, 601 bp, Human
ggcactagaactctaagagaaggcaggcatgggttccttgtggggacacagacattcctgtggagaagaaaatgtcctgatgttgatccaaggatcccagaaataagcctctagaaagattccactttatttaacaggattttctgtgtcattagtggtttccgtcattgctaagttaactcatggattcattcaaaatttataaccatccagaacagccagcgacctagcttatttatccagaagaggcatctgaattagccactacttaacattctttagcaaggacgacttgttattkaggatgagttagaactctctttgcacactacacatacaattatttcacttaccaacagaatgttgagataatccaagccaaactctcatggtaatgttattattttccctcatcagtctgctcacaaatttattctcatcttcatcttttatggaaacgatagttgcagagtgatctgttgaaagaaaacacattctcaattagctttatggaaactagagaagtagtttattctcaactagccatttgaaaaatacatatattattaacaagatcattgataaattcaagccttacaca

SEQ ID NO: 2274 - DNA, 601 bp, Human
atcaattatctgcaattttataggttggcgcaaaagtaatggcaaaagctgcaattactttcgcaccaacctaacactaagacagtttttaaagattactattaagacataattttaaccaatggtaaaaatattcttagagagaagggaataacaagaagataactttctgaataacgaagttataagctgcaaatccatgcggtgacaggcactagaactctaagagaaggcaggcatgggttccttgtggggacacagacattcctgtggagaagaaaatgtcctgatgttgatccarggatcccagaaataagcctctagaaagattccactttatttaacaggattttctgtgtcattagtggtttccgtcattgctaagttaactcatggattcattcaaaatttataaccatccagaacagccagcgacctagcttatttatccagaagaggcatctgaattagccactacttaacattctttagcaaggacgacttgttatttaggatgagttagaactctctttgcacactacacatacaattatttcacttaccaacagaatgttgagataatccaagccaaactctcatg

SEQ ID NO: 2275 - DNA, 601 bp, Human
ttaactgcagaaatagacctttaagcttttatataatcaaactatagaataaaatacatctcaagaacattttaaaagaaattacttccctaataccctggcaacttctgtttttcttaggaaagaattatataaaatgtagactggagtcctggacatcttgtgcagttatcgtcccttgtaatctatttttcagggggaaatctctatgacttaatcaagatagttggatatactttaaggactaaatacttcaagactaaatacagaattttgtacataattggattgtacatttatytcctgactgttctgcaaaaagtctcctaaggacaggttccatacttacccagaggcactttgcagacaactcttccaaaaccatgttcacattcaacttttttccaagtttcatttgaagctatcaacatgctacatcttccaacaccactcttacttttattttcccatttgacaaatgtcacttctgatccatctaaccaactccaagactggtctgaagaaagaaattaaatacaactatgtctactgccactaaactagtaagttacaagcatgggttcatgtaactcatcagaac

SEQ ID NO: 2276 - DNA, 601 bp, Human
tcctaacaccaatttgggaacatcactacttgtatattatcctactttgatagcaaattgctaaaagctataaatttttgtttttgacttacctggggctaaataaagtgttatttgcttcaaaatgatttaagtctctcagatgagttcatttagtgcagctgctgttccaagacccttatctgcatactgcccagatggattcgctctgttccatgactttaaataccattgctatgcacactacacatctcgtccctctatggataactcaaaatggccaacgtagaacttttgattygcaacaccctaactctgctcccacccaaccccccaaatcttccagttgctttccattccactcagaataaaaccagaactcaagccttgcttccaaagctctgtatgtctagcacctgcctacctttcagttcttccctgagcgctcagccaacttgttctgccttaggctctttgctccaactggtacctctgtctgttatgccctttcccttgaagtttgcttggcttgattttttagatcttagcttcggtgtctcctgcttctaggcttcttccctggtttcctaatctagagtag

SEQ ID NO: 2277 - DNA, 601 bp, Human
acacctgggcttgcgcatcacctccagagtgtcggagtccagcttccccgtcacctccaatccaaggaacttctgcatttctcggatttttttaacaacaggaccactgtcctttctcctaacaaactgtttcacatcttttttgaggtcgtagtagttttctagatatttctaacagaataagtatagtttttaggtcactcttacaatttttactatagctatctatttatagtaagtttttgcagttgctcacttcttaatctatttggagtatttctctagcttgctgaaataatgscaaattttataatatgatactagcaacacaaatatttagctaaaattacgttgcattaaaaaaaaaactgaagctgttccaaagcaagatatggttcatccactctccacttgttactcatgtgccttaagccccagtgctgctactgctatggtgttgtgtgatcttaagaaaacacctaatatttctggcctttgtttcttcctacataagaggagaagcccaaatggtgtgataatgagaccttttccacttccaacactctataactctctattcttgaactgttcctacacagta

SEQ ID NO: 2278 - DNA, 601 bp, Human
aaaaattgaagcagatgctattttctcctatgatatagtttataaaattccaatcttatgtgaaaacccctctgaaccattacctgtatgtaaggtgggttttcctccacttcgggatgccaggaaaggttctgaagtgaccaacatcaggaactccacacctgggcttgcgcatcacctccagagtgtcggagtccagcttccccgtcacctccaatccaaggaacttctgcatttctcggatttttttaacaacaggaccactgtcctttctcctaacaaactgtttcacatctttttygaggtcgtagtagttttctagatatttctaacagaataagtatagtttttaggtcactcttacaatttttactatagctatctatttatagtaagtttttgcagttgctcacttcttaatctatttggagtatttctctagcttgctgaaataatgccaaattttataatatgatactagcaacacaaatatttagctaaaattacgttgcattaaaaaaaaaactgaagctgttccaaagcaagatatggttcatccactctccacttgttactcatgtgccttaagccccagtgctgc

SEQ ID NO: 2279 - DNA, 601 bp, Human
taactgcaaaagagatcattatatcagcctctccttcatacagcctggagaatgtgagtggagtcacctcttcccagactttcagagctttctcaacagcagaatcaacagcatcttttggcaaatctggtgtataattcacaatcctgtaggagaaaaattgaagcagatgctattttctcctatgatatagtttataaaattccaatcttatgtgaaaacccctctgaaccattacctgtatgtaaggtgggttttcctccacttcgggatgccaggaaaggttctgaagtgaccaacrtcaggaactccacacctgggcttgcgcatcacctccagagtgtcggagtccagcttccccgtcacctccaatccaaggaacttctgcatttctcggatttttttaacaacaggaccactgtcctttctcctaacaaactgtttcacatcttttttgaggtcgtagtagttttctagatatttctaacagaataagtatagtttttaggtcactcttacaatttttactatagctatctatttatagtaagtttttgcagttgctcacttcttaatctatttggagtatttctctagcttg

SEQ ID NO: 2280 - DNA, 601 bp, Human
taatgtcttctatgaaagaaaaattattctatcgtgcaaatgaattagcccagcataagctttaattacctgcaatgtatgcaaaacagtgcgtgtgctataccctcttccaaaagctaggccgtgtttgtatacgtgtatgtgctgtgtaaatatattcttgtatgtgtgtagaaagattctggaaggatgcacaaaaagtcttgactctggatgagtacagggagaactgggaactaaaatttttaatttgcttctcatttgtgctctttgaatgtttgtcatgtgcatattgatccaycagtaagtaaattacttgattaaatgtaatgttgatcctgatgtcatttttaaaggaagtaaaaataaaattattattcgaaagatctactcatgccttttgaaaagtaactgtgacttaagacatttggaaacagcaattagaagctaagaaccagatcagcctgtgccttcaaaaatgaacctgacaattttaggaaaatgtgggaaaaggcagcaccagatctaaatgattccaagctcagaagaaacgtttttgttttaaatgtctaagaatctctatcaagtttctgcgtgtttt

SEQ ID NO: 2281 - DNA, 601 bp, Human
gaactaaaaatagaaagtgtttatagagctttactttatgtcagggactatgccaagcttgttacatgaatttattttcatttatttctgcaacaaccctatgaggttgtatgtctaactccatttacagattgagcaagttgaggttgagacagatttcgatgcttcctcaaggttactcagcaaggaagaatggagacagcactcggtgccagctctgtctgaaaacacagccagattccaggttacagggttattctgcttccgatcagataaattctccacttgcttggaaactctmatcacctatttctttcttccccaaaaatcctcctcccttttccctgcattgcagcctaggaagcacagcaactatttcaaaacaccaggggaccctttagtgctctgcaaacatggtgatcaggttacctttcaataaagatcatcagcctccacttccttaccttgagtagaaaacaaaatctttttttttttttaaactttgggcacatggaaaggtaagtatttgcaaatgactggcatgggcaatgactgacaactcaggaaagacagacaaaaaatctccctgggaattagtagc

SEQ ID NO: 2282 - DNA, 601 bp, Human
cacaggcaggagaaaacgaacatttcaattcacagagacttaggtgaagaattattagcttcatttaaagtgcccatattgtgccttctacatatctctttcaacaattaagccagctgttactcttcaaagtgtgtgtcactttctttgcatttgggtcaaactccaactgtgaagatccagtaaagaaataaaagaaccctgcaaatacagacaagggaaatagtaagatatttttccaaataaagacatttgacaatatacaaaactcagaatcatagagaactaaaaatagaaagtrtttatagagctttactttatgtcagggactatgccaagcttgttacatgaatttattttcatttatttctgcaacaaccctatgaggttgtatgtctaactccatttacagattgagcaagttgaggttgagacagatttcgatgcttcctcaaggttactcagcaaggaagaatggagacagcactcggtgccagctctgtctgaaaacacagccagattccaggttacagggttattctgcttccgatcagataaattctccacttgcttggaaactctcatcacctatttctttctt

SEQ ID NO: 2283 - DNA, 601 bp, Human
aattcagcttgttttcatgtccggcttttaaaaggcctagtccttaccagcttggaaccctccaaatcactaaaaggagatgttcaatctcaaactaatcacccaaataatttctttcaggctgttttaattaacaagagaaaacaacccacactatttcctaataatcagcaaatcaaacatcacctaactgatagttcatttacctgaacagtttttgtatttttctctttagaagatacaggaaaggccttggaaatctgcacatggagtaagagcagaaatggaagcgtcttcaggsagaacatgatcttctcttcaaactctacccctcctggctttctttctgtccctctgggtagggcccttccctggcgagcaccctgacgttcacagcatcatgtgtcactcacagctctcttgcagtcctctttaaagccatgtcttaaacaattgctgcatcaggaatatgaagcaacataggttaattacactctgacagttttgcaattttataatgtgatttagtacccccaaatgggggagtctttcaacagtctttcaaaactccaactttctactctttgcttttggatgtttt

SEQ ID NO: 2284 - DNA, 601 bp, Human
ggttcactttcagactgtgaaacaatggaaaaaaactattggttctgcttttataatgcttccaagagtttataaacagtccacaatctgatgctgggaaatatgattttactgtgtactgatttctagttcattgtaatctaccatcctcacattattttctatatctggaatttttggcggcaaagaaaatgcctgtatggaagcaccagacatatagtaacttgattgcagatatcctggaaggaaaaaccttaggtaaatgagaaagaaaatgataccattttataaataaaaccawttcttctacaaaagtttcccaactaggggtaactctacagcagtattttcccagcctttaaagaattcagcttgttttcatgtccggcttttaaaaggcctagtccttaccagcttggaaccctccaaatcactaaaaggagatgttcaatctcaaactaatcacccaaataatttctttcaggctgttttaattaacaagagaaaacaacccacactatttcctaataatcagcaaatcaaacatcacctaactgatagttcatttacctgaacagtttttgtatttttctctttagaa

SEQ ID NO: 2285 - DNA, 601 bp, Human
aatacatataaagcatttagttcattacttgtcaaatagtaataatattccacaaatattagatattattattattattaagatgtatgaaaggagggacttgactctctccagcaatgattaagcctttgttgggtcctaaagtaagtgcttagagagacagcctaacattgctgtagtcctctttagattgttggagaaggaagactaaaacgggaagccttggagtggaaagaacccacggtatctcaacattttcattctcatattcattcactactcacactctacaaaggcaggkatatttatctacttgttcctagtgtatcccaagaacagtgtctgtcatataagagcccagtccatactggataaatgagtgtatcctgaaaccctagagatatcacctgtaggtcaagttagtgcgttcccacttggggtttcctggggttaacataaaaccaccactgtcaggcactccacagcgaggctttttcatcatgtccagagtttcctcatttggcttccccgtcacattcaacccaaaaaatcgctgcatttctttaagcttttcaacgatcacattagtgccattcttcct

SEQ ID NO: 2286 - DNA, 601 bp, Human
cgtgaaaggaactgtgggcaatttgttgtggttctctgctctacagggagtgcatagtctagaagaggagagatgtgtgcaaacaacttgaaagcacacagtgagtgatgacagagaaggagatacaaaagctgtcagaattctgcagaggaagttctcatttccaggacaaggcaagacagaaggtggcctttgacatacatagcatggcaagatgagagagattttaaaaggtggtgcttggggcatgggaagagtatttcagggagaggaagcaattcaagcaaatgtgaggaagatraaaagcatagggtgtgacctagaaacagtgaatgtacaatgtgggtgttagcccgatgtgaatggaatacgtgaaataagaagacaagccaagaaagacaaggatgaacaagcaccaagagccttcaataccaagtggaagtatttggaccttatttggtgcagaatgtgtaaacattgaaacttttaagcatgagagtgatgtgatccaagatgggcttccaaaaacaaaccctgctgcaatggtaggaaaaattagagggagcacatactggagatggagagtccagttaggaatcta

SEQ ID NO: 2287 - DNA, 601 bp, Human
tccttttaattatgcattcatgagtgcatttcagaaaaatatctttgaatgcttggaataccgtgaaaggaactgtgggcaatttgttgtggttctctgctctacagggagtgcatagtctagaagaggagagatgtgtgcaaacaacttgaaagcacacagtgagtgatgacagagaaggagatacaaaagctgtcagaattctgcagaggaagttctcatttccaggacaaggcaagacagaaggtggcctttgacatacatagcatggcaagatgagagagattttaaaaggtggtgyttggggcatgggaagagtatttcagggagaggaagcaattcaagcaaatgtgaggaagatgaaaagcatagggtgtgacctagaaacagtgaatgtacaatgtgggtgttagcccgatgtgaatggaatacgtgaaataagaagacaagccaagaaagacaaggatgaacaagcaccaagagccttcaataccaagtggaagtatttggaccttatttggtgcagaatgtgtaaacattgaaacttttaagcatgagagtgatgtgatccaagatgggcttccaaaaacaaaccctgctg

SEQ ID NO: 2288 - DNA, 601 bp, Human
tttaaaattggggccaggtgcaatggctcacgcctgtaatcccagcattttgggaggctgaggtgggcagatcactcgaggtcaggagttcaagaccagcctggtcattgtggtgaaatcacctctctactgaaaatacaaaaattagccaagtgtggtggtgggcatctgtaatctcagctacttgagaggctgaggcaggagaattgcttgaacttgggaggcagaggttgcagtgagccaagatcgcgtcactgcactccagcctgggcaacagagtgagactccatccccccccccmaaaaaaatttaaaattggaaatttggaaagcctaaaaaagaagaaaaaaatccccaccatccaaagacaataactgggaagcactgtagtgcatttcttcttaaactttttttcttttagggcagcaatagaggctcagtccctcacaccttctttgttaatgctttattactggggaaattcagagttcagttttatggaaactgcagaagtgcaaaggaagagatattcagattctgggagtgttcgcctattcccaggtcctaccatgtactatgactctcttgagaagaccttacc

SEQ ID NO: 2289 - DNA, 601 bp, Human
atttaaaattggggccaggtgcaatggctcacgcctgtaatcccagcattttgggaggctgaggtgggcagatcactcgaggtcaggagttcaagaccagcctggtcattgtggtgaaatcacctctctactgaaaatacaaaaattagccaagtgtggtggtgggcatctgtaatctcagctacttgagaggctgaggcaggagaattgcttgaacttgggaggcagaggttgcagtgagccaagatcgcgtcactgcactccagcctgggcaacagagtgagactccatccccccccccaaaaaaaatttaaaattggaaatttggaaagcctaaaaaagaagaaaaaaatccccaccatccaaagacaataactgggaagcactgtagtgcatttcttcttaaactttttttcttttagggcagcaatagaggctcagtccctcacaccttctttgttaatgctttattactggggaaattcagagttcagttttatggaaactgcagaagtgcaaaggaagagatattcagattctgggagtgttcgcctattcccaggtcctaccatgtactatgactctcttgagaagaccttac

SEQ ID NO: 2290 - DNA, 601 bp, Human
atttaaacaccaggtgcggtggctaatgcctgtaatcccagaactctgggaggctgaggtgggaggattgcttgaggccaggagtttgacactaacctggtcagcatagtaagaccctgtctcctctataataaacaaacaaacaacacatttattaggttttttttttcctacttacgttcttgctggaaaactgcatcaactttactctctattcctggaaaggcacctgatatgcttttgggataacctggctccatgaattgtctttggttatcatatctggtaaaaacaaaatgtyatccgatttaacaccaatacagaatataacgaaaaaaattttttttattgtatataatttacaaagtctcctcacacatattttttcattcagttctcacaatgccctgtttactaggattaagaatggttaatttctctacctaagggtacacatttataaaacatatggttatcattaattctaaaacaggcttgatggctgacacactgttattacccaaagtaagcttatattttcaaggcttttacttaattggtatatagtataactcccttgtgtgtgtatatagatatataa

SEQ ID NO: 2291 - DNA, 601 bp, Human
ccactgaagacatggaagaaatctataaaaaaagagagataatttattgaattagcttatagaatatctcagatgtcttcagttagaaaaccctgcccctgttccaacataacattcaaatgcaaacatgctatttaaaaaatttaaacaccaggtgcggtggctaatgcctgtaatcccagaactctgggaggctgaggtgggaggattgcttgaggccaggagtttgacactaacctggtcagcatagtaagaccctgtctcctctataataaacaaacaaacaacacatttattaggttttttttttcctacttacgttcttgctggaaaactgcatcaactttactctctattcctggaaaggcacctgatatgcttttgggataacctggctccatgaattgtctttggttatcatatctggtaaaaacaaaatgtcatccgatttaacaccaatacagaatataacgaaaaaaattttttttattgtatataatttacaaagtctcctcacacatattttttcattcagttctcacaatgccctgtttactaggattaagaatggttaatttctctacctaagggtacacattta

SEQ ID NO: 2292 - DNA, 601 bp, Human
atagtggaatattccaaacatattttcacggaggacaggtagaatggatacagtgatgggaaacaatgacttaatattgagaaaagtataagcaggacacaatgtaacgaaaatgcatgctgaacttcccttcaacattctgaaagtggatacagccacatttgattttgcttcagccatatctacagttaagccatttattgcctcttgcaactctggtaactctctgagcaataagatcaaatgcgtaatatcttggtccactgaagacatggaagaaatctataaaaaaagagagatratttattgaattagcttatagaatatctcagatgtcttcagttagaaaaccctgcccctgttccaacataacattcaaatgcaaacatgctatttaaaaaatttaaacaccaggtgcggtggctaatgcctgtaatcccagaactctgggaggctgaggtgggaggattgcttgaggccaggagtttgacactaacctggtcagcatagtaagaccctgtctcctctataataaacaaacaaacaacacatttattaggttttttttttcctacttacgttcttgctggaaaactgcatc

SEQ ID NO: 2293 - DNA, 601 bp, Human
tgaaatagtaaatattgaggtgacaaaaaggcttactttccttctctttgatggaatcactaatgtaagatggaatgtgtaagaactgaataagcctctgcaaatagtggaatattccaaacatattttcacggaggacaggtagaatggatacagtgatgggaaacaatgacttaatattgagaaaagtataagcaggacacaatgtaacgaaaatgcatgctgaacttcccttcaacattctgaaagtggatacagccacatttgattttgcttcagccatatctacagttaagccatktattgcctcttgcaactctggtaactctctgagcaataagatcaaatgcgtaatatcttggtccactgaagacatggaagaaatctataaaaaaagagagataatttattgaattagcttatagaatatctcagatgtcttcagttagaaaaccctgcccctgttccaacataacattcaaatgcaaacatgctatttaaaaaatttaaacaccaggtgcggtggctaatgcctgtaatcccagaactctgggaggctgaggtgggaggattgcttgaggccaggagtttgacactaacc

SEQ ID NO: 2294 - DNA, 601 bp, Human
tgggtggggggagggggtgtggaggaaggggagattctctgacaactcccgtcccaccccctttggaaagcagagcaaaacaagggaaagtgaaactgttggcaagcagctgtgagtctgtgaatctgtgagcatctccctgtgtatttgtgcgtggtggtggtggtggtggcgggggtgggggaggggaggggggagtgctatttttctgcgtgtgtccctgaggatatgggtggtggacaagtaggagggaatgcccatcattctacccagcattcaggagctatgctaacagagacayggttatgtaaccctatcctcacatagccagggaaactacctaaaaaaccagaggccatgatgggcaggtaggggaaagagcaaaatgaggcagccacaagggccagcctgggagctaagcctccagtgtagcctttgtctggctggtttctcacaccaccccagcacttaggaactgggtgagagagaatgcttctttccgcctgcccccccaccgcgcccccagatcccctcagtgatggaagggaagcagcctgtgttcagccatgtgcatgcagctcacaagtaagggccccttctt

SEQ ID NO: 2295 - DNA, 601 bp, Human
gcctacacgatggctggagagaacctagatagagtctgtggaaggagcccccagttcagcacaggctttgagacttcctgcctggggtagggctccaaatacagttaaaaaaaaaagtctgggatggaccaattccaaccagcccttcctaggcctttacttatccccagatgtttatagttgcttgcacaagactagagtgaggctcccagaaccttctagaaccaagctgccattccatgagttctgggtactcccccaatcacccccaatcatggcaaaaacgttagtgaagcccagkacatgcaggctccctaacaagctcccaacttccaaggcccaggaggctccctggaacgtggtggctggcagaaggatgggggtgggtggggggagggggtgtggaggaaggggagattctctgacaactcccgtcccaccccctttggaaagcagagcaaaacaagggaaagtgaaactgttggcaagcagctgtgagtctgtgaatctgtgagcatctccctgtgtatttgtgcgtggtggtggtggtggtggcgggggtgggggaggggaggggggagtgctatttttctgcgtgtgt

SEQ ID NO: 2296 - DNA, 601 bp, Human
cgatgttggccaggctggtctcgaactcctgaccttgtgattagtccgccttggtctcccagagtgctgggattacaggcatgagccacggtgcctggcccaccccgtacatctcacagatgaggaaacaggctcaagaggtttggtctctggtccaaggcatcatagaccctcaagaggagagcccagttggaagtctcagctccgcaagagtcttctcctgccccctgctggctcttctctgactctctgtgtgcacttcagcaaaccctgtctcctctgggcttcggtttccccactygcataaggggctgaatgctggagttaattggccagcacaaggttggggacatggtccttctccctagactccaaaggtctgcctgtactcctggctgcttcctataccccccttcagggtacaaaagggataaaccaaacccctacagcctgggtgccagaactaagttctggaagctagggggtactaacctctcccctgcttttagcaagggggtgtttttgggggctgcaatcacgctccaggggaggactgtggaagctctgggaaaccagtacaccagggtatgaactcgcggtg

SEQ ID NO: 2297 - DNA, 601 bp, Human
ggtccactcctcattctccctgccccaccctgccatgcccatcctgatggtgagttacccccattccatcctcacaaccaccccgtacatctttttttttttttttttttttttttttttttgagacggagtctcacactgttgctggggctggagggcaatggtgtgatctcagctcactgcaacacctcccgggttcaagagattctcctgcctcagcctcccgagtagctgggattacaggtgctcgccaccacccctggctaattttttgtatttttagtagagatgggggtttcaygatgttggccaggctggtctcgaactcctgaccttgtgattagtccgccttggtctcccagagtgctgggattacaggcatgagccacggtgcctggcccaccccgtacatctcacagatgaggaaacaggctcaagaggtttggtctctggtccaaggcatcatagaccctcaagaggagagcccagttggaagtctcagctccgcaagagtcttctcctgccccctgctggctcttctctgactctctgtgtgcacttcagcaaaccctgtctcctctgggcttcggtttccccactt

SEQ ID NO: 2298 - DNA, 601 bp, Human
caggccaggctgggaaaggtcagggaagggaaggagtcagggttcagccttgtgccccgaccctctggggcctttgtcagtggccacagcagcccaacactctcacccctcacctggcctgactggagaaggccctgggcctgccggttaccatcccacattgcccccacagggctctcagtgtagcaagggcagggagaaggcccaggctggaaggtccactcctcattctccctgccccaccctgccatgcccatcctgatggtgagttacccccattccatcctcacaaccaccccgkacatctttttttttttttttttttttttttttttttgagacggagtctcacactgttgctggggctggagggcaatggtgtgatctcagctcactgcaacacctcccgggttcaagagattctcctgcctcagcctcccgagtagctgggattacaggtgctcgccaccacccctggctaattttttgtatttttagtagagatgggggtttcacgatgttggccaggctggtctcgaactcctgaccttgtgattagtccgccttggtctcccagagtgctgggattacaggcatgagc

SEQ ID NO: 2299 - DNA, 601 bp, Human
gaataggtccacacgtgagaagctgctactgaccagcagagggaagtggcggcagctggtgttggggctgagggcttccaggccaggctgggaaaggtcagggaagggaaggagtcagggttcagccttgtgccccgaccctctggggcctttgtcagtggccacagcagcccaacactctcacccctcacctggcctgactggagaaggccctgggcctgccggttaccatcccacattgcccccacagggctctcagtgtagcaagggcagggagaaggcccaggctggaaggtccacwcctcattctccctgccccaccctgccatgcccatcctgatggtgagttacccccattccatcctcacaaccaccccgtacatctttttttttttttttttttttttttttttttgagacggagtctcacactgttgctggggctggagggcaatggtgtgatctcagctcactgcaacacctcccgggttcaagagattctcctgcctcagcctcccgagtagctgggattacaggtgctcgccaccacccctggctaattttttgtatttttagtagagatgggggtttcacgatgttg

SEQ ID NO: 2300 - DNA, 601 bp, Human
aggaagaactgtggaaagagaatccttggtggcttggctttccaagctcctaggggccgacccctctggggaggacttagatccctaagtcctgggcagagagaggatgtagggacttgaagatgccattggttgggggtaggggctgattaaaggtaggagcagagaactcacctagctgcttcctccgccaccagtagctgaagaccagtgcagtcgccagtgcagccacaagcagcagcaaaggcagcaggataccaaggagcgtgctctgtgggaccccatctggccctggccgcaycactctacccaggatatgacattcaccatctacgcagacctgggggcaggtggcaactcaggcccagcctgtaggccctctgcccgtgtttcccagggaggtccagctgggctgcctacctgcaatggggcaccatcctggccaagctgcagggatgggggcagggggcagacaaccatgtccccccggaactcgtgctggcagctctcaccacccacggtcacgttgatacccacacagtcagccacagcgcccagcccaatatactgcagagagggtcatgaggaccagccagtaggc

SEQ ID NO: 2301 - DNA, 601 bp, Human
aggcaccgggggggctctgtcacctacgtgtgtggaggcagcctcatcagcccttgctgggtgatcagcgccacacactgcttcatgtacggccctgggtttctcctcttcgactcttctgccccaccccaagcacatccctttctccttcccagcaaagtgttccgcctcatttctccctcatctgcccctgtccatgcagcccatggccttggggacaagtcgtgctttgaggcctctagggagggaaggaagaagtggcagatttcatgggactaagctgtttgatgggtatcttctyccacagtgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattggtgagggggaaccccgcgactactgtggccataatggcttggggagagtgggacccagggagagactggagctgaggttgaagctgcccggtggggcaggggtggggcgagggaccttgaagcctcgatatacatgacaaaggga

SEQ ID NO: 2302 - DNA, 601 bp, Human
ccttgggatggattccagcctaactacctcagctgggagtttttgcagaaacgacctgtacagctgtatgcagtggctctggccatccaagcctttttcaacacctggaacaaagcccttggggcatggggcaggggaggtttccaggtgataagcgaccagcagacctccctggatgactgacctagggataggcatagctacttcctcggcacttggaggggacagatggggaccgcctaaccagtagtgatctttctcctctgaccctctgtcctcccccagccttgctgaagatccrttccaaggagggcaggtgtgcgcagccatcccggactatacagaccatctgcctgccctcgatgtataacgatccccagtttggcacaagctgtgagatcactggctttggaaaagagaattctagtaagtgacaattgcgactgacttagaaggtcctgaggagtgttttgacctgaaaatgagcccagtgtgatcaagggaagactgcagagttagaggtgggagcactgaggcggtggcagatgggtccagggatggatgaagagtgttgtttagggagcgatgggctgcaaaggta

SEQ ID NO: 2303 - DNA, 601 bp, Human
cctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggygaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcg

SEQ ID NO: 2304 - DNA, 601 bp, Human
gacaggatctcgctctgtcgcccaggctggagtgcagtagcatgatctcagctcactgcaacctccacctcccaggttcaagcaattctcctgcctcagcctcccaagtagctgagattacaggtgcgtgccaccacactcggctaatttttccttttttgtgtgtgtgtggagacgggtgtttcaccatgttggccagcctggtcttgaactcctgacctcaagcaattcatccgcctctgcctcccaaagtgctggaaatacaggtgtgagccagtgcccagcctgtttccaattttcyatgtcacaaacattgctgctaagaacattcgtatacatgtgtccctgggtatatgtggccaaggttctttggcatttctgcatggcgaggagttgagctgtagcatatgttaatcttcatctggactagatattgccgaatcgctctaagtggttgatgtgccaatttactcccccaccacagacacggtctgcaactccacatccttactaacccgggtattgtcagatttttaaatgcttgccaatctggtgggtgtgaaatgggctctccttgtttgtttgtttttagtttgcatgt

SEQ ID NO: 2305 - DNA, 601 bp, Human
agtgctgggattacaggtgtgagccaccatgcccggcccacctttctctctttcgttcatttttttgacaggatctcgctctgtcgcccaggctggagtgcagtagcatgatctcagctcactgcaacctccacctcccaggttcaagcaattctcctgcctcagcctcccaagtagctgagattacaggtgcgtgccaccacactcggctaatttttccttttttgtgtgtgtgtggagacgggtgtttcaccatgttggccagcctggtcttgaactcctgacctcaagcaattcatcygcctctgcctcccaaagtgctggaaatacaggtgtgagccagtgcccagcctgtttccaattttccatgtcacaaacattgctgctaagaacattcgtatacatgtgtccctgggtatatgtggccaaggttctttggcatttctgcatggcgaggagttgagctgtagcatatgttaatcttcatctggactagatattgccgaatcgctctaagtggttgatgtgccaatttactcccccaccacagacacggtctgcaactccacatccttactaacccgggtattgtcagattttt

SEQ ID NO: 2306 - DNA, 601 bp, Human
ctcaccacaacctcgaacttctgggctcaaggaatccttctgccttagcctcctgagtagctaggggtacaaatgtgagctactgtgcttggcttcatatactgttgtttcatgtgttcttaaagcttataaaaaacgtatcatattctgcaacatttttttccctctcaaccttaggtttctgagatgtgtccacattggtatctgcagctctatttccttctttaagctgcagtagagcgctccattatgtaattattaccacagtgtttctcttctgctgctgacttgctgactgacwtaaagtcgtttccattttcttcttttctttctttctccccttccttcctccctcctccctccctccctccctgcctctctccgtccctccctcccttcctctctctctttctctctctctctcttcctttcctttctttctttctttcttgagatggagttttgctcttgtcgcccaggctggagtgcaatggcacaatctcagctcactgcaacctccgcctcctgggttcaaacaattctcctgtctcagcctcccgagtagctgggataactggtgcctgccaccaagcccggctaa

SEQ ID NO: 2307 - DNA, 601 bp, Human
cgtcccaatggattgggcaggaccatctcctgcccagtcagatggacaaacatcactgagacatctcatctatgtctcatgcatgcgtgtgagcttgttaagggcagagttgcaagttatacataacaaccatacatacaaacatgcaggatggggattgggttaaggatgaaagtaattgtgtcgttggggtggggatttgggtagtctgagataaggatggggttgatttggggatggggttggaactgtgcttggaacagggctgggtttgagttgggaacagtgttagggtaacatraagttgggcataggattggaggtgaagttgagttggggttggatatggggtcaagaatgagttggggatggagctgagctagagatgggttgggttggggttgggacttggataaggcatggagttggggttcagctgatgtaaagttaagaataggattgggatgatgatgaggttgagctggggatggcttggggttggggatggcaagggctgccctactcaccagagttgccctggttgcacaagtctaacccacacacaacctcggtaaggctggtgatcttcaagccagtccga

SEQ ID NO: 2308 - DNA, 601 bp, Human
gaacccaaattctacacttctgttatttcagagattgtagcgcctcaagtttctcctttctttcttttttctttttttttttttgaaatggagtctcgcgctgtcgcccaggctggagtgcagtcgtgtgatcttggctcactgtaacctctacctcccgggttcaagcaattcttgtgcctcagccacccaagtagctgggaccacaggcatgtgccaccacgcctggctaacttttgtatttttagtagagacggggtttcgccatgttgcccaggctggtcttgaactcatgagctcragcaattcacctgtcttggcctcccaaagtgctgggattacaggcatgaaccactttgcccagccaagtttctcctttcatttgctgctctccagtgacttccaataattgtttattatttgtccagcatttgcaactgtcattggcagaagggttggtctgatacaagtgactccatcatgaccagaattgcaggtcccctcccacatctaatccaccactaaggcctgcttcttaatagctcttgttcggctttggttgagacagggttttgctctgccgcctaggctggagtgcagt

SEQ ID NO: 2309 - DNA, 601 bp, Human
tccccagcatcacatgtctgctggaagccttgttcgcttttgtagcttcccagttgctatttttctcttccaagtttcttggactctcaccctgtgcatgtagagcttgccaatgacttgagggagatttgtttgcaggttgggaactcccttttctgtggtcccatccattccaggattttaactctcatcttccagacattctggcagccccaaactccaacctccgtcttctcagtctagcgactctctttccgtctgggctctatttcccttccacagcagcagattggcaagtgcrctccgggaaaaagccaggttgtctgtggaacccaaattctacacttctgttatttcagagattgtagcgcctcaagtttctcctttctttcttttttctttttttttttttgaaatggagtctcgcgctgtcgcccaggctggagtgcagtcgtgtgatcttggctcactgtaacctctacctcccgggttcaagcaattcttgtgcctcagccacccaagtagctgggaccacaggcatgtgccaccacgcctggctaacttttgtatttttagtagagacggggtttcgccatgttgc

SEQ ID NO: 2310 - DNA, 601 bp, Human
cttctgttttcctgaatatatcgattgtagcaattttcatgtttcctgtcctataatccaatatctgagttgctacaattctgtttctacagttggatttttctcttggtttctggtcaattggtcccttttattttcttcaggataccttgtaaggttttttgttactgttttttattttttgttttttgttttgttttgttttgagacagagtcttgcgttttgttttgttttgttttgttttgttttgagacagagtcttgccctctcgctcaggctggagtgcaatggtgtgatctyggctcactgcaacctccacctccctggttcaagcaattctcctgcctcagtctcccaagtagctggtattacaggtgtgtgccaccatacccggctaattttttttttttttgtatctttagtagagaaggggtttcaccatgttggccagtgtggtcatgaactcctgacctcgtaatcctcccacctcggcctcccaaagtgctgggattacaggcttgagccaccatgcccggcctggttttttttttttttaaagatggggtcttgctatgttgtccaggctggtgtgcagtggct

SEQ ID NO: 2311 - DNA, 601 bp, Human
ttaggcgaatcatttacatccaaagcccagtcgtccccctcaaagaaaaataactacaaggccacccacgtcttctcacacaaacttccatgaaaatgaaaacacaaattctcaccattgccaacatagctgttcacacctagaacaccttttccttgagccctactttctctaactcctattcattcttcagctgtcatcttcaatttcacctcctctaggaagccctccctgacccatcagcctggaacgggtacctgctctgagctcccactgccccttgaattccccatttctagtkctgcccactctgggtggtcactcatgggtctctggtgtgaactcttgtaaatgccaatgatccttagggctattttcctttttcttttcttttcttttttttttttttttttttttgagatagggtcttgctctgtcccaaggctggagtgcagtggctcactgccacctcgacctccctgagctcaggtgattctcccatctcagcctactgagtagctgagactacaggcatgtgccagttcacctggctgattcctgtatttttgtagagacaaggtcttgctatgttacccaggct

SEQ ID NO: 2312 - DNA, 601 bp, Human
agagtcattcctctacccagcccttggctcacaccatttcccatgcttggcatgccctccccgtcctgacccaagacacatctaagctgagtccaggccaagtcttaaaaaagtgagaggaccatgtcagccaaggttctcaactggcaggccgctagctgtaattaggcgaatcatttacatccaaagcccagtcgtccccctcaaagaaaaataactacaaggccacccacgtcttctcacacaaacttccatgaaaatgaaaacacaaattctcaccattgccaacatagctgttcayacctagaacaccttttccttgagccctactttctctaactcctattcattcttcagctgtcatcttcaatttcacctcctctaggaagccctccctgacccatcagcctggaacgggtacctgctctgagctcccactgccccttgaattccccatttctagttctgcccactctgggtggtcactcatgggtctctggtgtgaactcttgtaaatgccaatgatccttagggctattttcctttttcttttcttttcttttttttttttttttttttttgagatagggtcttgctctgt

SEQ ID NO: 2313 - DNA, 601 bp, Human
ggatccgttacttttccctggaaacaccagagtcattcctctacccagcccttggctcacaccatttcccatgcttggcatgccctccccgtcctgacccaagacacatctaagctgagtccaggccaagtcttaaaaaagtgagaggaccatgtcagccaaggttctcaactggcaggccgctagctgtaattaggcgaatcatttacatccaaagcccagtcgtccccctcaaagaaaaataactacaaggccacccacgtcttctcacacaaacttccatgaaaatgaaaacacaaaktctcaccattgccaacatagctgttcacacctagaacaccttttccttgagccctactttctctaactcctattcattcttcagctgtcatcttcaatttcacctcctctaggaagccctccctgacccatcagcctggaacgggtacctgctctgagctcccactgccccttgaattccccatttctagttctgcccactctgggtggtcactcatgggtctctggtgtgaactcttgtaaatgccaatgatccttagggctattttcctttttcttttcttttctttttttttttttt

SEQ ID NO: 2314 - DNA, 601 bp, Human
attcaatgcatatttgttaaatgaatgaatgaatgagcaattacttaaaacccttctattgttccctgtggtagcctgtctccaaaatggcccccaataatctctgctccctggtattcatgcccttaaagaatagggctggctgggtgcagcagctcatgcctgtaatcccagcattttgggaggccgaggtgggaggattgcttgagtctgggagtttgagactagtctgggcaacatagcaagactctgtctttaaattaaaaaaaaaaaagaagaagaaaagaataaggatgccctrtgtagtcaactggatattatggaaatgatggtgtatgccttctgtggctagatcatagaacacatgcctggctctctcacttggatcactttttctggggcaagcagcagccatgttgtgaggacactcaagtagcaccatgggaaagttcacgtggcagaactgaggcctgtgccaaagccatgggaggggagcattcatgtgagtgaagctaccttaggagccttcagatgactgcagccccagctgacatctcgactgcaggctcatgaaggatcctgagccagaaccacctagcta

SEQ ID NO: 2315 - DNA, 601 bp, Human
aggctgaggcagacagatcacttgaggtcaggagttcgagaccagcctggccaacatggtgaaacccccatctctactaaaaatagaaaaattagccaggggtgatggtgggcacctgtaatcccagctactcaggaggctgaagcaggagaatcgcttgaactcgtgaggcgaagtttacagtgagcggagatcacgccattgcactccagcctgggcaacagagtgagactccgtctcaaaaaaaaaaaaaaaaaaaaaaaggcctgatactcccatttttcagaaaagcaaacagagrcccagagaggacttgattgccagagagtgactgcgcagctgtctgcctgagtgcatgcccctgcccgaccccaggccttgcctgtgtctcccgttccttacttgggccctcgttgcatttggtggtgttgcagcatttcaggaagtggaaggtgtcgttgttgtggaaaccattggagcccgggcagccgggaaggtagccacagccacggaggtggcggtcatcctttggacgccctatgggggccaggggacagaggtcagatgtcagattgtgaatgagggactaagatgggatttg

SEQ ID NO: 2316 - DNA, 601 bp, Human
tctttgaagaaaggcctggctgggtgcagtggctcatgcctgttaccccagcactttgtgaggctgaggcagacagatcacttgaggtcaggagttcgagaccagcctggccaacatggtgaaacccccatctctactaaaaatagaaaaattagccaggggtgatggtgggcacctgtaatcccagctactcaggaggctgaagcaggagaatcgcttgaactcgtgaggcgaagtttacagtgagcggagatcacgccattgcactccagcctgggcaacagagtgagactccgtctcaaaaaaaaaaaaaaaaaaaaaaaggcctgatactcccatttttcagaaaagcaaacagaggcccagagaggacttgattgccagagagtgactgcgcagctgtctgcctgagtgcatgcccctgcccgaccccaggccttgcctgtgtctcccgttccttacttgggccctcgttgcatttggtggtgttgcagcatttcaggaagtggaaggtgtcgttgttgtggaaaccattggagcccgggcagccgggaaggtagccacagccacggaggtggcggtcatcctttggacgccctat

SEQ ID NO: 2317 - DNA, 601 bp, Human
ttcagaggagcatccatgggtgctgttccccttgcagctgtaacactggcggccattctgcggcagattttcaagctccaggacttaggagaagaccagagacacagagaccaagaaaattagtgcttggatctccacttccttgaatgacctccccaggacttccactccgagccagagatgtcatggagccaccttgtggtcaggcgtctgaatggcatttggagggggatggttttcgagggcttgagagaaaccccaactttcaactccccatgagtcccatttctggccaggcacygtgctgggtgctgggtaaaactatgtaagatgaaactgtccttgctctcacaaaagttacaacttatttatttatttttgatacagggtctcagtttgttgcccaggctggagtgcagtggcgcaattgtagctcactgcagcctcgaccaccccggctcaagagattcttccacatcagcctcctgagtagctgggactacaggcgtgcaccaccatgcctagccaatttttctgttttttgtagagatggggttttgacacattactcaggctggtctcaaactcctgggatcaagca

SEQ ID NO: 2318 - DNA, 601 bp, Human
aaagagagacagagaaagaaaaggaaagaaaaaaaaagaaagaaaggaagcgagcagcggttcttaaagtgtggctcagggaccccagagaccctttcaggagatctgtgatttcacatggctttttcactctcataagtgtacaatgggcttttccaaaaactccaggacatgtgatattgcaagagactgaaagcagaagcttccatgaggacccagctgtcttctattaagctggacattaaagagatgtgcaacacagcaaaataatgccagttttctcattacgctttttttttgtttttttttttgagatggagtctcactctgtcacccaggctggagtgcagtggcacgatctcggctcactgcaacctctgcctcccgggttcaagcaattcttctgcctcagcctcccaagtagctgggactacaggcgcgaccaccatgcccagctaatttttgtatttctagtagagacggggtttcaccatattggccaggctggtctcgaactcctgaccttgtgatctgcccgccttggcctcccaaagtgctggtattacaggcgtgagccaccgcgcctggctggttttttttt

SEQ ID NO: 2319 - DNA, 601 bp, Human
aacagcggcaacaatattaataataacaagagctctcccattggcccacggccttcctccagcttttctcttctgcttcacacaactttgtgagatagctgttttcatagctgggaaaactgaggcccagagaggtcggcacactggcctgaggtcacacagcaagtctgtagggctgggagccgagggaagggcaaaggggtcccccggatccagccagggcagagagggggatttcaggtttaggtccagaggagagtgcctccccacagtctggcagtcattagcagggtgatggtgrggctgagatgggcagggccaggctgaggagcagccccactgcggtactggacatccaggtctgggtggttacagccacttttagtacagcaggagacatcaatgtggttcatgctgaaggcgtcacccaggtgggcatgttggcacattgaggcggttgcacagcctcttaccatatagctttggtttttcggttctgaggaaagagaagacggagtgagacttccagctcctgggcccaggactggaattctccagtaggtgacctgccaccttgcagtgggtgccaccttcactacca

SEQ ID NO: 2320 - DNA, 601 bp, Human
tcagcgagcatgaccatatgccattctcgtctccagagagctggtggcagtgacctcactaggagaaaacacatccctcagccgtgggacttgacagaatgaggtgcgcgagggaggccgctagccgagacgtggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccrtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctca

SEQ ID NO: 2321 - DNA, 601 bp, Human
cagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggtgagttgctaactatgccaccttccttctcatctggcgtcgttccatagaaaggggaactgagtgcaaaacacttacaatcacaaaacatgctcatcttttgctgaaattacttctgtggcttttatgacactatttggaggcaccttattrtattgtcaggcaaaaatactggagaggctaaaaaaatagtagccttttgagcacagaagtttttgcaatcaagtaactactttgctatgacctaaatgcttgtgttcccctaacattcaaaggttgaaatcctaacccccaaggtgatgctattaggaggtggagcctttggaaggtgattaggtcatgaggatggagccctcatgaatgggattagtgcccttgtaaatgaggctggagggagcttgtttgccacttccactgtgtaaggacacactgagatggcatcatctatgaagt

SEQ ID NO: 2322 - DNA, 601 bp, Human
tgaacctatctgtgcccagggtgagccatcctgctatcttatttttccaactgaaattgcacagacctcccagttccgtattttccagccaattcaaggcaggggagaaaggaggaacaggtgggagggaggtctcgccctggactctgactcaaagactcttcccaccctagccatagccactaaaccctggatggctcaacatctctggccctgccaccacgatctgggtcataggtgcctggctgcctccgttctcccagccttgaaccctcagctcacagggctgtgctccagctgyccttccaacaggctgacaaccttcaggccagacggagaagagctgggcttctccatatcacagcaggcaggtgactcactgagagcccagacgagactgtataatccacagtctattggcctctcatcttcaggctcactgtctgtggtcacgagatggtcgcaatcgctttcaggttctcatgcagaagtgtccaacgaagaaaggtagggaggggtcagccagggcagccaaacagctctcctcacatttctctcttaccagggaggaacaccttccccggaagtccttccaggagat

SEQ ID NO: 2323 - DNA, 601 bp, Human
gcacagacctcccagttccgtattttccagccaattcaaggcaggggagaaaggaggaacaggtgggagggaggtctcgccctggactctgactcaaagactcttcccaccctagccatagccactaaaccctggatggctcaacatctctggccctgccaccacgatctgggtcataggtgcctggctgcctccgttctcccagccttgaaccctcagctcacagggctgtgctccagctgcccttccaacaggctgacaaccttcaggccagacggagaagagctgggcttctccataycacagcaggcaggtgactcactgagagcccagacgagactgtataatccacagtctattggcctctcatcttcaggctcactgtctgtggtcacgagatggtcgcaatcgctttcaggttctcatgcagaagtgtccaacgaagaaaggtagggaggggtcagccagggcagccaaacagctctcctcacatttctctcttaccagggaggaacaccttccccggaagtccttccaggagattcctgtccctgtttgattgaatcacatggcctccccttattgcaagagaggcagggaa

SEQ ID NO: 2324 - DNA, 601 bp, Human
cactgcttttgggctactgcacaccacagccccttggacagcacacttaaccatctggcattgcctccccaggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaaggtacctgagcctggcagccaggccaagtgtcctgggaggatgagctaggctccaccttgcggggtagggggcaggcaggtctccttccaaaagggcaaagcatggtccttggatataaaagtcaaggctcccctgccagtgggcctttgccctaactacttccaagctgtggatgctgggcctcaggagtccattaggggcagtcattagtgttctacccttgtttctgctgccttttgcttctcatcttccttgctcaccttcctccctctctttccttcatcctccctcacatttttgtcctggaaggcttggtgtgctgcaaagaacaggagcttcctcagcctgagggcaagacccaggtccc

SEQ ID NO: 2325 - DNA, 601 bp, Human
ctccctgaagtgaacagtgaaggtacctgagcctggcagccaggccaagtgtcctgggaggatgagctaggctccaccttgcggggtagggggcaggcaggtctccttccaaaagggcaaagcatggtccttggatataaaagtcaaggctcccctgccagtgggcctttgccctaactacttccaagctgtggatgctgggcctcaggagtccattaggggcagtcattagtgttctacccttgtttctgctgccttttgcttctcatcttccttgctcaccttcctccctctctttccttcatcctccctcacatttttgtcctggaaggcttggtgtgctgcaaagaacaggagcttcctcagcctgagggcaagacccaggtcccattccaccagtgatgagctgtgtggcctcaggcaaggaccgcccttcactcctcaggcttactccctctactgtatattcaaggctcagcaggcctgggaagaggccaaaggctctagctgcctctagctctcagaggctcaggagacccagtctcggtgacagcatccctcagcagccgaaacgtccatcttgtgacaggtgcagaacaag

SEQ ID NO: 2326 - DNA, 601 bp, Human
gggcaagacccaggtcccattccaccagtgatgagctgtgtggcctcaggcaaggaccgcccttcactcctcaggcttactccctctactgtatattcaaggctcagcaggcctgggaagaggccaaaggctctagctgcctctagctctcagaggctcaggagacccagtctcggtgacagcatccctcagcagccgaaacgtccatcttgtgacaggtgcagaacaagggaggcaggccccaagaccacactgggggcattaattctgagctccatttattacaggacagaaatagacyaaaggtgatgaatctgatgacaaaaactcaggtgcggcacaggtgaaaggcgggctctggatgaagcagggttgaggggctcagtgtcctgcccacctgcctctcaatctccagacatgctcctgagaacccttccagaacccctggggctctgagcagctcagtttggaatccactgggccagaggaaggtgacaagattgtacagaagcttcattatctaagaaatgacttaaaaacatccggggagggtgagcctagggaggaggagtttctgaggggcggtggcttaggagttaag

SEQ ID NO: 2327 - DNA, 601 bp, Human
ctcaatctttacagctttaattctctcatttccttgtcaaaaggtcaagtcatggctggggccaaaaaaggggccagaggcccaaagagagaaaaacctgcccagacttgaagctgggccccgcactagactggcccgattcttccagtcctaggaatttgtcaggcagatcctcttttaagtttgcaactccagacccagaaacacgctctgagcatcagactgttgggggtgatcagagttactgctgcttaactaatttgggggtctagggttacactgcagcactgcgtcctcctgrgaggccagtgaccttctgaatccatcgatttcctcaatcactgatgaattttcttgcaaagagatacagggctggtgtgaggggcaggttaatggtgcaggctgaggcccacgagggagctcctcggagggatgggcagcctgggccttgagctcagctccatttctccctctccatgtgggctgtaacatgaggagccaagtcatgatttaagcggacctccagagatgccagtgctgagaaggaatccaaacttctaggctagtccttgcgctgagataacccagggcagagctccaa

SEQ ID NO: 2328 - DNA, 601 bp, Human
ctgggccccgcactagactggcccgattcttccagtcctaggaatttgtcaggcagatcctcttttaagtttgcaactccagacccagaaacacgctctgagcatcagactgttgggggtgatcagagttactgctgcttaactaatttgggggtctagggttacactgcagcactgcgtcctcctgggaggccagtgaccttctgaatccatcgatttcctcaatcactgatgaattttcttgcaaagagatacagggctggtgtgaggggcaggttaatggtgcaggctgaggcccacsagggagctcctcggagggatgggcagcctgggccttgagctcagctccatttctccctctccatgtgggctgtaacatgaggagccaagtcatgatttaagcggacctccagagatgccagtgctgagaaggaatccaaacttctaggctagtccttgcgctgagataacccagggcagagctccaagagcagagctcccagggcacccacccctgctcaagggaagggccaccagtgcctgtgtgcagagctgctatctgctgaattttggcatacattcatgctggttagcaaacagc

SEQ ID NO: 2329 - DNA, 601 bp, Human
tggtagctgctcagtttagaaacagcagtcgagggctcaagcagctaggactccgagggggcctaactgggagtcccactgccgggggaatgtgacagctagttacataagtgacagatgagcaatttctcctttttagtcatttgacagatgatgggtttcagattaaggaggcactgagggagggccagggcgacgctgctatttttggacaggtttgctggcttgttgttgtcaattgttgttttcaagcattgccaacaaatagagattaatgaagactctgtcttctgccaccccyggggcagccctgcccttgactgtggttcctgcggcagcttccccttcctccagagagcctggaggcaaagaacattggctcagggagagtcatcctatactttctgcgactgtggcatagggttgtgccaggaaaaactgtcacaggatttgttgctgcctgtccaccctgaccacccctaaacctggtgcacctcacctgtgctcccaacctttgccatcacacctgcccaagggaagaggatgacaaaggaccttcttgctgtgggcaagctccttaccctcttggaatgctagtttc

SEQ ID NO: 2330 - DNA, 601 bp, Human
tgaagactctgtcttctgccacccctggggcagccctgcccttgactgtggttcctgcggcagcttccccttcctccagagagcctggaggcaaagaacattggctcagggagagtcatcctatactttctgcgactgtggcatagggttgtgccaggaaaaactgtcacaggatttgttgctgcctgtccaccctgaccacccctaaacctggtgcacctcacctgtgctcccaacctttgccatcacacctgcccaagggaagaggatgacaaaggaccttcttgctgtgggcaagctscttaccctcttggaatgctagtttcccaactgtaaagcgggggtgataacacaaagtcccacagggttgctatgaagactacagataatgtatgtttggcacttggaatagagcagccaagggtcagcgtcttcacacactcttcctcctggaaatttctgcccaaggccactcaatcaaggaggcagggttcagctgtaggagcaattcctgccctagcagcgtcactgggaggcgggcagtgctgaggccttcctgtgcctctccagtcacactctgtgggctacagctgccaggtct

SEQ ID NO: 2331 - DNA, 601 bp, Human
cctcaactgacagctgaggaaaggcaattaggcccagagaggcagagacactcgcttaagatcacaggcttagtgtgaggacgagcttgaaatcccagtctcctggcccccaggccagggtctgtccaccatagaatgtcttcctctactggggtcgttctggctttttgttagaaacttggtctgagatgtttcttccctgtccattaccattcgatgttcttttattcagagcaatgtttcttgtattctgaaactggaaactgaaccagtttgtttctcctagtcaccaagcatactytcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcactttcctgacacgcaaagacacagccctctttccccactgggcgtcctaccccagtgaggttgaaggcaccaattccaagaatccctccaacctccctgccagcactcccccttcaccccacacccggcccc

SEQ ID NO: 2332 - DNA, 601 bp, Human
aagaggaagaaaaaaagtgaggggagagggcaaaaagcggtaaggcaagactcaggataaaacacggtggtgtggccgggagcggtggctcacgcttgtaatcccagcactttgggaggccgaggcaggcggatcacgaggccaggagatcgagaccacggtgaaatcccatctctactaaaaatacaaaaaactagccgggcttggtggcgggcgcctgtagtcccagctactcgggaggctgaggcaggagaatggtgtgaacccgggaggcggagcttgcagtgagccgagatcgcgycactgcactccagcctgggcgacagagcgagactccgtctcaaacaaacaaacaaacaaaacaaaacacggtagtgtaaaatggagcggggccgggatggggcggcgtaagaggaggagaaagaacgcggcgaagagtccacggaagagcgaggatccgggtggcagaaatcggacagggcctgagtggggcgggtcacccaggggccgagccagaagaagggcccagctgacttgggggcgggccgtgctccggagcgctgggtgggtgctggggtctcgggggaggagaggtgcgcgg

SEQ ID NO: 2333 - DNA, 601 bp, Human
tgtactccagccacggagacagagcactgccctgtctcaaaaaaaaaaaaaaaaaaaaaagaaggaaagaaaaagagagagaaagaaaaaaacaagaaagaaagaagaaaaaataagagagaaagtaaaacaagaaagaagaaacaaacgaaaggaaggaaggaaaggaaggaaggaaaagaagaacgaaagaaagaaaagaaagaaagaaaaagaaaaaagagagagaaagggaaagaggaagaaaaaaagtgaggggagagggcaaaaagcggtaaggcaagactcaggataaaacackgtggtgtggccgggagcggtggctcacgcttgtaatcccagcactttgggaggccgaggcaggcggatcacgaggccaggagatcgagaccacggtgaaatcccatctctactaaaaatacaaaaaactagccgggcttggtggcgggcgcctgtagtcccagctactcgggaggctgaggcaggagaatggtgtgaacccgggaggcggagcttgcagtgagccgagatcgcgtcactgcactccagcctgggcgacagagcgagactccgtctcaaacaaacaaacaaacaaaacaaa

SEQ ID NO: 2334 - DNA, 601 bp, Human
aaggaccacaccgccccctggcggccacagcgcaagcccggtctctcctcctgctggaaggacaccggggaccgcacctccagctgtgggagttccgagagaccccgccctgcccgctcctccctggaggccgcctccacagccccccgtggcgtcctcggggatggatctcctcctacttgtttccgcagtgcgcggccgtcagcacccaactctggtccaccaggacacccgcgcagtggaacgagaggccgttgaagagcgagacctgccagggctgcgagccgcgcgcgcacggggmgccataggcttcggggtccaagcgcgtgtcgttttgggggagcagcgccgcctctgcggctggagaaagaaaggggacggaatcaaagcacggagggcagggtctgggtttggggttggagctgggctgtggcactggactgcgttcggggacgggggacgcagccagaacgcgagggtggtagggaaatattgggggtttcgcgtgcaccgaagggaatgggaggagaagaagcgcgtgaaagtggaaggaagctgggatagggtagcgtggagtaatgagacagaatagggtgggtct

SEQ ID NO: 2335 - DNA, 601 bp, Human
gccaggctggtcttgaactcctgacctcaggtgatccacccgccttggcctcccaaagtgctgggattacaggcgtgagccaccgagcccagcccaactccacattttctctgtggtaatacccaacccttcctccttcaacggggactcacgaagtgaaccttttcctttagttctaaattcctgaccacaccggaccctggcttctatccgttgcaggcaaccacctcctcctagagctcaaggagaatcagcgggagaggagtgacgggcccagaaatgcggaaaaggaccacaccgycccctggcggccacagcgcaagcccggtctctcctcctgctggaaggacaccggggaccgcacctccagctgtgggagttccgagagaccccgccctgcccgctcctccctggaggccgcctccacagccccccgtggcgtcctcggggatggatctcctcctacttgtttccgcagtgcgcggccgtcagcacccaactctggtccaccaggacacccgcgcagtggaacgagaggccgttgaagagcgagacctgccagggctgcgagccgcgcgcgcacggggagccataggcttcg

SEQ ID NO: 2336 - DNA, 601 bp, Human
ccagaagtgggaaacagtgggagatgagaaggaagtggttaaaaggtgtttcctgggacttggaactagggtgaggaaaatgattcttccatcatccctaagggttggggatggaaggttgggattgggggctaccctgtgcacttcttccctggacacacgctttcaccgggacgtggtcagatcacgacaacaggtaacctttagtcagaactcaccacccactgtgttaagccttacatgacaatcaccatgaagatttacatacacatgttatatcatagtctcctcacaacatgtmtaagaggtaggcacgtcattgttcccattttgcagatgaggaaactgaggttcagagagggcacttggcttgcccaaagtcacacagcggggagtggcagaggaagtcaggttgggtgaccccagtaactgctctcagaggctgggtgatgaccggcttcctggcttctctggaataaacctttgccaccacttcctgcatttcagcttcagtacaggcagagaatggggataggtgggggaatgaggtgagaggggagatgtttagaggtgtggagggcggcagaggtttgaacagtgc

SEQ ID NO: 2337 - DNA, 601 bp, Human
cactgaaaaacttttgtgaagattcaaagaagaaaacatgcaatgaagtgagcagcctccgattggatagacttgccttgtggggctgggttgcttctccctgaccggcgacttccaaagcctcaataagacgagctattggtcagcagtgcctaagatgctatgggccaggctggccaagaggctagcaagcacagagatggaaaagtccagttcacagttcagcaccatcactccatcacaccttacagtcaccaagaggtgctccagaaatggtgcagtcacaaattggttgcaacarcggaggcttggctttccctgtgaccacttaaagtggctcgatttggttttctgagccccgagctcagttcttcctcccctagaccttgggaagtacgagccatggatctgcagattccaaaagaaagtgggctgagcaagccctgttcgtctggctgtctggtaaaagacacatccattgtgcagcacccccacatccctggcatatcacggtgcttttcctggaaaagtccatattggatttgcggtcttgaaaaccccaagcttaaaacaccctgggcctcaggatttccccccgtgt

SEQ ID NO: 2338 - DNA, 601 bp, Human
tgggaattagaagttgagctgagtagaaatgagaatgggagtggatgccagttttacaagaatcaagcttcttgcttgggcaaatctgtcatgactaacctgccccatttgcaaagcatttctgtctgggttttattggggcttcacaaaagggtgtgtatttaaaaataaaaacactgaaaaacttttgtgaagattcaaagaagaaaacatgcaatgaagtgagcagcctccgattggatagacttgccttgtggggctgggttgcttctccctgaccggcgacttccaaagcctcaayaagacgagctattggtcagcagtgcctaagatgctatgggccaggctggccaagaggctagcaagcacagagatggaaaagtccagttcacagttcagcaccatcactccatcacaccttacagtcaccaagaggtgctccagaaatggtgcagtcacaaattggttgcaacaacggaggcttggctttccctgtgaccacttaaagtggctcgatttggttttctgagccccgagctcagttcttcctcccctagaccttgggaagtacgagccatggatctgcagattccaaaagaaa

SEQ ID NO: 2339 - DNA, 601 bp, Human
ctatgtgagtaaacagacactccataggtaagaaacaaggacaaattattttccctacctataaaagagggaggaggcagctatcccccctccccgtcttaaaggtctgctccttattccaacactttggtaggtagataaatctctccaggagccagatagtccgttacatgtcttggcttttatggcaagtcctgggacttgactccaagttctggggctcattccttcttgcatgttgcataatgatggcacaagcttatgctggcctgcttaggaagatagtgactccaggcttcayggcaccctgggcgctctacctagggaccttgttcaggctataaccatttgctcctctcgggaaaaattttattattcgtttggatcagagcaattacctatgcaaataactacagatttaattcttatggtatgaaaaaatgtcagagctagtactcttcaccaggacactgaaaagtcgagagaagttttatttccccaccctctttatctctgatttcttctctgccatgttaaaaaattgatacataatagatgtatatattttcagggcacatgtgctgtctgatacactcacatg

SEQ ID NO: 2340 - DNA, 601 bp, Human
tagctgttaacaccaactcactttccttcatgggtaattctacttcgaaaaatgagtgattcacatgggcctatggagtttggtcaaaaattattaatagtaggatttagccaaccctctcacaagatgggcttctacctaatgataactctttttgttttattgtattatatttttttgcctagccctgacactttcatatgtgcttttagcatcttgctacagtattctttcaggtacagaaggaacagaacttacagaccccacagttcttttggtaaatttaggctcagaaagaaargacatcttgtctgtgtttgctttttaaactgtatccccatcagtcaaagtcctatttttattatttggcactgctgggtctttctatcttagactattagtatgtacgttccctagccttagaggctataaccactctttatttgcctagctaacaacttccatctttctggtctccattttgacatctctttcatagggaagactttcctgactcctgacttaggttgggttttcctgtcacagacttccaatggacaatgaacgcactccttcatatcattcatcacgtgttcaactc

SEQ ID NO: 2341 - DNA, 601 bp, Human
tgctaattttttgtatttttagtaaagacggggtttcaccatgttggccaggctggtttcgaactcctgacctcaagtgatctgcccgcctcggcctcccaaagtgctgggattacaggcatgagccactgtgcccagccatactccacactcattttaacagcaaatcctcctggctctgacttcaaaatatgtctggtatctgaacccttttcacctcctgcatttccaccaccatcatcccaggcctgggtactgccgtcttcttccagctgatctccctgcattcatacaatagatrgaatcatctttaaaaaccatgtcctattttgtctctctcctgcttttaaatttctgtggctttctagcaccgatagaataaaaccatagtccattattgatatggcttcaaaggccctgcatgcccagtccgtggcactgttccaactccatttcctgccctcctctttgctcactgtgctacggccacactggctcctggctgtttcttaaacccaccaagaacattcctgtctcagaacttttgcttttgctgttcctctctctgaagaatttcttcccttccatacctgggtagctc

SEQ ID NO: 2342 - DNA, 601 bp, Human
tttgctttttgtttcactgaagtataaaatagaaaacacaaaaagagaacttccacttattaccaccactaaatcaacctacctacctggatggatggtctacattcccacttaagtcgagcctcttcctccacggagcactcacctacttcaaggctttgtttcggcaattgcctctgtccctcacattatcaggtttttttttactaggttatttccatcaatacacaacatataaacttgtagtttccttatattaaaactatctcccctgatcccaggtccatccccagatacctcyccatttctgttttcctttacagcaaagtgctttaatgtgtgtttatagtttcttttcccatttccagacccatttttccttggacccactataaacaggtgttcttccccactgctcgctggaaccacctttgtcaaggtcactgtctactccactaagccaagtcaaagttcttatcttacttgctttctcaggggtacttgacatagttcatccatccctccttcaaacgctgtcatcatttggctcagggaacaacatactctcccggtttttctcctatcctatataggttgcctc

SEQ ID NO: 2343 - DNA, 601 bp, Human
attagaattcagttctgctaattcctctaccagggttttttccaccattgaatatacaggatgaaggatggagagcaaataaaagtgattctgagctcatgagcccaggaagcatttcagatcatgaggaaaacagaaaaatctgaggaatgtggagtcaggaagtgataagcccagtgttcaaactgtggaatcctctctctccaaacaccctgagatagttaataatgtcgacagtgagatattactgtatttctcttttccaaaaaagctgagccaacaacaaggttaaaaaaaaaaataccaagagcctttcaaaccactatgagggttcctgctgctgattatttcacacctcctctctcctcaaacccacaacctgcctttccccctcctctctcatgtgacgactttgctttttgtttcactgaagtataaaatagaaaacacaaaaagagaacttccacttattaccaccactaaatcaacctacctacctggatggatggtctacattcccacttaagtcgagcctcttcctccacggagcactcacctacttcaaggctttgtttcggcaattgcctctgtccctcacatt

SEQ ID NO: 2344 - DNA, 601 bp, Human
tctgaacctaggtctgtctgacttcaaaatccaaactcttcctttggcttgagaaaaatgccatggttgcagagaccacattttccaaagtaagaatttgatcacaagatgtgacaaaaacaggaaacataggaaccaaaggacagaatgtctggcatccacaccgttttggaaaatgcatcatgtgcagcctccacgctcatggcagtcgtgcctggagccactgctggaaatgactctcaggtacctgggggagggccatgggaattccgcaggcactgtttgaaggaaagggaatgckgggttgagggaggattggtgagagtattgctgccttccctctagatatttgagaatttcaaagaaatgctggttaggtgggaattcctgtcccatccccagagataaggaagtcattttgaagaagcaggaaagccccatgtggctatcaggatccctgggaattcagatgagtctctgggcctaagagacacaatccctgggtgcactcaagagggactggtagttaaaaaggctcaaaaaagcactggccttggattcaggtggacttggttcctagtttaagtacagcaactaaaag

SEQ ID NO: 2345 - DNA, 601 bp, Human
ttgtaattattccccattttatagatgagaaagccaagtcccagggaggtggaatatcttacaactcacagcttctaagtggccaagttaagatctgaacctaggtctgtctgacttcaaaatccaaactcttcctttggcttgagaaaaatgccatggttgcagagaccacattttccaaagtaagaatttgatcacaagatgtgacaaaaacaggaaacataggaaccaaaggacagaatgtctggcatccacaccgttttggaaaatgcatcatgtgcagcctccacgctcatggcartcgtgcctggagccactgctggaaatgactctcaggtacctgggggagggccatgggaattccgcaggcactgtttgaaggaaagggaatgctgggttgagggaggattggtgagagtattgctgccttccctctagatatttgagaatttcaaagaaatgctggttaggtgggaattcctgtcccatccccagagataaggaagtcattttgaagaagcaggaaagccccatgtggctatcaggatccctgggaattcagatgagtctctgggcctaagagacacaatccctgggtgca

SEQ ID NO: 2346 - DNA, 601 bp, Human
aggcctcatcaatctatcccactctaaggccatgaaataggccacataaaaggtaaattcttgcttatttagcaactattataggacaagcacagtgctggtgtttcacattcatcatcttttttttttttttttttgagacagagtctcgctctgtcacctaagctggagtgcagtggcacaatctcagctcactgcaagctccacctcctgggttcacgccattctcctgcctcagcctcccgagtagctgggactacaggtgcccaccaccatgctgagctaatttttttttttttttgtatttttagtagagatggggtttcaccaccatagccaggatggtctcgatctcctgaccttgtgatccgcccgcctcggcctcccaaagtgctgagattacaggcgtgagccacctcatcatcttttttaatcttctcaacaattataactctagttgtaattattccccattttatagatgagaaagccaagtcccagggaggtggaatatcttacaactcacagcttctaagtggccaagttaagatctgaacctaggtctgtctgacttcaaaatccaaactcttcctttggcttg

SEQ ID NO: 2347 - DNA, 601 bp, Human
ctctatcacctcctgttggtttcgtcaactgtgaactgagcataaaaatgccaccctggtcaatatgagagtgagctcactaaatgcacatggtaaacttttgcaaactataaagaaaatgtaaagtattgttactaaggtgaatgccatggctggggagcaattggaccatgtgaagactgagcccatgctcattaaggtggcacacaggctgccaccagtgtactcacctgaggggtctgtcctgcatccgggccacgggctgaaggtctgggaattgttgctgatagggttgctcacrgtgcagatgtagatattgtcagcatgctgggggccgagggtgagggacaggaggtgggagctgttggctgggttcagtgggtgggtgcccgccttttcactccagctgtaagccacatggtcccccttctccactgtgcagcccagtatcaaggtgcaggtcccgttctcctgggtcttgtttaaaactttaatttctggagtggagacctgctctgtcaggagtgggaggaagggagccatcactgaagtgaacccctgggaattctcacttgacctttttgttagaacaaagtacagc

SEQ ID NO: 2348 - DNA, 601 bp, Human
ttattatgggattattgcaaagtccaggcagaggcaatggaggctggacccagaaaatcacagcctttaaggtagacttattttaacaccagttaatttattctcttaaaaaactgggctgggtgcagtggctcacgcctataatcacagcactatgggaggccgaggtgggcagatcacgaggtcaggagtttgagaccagcctggccaacatggggaaaccctgtctctactaaaaatacaaaaattagccaggcatggtggcacgcgcttataatttcagctactcaggaggctgagrcagaagaactgcttgagcccaggagacagaggttgcagtgagccgagatcatgccattgcactccagcctgagtgacagagcaagaatctatctcaaaaaaaaaaaaaaaaaaaaaaaggcacatctctgaggaaatagcatttttaggagaggcacatttttctttggaagggaaaggcccagtgtgtatgtggtgagcatggtggaatgtgctgcgtgagggtgtgagtcttggggaggaaatgtggggcagacactgatgaagttccaggaattcaaggaaagtcaacatgggattt

SEQ ID NO: 2349 - DNA, 601 bp, Human
acttaaaatgtattgaggacatttttcatgttagcacagtagacctatctcattctttctaaagttgcacagtatcctttgtatacatcatgcagcagtaaggatggtgggaaagtggcagactgaaggatggaggtttattatgggattattgcaaagtccaggcagaggcaatggaggctggacccagaaaatcacagcctttaaggtagacttattttaacaccagttaatttattctcttaaaaaactgggctgggtgcagtggctcacgcctataatcacagcactatgggaggcygaggtgggcagatcacgaggtcaggagtttgagaccagcctggccaacatggggaaaccctgtctctactaaaaatacaaaaattagccaggcatggtggcacgcgcttataatttcagctactcaggaggctgagacagaagaactgcttgagcccaggagacagaggttgcagtgagccgagatcatgccattgcactccagcctgagtgacagagcaagaatctatctcaaaaaaaaaaaaaaaaaaaaaaaggcacatctctgaggaaatagcatttttaggagaggcacattttt

SEQ ID NO: 2350 - DNA, 601 bp, Human
tctgtgaaatgggatttgaaatacctgcctcacggggctgttgtgataattaaatgagataccacttgtaaagtgtttagaacactgcctggtgcataacaaatgcccaatacgcattaggtgtttttctcattggtgtaccattcaattactttaatctctgttgctcaatgtgcatatctggtctcctaataggattctaagttctttgagggcagggctagttgtttatacctcttttgtattttccagctggtagtatgttgcttcactcacagctttctcacctccctatttctgsgggaattgatgtgtgggaggtaagggcggggggacgtgtaagagggatgttccacctgggactatttagaaaataaagcaacaatgtcattctgttgcccaccatctggaaattttgctcagggcctagggtctctggaaattaataagttgcagaatattttaatttttagccaattttaaaaagctttctttttaaattataggagtaatttattctcatcataaaataaaaattgtgaagaaatatataaagtataaagtaaaaagtataaatccccttcttccattaaccaaccca

SEQ ID NO: 2351 - DNA, 601 bp, Human
tttactgtcctttgcatacccactttccccaagggcacaatggaaacaaagccctgagtcccagcccccctgcacatttgtcatattgtcttaggttagttacttgatcactctaggcctatctgtgaaatgggatttgaaatacctgcctcacggggctgttgtgataattaaatgagataccacttgtaaagtgtttagaacactgcctggtgcataacaaatgcccaatacgcattaggtgtttttctcattggtgtaccattcaattactttaatctctgttgctcaatgtgcatayctggtctcctaataggattctaagttctttgagggcagggctagttgtttatacctcttttgtattttccagctggtagtatgttgcttcactcacagctttctcacctccctatttctgggggaattgatgtgtgggaggtaagggcggggggacgtgtaagagggatgttccacctgggactatttagaaaataaagcaacaatgtcattctgttgcccaccatctggaaattttgctcagggcctagggtctctggaaattaataagttgcagaatattttaatttttagccaattt

SEQ ID NO: 2352 - DNA, 601 bp, Human
aattctaatatttttttttctttttgtggtacttgataagttgattctaaaatacatatgaaagtataaaggaacaagaatagccaaaaacttttgcagaaaaacaaattaggaagacttgctttaccaaatatcgagatatgtgtttaagggtaattcactgagctgacattaatgtgttgtgtatttttttggtcagagttgatccttactgaggagtgggtatgcatgagtgtgtgtatgtgagagtgagtgtgtgtgtgtgtgtgtgtaaaatggaggagaggactaaaagtgtgaytagaagcagctggaagtagcagaggaggtggaagttagtcccctcgagtgtttgcaaagtaagacatgcctgcccagcactctcctaggtgtatagtggctacaaatagagtagagaacagactccagtcctcaaagactttcagtcttgcaggtcagctcagactcaaatgtagaactgggaggacagtcctgaactgatgaatgccactgaattttaaattttatttaattcaaattaatttaaatttaaaaagctacatgtggctagtgactaccatatgtcatgcttcacagtaaa

SEQ ID NO: 2353 - DNA, 601 bp, Human
gagagaggaagtaatgattgggaagtggcacaggaggccttcaggaagtacgggcaatgttctagtctttgatctgagtggtagttttatggtattagaagactcaatactgaggccaggcacagtggctcacatctgtaatcccagcactttgggaggctgaggtgggcagatcacttgaggttagtagtttgagaccagcctggccaacatggtgaaaccccatctctactaaagatacaaaaattagctgggtgtggtggcaggtgcctgtaatctcagctacttggaaggctgaggyaggagaatcacttgaacccaggaggcggaggttgtagtgagcccagatcacaccactgcactccagcctgggcgataaagcaagactctgtcaaaaaacaaaaaacaaaaaacaaaaaacacgcaacactgaaaaatgtaatttctcctcatatagatctgtagactcaatacaattctaatatttttttttctttttgtggtacttgataagttgattctaaaatacatatgaaagtataaaggaacaagaatagccaaaaacttttgcagaaaaacaaattaggaagacttgctttac

SEQ ID NO: 2354 - DNA, 601 bp, Human
ttgagactctcatatgtagctgatagaaaagtaaatggatacgcccactttgaaaaacagctcggccttatctagtcaatttggaggtatgcatactctacgattcagcagttctacttccaggtatatctaggtatatacccaaaaaaatatgtgcacatgtccacttaacgacttgcatatgaatgttcacagctgcaactttcataatagcctcaaactggaaataacccacatgtccatcaatagtcaactggataaataaactctagtatattcatacgtttatattctatgaagyaatgaaaaagaatgcattatatctaaattcaaagacatatatgaatctcataaagataatactgagcaaaataaatcagacatgagagaaaaaagaataaagaattcaatttttataaagttcaaaaataaaaaaggaaaaagctaacctatttttctagaagtcaggatagtggttatctttggggaggagagaggaagtaatgattgggaagtggcacaggaggccttcaggaagtacgggcaatgttctagtctttgatctgagtggtagttttatggtattagaagactcaatact

SEQ ID NO: 2355 - DNA, 601 bp, Human
cgccactgcaccccagcctaggcaacagagtgaaactctgtctcaaaaaaaaatttaaaaaaaaaaggcatagcaattgagactctcatatgtagctgatagaaaagtaaatggatacgcccactttgaaaaacagctcggccttatctagtcaatttggaggtatgcatactctacgattcagcagttctacttccaggtatatctaggtatatacccaaaaaaatatgtgcacatgtccacttaacgacttgcatatgaatgttcacagctgcaactttcataatagcctcaaactggwaataacccacatgtccatcaatagtcaactggataaataaactctagtatattcatacgtttatattctatgaagcaatgaaaaagaatgcattatatctaaattcaaagacatatatgaatctcataaagataatactgagcaaaataaatcagacatgagagaaaaaagaataaagaattcaatttttataaagttcaaaaataaaaaaggaaaaagctaacctatttttctagaagtcaggatagtggttatctttggggaggagagaggaagtaatgattgggaagtggcacagga

SEQ ID NO: 2356 - DNA, 601 bp, Human
ctgtaatcccagctgcttgggaggccgagacaggagaatggcttgaacccaggaggcggaggttgcagtaagacaagatcacgccactgcaccccagcctaggcaacagagtgaaactctgtctcaaaaaaaaatttaaaaaaaaaaggcatagcaattgagactctcatatgtagctgatagaaaagtaaatggatacgcccactttgaaaaacagctcggccttatctagtcaatttggaggtatgcatactctacgattcagcagttctacttccaggtatatctaggtatatacccmaaaaaatatgtgcacatgtccacttaacgacttgcatatgaatgttcacagctgcaactttcataatagcctcaaactggaaataacccacatgtccatcaatagtcaactggataaataaactctagtatattcatacgtttatattctatgaagcaatgaaaaagaatgcattatatctaaattcaaagacatatatgaatctcataaagataatactgagcaaaataaatcagacatgagagaaaaaagaataaagaattcaatttttataaagttcaaaaataaaaaaggaaaaag

SEQ ID NO: 2357 - DNA, 601 bp, Human
gagccaggtgtggtggtgcgtacctgtaatcccagctgcttgggaggccgagacaggagaatggcttgaacccaggaggcggaggttgcagtaagacaagatcacgccactgcaccccagcctaggcaacagagtgaaactctgtctcaaaaaaaaatttaaaaaaaaaaggcatagcaattgagactctcatatgtagctgatagaaaagtaaatggatacgcccactttgaaaaacagctcggccttatctagtcaatttggaggtatgcatactctacgattcagcagttctacttcyaggtatatctaggtatatacccaaaaaaatatgtgcacatgtccacttaacgacttgcatatgaatgttcacagctgcaactttcataatagcctcaaactggaaataacccacatgtccatcaatagtcaactggataaataaactctagtatattcatacgtttatattctatgaagcaatgaaaaagaatgcattatatctaaattcaaagacatatatgaatctcataaagataatactgagcaaaataaatcagacatgagagaaaaaagaataaagaattcaatttttataaag

SEQ ID NO: 2358 - DNA, 601 bp, Human
aatacaacaatgagccaggtgtggtggtgcgtacctgtaatcccagctgcttgggaggccgagacaggagaatggcttgaacccaggaggcggaggttgcagtaagacaagatcacgccactgcaccccagcctaggcaacagagtgaaactctgtctcaaaaaaaaatttaaaaaaaaaaggcatagcaattgagactctcatatgtagctgatagaaaagtaaatggatacgcccactttgaaaaacagctcggccttatctagtcaatttggaggtatgcatactctacgattcagcwgttctacttccaggtatatctaggtatatacccaaaaaaatatgtgcacatgtccacttaacgacttgcatatgaatgttcacagctgcaactttcataatagcctcaaactggaaataacccacatgtccatcaatagtcaactggataaataaactctagtatattcatacgtttatattctatgaagcaatgaaaaagaatgcattatatctaaattcaaagacatatatgaatctcataaagataatactgagcaaaataaatcagacatgagagaaaaaagaataaagaattcaa

SEQ ID NO: 2359 - DNA, 601 bp, Human
caattgaggccaggagtggtggctcatgcctgtaatcccagcactttgggatgctgaggcgggcagatctcctgagatcaggagttcgagaccaccctggccaacatggtgaaatactgtctctactaaaaatacaacaatgagccaggtgtggtggtgcgtacctgtaatcccagctgcttgggaggccgagacaggagaatggcttgaacccaggaggcggaggttgcagtaagacaagatcacgccactgcaccccagcctaggcaacagagtgaaactctgtctcaaaaaaaaattwaaaaaaaaaaggcatagcaattgagactctcatatgtagctgatagaaaagtaaatggatacgcccactttgaaaaacagctcggccttatctagtcaatttggaggtatgcatactctacgattcagcagttctacttccaggtatatctaggtatatacccaaaaaaatatgtgcacatgtccacttaacgacttgcatatgaatgttcacagctgcaactttcataatagcctcaaactggaaataacccacatgtccatcaatagtcaactggataaataaactctagtatattca

SEQ ID NO: 2360 - DNA, 601 bp, Human
tagcaattgaggccaggagtggtggctcatgcctgtaatcccagcactttgggatgctgaggcgggcagatctcctgagatcaggagttcgagaccaccctggccaacatggtgaaatactgtctctactaaaaatacaacaatgagccaggtgtggtggtgcgtacctgtaatcccagctgcttgggaggccgagacaggagaatggcttgaacccaggaggcggaggttgcagtaagacaagatcacgccactgcaccccagcctaggcaacagagtgaaactctgtctcaaaaaaaaatttaaaaaaaaaaggcatagcaattgagactctcatatgtagctgatagaaaagtaaatggatacgcccactttgaaaaacagctcggccttatctagtcaatttggaggtatgcatactctacgattcagcagttctacttccaggtatatctaggtatatacccaaaaaaatatgtgcacatgtccacttaacgacttgcatatgaatgttcacagctgcaactttcataatagcctcaaactggaaataacccacatgtccatcaatagtcaactggataaataaactctagtatat

SEQ ID NO: 2361 - DNA, 601 bp, Human
gcaagagattaaatgggcactttaagaaagaattttaatatggccaataaacatatgaaaagttgttcaacttccttaataattacagagatgtggaataaaagcataataagacacatccaacagtaggactaaaattagactgttaataccaagttttcattagaatgcatagcaattgaggccaggagtggtggctcatgcctgtaatcccagcactttgggatgctgaggcgggcagatctcctgagatcaggagttcgagaccaccctggccaacatggtgaaatactgtctctastaaaaatacaacaatgagccaggtgtggtggtgcgtacctgtaatcccagctgcttgggaggccgagacaggagaatggcttgaacccaggaggcggaggttgcagtaagacaagatcacgccactgcaccccagcctaggcaacagagtgaaactctgtctcaaaaaaaaatttaaaaaaaaaaggcatagcaattgagactctcatatgtagctgatagaaaagtaaatggatacgcccactttgaaaaacagctcggccttatctagtcaatttggaggtatgcatactctacgatt

SEQ ID NO: 2362 - DNA, 601 bp, Human
aaggactagactaaattggtctacaacaaaattaagaccttctctttatcagtaggtatctctgagaaattccaaaggcaagctacagatgggtgaaggtatttgctaacatatctgccaaagggcacatatccaaaatatatgaaaagcatatactagtccataaaagaaagactaaacctcaaagggaaatgggcaagagattaaatgggcactttaagaaagaattttaatatggccaataaacatatgaaaagttgttcaacttccttaataattacagagatgtggaataaaagcmtaataagacacatccaacagtaggactaaaattagactgttaataccaagttttcattagaatgcatagcaattgaggccaggagtggtggctcatgcctgtaatcccagcactttgggatgctgaggcgggcagatctcctgagatcaggagttcgagaccaccctggccaacatggtgaaatactgtctctactaaaaatacaacaatgagccaggtgtggtggtgcgtacctgtaatcccagctgcttgggaggccgagacaggagaatggcttgaacccaggaggcggaggttgca

SEQ ID NO: 2363 - DNA, 601 bp, Human
gtcccttccagttcttaaagtctgaatttttaacaggagagcgaccaactttaccgtgatgtgggtattaggtagagtagctgtgtgtcattttgggatcaatctgaggcttgtgattaaagaagagtccaggaagaactctgttacttatttttttaaggacatttgaaatatttctacctcaacttgtatcccagttagatatattcacaagaatgctatataccagccactgcagtgccttcttaaaaaaaaaaaggcattatacaagagaattacaggccaatttcactcagaaacwtaagtggaaaaccaaactcttaacaaaatattagcaaataaaatccagtaatgcttaaaaaggactagactaaattggtctacaacaaaattaagaccttctctttatcagtaggtatctctgagaaattccaaaggcaagctacagatgggtgaaggtatttgctaacatatctgccaaagggcacatatccaaaatatatgaaaagcatatactagtccataaaagaaagactaaacctcaaagggaaatgggcaagagattaaatgggcactttaagaaagaattttaatatggcca

SEQ ID NO: 2364 - DNA, 601 bp, Human
aatctttatatcaaaaccccactggttgggcatgactacccaggtcccttccagttcttaaagtctgaatttttaacaggagagcgaccaactttaccgtgatgtgggtattaggtagagtagctgtgtgtcattttgggatcaatctgaggcttgtgattaaagaagagtccaggaagaactctgttacttatttttttaaggacatttgaaatatttctacctcaacttgtatcccagttagatatattcacaagaatgctatataccagccactgcagtgccttcttaaaaaaaaaaaggcattatacaagagaattacaggccaatttcactcagaaacataagtggaaaaccaaactcttaacaaaatattagcaaataaaatccagtaatgcttaaaaaggactagactaaattggtctacaacaaaattaagaccttctctttatcagtaggtatctctgagaaattccaaaggcaagctacagatgggtgaaggtatttgctaacatatctgccaaagggcacatatccaaaatatatgaaaagcatatactagtccataaaagaaagactaaacctcaaagggaaatgggca

SEQ ID NO: 2365 - DNA, 601 bp, Human
actttatttgaataaaggtcttcacagatgtcaagataaggatttcaaaataaggtcatcctggattagaataagtccgaagtctgatgatgactgtccttataagagatggaaaagaagaagacacagagagggaggtcatgtgaagatgaaggcaaaaattgcagatacacaactacaagccaacaaatgccacggagagcctggagccaccagatgctggaagaggcaaagaggattttctcttaaagcctccagatggagtgtggccctgaggatgtgcctccttgattttggactyctgacctccagaactgttagagaataaatttctgttgttttaagccaccaagtttccagtaatttgttaaggcatccctaggaaactaacatataccccaactccttatgtgaattagcataaatctttatatcaaaaccccactggttgggcatgactacccaggtcccttccagttcttaaagtctgaatttttaacaggagagcgaccaactttaccgtgatgtgggtattaggtagagtagctgtgtgtcattttgggatcaatctgaggcttgtgattaaagaagagtccaggaa

SEQ ID NO: 2366 - DNA, 601 bp, Human
ttcactaatatgtagaggagaaaatttaataataaaaatataacttaaaaaaatttccaccaaagaaaccccagtctcagatagctttactagcaatttgctctactagcaaatatttaaggggagaaataagacatcctacccaaatatcgcagagaataacaaaaaggaaatgcaccctgtggtgggttgaactgtggccccaaaagatatgtccaggcagaatgtcaaaatgtgactttatttgaataaaggtcttcacagatgtcaagataaggatttcaaaataaggtcatcctgrattagaataagtccgaagtctgatgatgactgtccttataagagatggaaaagaagaagacacagagagggaggtcatgtgaagatgaaggcaaaaattgcagatacacaactacaagccaacaaatgccacggagagcctggagccaccagatgctggaagaggcaaagaggattttctcttaaagcctccagatggagtgtggccctgaggatgtgcctccttgattttggacttctgacctccagaactgttagagaataaatttctgttgttttaagccaccaagtttccagtaat

SEQ ID NO: 2367 - DNA, 601 bp, Human
cgtaatcccagctactcaggaggcggaggcaggagaatcccttgaaccagggagctggaggttgcagtgagctgagatggcgccacagcactctagcctggcgacagagtgagactccgcctcaccaaaaaaaaaaaaaagaagagagacctttatcaacagatgcaacctctgctggtcttcctgtttgggagaactttagcataacctgacctagaggcagaaggaggcaaataacttacatttttaacgttaattcagaagttttagaaaggagaaaaatatgtaaaagaagtcaccyatagtcctattaagactctgtgtgtgcttaaatgttcacttcaggatttttatccaggcatagggaattattttaaacataaatataataagttagtatatttttgtatcttattatcttctgttaggaccactgatttgtacatctttagggagcatcatttacaagcaactccagaggcattattttcacataatttttgtgaatggtggccgctggaattaattctgcaagatactagctctgataagtcctagaagagttcctagcacacagtaaacacttgtttagtgattttca

SEQ ID NO: 2368 - DNA, 601 bp, Human
cctttggccgggcgtggtggctcacgcctgtaatcccagcactttgggaggctgaggtgggtggatcacgaggtcaggagatcgagaccatcctggccaacatagtgaaaccccatctctactaaaaatacaaaaattagccaggaatgatggtgcatgcccgtaatcccagctactcaggaggcggaggcaggagaatcccttgaaccagggagctggaggttgcagtgagctgagatggcgccacagcactctagcctggcgacagagtgagactccgcctcaccaaaaaaaaaaaaaagaagagagacctttatcaacagatgcaacctctgctggtcttcctgtttgggagaactttagcataacctgacctagaggcagaaggaggcaaataacttacatttttaacgttaattcagaagttttagaaaggagaaaaatatgtaaaagaagtcacccatagtcctattaagactctgtgtgtgcttaaatgttcacttcaggatttttatccaggcatagggaattattttaaacataaatataataagttagtatatttttgtatcttattatcttctgttaggaccactgattt

SEQ ID NO: 2369 - DNA, 601 bp, Human
aaaacagtttattaagagacctttggccgggcgtggtggctcacgcctgtaatcccagcactttgggaggctgaggtgggtggatcacgaggtcaggagatcgagaccatcctggccaacatagtgaaaccccatctctactaaaaatacaaaaattagccaggaatgatggtgcatgcccgtaatcccagctactcaggaggcggaggcaggagaatcccttgaaccagggagctggaggttgcagtgagctgagatggcgccacagcactctagcctggcgacagagtgagactccgcmtcaccaaaaaaaaaaaaaagaagagagacctttatcaacagatgcaacctctgctggtcttcctgtttgggagaactttagcataacctgacctagaggcagaaggaggcaaataacttacatttttaacgttaattcagaagttttagaaaggagaaaaatatgtaaaagaagtcacccatagtcctattaagactctgtgtgtgcttaaatgttcacttcaggatttttatccaggcatagggaattattttaaacataaatataataagttagtatatttttgtatcttattatctt

SEQ ID NO: 2370 - DNA, 601 bp, Human
tttatggcactctatgctatatttaaaacattctgatatatttatgtgttgtttctccagtctatacattccttgagaaataagccatatatttttgtactccccacagaacagtattggacacataaaaataaactcttcagctgatatttgttgatgttactttgaacgaattaaaatccacaattcctggacaaagacctcaaaataaattgagaccacatccttgtaagatgcggatgccatcacttacaatagggaagtcattaattcaacacattttggggacactggttatggrataatgctgctgtccactctccctgggtatagagccagacttgaagccacaccacatgtgttttaatgcgagaaaacttggaattttgtcatgtgatggaagggttaaggaattaggaaagtttattggaggaaaaagggatgggacataatttttctcttcatatatttgatgaattgccatatagaaaaggaattcaatttgcctataaagtatctcaggtttaaaccaagattaggatttggggaaaatattttgattcaatataatgaagatctttctaatggtaaaagatgttca

SEQ ID NO: 2371 - DNA, 601 bp, Human
agagactcctttttgcctgcatgctgtggcctcccttccccagtccaggactcatcaatctgtttcatttaatttgtttttgttttaatttttttttttttacttttattttaagttcaggcgtacatgtgctggtttgttacataggtaaacttgtgtcatgaggatttgttatacacagtattttgtcacctaggtatgaagcctagtgcccaatagctattttccctgatcctctccctcttcccaccttaaaaaaaaaaaacttcctcattttcccctccttcatgtattccctctstacggagagtaggcagagagatgcctcacctggacagactctgggacaggctctgtggcagcaacatatatggtggtgcaagggtcctgagctgggaaggagtcaagtttcttctgaagaggctacaagagaagcaaagaaagcagattagctgaacagagagagctagttctcacccaactctccgatagagaagcacagactcaagaagacttgaggcagaaagttccttccagtcatttggtccaacctccttctcaggtgggaattctcccccaaattctctggaactcaattccc

SEQ ID NO: 2372 - DNA, 601 bp, Human
tgggggcttcatggaaactggaaaaccaaagccacagagactcctttttgcctgcatgctgtggcctcccttccccagtccaggactcatcaatctgtttcatttaatttgtttttgttttaatttttttttttttacttttattttaagttcaggcgtacatgtgctggtttgttacataggtaaacttgtgtcatgaggatttgttatacacagtattttgtcacctaggtatgaagcctagtgcccaatagctattttccctgatcctctccctcttcccaccttaaaaaaaaaaaamttcctcattttcccctccttcatgtattccctctctacggagagtaggcagagagatgcctcacctggacagactctgggacaggctctgtggcagcaacatatatggtggtgcaagggtcctgagctgggaaggagtcaagtttcttctgaagaggctacaagagaagcaaagaaagcagattagctgaacagagagagctagttctcacccaactctccgatagagaagcacagactcaagaagacttgaggcagaaagttccttccagtcatttggtccaacctccttctcaggtgg

SEQ ID NO: 2373 - DNA, 601 bp, Human
ggctactctccatagacattttcatttaacagaatcctaggtggaagtccctaggaatctttatttttaacaagtacgctggctgattctgatgtggtccttggacaactctcagggaaacactggccagcagggggttagcagtggccccgtgtgagcaggtattgggggcttcatggaaactggaaaaccaaagccacagagactcctttttgcctgcatgctgtggcctcccttccccagtccaggactcatcaatctgtttcatttaatttgtttttgttttaatttttttttttttacttttattttaagttcaggcgtacatgtgctggtttgttacataggtaaacttgtgtcatgaggatttgttatacacagtattttgtcacctaggtatgaagcctagtgcccaatagctattttccctgatcctctccctcttcccaccttaaaaaaaaaaaacttcctcattttcccctccttcatgtattccctctctacggagagtaggcagagagatgcctcacctggacagactctgggacaggctctgtggcagcaacatatatggtggtgcaagggtcctgagctgggaagg

SEQ ID NO: 2374 - DNA, 601 bp, Human
ttggcaggagagaggaaggggagaagagggttatgcgcaaagatctctcatgtcaaagaaacaaagaaaatagaatttaagggttttgccataaaatgttaactatagcatactgtttttgtccttaagtaaacttcattaaaaatctatgtatttttttgaagctttgaagtcaggtttatatttttacttccttcttagatatgacagtgaagtgagaatggacctcaagttgaagattggtttcatcttgaaatatagggcacctgcccaggcatttctggatgagtgtgtgtgcggyaggagctttgaaaaataaggtggatgcaggcatttgtgtgacctttgtgcctctatcatcctgggctctcttctgaaagagcccaaatggagcaaagatttcagcccagaatttatttctattcattcagtaaaggaaagattcctgtccgaagtaaacttagtccctgctgatcttgcaatagggtagaatatgcaagtatcattttgagctgcaccccatattctcttctaggcttaacacctatgcagatctccacccctaaatattctgattaaatggggctgcacagagtctagg

SEQ ID NO: 2375 - DNA, 601 bp, Human
tccctctttgccctctccccttccatccccttgtaaggaaaaccatttgttttgctgttacatatgggtcacaatctgggaagccaagagagttgtaaattattgagtttttaaaaagtctagtgggactcaaagggagaagagaaaagtggtattggcaggagagaggaaggggagaagagggttatgcgcaaagatctctcatgtcaaagaaacaaagaaaatagaatttaagggttttgccataaaatgttaactatagcatactgtttttgtccttaagtaaacttcattaaaaatmtatgtatttttttgaagctttgaagtcaggtttatatttttacttccttcttagatatgacagtgaagtgagaatggacctcaagttgaagattggtttcatcttgaaatatagggcacctgcccaggcatttctggatgagtgtgtgtgcggtaggagctttgaaaaataaggtggatgcaggcatttgtgtgacctttgtgcctctatcatcctgggctctcttctgaaagagcccaaatggagcaaagatttcagcccagaatttatttctattcattcagtaaaggaaagattcct

SEQ ID NO: 2376 - DNA, 601 bp, Human
acattactgtccatttcatctgctacaacacaaagatggaacgctgttatcaagtaacgctctgttctgcgcctgcagccactgcacagcaagctaaattcttgggaagcctcacttccttgttcatttcacagatgtatgtggaagaaacatcaccagggagttgatctgagaagggtacagacgtgcagcatgtctgccagaggaaacttggggcctgtggccaagttcagtgttcattttggtttttccattttccttcagaaagtccctttgttggtctctggtgtcagctctctgkaagtgtcacactagcatagactgtgatggaatttgtttcctggggacaaagcagaagtctgtgagtagagggactggatactcacttcacagaatgcaaatgaaaacagcactgctgaggaaaaggaaagggtcttagagatcatggcttgtgcagggtctgtcacagacagggccttgctgggacagcacttgggttcccacactgcttctccacctgcaacaagggccacagctcccttccaagcataagcatgccattatggggagcatgatctgaggaccagcactcagtgccctg

SEQ ID NO: 2377 - DNA, 601 bp, Human
tacacacaggtaagtcgcccccggcggccgccgaggaccaaagctgcccgggacatccacctggagcgctgaggcttcagtccctctggtggaccccggaacctacactctccccgctcgcctaccccagcccgctcctctcagccgctggaggactcttcagggcaaggctccagagccatcctctccagccttgaggttcacaaaccaactcatcaggacaccccaagatttccttactctctgaagtcctccttaagcctttgtatcagcactccagggaagagtctgtacttccccgtgccctccctgcaaccccaaactacagttcctgatcttgctcaccttcgacttcccaaaagcccccaaattgttggtcttgcgccccccacactttaaaaccagcatctctttcctccacctctctctctctctctctctctctctctcatgctctctggaaagtaatcctgttgtccttcatttcagcaaacgcggggtcaaagagggatggtcccggccctgtccccatgcccagccccgtttctgcgcaccgtccctccctgcctagctgatctctgaccctcggctcttgtgcttc

SEQ ID NO: 2378 - DNA, 601 bp, Human
acctggagggcttgtgaaagctcaccctgctgcaccccagccccagagtctgggattctgtaaaactgcaactctaacaagtaccaggtgatgctgatgccggtggtctgggaagcacactttgaaaactactcaaggaaacaagaaatggttttcctttagcagtcagcctgttcaagccttagatactccttaggctcttaagaaaagagcttatttcaaatgcattcccccaattttaatcttgtttgaaatggatactttctatgggcagaatcagtaccactttgctattggattyctcatggggatgcagctggtctcacataaaaggttaaaatagcagttagttgttgctgttacagcttcatctgtgccttaacttctagatctttgcaacggtggctttgaactcccacatttaactctttgacactggaaagtgtcattatatcctctaggcttaggatcagattccatttcctgtgtacccaagtaggctgataactgaattctttgtaaaatactcaagacttggcagaagtcacaattaagattttgaagttgtttggcgattaatgttgctgtgttattttgacat

SEQ ID NO: 2379 - DNA, 601 bp, Human
ccccatccccaccccgctctgcattctacaagtaatgtgtgtcctctgcccacagggggtgctgcagaatgtgaggtttgtctttggaaccacaccagaagacatcctcaggaacaaaggctgctccagctgtgagtacccctctatttttagggcacatagggaatcagggggaattccaccaaaaacaaactgaggaatttagcaatagtggttatacataaattacccccagtgagatcatcaagaggcatacagaagtgactccaaggggtattatacacacacacgtatacacacttgcgcatacacgcaacccctctacctgcatccttcacaccaaatgaaacgtcttctaccactaagaactcaagaggctggttggtaagagtatctatttgaagttttcattttgtttcttgccagctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccac

SEQ ID NO: 2380 - DNA, 601 bp, Human
cgtcttctaccactaagaactcaagaggctggttggtaagagtatctatttgaagttttcattttgtttcttgccagctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtggtcagtggcctctgcacccagccygttagcatgaaccctggaaggtttatcgcagatggtcccaaatgactgaaaatgcggggggacactaatgatattctctcccatttagactgaagagaacaaagagttggccaatgagctgaggcggcctcccctatgctatcacaacggagttcagtacagaaataacgaggaatggactgttgatagctgcactgagtgtcactgtcaggtaagggaccttcaccagccagaataagaatcgacggcttttgtttgaacctacatctttggggaaataccctaatcgccacagagatt

SEQ ID NO: 2381 - DNA, 601 bp, Human
tggtcccaaatgactgaaaatgcggggggacactaatgatattctctcccatttagactgaagagaacaaagagttggccaatgagctgaggcggcctcccctatgctatcacaacggagttcagtacagaaataacgaggaatggactgttgatagctgcactgagtgtcactgtcaggtaagggaccttcaccagccagaataagaatcgacggcttttgtttgaacctacatctttggggaaataccctaatcgccacagagattctttttatgttccatggcctgataacaaagtgttttttttttctttaagatgcaattatggcatctataagttcttctttaaactctcagatggtttatcaaagtattaattataccccaggctaagtatctaagagaatgaatctactaagacatctgaataatttacctaccttagttcaaagactaagtgttgaatgtcaggtaaataaaacctggttggaacattcatttttttttcccaaccctgatttatattcagctttggcataggttcttttagtacagtagcaattgtttttcaaatcacttagtctgacactgttaggatgt

SEQ ID NO: 2382 - DNA, 601 bp, Human
ctggattgcagtaatggcagtgaagatcttggtatagctcattaattctgattttttgctttgaggaaaagagatgaagacgtggcagcaacagctctaagttgactgcttttagaatttgaccttagtggcacagagttaagaaaaatctgctcaccagagatattgacaggcttactgtgtaagcattggcctgatcgggcctggaagttttgcccctttcatctgtagggataagagggcctaagagaatagcagcaatctgagctctagagcaccaaaagaaataaggcacgatatygttccatggcacgttatccctggcttttgttaccagtaaaatgaatgactttgctgagacaatacttagtgtagcaggtacaagttataaaagtgattcattacaactaagataaggaagaaaacaggaaaacagcacttgcccttcacacacacagaaacacacatgcacacacacacaaacacacccttgtcacagctcagaataaccaattccatccagggatcatattagcgatattggcactgtaatggtcgtttttacatttattttctgttccgcattcacttaacatgtgcg

SEQ ID NO: 2383 - DNA, 601 bp, Human
cagtaatggcagtgaagatcttggtatagctcattaattctgattttttgctttgaggaaaagagatgaagacgtggcagcaacagctctaagttgactgcttttagaatttgaccttagtggcacagagttaagaaaaatctgctcaccagagatattgacaggcttactgtgtaagcattggcctgatcgggcctggaagttttgcccctttcatctgtagggataagagggcctaagagaatagcagcaatctgagctctagagcaccaaaagaaataaggcacgatatcgttccatrgcacgttatccctggcttttgttaccagtaaaatgaatgactttgctgagacaatacttagtgtagcaggtacaagttataaaagtgattcattacaactaagataaggaagaaaacaggaaaacagcacttgcccttcacacacacagaaacacacatgcacacacacacaaacacacccttgtcacagctcagaataaccaattccatccagggatcatattagcgatattggcactgtaatggtcgtttttacatttattttctgttccgcattcacttaacatgtgcgttaaaagg

SEQ ID NO: 2384 - DNA, 601 bp, Human
agaaagaaaatcaatgaataggagagcatacactgtgggaaggctcagctgtactgagccaggcaaagcatccgattaccccactgctgtacacatcatgacctgggataaacccctgggccgttggcctaagaaatatgttgcttttcatcctgtataactgcaactttgtgccggctcatattatgttctagagagctcatgtacaccatggtgaccatagttaataatactggattgtatgcttaaaatttgctaagagagtagatcttaagtcatcaccaaaaaaagtaactgtaaratgatggagatgtgttaattagcttgacggtggtaatcacaatatatgtgtatatcaaaacatcacattatacaccttaaatgtatataatatttgtcaattatacctcagtaaagccaaaaagaaataaatatattgcttttcaccctctggcaagtggagggccctgaacagagccctctaaagaacagcttgtcctaatcatcacgtacctgatgaacctctgtttcccctgcagccagcgactctgcggacgatggctggtctccatggtccgagtggacctcctgttctacgagc

SEQ ID NO: 2385 - DNA, 601 bp, Human
ccatggtgaccatagttaataatactggattgtatgcttaaaatttgctaagagagtagatcttaagtcatcaccaaaaaaagtaactgtaagatgatggagatgtgttaattagcttgacggtggtaatcacaatatatgtgtatatcaaaacatcacattatacaccttaaatgtatataatatttgtcaattatacctcagtaaagccaaaaagaaataaatatattgcttttcaccctctggcaagtggagggccctgaacagagccctctaaagaacagcttgtcctaatcatcaygtacctgatgaacctctgtttcccctgcagccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatgtaagcatcttagcctctcagggacgtggagaactgacctgtccttgttgtcgtcaccaagggcagctccacagcatgtatattaagaacacgggt

SEQ ID NO: 2386 - DNA, 601 bp, Human
tcagtaaagccaaaaagaaataaatatattgcttttcaccctctggcaagtggagggccctgaacagagccctctaaagaacagcttgtcctaatcatcacgtacctgatgaacctctgtttcccctgcagccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaaragatgtaagcatcttagcctctcagggacgtggagaactgacctgtccttgttgtcgtcaccaagggcagctccacagcatgtatattaagaacacgggttctaggatctctggatcccaatcccactgcttagctgtgcacccttgaacacaacttaccctctctgaggctctttcctcatttgcaacttggagataataatagttcttgataagtttatcttgagcattttatttagatactgcatgtaaagcagttagcactgagttttggtttatggtaagcaccctgtaaatgtt

SEQ ID NO: 2387 - DNA, 601 bp, Human
ctgttctacgagctgtggcaatggaattcagcagcgcggccgctcctgcgatagcctcaacaaccgatgtgagggctcctcggtccagacacggacctgccacattcaggagtgtgacaagagatgtaagcatcttagcctctcagggacgtggagaactgacctgtccttgttgtcgtcaccaagggcagctccacagcatgtatattaagaacacgggttctaggatctctggatcccaatcccactgcttagctgtgcacccttgaacacaacttaccctctctgaggctctttcctsatttgcaacttggagataataatagttcttgataagtttatcttgagcattttatttagatactgcatgtaaagcagttagcactgagttttggtttatggtaagcaccctgtaaatgttaggatattaacagcaacccataaaaacagcgaacttatccgttctctggtagaaaacattccatgttgacatttgggcatgtggccaggagccaatttctaccgtacactgggtttagttgccattgaccatttcctggaaatacttctgcgtgctcctgatgggagcctctatttggct

SEQ ID NO: 2388 - DNA, 601 bp, Human
ccagacacggacctgccacattcaggagtgtgacaagagatgtaagcatcttagcctctcagggacgtggagaactgacctgtccttgttgtcgtcaccaagggcagctccacagcatgtatattaagaacacgggttctaggatctctggatcccaatcccactgcttagctgtgcacccttgaacacaacttaccctctctgaggctctttcctcatttgcaacttggagataataatagttcttgataagtttatcttgagcattttatttagatactgcatgtaaagcagttagcaytgagttttggtttatggtaagcaccctgtaaatgttaggatattaacagcaacccataaaaacagcgaacttatccgttctctggtagaaaacattccatgttgacatttgggcatgtggccaggagccaatttctaccgtacactgggtttagttgccattgaccatttcctggaaatacttctgcgtgctcctgatgggagcctctatttggctgtctctaagccaaaaccatttgtgaccatcaactctgtactttagttaaacaggatggtggctggagccactggtccccgtggt

SEQ ID NO: 2389 - DNA, 601 bp, Human
gttctctggtagaaaacattccatgttgacatttgggcatgtggccaggagccaatttctaccgtacactgggtttagttgccattgaccatttcctggaaatacttctgcgtgctcctgatgggagcctctatttggctgtctctaagccaaaaccatttgtgaccatcaactctgtactttagttaaacaggatggtggctggagccactggtccccgtggtcatcttgttctgtgacatgtggtgatggtgtgatcacaaggatccggctctgcaactctcccagcccccagatgaaygggaaaccctgtgaaggcgaagcgcgggagaccaaagcctgcaagaaagacgcctgccccagtaagtgtgaggtccgctgcaagggtgagcatgggcagcagctctgcccagctggttgcctggcatctgcagcctgcagttcagtgggtcatagagcaggaaggttacctactagagaaacaaacagaagcaaagtcctgcaggctcagcaacttcttttaatgaaaaacaaactcaccctcttccccagcattctttccatgtgtcagagaagcagaggtttcttgaacgggcttagg

SEQ ID NO: 2390 - DNA, 601 bp, Human
ggttacctactagagaaacaaacagaagcaaagtcctgcaggctcagcaacttcttttaatgaaaaacaaactcaccctcttccccagcattctttccatgtgtcagagaagcagaggtttcttgaacgggcttaggagagtctatgacaagggagggatttgaaagttgatcttaattgttgcctgtggttcatcttcttacagtcaatggaggctggggtccttggtcaccatgggacatctgttctgtcacctgtggaggaggggtacagaaacgtagtcgtctctgcaacaaccccrcaccccagtttggaggcaaggactgcgttggtgatgtaacagaaaaccagatctgcaacaagcaggactgtccaattggtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagacca

SEQ ID NO: 2391 - DNA, 601 bp, Human
tgtgcgtggccaatgcgacttaccactgcaaaaaggtagagccaggtcctttgtgtgcctccagaaagagggcccatcaccttatcaaaacacaggctaaggaattttaaatacttaaagtttggacatgaaactgaaagattaaatctcccaaagggagaggggcactaattcctattaaaattaaatcacttggtgccaaaaacatgaacagggctagctctttttgggcaactgtgttccatagtcaactcttctgtccaaaaaaaagttcagtactctatccaaataccagcaaagyatgacttgtgttcacaacatctataaagcctagagcatttacacaaattctgtatgtatatcccccaagaaaagttttattttcttgtcttcccataaaaaaaatatgctgttactgagccaaattctgttctttttctatttggaattccaggtacactccctcgtgcatgagctcagcatgaggaaggcaactgaagcagtgatatatatcttctctttcctaggataattgccccaaccttcccaactcagggcaggaagactatgacaaggatggaattggtgatgcctgtgatga

SEQ ID NO: 2392 - DNA, 601 bp, Human
ttgtttatttaacagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttrggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctg

SEQ ID NO: 2393 - DNA, 601 bp, Human
ttttggatgtgtcagtcaagactgtagcaaatctggaactatctaatatcaaatgtgtgctagaagataacaaatgttcttacttcctaagtattctggcgaaacttcaaacaaatccaaagttatcaaatcttaccttaaacaacattgaaacaacttggaattctttcattaggatcctccagctggtttggcatacaactgtatggtatttctcaatttcaaacgtgaagctacagggtcagctggacttcagagattttgattattctggcacttccttgaaggccttgtctatacwccaagttgtcagcgatgtgttcggttttccgcaaagttatatctatgaaatcttttcgaatatgaacatcaaaaatttcacagtgtctggtacacgcatggtccacatgctttgcccatccaaaattagcccgttcctgcatttggatttttccaataatctcttaacagacacggtttttgaaaattgtgggcaccttactgagttggagacacttattttacaaatgaatcaattaaaagaactttcaaaaatagctgaaatgactacacagatgaagtctctgcaacaattggatat

SEQ ID NO: 2394 - DNA, 601 bp, Human
ccagaattctgtaagctatgatgaaaagaaaggagactgttcttggactaaaagtttattaagtttaaatatgtcttcaaatatacttactgacactattttcagatgtttacctcccaggatcaaggtacttgatcttcacagcaataaaataaagagcattcctaaacaagtcgtaaaactggaagctttgcaagaactcaatgttgctttcaattctttaactgaccttcctggatgtggcagctttagcagcctttctgtattgatcattgatcacaattcagtttcccacccatcrgctgatttcttccagagctgccagaagatgaggtcaataaaagcaggggacaatccattccaatgtacctgtgagctaggagaatttgtcaaaaatatagaccaagtatcaagtgaagtgttagagggctggcctgattcttataagtgtgactacccggaaagttatagaggaaccctactaaaggactttcacatgtctgaattatcctgcaacataactctgctgatcgtcaccatcgttgccaccatgctggtgttggctgtgactgtgacctccctctgcagctacttggatctg

SEQ ID NO: 2395 - DNA, 601 bp, Human
ctcgggtaaaaatggagttggcttcagcaagttgattcccaggtttacagatgattacgtgctggtatgtgtcttcatatgggcgtgcctgtgtatgaacctactacaaaggttgcaaagtttacaaatcaaactatggatagtggttaactccaggtagtctgcctccagaccccatgtcctaaccatcaggcaatattgtctctcacttggacaaagaatgtgaattccatgtgccctcacaaaatatttccaaaattctaaggctgagtgagtctctttttaattttttttcattttytttatttctgctagatctcattcaacagcaacgttttcttcactctcatttcatcctttaactgcatttttgcttgttttactgaagcatgtcctagaataaccttttcatacagatcgtatggctataaacttactgaatttttgcatatctcaaaatacttatacctttttatttagttattcagatggatgtgaaatttccctatcttattttattttattttatttcattttatttcatttatcgatttagagacaaggtctcgctgtgttgcccaggctgaagtacagtggcatg

SEQ ID NO: 2396 - DNA, 601 bp, Human
tctgctagatctcattcaacagcaacgttttcttcactctcatttcatcctttaactgcatttttgcttgttttactgaagcatgtcctagaataaccttttcatacagatcgtatggctataaacttactgaatttttgcatatctcaaaatacttatacctttttatttagttattcagatggatgtgaaatttccctatcttattttattttattttatttcattttatttcatttatcgatttagagacaaggtctcgctgtgttgcccaggctgaagtacagtggcatgatcgtgrctcactgcagccttgacctccctggctcaagcaattctcacacctcagtgtcacgagtagctgggaccacaggtgtgaaccactatggccagctaatttaaaaaaaaattttggtggagatgaggtttccctgtgttgcccaggctggtcccaaactcctaggctcaagggatcctccagcctcagcttcctaaagtgatgggattacaggcatgagccacaggtaattttcttggcctggtcaaaggtaattttcttgttttttagaggtaaggtcttgctctgttgcccaggctggag

SEQ ID NO: 2397 - DNA, 601 bp, Human
ctgctagatctcattcaacagcaacgttttcttcactctcatttcatcctttaactgcatttttgcttgttttactgaagcatgtcctagaataaccttttcatacagatcgtatggctataaacttactgaatttttgcatatctcaaaatacttatacctttttatttagttattcagatggatgtgaaatttccctatcttattttattttattttatttcattttatttcatttatcgatttagagacaaggtctcgctgtgttgcccaggctgaagtacagtggcatgatcgtggytcactgcagccttgacctccctggctcaagcaattctcacacctcagtgtcacgagtagctgggaccacaggtgtgaaccactatggccagctaatttaaaaaaaaattttggtggagatgaggtttccctgtgttgcccaggctggtcccaaactcctaggctcaagggatcctccagcctcagcttcctaaagtgatgggattacaggcatgagccacaggtaattttcttggcctggtcaaaggtaattttcttgttttttagaggtaaggtcttgctctgttgcccaggctggagt

SEQ ID NO: 2398 - DNA, 601 bp, Human
tggaagagaggtttgggacactctcagagagggggcaggtggggagctggtccccagcatttgagaggtatcattgccagccctgcatccttcacgtgcctgggcaagtcagcaaatgcatccttgctggcctagctgtggcattcctcatggcctgtggatataaagaatgtgcacagctttacaatgattagtgccagagttgtaaaggccatgagatgggaatattagtttatggaagccagttttttttgttgttttttctgtttctgagaactaaattagaatattagtaaaatcrctatttttaagtatattagaacaattctatatactcacattagttctgttttcctaggattagtcacctaaggtgattttattacctgacacttacctggaataattttcatgtcatgacttttagatcttgtggaatatctatttagatatcattaccactgcttcatctccataccttgtgggtgtatttgattttttaaaatatctgaaatttggttgttgatcacaccacagagtatcacactgggtacacatcccaccaaaataaagtgtgacaatgtatggagttgagtggctt

SEQ ID NO: 2399 - DNA, 601 bp, Human
aaattaactaaagaaaagttgtgaatagaatgagagaaaaatataattaaattccttatctttatagtgaaatgagtaaatgaagaaatagaagatcaagaatattaagtttatggaggtaatcatgagaattacagatagaacctatcaaaagagagacattgcagctgcaactggcattaaggtgaaggataggaaggaagtttggatgttttattttttacctttctgtactgtttgacatttttccgtttgatgtatgacttgtataatatgtacttgtatggcataaaagtatgartaataacatcatacatggtcatattttggtgatatattttacaaggaatataccaatgcatttgaaagccatctgctattaatgttgctcatactttttaatgtttcttttctacagcagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttac

SEQ ID NO: 2400 - DNA, 601 bp, Human
ttagaaatagaacttagacgcaagagatagaagtaatgaacagagaagaatcagaatatcccctaagaacatggaaactaaactttcaatgctgctgatttagcatgtgaagtcgtgacaaaagtcttgagtccaaattctgacttaaataaaattaacaaattgatacaatgatcaagtgaattgttcaactaaaaattacctactcctggtttcagaaatctcctcagtggctatttcaatgactttttcaatagtggtgtcactttttcaatgattcctttttcttttcaaaactttrctcgaattttagttttttttcttttctttttagttgatgtttaataattgcacatatttatgagatagagaatgatttttcagtatgtgtatataatgtgtaatgattaaatcagggtaattatcatatccatcatctcaaatgtttctcatttgtgttgtgaacattcaaaatacgctcttctagcttttaaaaaatacacaataaatcgtagttaaccatattcaccctacaatgctttagagcaccagaaaaaaaaaaacgcatgttattgtttctaaatctgaggcaattattaag

SEQ ID NO: 2401 - DNA, 601 bp, Human
gtacaaatgtaaatatgctgtgaaacataaagtgatttgctccctagctattttaaatcttttcttgggtcttcttagagtctaatgtggatgaaatatctttgaatacaaaggcctcaaaatctggctagagaaatcattgcaaaatgttatttttgtaaagacttaaattaaaaaacctgcttctcgttaacagcgattacattagactttgccttaactggtatcgctttcccttaccttttgcctgaatttgaagcatacatattcaaaaatagcaaagggtgataaaaacatcccrcagtactgataaagcaaacaaaacttaatattctgtactagtcatgactcaaaatttatataatatgaccctttctcagtataaaaatctatttaaaatttcatagatggcaaaattctcatgctttttaagaaaacattctgttcttttttctgatacttattttcaaggttaaagcatgacactgtgtgtttgataagccatgtgaaaatttcttgcatcataagtaaaaggttatgataaataagttcataaattagcaatgttccttatatcataaataagcttaagtctttttta

SEQ ID NO: 2402 - DNA, 601 bp, Human
caagactctaacatatgcatattattttttcccttcagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagaggtaagaagtaaggtaaaattattttgcattctgcctttaaggtggatagtccctatctgtgtcacatacayaggaatgtaatgctctctagcctctgcctgtcttccagcaatccttcccacctactgcttgggggcattggtgtcatcctcctgagagctcaggcagccccaggagaggtcgggagacgggactctgccgccctgcagcactgggtggaacccctgtgccgtgaccttgcgaacatccttaacatctctgagtctgtgtcctcacttataaagtggaaatagtgctctctcacacaaactctctgacagagttattaattaaagagtacgatggtcaagagccccaggttcacagtcggg

SEQ ID NO: 2403 - DNA, 601 bp, Human
atctccaagagcttctattatcaaacaataaaattcaagcgctaaaaagtgaagaactggatatctttgccaattcatctttaaaaaaattagagttgtcatcgaatcaaattaaagaggtaagaagtaaggtaaaattattttgcattctgcctttaaggtggatagtccctatctgtgtcacatacacaggaatgtaatgctctctagcctctgcctgtcttccagcaatccttcccacctactgcttgggggcattggtgtcatcctcctgagagctcaggcagccccaggagaggtygggagacgggactctgccgccctgcagcactgggtggaacccctgtgccgtgaccttgcgaacatccttaacatctctgagtctgtgtcctcacttataaagtggaaatagtgctctctcacacaaactctctgacagagttattaattaaagagtacgatggtcaagagccccaggttcacagtcgggttagctggcttggtctctgggctttgtcttttaacaatcatgttatcaggcaagttattcaagttctccctctctagcctcccagctttcaaatgggcgtgataatgactc

SEQ ID NO: 2404 - DNA, 601 bp, Human
gagcttctattatcaaacaataaaattcaagcgctaaaaagtgaagaactggatatctttgccaattcatctttaaaaaaattagagttgtcatcgaatcaaattaaagaggtaagaagtaaggtaaaattattttgcattctgcctttaaggtggatagtccctatctgtgtcacatacacaggaatgtaatgctctctagcctctgcctgtcttccagcaatccttcccacctactgcttgggggcattggtgtcatcctcctgagagctcaggcagccccaggagaggtcgggagacsggactctgccgccctgcagcactgggtggaacccctgtgccgtgaccttgcgaacatccttaacatctctgagtctgtgtcctcacttataaagtggaaatagtgctctctcacacaaactctctgacagagttattaattaaagagtacgatggtcaagagccccaggttcacagtcgggttagctggcttggtctctgggctttgtcttttaacaatcatgttatcaggcaagttattcaagttctccctctctagcctcccagctttcaaatgggcgtgataatgactctgcttcat

SEQ ID NO: 2405 - DNA, 601 bp, Human
ttaaagagtacgatggtcaagagccccaggttcacagtcgggttagctggcttggtctctgggctttgtcttttaacaatcatgttatcaggcaagttattcaagttctccctctctagcctcccagctttcaaatgggcgtgataatgactctgcttcataggactgtgtggtaaagaatttaggaccgtgtctggcgtaggcagtgctcaggaaatgatcagcagcagtatgtggttataaaaaccttcctataatgaagtcagcttaaataactgacaggactgtctctttttggaawcatgatcttcaagctaatcattttctgtcacgggagagcaacaactatctggaccggtggcacaggggtaaaagaatttaccaagacagttgcaggtggagaaaggcacatttattcgtgaaagtaggaaactacattgcgagaaggcaacgggcatatcagcaagagaagctgactgcaaagaaacaaaggcttgctggggattttacagggtcttgtttatgctgtgtgctgaagagggctttgagctgcactgacagcgcccaggttgcagtgggctaactcgcaggggcctggtga

SEQ ID NO: 2406 - DNA, 601 bp, Human
ttcgtgaaagtaggaaactacattgcgagaaggcaacgggcatatcagcaagagaagctgactgcaaagaaacaaaggcttgctggggattttacagggtcttgtttatgctgtgtgctgaagagggctttgagctgcactgacagcgcccaggttgcagtgggctaactcgcaggggcctggtgatagctgggcacaggaagattgtcagttatttgcacaggagggctacgtgtcctggatcatgaagacagactaataatttacctgctcttttgctttctctcggtcccgccaactractacttttccctaaataggactctgcattttcacatacaggtttgtctgtattttacactcattttgttccaggctataagactactggaaatccttaattacaactctattttttttttcagacataaaaataaatggcgtacaaatttatcctaagatattaagatgttttgtgcaagctcttcattttattttttaaactgcatttttctatgattaagacatttattgtagtaatcttattaaatatatgaataaatgagaaaataataataaggggtgattttaaaaaatcact

SEQ ID NO: 2407 - DNA, 601 bp, Human
aaaacacgatagtaaaagaaagtcaggagaaaatccgggtggaaagacgagagggagagctagagctcagagttccagaaaggaaagtgtgccgtcaccgcctcatcataaaagccatccacaacttccttccatgaggctcactgagaacagcggcaccaagacacaaccaggaactgccccaggagtgacttcacgagcagtttattcattgcaattgttctcatggtgataaagaaaaagtaccaggagatggatcctggactggaaggtcagagaagcctccctgaaaaggtggcayctaagctgaggctgtgaatgctgagcagaagttagcccgtggccaggggaggtcagaggctggagtaagaggtgggcgctgcaggaaccgagtaaggaaggactcgtgcattacaggaagggggagaaatgctctgcccatgggatgtggtgaagggtgagcggagatggagtaaagaactgcatctggccgggtgcagcggctcaggcctataatcccagcactttgggaggctgaggcgggcggatcatgaggtcaggagttcaagaccagcctggcctacacggtgaaaccccgact

SEQ ID NO: 2408 - DNA, 601 bp, Human
catttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacataytcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctgg

SEQ ID NO: 2409 - DNA, 601 bp, Human
ccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttygaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaag

SEQ ID NO: 2410 - DNA, 601 bp, Human
gagctcccggactctacctgtggcagcactttcttggcagcagttggcgttgcactggtctcgcagcaccgacacctccctctccagcatctcgatccggctcagcagctcctgcagcacctgggctgaactggcacatggacaggcctttttggggaagttgatcctgtgtgtaaaggtgacctggctctcgtggtctgaggtctggcccatgtactctgccagagtctcgtcttctgcactcacctcctgctcagcagaggcctctagccctgaggagcagaggttgtccaagggcacrttaatgttgtacacgtggttgaagaccacaggctgctctttgctggacgtgttgtagttggcaatgcctccctcctcctccactgactgtctctggaccctttctgtggtgacctccagctgacactctgaaggcttgatcatggagcccagaaggatcaggttgacgccaatgagcatgttcttcagaaccactgtttccccatctgcccccatcctctcagccagagatctgggttcaggaccagcctgcagcacacagcatggagttgtgggaatctgcaacggaaaccaaggaaag

SEQ ID NO: 2411 - DNA, 601 bp, Human
gacatattaaccggcagctacagactaggacacttttttcctttgaccgtgtgaagagatgccggggttttgctgggagtgcgttttcgctggaagtgcattggtccttcttgttcactctccctctctgctcagccctctccttcccctcctgagaccacgctgcgagctcccggactctacctgtggcagcactttcttggcagcagttggcgttgcactggtctcgcagcaccgacacctccctctccagcatctcgatccggctcagcagctcctgcagcacctgggctgaactggmacatggacaggcctttttggggaagttgatcctgtgtgtaaaggtgacctggctctcgtggtctgaggtctggcccatgtactctgccagagtctcgtcttctgcactcacctcctgctcagcagaggcctctagccctgaggagcagaggttgtccaagggcacgttaatgttgtacacgtggttgaagaccacaggctgctctttgctggacgtgttgtagttggcaatgcctccctcctcctccactgactgtctctggaccctttctgtggtgacctccagctgacactctgaagg

SEQ ID NO: 2412 - DNA, 601 bp, Human
gttgctgtgctgaaccgatgaaccattacctgactcatccccccaaaatcaggttaatgtatttcaaactggctatgcagtgtagaaaatccctgaactgaatccctcggggaagaactgcatttagatcttagagacatattaaccggcagctacagactaggacacttttttcctttgaccgtgtgaagagatgccggggttttgctgggagtgcgttttcgctggaagtgcattggtccttcttgttcactctccctctctgctcagccctctccttcccctcctgagaccacgctgygagctcccggactctacctgtggcagcactttcttggcagcagttggcgttgcactggtctcgcagcaccgacacctccctctccagcatctcgatccggctcagcagctcctgcagcacctgggctgaactggcacatggacaggcctttttggggaagttgatcctgtgtgtaaaggtgacctggctctcgtggtctgaggtctggcccatgtactctgccagagtctcgtcttctgcactcacctcctgctcagcagaggcctctagccctgaggagcagaggttgtccaagggcac

SEQ ID NO: 2413 - DNA, 601 bp, Human
accatttgtagatgaggaaaggaaggcacagatatggaactgcttaggtcatcagctaggaagcagtagagccaggatctgaacttgggaattctgactctgaagacttaattatgtcttgcagagaggtaaaggtaactcacaagggttactaattagggggtgggcaatgttagaagtaaatcccctgagatttcagccttttggagggtgcactaagttgtgtgagtgtgttgtgtgtgagagcatgcgtgtgtgcatgcgtgagagagagagtatgtgtgtgtgagagtgtgtgtgwgtgtgtgtgtgtgtgtgtgtgcatacgcttctgtgtgctttttgagggggcaggtgctaaagcttccatctcactggagaagatggggataggtcctctgagaccttaatgactatcatctactcagatgggagaaaggctgcgattgagtgaacagagcgtctgcattctctagtccctcaggttaacatggatagatatcaattcaacagcctgtgaaaaccaaagatgaaagaagacagacatcaaattccctgctcgccatcgaagttgctgtgctgaaccgatgaaccattacct

SEQ ID NO: 2414 - DNA, 601 bp, Human
gcaccatttgtagatgaggaaaggaaggcacagatatggaactgcttaggtcatcagctaggaagcagtagagccaggatctgaacttgggaattctgactctgaagacttaattatgtcttgcagagaggtaaaggtaactcacaagggttactaattagggggtgggcaatgttagaagtaaatcccctgagatttcagccttttggagggtgcactaagttgtgtgagtgtgttgtgtgtgagagcatgcgtgtgtgcatgcgtgagagagagagtatgtgtgtgtgagagtgtgtgwgtgtgtgtgtgtgtgtgtgtgtgcatacgcttctgtgtgctttttgagggggcaggtgctaaagcttccatctcactggagaagatggggataggtcctctgagaccttaatgactatcatctactcagatgggagaaaggctgcgattgagtgaacagagcgtctgcattctctagtccctcaggttaacatggatagatatcaattcaacagcctgtgaaaaccaaagatgaaagaagacagacatcaaattccctgctcgccatcgaagttgctgtgctgaaccgatgaaccattac

SEQ ID NO: 2415 - DNA, 601 bp, Human
tagcaccatttgtagatgaggaaaggaaggcacagatatggaactgcttaggtcatcagctaggaagcagtagagccaggatctgaacttgggaattctgactctgaagacttaattatgtcttgcagagaggtaaaggtaactcacaagggttactaattagggggtgggcaatgttagaagtaaatcccctgagatttcagccttttggagggtgcactaagttgtgtgagtgtgttgtgtgtgagagcatgcgtgtgtgcatgcgtgagagagagagtatgtgtgtgtgagagtgtgwgtgtgtgtgtgtgtgtgtgtgtgtgcatacgcttctgtgtgctttttgagggggcaggtgctaaagcttccatctcactggagaagatggggataggtcctctgagaccttaatgactatcatctactcagatgggagaaaggctgcgattgagtgaacagagcgtctgcattctctagtccctcaggttaacatggatagatatcaattcaacagcctgtgaaaaccaaagatgaaagaagacagacatcaaattccctgctcgccatcgaagttgctgtgctgaaccgatgaaccatt

SEQ ID NO: 2416 - DNA, 601 bp, Human
ctgcctctagacttgctgtgtctcagggtgaatgtgtcaggtacccctctacatctgcgggccatccaggctctgttaaaatttcactctgccacctccagctttcatccccgtgaaagccttgagatcatggatcctatagaggtgagtgcttgaactcaagacaaatgcctcttgtcatcaaagaactgaattgcatggggtctaaggtaccttttgggagagaaaacctgtgcacaaaggggtacagatacagttcccactcattggcgtcagccgataatagctgttgcttatacgktacttacagaagccaggctgacatctgaataggtgcttttattgttaataacttcttgttgctctagtctagcaccatttgtagatgaggaaaggaaggcacagatatggaactgcttaggtcatcagctaggaagcagtagagccaggatctgaacttgggaattctgactctgaagacttaattatgtcttgcagagaggtaaaggtaactcacaagggttactaattagggggtgggcaatgttagaagtaaatcccctgagatttcagccttttggagggtgcactaagttgtgtg

SEQ ID NO: 2417 - DNA, 601 bp, Human
tgagagtgaagctcaacgtagtttggtacatattcaatttaataaatattttcacctagcatgggctgtctgtgcctagcacagggctgggggcaaagatgaatgagatctgggcccttgtcctccagaagctgacctttaaggtgtcttaggatggattccttagaagtaggtctttgctaaagattcatgtaaaagtgatttattggaaggtgttcccagaaaaaactggtagggaagagtggaaagttgggaagggaacgtgctcaagcccaggtgcattatcaagccaagttccagragagtcacttgggttcagttctgcagggtgctctgggcagtgcaggtcacatctcattgtgggttaaggtctatgtccctgagggcatgcgaatcccccagcccctcattctctctctgggcagcccaagaagtttccaacaaactgaggacagccttctcaccaggatgcccaggtgctggctatgggattttgtgagggacctaaggaggtataggctgagcactgagtccactgtgcagagaaaggtcttatgtgttacaaacctgtctcgctccctccctgcctgccatctgactc

SEQ ID NO: 2418 - DNA, 601 bp, Human
ggaaggatgggcaaaggcctctctactcattctctgaccagatttctgttgctgagagtgaagctcaacgtagtttggtacatattcaatttaataaatattttcacctagcatgggctgtctgtgcctagcacagggctgggggcaaagatgaatgagatctgggcccttgtcctccagaagctgacctttaaggtgtcttaggatggattccttagaagtaggtctttgctaaagattcatgtaaaagtgatttattggaaggtgttcccagaaaaaactggtagggaagagtggaaarttgggaagggaacgtgctcaagcccaggtgcattatcaagccaagttccagaagagtcacttgggttcagttctgcagggtgctctgggcagtgcaggtcacatctcattgtgggttaaggtctatgtccctgagggcatgcgaatcccccagcccctcattctctctctgggcagcccaagaagtttccaacaaactgaggacagccttctcaccaggatgcccaggtgctggctatgggattttgtgagggacctaaggaggtataggctgagcactgagtccactgtgcagagaaag

SEQ ID NO: 2419 - DNA, 601 bp, Human
atacatagggttggttctaatttgctagatagtcatctggaacaaagtgagtcatactcttaatattctgtactaattgttagcatgttagctgttgcccaatgtccttagtactttattcctgtttagatttaagtccttgtctaaaaacactctgccccactggaatcacttcataaattaataacatcttgcaatctgtaagctccaagataatcagagagcctcacagaccaaccaccatctcttgcagtagcattgtggaaggcattcctggaatatggcaactggtgagggagayaattttgagcaggtggaacgcttgggatccctcagagttagagaatggccttgcctaaggtggtcccatgacttcactgtctaccctcccccacctcaagggcaatgaagtgttgtcatcattgttaccactacctttttcctagtctcaggggtaacaatccagctctcagcctgaacttgaccttttcctatttccactctttatcccttttaatctgcctcatcaagactcaagaactcagctctcttggaaagcaaatgagtacaactcaattgagaattattttgcctaaacttc

SEQ ID NO: 2420 - DNA, 601 bp, Human
tctactaaaaatacaaaaaattagccgggcgcggtggtgggcgcctgtagtcccagctactcgggaggctgaggcaggagaatggcgtgaacccgggaagcggagcttgcagtgagccgagattgcgccactgcagtccgcaatccggcctgggcgacagagcgagactccgtctcaaaaaaaaaaaaaaaaaaaaaaaaagggaatcagccccaatgagatacttttttttttttttctcactgttgggtttagatccccattttagtacatcatccttctatcagctttgacagtgtaractatacatagggttggttctaatttgctagatagtcatctggaacaaagtgagtcatactcttaatattctgtactaattgttagcatgttagctgttgcccaatgtccttagtactttattcctgtttagatttaagtccttgtctaaaaacactctgccccactggaatcacttcataaattaataacatcttgcaatctgtaagctccaagataatcagagagcctcacagaccaaccaccatctcttgcagtagcattgtggaaggcattcctggaatatggcaactggtgaggg

SEQ ID NO: 2421 - DNA, 601 bp, Human
tagtgaaataataaacataatctgatttgcataaaaaagggaatcaggccgggcgcggtggctcacgcctgtaatcccagcactttgggaggccgaggcgggcggatcatgaggtcaggagatcgagaccatcctggctaacaaggtgaaaccccgtctctactaaaaatacaaaaaattagccgggcgcggtggtgggcgcctgtagtcccagctactcgggaggctgaggcaggagaatggcgtgaacccgggaagcggagcttgcagtgagccgagattgcgccactgcagtccgcartccggcctgggcgacagagcgagactccgtctcaaaaaaaaaaaaaaaaaaaaaaaaagggaatcagccccaatgagatacttttttttttttttctcactgttgggtttagatccccattttagtacatcatccttctatcagctttgacagtgtagactatacatagggttggttctaatttgctagatagtcatctggaacaaagtgagtcatactcttaatattctgtactaattgttagcatgttagctgttgcccaatgtccttagtactttattcctgtttagatttaagtcc

SEQ ID NO: 2422 - DNA, 601 bp, Human
cagaagaggatgagctatagtgaaataataaacataatctgatttgcataaaaaagggaatcaggccgggcgcggtggctcacgcctgtaatcccagcactttgggaggccgaggcgggcggatcatgaggtcaggagatcgagaccatcctggctaacaaggtgaaaccccgtctctactaaaaatacaaaaaattagccgggcgcggtggtgggcgcctgtagtcccagctactcgggaggctgaggcaggagaatggcgtgaacccgggaagcggagcttgcagtgagccgagattgygccactgcagtccgcaatccggcctgggcgacagagcgagactccgtctcaaaaaaaaaaaaaaaaaaaaaaaaagggaatcagccccaatgagatacttttttttttttttctcactgttgggtttagatccccattttagtacatcatccttctatcagctttgacagtgtagactatacatagggttggttctaatttgctagatagtcatctggaacaaagtgagtcatactcttaatattctgtactaattgttagcatgttagctgttgcccaatgtccttagtactttattcc

SEQ ID NO: 2423 - DNA, 601 bp, Human
agaaggtttaaaatgtttgtttgttgttattttttattttaaataatcccagtgggctctctgagccctgaatggaaaagaccaaccacttaatctgtactgtttaaaacataaacaaatgtatgagcagtagtcactgatttagtcagaagaggatgagctatagtgaaataataaacataatctgatttgcataaaaaagggaatcaggccgggcgcggtggctcacgcctgtaatcccagcactttgggaggccgaggcgggcggatcatgaggtcaggagatcgagaccatcctggstaacaaggtgaaaccccgtctctactaaaaatacaaaaaattagccgggcgcggtggtgggcgcctgtagtcccagctactcgggaggctgaggcaggagaatggcgtgaacccgggaagcggagcttgcagtgagccgagattgcgccactgcagtccgcaatccggcctgggcgacagagcgagactccgtctcaaaaaaaaaaaaaaaaaaaaaaaaagggaatcagccccaatgagatacttttttttttttttctcactgttgggtttagatccccattttagtacatcatcctt

SEQ ID NO: 2424 - DNA, 601 bp, Human
gtgtcctccagatggggtctcatggagcctcatcccctggatggaaactggagccatttgtcagcctggcttcccagaaggtgcctagtgactttggattcagaaacaataaggcttaacttctgcttgaatttcactttgggataattggtgtggtgacaatatttttagaaagatatttcaattcagtaaacaaaattgggaggctaaatgaaataattggatatggaaaaaattaaggaacattaaatttttttccctaagcacagtgcattattgttgtttttcttttcattattaycattgatttttgaaaataatttaagttgaagttacatgtgcgggaacattgcctgccacgtaggagtgagtaactctggcttacagaagtctggtgaatccggcttaccaggctttcccccttaaactgatgtcacatgacttatcagcaaattcctaaaattgctccattagaaggtttaaaatgtttgtttgttgttattttttattttaaataatcccagtgggctctctgagccctgaatggaaaagaccaaccacttaatctgtactgtttaaaacataaacaaatgtatgagca

SEQ ID NO: 2425 - DNA, 601 bp, Human
atccctgtagaaaggcagggtcaagaatatgacaggtatgtccagaccgccaaagagtaagtctactaagaagcatgtgcgctacagaatagcattaacacagcgatggcccacactgaccctgggtgtcctccagatggggtctcatggagcctcatcccctggatggaaactggagccatttgtcagcctggcttcccagaaggtgcctagtgactttggattcagaaacaataaggcttaacttctgcttgaatttcactttgggataattggtgtggtgacaatatttttagaaagrtatttcaattcagtaaacaaaattgggaggctaaatgaaataattggatatggaaaaaattaaggaacattaaatttttttccctaagcacagtgcattattgttgtttttcttttcattattatcattgatttttgaaaataatttaagttgaagttacatgtgcgggaacattgcctgccacgtaggagtgagtaactctggcttacagaagtctggtgaatccggcttaccaggctttcccccttaaactgatgtcacatgacttatcagcaaattcctaaaattgctccattagaa

SEQ ID NO: 2426 - DNA, 601 bp, Human
cagacctcctgcaaatgagtggtggctctagggttgctatagaaacagatggagattatgcaactgtccttcttcacatgctttgggaacctgtaaagtaatttatctgggcctattgaagtgttcctcaagcagcacagaggtaccatgtcagaggtaacgtgctcatagtttggactcaacccagttgtagctatgctagcagctgctgagtcttccctgaagtagccaggagggttcagtgtaagtcctggattagatcaagattttgtttgcaaatgaacctatccctgtagaaagscagggtcaagaatatgacaggtatgtccagaccgccaaagagtaagtctactaagaagcatgtgcgctacagaatagcattaacacagcgatggcccacactgaccctgggtgtcctccagatggggtctcatggagcctcatcccctggatggaaactggagccatttgtcagcctggcttcccagaaggtgcctagtgactttggattcagaaacaataaggcttaacttctgcttgaatttcactttgggataattggtgtggtgacaatatttttagaaagatatttcaattcagt

SEQ ID NO: 2427 - DNA, 601 bp, Human
gagcactttagataatgacctagatacttctctggaagagacctgtagcacttggtttaaaaagcaggccttaagagcagacctcctgcaaatgagtggtggctctagggttgctatagaaacagatggagattatgcaactgtccttcttcacatgctttgggaacctgtaaagtaatttatctgggcctattgaagtgttcctcaagcagcacagaggtaccatgtcagaggtaacgtgctcatagtttggactcaacccagttgtagctatgctagcagctgctgagtcttccctgargtagccaggagggttcagtgtaagtcctggattagatcaagattttgtttgcaaatgaacctatccctgtagaaaggcagggtcaagaatatgacaggtatgtccagaccgccaaagagtaagtctactaagaagcatgtgcgctacagaatagcattaacacagcgatggcccacactgaccctgggtgtcctccagatggggtctcatggagcctcatcccctggatggaaactggagccatttgtcagcctggcttcccagaaggtgcctagtgactttggattcagaaacaataag

SEQ ID NO: 2428 - DNA, 601 bp, Human
tgatggttcttttatcctgctggctccgggggagttttggccagctccctggccagccccagcactaaccaccatcactggggacagatgtggacaaatggttgaatgtgcttttccaccctacctctgacgtctcatttttttaatcatgtgatggagctcagctttcatatcaaaaggctacttctttgtgtatatggctttaaaatttttatttttcaattctattctactttgcattccagagaagataaaagagtgctagaagctggtaggagaccaggattctttttcttactcsgccattaattagctgtctggctctgggaaaatctgtctcactgactgctgctttttaaatctgtaaaatgagaagcttctttctaaggcctgttttaagttctcatattcatgaatgttttgttctattatctgtacatgggcagagaatggaggcagaagtcttgagattttgtcccttggcacactatgaggatagatcaaggctaggagtcaaaagtagtgaccttggcaacactattcaattgtgcttaagtgctgcagacctagggggcctcagaatgcaatccacacaatgggc

SEQ ID NO: 2429 - DNA, 601 bp, Human
ataaactattttcatatataccatctaacaagaatttaaaaaaatatttagtagcagtcatatgaggtagttcatgtagagataattatcccagctttaccaatgaggaaactgaatcccaggttaagggatgtgccaaaagtcagagtgggtcatagcagaactgactgtcaaaccctgatgttctacagttttcattctttcccctacaatttagacagcaggttacagattgcgcgagatgcctcctttcatttatacatggtgtcccaaagtaaactatattaggaataattcagaygatcttaataggtgtgatctctagactggtgctcatcctacaggtaagaaaattctttttaaacaggttctctagtgcctgtctcctgtgattcaacacattaactccaggtttcctatgcaggacttctgtcatagtggcagaaatggccactccaaatttcaagtcaccagcaattcttagggcatttggaacaaatcagcgtattcctttttgcttccttcttcaaagctaatattaacaatagagggtgatctaagaagagcattttgggattttaaagcaaaaaaaagaggtgca

SEQ ID NO: 2430 - DNA, 601 bp, Human
tagaatgcaggcagaatgactataaaccttcttagccaatatacaataccactttacatttatatagcatttcacagtctataaactattttcatatataccatctaacaagaatttaaaaaaatatttagtagcagtcatatgaggtagttcatgtagagataattatcccagctttaccaatgaggaaactgaatcccaggttaagggatgtgccaaaagtcagagtgggtcatagcagaactgactgtcaaaccctgatgttctacagttttcattctttcccctacaatttagacakcaggttacagattgcgcgagatgcctcctttcatttatacatggtgtcccaaagtaaactatattaggaataattcagacgatcttaataggtgtgatctctagactggtgctcatcctacaggtaagaaaattctttttaaacaggttctctagtgcctgtctcctgtgattcaacacattaactccaggtttcctatgcaggacttctgtcatagtggcagaaatggccactccaaatttcaagtcaccagcaattcttagggcatttggaacaaatcagcgtattcctttttgcttc

SEQ ID NO: 2431 - DNA, 601 bp, Human
aatttataaaactcaagaagtgtaaacgaaatttaaataagctttcaaatgatgttttataaactgtatcacctatagttttgaccttattaaagctttgaatttcactaaaacctttgggacaacctatataacacatacagaatgactcctaggccatgagaagaagagttgatatttagaacctgtcaggattttgcatgattatactgagcacttattatgtaccaagtacaatgctaaccacttttacatagattatttcaattcaccctctcaccaacaccatgggattaaggtrtcattattactaccattttatagatgacgaaattgggccacacagtcagcaaacatagaagctaggattagaatgcaggcagaatgactataaaccttcttagccaatatacaataccactttacatttatatagcatttcacagtctataaactattttcatatataccatctaacaagaatttaaaaaaatatttagtagcagtcatatgaggtagttcatgtagagataattatcccagctttaccaatgaggaaactgaatcccaggttaagggatgtgccaaaagtcagagtggg

SEQ ID NO: 2432 - DNA, 601 bp, Human
tgaggatggcaaatgttgaccaaaacaaaaattaaaaaaaatttttgtttaaaatttataaaactcaagaagtgtaaacgaaatttaaataagctttcaaatgatgttttataaactgtatcacctatagttttgaccttattaaagctttgaatttcactaaaacctttgggacaacctatataacacatacagaatgactcctaggccatgagaagaagagttgatatttagaacctgtcaggattttgcatgattatactgagcacttattatgtaccaagtacaatgctaaccactkttacatagattatttcaattcaccctctcaccaacaccatgggattaaggtatcattattactaccattttatagatgacgaaattgggccacacagtcagcaaacatagaagctaggattagaatgcaggcagaatgactataaaccttcttagccaatatacaataccactttacatttatatagcatttcacagtctataaactattttcatatataccatctaacaagaatttaaaaaaatatttagtagcagtcatatgaggtagttcatgtagagataattatcccagctttac

SEQ ID NO: 2433 - DNA, 601 bp, Human
cttccccatcctggactcaactttcttcctcacatctcaccccccatgccatgtctatatgtcctgctgggctcaatggctttaagtgatttgtaacttcctttgtgagcaggctcttgtctttttggtgcttagtaccccaatctctataaggtcatgaacatgcactggagccagctcctactggcttgtaaatgctgattgtcaaattttcaggactgtttcaagactgtcgttgaatacagccattattaaagattcaattttataacctaatacttaagtaaattatattaaaaayaaaggtaatagatattcaaaatttatcactctcaaattatttgactacattttactattatgtgtacctttaagataatttatgtgtgctctgtctggtgaaaatattctatgattgtactctactacacatctgtttccagctccatgtttactgacgtcatgttggtaattgaaattggccatggagagagtatttacatcatggaaactggcaaatgctacacaacggggcttttaaatttttttcctttagggagccaggttgttaggtatttaacagcacaccactggccaacat

SEQ ID NO: 2434 - DNA, 601 bp, Human
aggcacccgctgctggagctggaggccccccagggccgtcggctggtaagagatcacatattccgtcactgccatcggcccgtcccattccagctcaatggacctgtcgctgataccagccactcgcaagtcctctggaggggcaactaccgggaggcaatacacagatagcatgagctcagaggattgccttccccatcctggactcaactttcttcctcacatctcaccccccatgccatgtctatatgtcctgctgggctcaatggctttaagtgatttgtaacttcctttgtgagcmggctcttgtctttttggtgcttagtaccccaatctctataaggtcatgaacatgcactggagccagctcctactggcttgtaaatgctgattgtcaaattttcaggactgtttcaagactgtcgttgaatacagccattattaaagattcaattttataacctaatacttaagtaaattatattaaaaataaaggtaatagatattcaaaatttatcactctcaaattatttgactacattttactattatgtgtacctttaagataatttatgtgtgctctgtctggtgaaaatattct

SEQ ID NO: 2435 - DNA, 601 bp, Human
tagatgtcttacactttccttgacttctagtcagagtctagcttataacaagccagtactccataattaaagtactttttgtccttttggttctataatttatgaaagctgcctgaatttggaaactctcttaatcgaaagtgcctttttaatgatgtaccctttctaaatgggtcacatctctagcccttcccctcaagggcaataactattccaggcatccctgaagaactaagaaaagacgctactatcatgaatgcccatgatctcatgtaggagaaaagaaaaatgaagcaggacrgggaaatggtacgtacgggtggccaccttggcagtgatgggaaggctgaggatgttgctaatgacagcgtagacgctgatgttgtaggtgagacctggctccagctccgtgatggtgacaccactccaatctccaggcacccgctgctggagctggaggccccccagggccgtcggctggtaagagatcacatattccgtcactgccatcggcccgtcccattccagctcaatggacctgtcgctgataccagccactcgcaagtcctctggaggggcaactaccgggaggcaatacaca

SEQ ID NO: 2436 - DNA, 601 bp, Human
tttctgaactttcgtggcatttgttacctgaataccatctacctacacaaaatgggctcagatctcttaccccttatctggtggtaagtcctatttactggcccgggggctttctgaattctagagggcttatgttttcatggttacttcttgttccactttcttggtattgctaaaaatctctgtatcactcatacctcatctcctttgaatgttctcttctctcttcccagattttaatcagatacagcccctttttcatgatctctccaaagactttccacataaggcacagaggcattgtgtgcatgcaggttttgcagtagacttggggtgatgagaacttctcttgcctaaattattctgcctggcttttgaaattctaaactaaaacaggcttattgtatcaatttaagaattcagaggggtataaagaaaaatataataattatttcctatctccttcttattctactctgtgatgtagtcagtgttaataattgttatgtaatcttttatatttttctatgcttgaacatacacaaaatataggtacacacccacagaagtttccctttatgtataaaaaaaactgttcatt

SEQ ID NO: 2437 - DNA, 601 bp, Human
cagagtcagcactcttctcatagcggagtccaaaattatagcagaatttctgtcacctgaaaagcaaggggacaagatgacttcttaaattccttcccctctgcctgtctctatccttgcatccttcaaaggtcaattcagtcctggagcttccatgaagatttcaaggctaaatctttctaccttgaccttttccttttctgaactttcgtggcatttgttacctgaataccatctacctacacaaaatgggctcagatctcttaccccttatctggtggtaagtcctatttactggccygggggctttctgaattctagagggcttatgttttcatggttacttcttgttccactttcttggtattgctaaaaatctctgtatcactcatacctcatctcctttgaatgttctcttctctcttcccagattttaatcagatacagcccctttttcatgatctctccaaagactttccacataaggcacagaggcattgtgtgcatgcaggttttgcagtagacttggggtgatgagaacttctcttgcctaaattattctgcctggcttttgaaattctaaactaaaacaggcttattg

SEQ ID NO: 2438 - DNA, 601 bp, Human
cagatggtgacctgcctctctgcacaatcattgcagatatttaaaaccagttctcaggcaccagaggattttttttttaaaaaaaggtcaaatataaacagagataattataggcatattaacagagtcagcactcttctcatagcggagtccaaaattatagcagaatttctgtcacctgaaaagcaaggggacaagatgacttcttaaattccttcccctctgcctgtctctatccttgcatccttcaaaggtcaattcagtcctggagcttccatgaagatttcaaggctaaatcttyctaccttgaccttttccttttctgaactttcgtggcatttgttacctgaataccatctacctacacaaaatgggctcagatctcttaccccttatctggtggtaagtcctatttactggcccgggggctttctgaattctagagggcttatgttttcatggttacttcttgttccactttcttggtattgctaaaaatctctgtatcactcatacctcatctcctttgaatgttctcttctctcttcccagattttaatcagatacagcccctttttcatgatctctccaaagactttcc

SEQ ID NO: 2439 - DNA, 601 bp, Human
gctgactgcaagcccacttgaagttgtgtcaggtggtttacatgattttgtccttgtcacctgggagcttgcctgagggaatgccctgaattggcataataaatgccacaggagatggaaacctcatcactgtgcatgcatgtggatcagagaggagacgcttgggagttaggccaggcacttagggtggtgactcatcccggagcaaggtgggaaaagcggcagatggtgacctgcctctctgcacaatcattgcagatatttaaaaccagttctcaggcaccagaggattttttttttwaaaaaaggtcaaatataaacagagataattataggcatattaacagagtcagcactcttctcatagcggagtccaaaattatagcagaatttctgtcacctgaaaagcaaggggacaagatgacttcttaaattccttcccctctgcctgtctctatccttgcatccttcaaaggtcaattcagtcctggagcttccatgaagatttcaaggctaaatctttctaccttgaccttttccttttctgaactttcgtggcatttgttacctgaataccatctacctacacaaaatgggctca

SEQ ID NO: 2440 - DNA, 601 bp, Human
ggaaggcagggctgactgcaagcccacttgaagttgtgtcaggtggtttacatgattttgtccttgtcacctgggagcttgcctgagggaatgccctgaattggcataataaatgccacaggagatggaaacctcatcactgtgcatgcatgtggatcagagaggagacgcttgggagttaggccaggcacttagggtggtgactcatcccggagcaaggtgggaaaagcggcagatggtgacctgcctctctgcacaatcattgcagatatttaaaaccagttctcaggcaccagaggattttttttttaaaaaaaggtcaaatataaacagagataattataggcatattaacagagtcagcactcttctcatagcggagtccaaaattatagcagaatttctgtcacctgaaaagcaaggggacaagatgacttcttaaattccttcccctctgcctgtctctatccttgcatccttcaaaggtcaattcagtcctggagcttccatgaagatttcaaggctaaatctttctaccttgaccttttccttttctgaactttcgtggcatttgttacctgaataccatctacctacacaa

SEQ ID NO: 2441 - DNA, 601 bp, Human
tctgaatttttcatttcatgtatctccctcttttcctcccaccaccccttctcccccaaccacacagtcacatacacatgcacaggttttgtgagatggaagtgtgcttgtcctaatggagtttcaattatcagccctgaaatatgacagcatgacttttctcagttctccaggaagcctgctcccattttagctttgcctctcatgggctattcccattggaaaaaggacagattttctcatccttcctgtttggaagagttctcatgcttcttggttggaaggcagggctgactgcaarcccacttgaagttgtgtcaggtggtttacatgattttgtccttgtcacctgggagcttgcctgagggaatgccctgaattggcataataaatgccacaggagatggaaacctcatcactgtgcatgcatgtggatcagagaggagacgcttgggagttaggccaggcacttagggtggtgactcatcccggagcaaggtgggaaaagcggcagatggtgacctgcctctctgcacaatcattgcagatatttaaaaccagttctcaggcaccagaggattttttttttaaaaaaaggtca

SEQ ID NO: 2442 - DNA, 601 bp, Human
cttgagcagtatctttagaagctttacaggactcccgggaggtactatgatggcttctatcagtgttctcattttgcacacaggaaaagagaggcacagagaaagctggctaaagttgtggagcaaaccagtttcagaattaatactagagtgatttccttgatcatctgatgcacattgagagtattttgtttagctcaaatcactaagtctaggatggtctgaatttttcatttcatgtatctccctcttttcctcccaccaccccttctcccccaaccacacagtcacatacacatgyacaggttttgtgagatggaagtgtgcttgtcctaatggagtttcaattatcagccctgaaatatgacagcatgacttttctcagttctccaggaagcctgctcccattttagctttgcctctcatgggctattcccattggaaaaaggacagattttctcatccttcctgtttggaagagttctcatgcttcttggttggaaggcagggctgactgcaagcccacttgaagttgtgtcaggtggtttacatgattttgtccttgtcacctgggagcttgcctgagggaatgccctgaatt

SEQ ID NO: 2443 - DNA, 601 bp, Human
ttattgcattaataggttactattaaaatgcagacatcatttttcttttcttactaatgtggtagatcttggcatatcatatatagtacagtgcctttttcagaggacttgagcagtatctttagaagctttacaggactcccgggaggtactatgatggcttctatcagtgttctcattttgcacacaggaaaagagaggcacagagaaagctggctaaagttgtggagcaaaccagtttcagaattaatactagagtgatttccttgatcatctgatgcacattgagagtattttgttwagctcaaatcactaagtctaggatggtctgaatttttcatttcatgtatctccctcttttcctcccaccaccccttctcccccaaccacacagtcacatacacatgcacaggttttgtgagatggaagtgtgcttgtcctaatggagtttcaattatcagccctgaaatatgacagcatgacttttctcagttctccaggaagcctgctcccattttagctttgcctctcatgggctattcccattggaaaaaggacagattttctcatccttcctgtttggaagagttctcatgcttct

SEQ ID NO: 2444 - DNA, 601 bp, Human
ctttttattgcattaataggttactattaaaatgcagacatcatttttcttttcttactaatgtggtagatcttggcatatcatatatagtacagtgcctttttcagaggacttgagcagtatctttagaagctttacaggactcccgggaggtactatgatggcttctatcagtgttctcattttgcacacaggaaaagagaggcacagagaaagctggctaaagttgtggagcaaaccagtttcagaattaatactagagtgatttccttgatcatctgatgcacattgagagtatttygtttagctcaaatcactaagtctaggatggtctgaatttttcatttcatgtatctccctcttttcctcccaccaccccttctcccccaaccacacagtcacatacacatgcacaggttttgtgagatggaagtgtgcttgtcctaatggagtttcaattatcagccctgaaatatgacagcatgacttttctcagttctccaggaagcctgctcccattttagctttgcctctcatgggctattcccattggaaaaaggacagattttctcatccttcctgtttggaagagttctcatgc

SEQ ID NO: 2445 - DNA, 601 bp, Human
tggctctagtgctcgatgttgatggaatacatgagttaacttaaacacaatctatataaacaatttttaatgctttttattgcattaataggttactattaaaatgcagacatcatttttcttttcttactaatgtggtagatcttggcatatcatatatagtacagtgcctttttcagaggacttgagcagtatctttagaagctttacaggactcccgggaggtactatgatggcttctatcagtgttctcattttgcacacaggaaaagagaggcacagagaaagctggctaaagttktggagcaaaccagtttcagaattaatactagagtgatttccttgatcatctgatgcacattgagagtattttgtttagctcaaatcactaagtctaggatggtctgaatttttcatttcatgtatctccctcttttcctcccaccaccccttctcccccaaccacacagtcacatacacatgcacaggttttgtgagatggaagtgtgcttgtcctaatggagtttcaattatcagccctgaaatatgacagcatgacttttctcagttctccaggaagcctgctcccattttagctttg

SEQ ID NO: 2446 - DNA, 601 bp, Human
agctgatttcccacccatcgaaggaaaatgagaagggctcccactgcacctccacggtggtctctgtgatcgtcttaaattgtagcccttgaggagtggagagatctggaacacagcaatgtaggtgacaatgtcatggctaacccttgggacagacagcattgcctggtgctttgtcttggtgaactccctccacgccatgggcgtggtggtgtctggtggacaatcccaatcttgctccagacacagtgagtcccaggtgcagaatcaacccaccccatgtggctctagtgctcgatgwtgatggaatacatgagttaacttaaacacaatctatataaacaatttttaatgctttttattgcattaataggttactattaaaatgcagacatcatttttcttttcttactaatgtggtagatcttggcatatcatatatagtacagtgcctttttcagaggacttgagcagtatctttagaagctttacaggactcccgggaggtactatgatggcttctatcagtgttctcattttgcacacaggaaaagagaggcacagagaaagctggctaaagttgtggagcaaaccagtttca

SEQ ID NO: 2447 - DNA, 601 bp, Human
ggtgagtgttacctttggaatgaagctgatttcccacccatcgaaggaaaatgagaagggctcccactgcacctccacggtggtctctgtgatcgtcttaaattgtagcccttgaggagtggagagatctggaacacagcaatgtaggtgacaatgtcatggctaacccttgggacagacagcattgcctggtgctttgtcttggtgaactccctccacgccatgggcgtggtggtgtctggtggacaatcccaatcttgctccagacacagtgagtcccaggtgcagaatcaacccaccycatgtggctctagtgctcgatgttgatggaatacatgagttaacttaaacacaatctatataaacaatttttaatgctttttattgcattaataggttactattaaaatgcagacatcatttttcttttcttactaatgtggtagatcttggcatatcatatatagtacagtgcctttttcagaggacttgagcagtatctttagaagctttacaggactcccgggaggtactatgatggcttctatcagtgttctcattttgcacacaggaaaagagaggcacagagaaagctggctaa

SEQ ID NO: 2448 - DNA, 601 bp, Human
ggcagctctagggagaagggttggaggcactcacctgtggagacgctggccgaggtaggggggctgcgggcctgttctttcagagccaccacattgacaatgtattcctccccaggctttagtcctgtctggttaaaggacgtaacatcgctggggacctgagcaatcactcccccttcattgttctggacagtggggagaagcagagagcaaaagagaaaagtcactgggagagaaatctgatgagagaaagataaaggtgtggaatactaattgtggattgtgaatttaaaatgggggygatgtctctttcctccatgctgacagctgagtatctggggccagaaataactccccatagactccataagaatgacaccaccctatgaggatttggcaaatggaggatcaatttttaagaacatttctttggccactcctgagtttgctgagtttgccaataaaaattagtgatgaggtggtgcagattggctcttgccaaagatcaaatgtttgatggttgcggttaacattcatcagaggtttttggcatttatcgtaatgaacatgcccccggctatttaggagaggatagtcatgt

SEQ ID NO: 2449 - DNA, 601 bp, Human
tccattattcctcaaacctaagcgtaaaaacagacaatttcccccaggtctttgggtcttcatttctgaaggctcctttgtcatgtgaaactttgattaaataaatttgttacgctttctcttgttaacctgtcttttgtgatagcagtgttgttgtgatgcttatatgatgggtgagcaagggcatcacacctttctgcccccaagttatcgaatgtcaactcttcaggttacagcataaccttggagctgtggaaaacctcagccaccggccttctggagggattcctacagagcactktagcttttatggttatggggtttcttctaaaacatactatttagagcagaaccatggtttgaaagctttttgggtggtaaacttattttttaaaggacaaaaatcttaaatggatgtacaaaatataaaacagatcaaagtggagctgtcctggttggaggcatgaaagagggagtaattagaggtctggctttccactggattctagcctcaaggcactgccatagaaccttggtgcactaatggaacacaagctactgccacaatagttctgaaccaacgttttctaaactgagctta

SEQ ID NO: 2450 - DNA, 601 bp, Human
tcaaagcaagccataaaacctagaaaggtaactttttccctcctcccttctcccttgaggaccctcattccagtgaggtcttgtcccacagaggaggtggagaagaaatgcttcacagagaggccaagaagaatctgggcagacaggccttgctgggtctcccccttagactattaccattagatcatagccatttgtccaattacgtttctacatggctgtccattattcctcaaacctaagcgtaaaaacagacaatttcccccaggtctttgggtcttcatttctgaaggctcctttktcatgtgaaactttgattaaataaatttgttacgctttctcttgttaacctgtcttttgtgatagcagtgttgttgtgatgcttatatgatgggtgagcaagggcatcacacctttctgcccccaagttatcgaatgtcaactcttcaggttacagcataaccttggagctgtggaaaacctcagccaccggccttctggagggattcctacagagcactttagcttttatggttatggggtttcttctaaaacatactatttagagcagaaccatggtttgaaagctttttgggtggta

SEQ ID NO: 2451 - DNA, 601 bp, Human
atcacaggaataacttgggcaccttgtaacatttcatatcagaagaggagaagctgcacctgctattgttgggctcatcacagacactccaaaatttggcaccttggtgtgctgagtactttgaattaaagaggaatgaaagagcctcagaaacagccccggaagcaagcaaggtctttctgaccatctgcagtcctcccatctcctgacccttcttctccctttgaagtgattcacagaaatcagaattcctcttcctcagggcaggtaatagaaactagaactccttttcctcaaagcmagccataaaacctagaaaggtaactttttccctcctcccttctcccttgaggaccctcattccagtgaggtcttgtcccacagaggaggtggagaagaaatgcttcacagagaggccaagaagaatctgggcagacaggccttgctgggtctcccccttagactattaccattagatcatagccatttgtccaattacgtttctacatggctgtccattattcctcaaacctaagcgtaaaaacagacaatttcccccaggtctttgggtcttcatttctgaaggctcctttgtcatgtg

SEQ ID NO: 2452 - DNA, 601 bp, Human
ctccctcagggccgtcttaggctgaccttgaggctttcagtttttcaaggttgagcctttccctgggtacccctccctctttccgggtcttagcctagtcctgtcctctcttaagctgcttagggcttttggtccagcaccagctaaaatgaaaatcaccagaccacttgggtgccacctggtttggacttaaaatgaagtcctggttttcatatttgaggtagtaatgtgatttaacagaatatatccagtttcttttcagcatgctgcacttggtggttttagataacttaggcctttyacatttaatttaaattaattatgaaatgggggaagtggcctcctagttgctgtgtaagcatgatatctgaagcatagtagacactcagtaaatgtgtgtcgagtaaatgaaatgaatggaaaatcttctttatccatgagaaagaaggggaagcatttcaataaactggagctttttggaaaaaaaaaaaagtgtcagggaaatgcaactgaccacaaaaagcttttgtccttcaactctttaaatccagaaaacccgaatcataatggattgaacatattaaaatgtgattatgtagcg

SEQ ID NO: 2453 - DNA, 601 bp, Human
tctccagaatgaagtttctccctcagggccgtcttaggctgaccttgaggctttcagtttttcaaggttgagcctttccctgggtacccctccctctttccgggtcttagcctagtcctgtcctctcttaagctgcttagggcttttggtccagcaccagctaaaatgaaaatcaccagaccacttgggtgccacctggtttggacttaaaatgaagtcctggttttcatatttgaggtagtaatgtgatttaacagaatatatccagtttcttttcagcatgctgcacttggtggttttmgataacttaggcctttcacatttaatttaaattaattatgaaatgggggaagtggcctcctagttgctgtgtaagcatgatatctgaagcatagtagacactcagtaaatgtgtgtcgagtaaatgaaatgaatggaaaatcttctttatccatgagaaagaaggggaagcatttcaataaactggagctttttggaaaaaaaaaaaagtgtcagggaaatgcaactgaccacaaaaagcttttgtccttcaactctttaaatccagaaaacccgaatcataatggattgaacatattaa

SEQ ID NO: 2454 - DNA, 601 bp, Human
agctagtttaagtaagtctctcttccttgttactggagagccttggctaagacttgtttctaaccagtccactctggcccacctcctactctgtctccagaatgaagtttctccctcagggccgtcttaggctgaccttgaggctttcagtttttcaaggttgagcctttccctgggtacccctccctctttccgggtcttagcctagtcctgtcctctcttaagctgcttagggcttttggtccagcaccagctaaaatgaaaatcaccagaccacttgggtgccacctggtttggactwaaaatgaagtcctggttttcatatttgaggtagtaatgtgatttaacagaatatatccagtttcttttcagcatgctgcacttggtggttttagataacttaggcctttcacatttaatttaaattaattatgaaatgggggaagtggcctcctagttgctgtgtaagcatgatatctgaagcatagtagacactcagtaaatgtgtgtcgagtaaatgaaatgaatggaaaatcttctttatccatgagaaagaaggggaagcatttcaataaactggagctttttggaaaaaaaaaaa

SEQ ID NO: 2455 - DNA, 601 bp, Human
ggttgccaaagaggtcatcatgagtattcaaaagatgtccctgctcagccactctaacagcacagtcaacacagttgctaagaccatttaaaaaccaacagacatttgcatatgaggacatgaaacatgccttctgggtaaacttgcttctctggataaaaggataaaaaggaccccagcttcggaacagcctcttacgggtcatttttctccatctgttcttgcatatttctacagcagaaggacattgcagtcacctcttccaggttctctagtgtatttccctcataagccctggccyctggcactgtgcaggtcagggcaacacctggaaagctggttgatttcctgcagggcccaccagctgtggctccagcacccacttgaggttctgttcatactgaattagataatggggaggtgagggaatgtagaagaagaaagaaaaagaaacagccaagtgaggagaataggaaatggtcttctcaacttctcatgggatgtctgcatggccaacatgctcttgcctccatgttttcatttattattggggctacacccttctggctggagctgattattaatgttaatattctttaag

SEQ ID NO: 2456 - DNA, 601 bp, Human
gcacttgctggcttgaaagagtcagccctgtttctttctggaggtcatgggacagggaattgagaactgggtttctgcgtgtgtctgccactcagctctcacctctttgagccctgaggaaagacctaggaaatgaccagcccacctaaacatccaagacttccagattggttgccaaagaggtcatcatgagtattcaaaagatgtccctgctcagccactctaacagcacagtcaacacagttgctaagaccatttaaaaaccaacagacatttgcatatgaggacatgaaacatgccytctgggtaaacttgcttctctggataaaaggataaaaaggaccccagcttcggaacagcctcttacgggtcatttttctccatctgttcttgcatatttctacagcagaaggacattgcagtcacctcttccaggttctctagtgtatttccctcataagccctggcctctggcactgtgcaggtcagggcaacacctggaaagctggttgatttcctgcagggcccaccagctgtggctccagcacccacttgaggttctgttcatactgaattagataatggggaggtgagggaatgt

SEQ ID NO: 2457 - DNA, 601 bp, Human
cgcccaccaggccatatttcaaaagaatgaaatcgactttggctcgagggggaatccactccacaaaagccacggtgtccgagacatcgcgaaccaggatctgcgtggggccgtcaatgactgagtgagaaggatcaaacagaacaaaaagtttgaatgagaaataagccttgggtgtcagctctctcttttcctccttatggaagtctggtgagtcagagagaggatgggtattgttactgcattttacagatgaggaaaatgagacacagtaagatgaatatctttcctgaggacatgyagtttgccttgattcccctgaattttggtctaactgctcttttaccaggctgtagtttccaggtgatggcacttcccagtctgggcaggggaagggcacttgctggcttgaaagagtcagccctgtttctttctggaggtcatgggacagggaattgagaactgggtttctgcgtgtgtctgccactcagctctcacctctttgagccctgaggaaagacctaggaaatgaccagcccacctaaacatccaagacttccagattggttgccaaagaggtcatcatgagtattcaaaagat

SEQ ID NO: 2458 - DNA, 601 bp, Human
catttggactagcgatatggatgcttacatgtgttcaaggcaaacttgtcattttacaaacgggaaacctgaggcccatagtggggaaggatttatatcaagcacagatctggttgccagtagaggtaggatgagaagctagttttcctctcctagtgagggagcgctgcttttcctgtatgctggaaacctcttgcttccttctcgcggtgtctatgacaaggccaatgctctgacacaccttgcctcattcctaatactcctcttgctgtgatgacaccaccggttggctccacccctstttccctccttgtgcgtctctcccccaccgcagccttacctgttgtgaactgagtggtggcagaatcgctctcgttggtccctcggacggcactgactgacacctcgtatcgggagccaggccgcagggcctgcactgagtattggctcaggggaggctgcagccggaaggtggtcctcccaccttccccgcccaccaggccatatttcaaaagaatgaaatcgactttggctcgagggggaatccactccacaaaagccacggtgtccgagacatcgcgaaccaggatctgcgtggggc

SEQ ID NO: 2459 - DNA, 601 bp, Human
tacaaacggcaaggtgagtcacagaattggtcagaagttctgcttagagttgtacaggctgggcttagcataatgccaatgcacatcatcatggtggtgtagtcatcgtaggtttatagaattattatgataatttccagcaaatggtaagaatgtgtcttgagaaagagacacctttcctgaattctcacaaaatttccatttggactagcgatatggatgcttacatgtgttcaaggcaaacttgtcattttacaaacgggaaacctgaggcccatagtggggaaggatttatatcaarcacagatctggttgccagtagaggtaggatgagaagctagttttcctctcctagtgagggagcgctgcttttcctgtatgctggaaacctcttgcttccttctcgcggtgtctatgacaaggccaatgctctgacacaccttgcctcattcctaatactcctcttgctgtgatgacaccaccggttggctccacccctgtttccctccttgtgcgtctctcccccaccgcagccttacctgttgtgaactgagtggtggcagaatcgctctcgttggtccctcggacggcactgactgac

SEQ ID NO: 2460 - DNA, 601 bp, Human
gagcttacctaaatggtgagttttgcagcaaggcctgggcattgcccttctgttcccctctctcgtgggacaggctgttccgagggttcaggcacctacttgttcctctatgctctaagtcctaacctggatagtctcccaatttctgccatatggagagacttgcctaggtccacagtggccatccagtttgcaaacccatctggccatgacactaagttacatgctgcaatctaggggacattttggtgtccatctgtttcactttttcccttatttatcaattgattttaaacccagyggaacacaggggtgttatttatttattgaatcttcttgaaaaccctggactcattccattctgtagcaggctcttatgccacagtctaaggtagaattcttgaattagtgattctccaactttatcccatctgaagatgctggttcttagatcttacagatgttatcagttttcattgatccctgggtcaacttggagttggcagagatattatttgacatgtgaccaccccaaggcaaagaggatgagactgagaatccagaagacagacacaatcactaatctgatcacaggccctta

SEQ ID NO: 2461 - DNA, 601 bp, Human
tttccctgcccttgatgtttccttcctaaggctcttgtctctcttttgctggagaaaatgagcttacctaaatggtgagttttgcagcaaggcctgggcattgcccttctgttcccctctctcgtgggacaggctgttccgagggttcaggcacctacttgttcctctatgctctaagtcctaacctggatagtctcccaatttctgccatatggagagacttgcctaggtccacagtggccatccagtttgcaaacccatctggccatgacactaagttacatgctgcaatctaggggayattttggtgtccatctgtttcactttttcccttatttatcaattgattttaaacccagtggaacacaggggtgttatttatttattgaatcttcttgaaaaccctggactcattccattctgtagcaggctcttatgccacagtctaaggtagaattcttgaattagtgattctccaactttatcccatctgaagatgctggttcttagatcttacagatgttatcagttttcattgatccctgggtcaacttggagttggcagagatattatttgacatgtgaccaccccaaggcaaag

SEQ ID NO: 2462 - DNA, 601 bp, Human
actggaaacagaaagccatgtagcaatgaactgaaactcatggggagctcctaggaggcagaatgtaattgtcttgatcagaattttcctgggccaccagccaatcctgcttccatcttgtcgacctgaacaccaagaatttgttttccatcatgctgctcaagagctctcctctcctttttgccgcttcaaacttcttatcagagcagagcacaaagaaaccacttttcaaacaaaactatcttgaaattaagaaaaggatgcaggactcattgtccacagaagataccacaccccggakcaagtggtattgtgggggtgggaaatgagaagctgacctagaattaaccaagaagggacgtgagcatctttggctaaatgaggaagcagaagggaagagaaatgggcagaatttagttcattgtttcaagatgcacattcggtcactccggattccaagatatgttcagtaaaaatcccactgggcaccccctgggtgacagggtggcatctggcccaggcactacagagaaaacctaaaagagtatttttcagaaataaactttgccttctccattttgtcagtgtctgtacttgctcc

SEQ ID NO: 2463 - DNA, 601 bp, Human
agagctgctgagggcagggaggggttttggagattggcctctgggttttctaggctggcttctctccaatcaccggccatggtgcactttgttcagggttctttccttttcagaacagctctaagacccaagcaaatatccactcaccatgcaggaagcaaatctctgctttaattgcctgtgcaattagtgcactcctagtgtcggagccatcacctggaaaagcactttggttaatttgaatttaagcggagctctgaaatgactgagggcctcatcatgagggtctgggtaccctctyatcatttaactggcacctgccaacccaggcctggagaatctgtctgcagtgctgtttgcatctcctcatcccttctttcccctcaccctcctccagcagaggggagcatatttgaggtgtaggctgaggctgtattgagaagtcagccgcctgacagctgccaatccaccaggcaactggaaacagaaagccatgtagcaatgaactgaaactcatggggagctcctaggaggcagaatgtaattgtcttgatcagaattttcctgggccaccagccaatcctgcttccatcttgtcgac

SEQ ID NO: 2464 - DNA, 601 bp, Human
tcaacgtctttttaaggagcacaattcaacctataatagcaataaagagaaatctggagtattcaggtcaaaacagcagcctctggttgaccagatgccctggtgactgtgcttggaacattgagggatctgcttaaagagaaggcctccagaggagagaaatggtgccaggagttccctcctgagggcaactgaaaccagagctgctgagggcagggaggggttttggagattggcctctgggttttctaggctggcttctctccaatcaccggccatggtgcactttgttcagggttckttccttttcagaacagctctaagacccaagcaaatatccactcaccatgcaggaagcaaatctctgctttaattgcctgtgcaattagtgcactcctagtgtcggagccatcacctggaaaagcactttggttaatttgaatttaagcggagctctgaaatgactgagggcctcatcatgagggtctgggtaccctcttatcatttaactggcacctgccaacccaggcctggagaatctgtctgcagtgctgtttgcatctcctcatcccttctttcccctcaccctcctccagcagag

SEQ ID NO: 2465 - DNA, 601 bp, Human
caaggtaccaccaactgggtgtcttaaataatataaattattgtctctctgggcacggtggctcacgcctgtaatcccagcacacagggaggccgaggcgggcagatcatgaggtcaggagatcgagaccatcctggctaacatggtgaaacctcgtctctactaaaaatccaaaaattagctgggcatggtggcaggtgcctgtagtcctagctacttgggaggcttgaggcaggacaatcgcttgaacctgggaggcggaggttgcagtgagctgagaccatgccactgcactccagaytgggtgacagagtgagactccatctcaaaaaaaaaaaaaaagaaaaattattgtctcacagactcaaggtacaggtgtcagtagggctgcttccttctgagggctgtgagtgagaatctgttgcatgcctctcctagctgctagtgatttgctggtgatctttggcgtttcttggcttctggaagaatcaagaatcattccgatctcagccttcatcttcactatggtgttcttcttgtgggcatgtctgtctctgtgcccaaatttcccctttctataaggacacagtcatattggctt

SEQ ID NO: 2466 - DNA, 601 bp, Human
agcggcatcactgccaagcagctaggggcttgaactgttgggacttggaagttcctattagtttcccagggctgccataacaaggtaccaccaactgggtgtcttaaataatataaattattgtctctctgggcacggtggctcacgcctgtaatcccagcacacagggaggccgaggcgggcagatcatgaggtcaggagatcgagaccatcctggctaacatggtgaaacctcgtctctactaaaaatccaaaaattagctgggcatggtggcaggtgcctgtagtcctagctacttgrgaggcttgaggcaggacaatcgcttgaacctgggaggcggaggttgcagtgagctgagaccatgccactgcactccagactgggtgacagagtgagactccatctcaaaaaaaaaaaaaaagaaaaattattgtctcacagactcaaggtacaggtgtcagtagggctgcttccttctgagggctgtgagtgagaatctgttgcatgcctctcctagctgctagtgatttgctggtgatctttggcgtttcttggcttctggaagaatcaagaatcattccgatctcagccttcatcttc

SEQ ID NO: 2467 - DNA, 601 bp, Human
catccaggttgaaattgtgaaagaatttcctgaagagtcctagagcggcatcactgccaagcagctaggggcttgaactgttgggacttggaagttcctattagtttcccagggctgccataacaaggtaccaccaactgggtgtcttaaataatataaattattgtctctctgggcacggtggctcacgcctgtaatcccagcacacagggaggccgaggcgggcagatcatgaggtcaggagatcgagaccatcctggctaacatggtgaaacctcgtctctactaaaaatccaaaaaktagctgggcatggtggcaggtgcctgtagtcctagctacttgggaggcttgaggcaggacaatcgcttgaacctgggaggcggaggttgcagtgagctgagaccatgccactgcactccagactgggtgacagagtgagactccatctcaaaaaaaaaaaaaaagaaaaattattgtctcacagactcaaggtacaggtgtcagtagggctgcttccttctgagggctgtgagtgagaatctgttgcatgcctctcctagctgctagtgatttgctggtgatctttggcgtttcttggct

SEQ ID NO: 2468 - DNA, 601 bp, Human
ttcttggctgaggtgcaagtatcatccaggttgaaattgtgaaagaatttcctgaagagtcctagagcggcatcactgccaagcagctaggggcttgaactgttgggacttggaagttcctattagtttcccagggctgccataacaaggtaccaccaactgggtgtcttaaataatataaattattgtctctctgggcacggtggctcacgcctgtaatcccagcacacagggaggccgaggcgggcagatcatgaggtcaggagatcgagaccatcctggctaacatggtgaaacctcrtctctactaaaaatccaaaaattagctgggcatggtggcaggtgcctgtagtcctagctacttgggaggcttgaggcaggacaatcgcttgaacctgggaggcggaggttgcagtgagctgagaccatgccactgcactccagactgggtgacagagtgagactccatctcaaaaaaaaaaaaaaagaaaaattattgtctcacagactcaaggtacaggtgtcagtagggctgcttccttctgagggctgtgagtgagaatctgttgcatgcctctcctagctgctagtgatttgctgg

SEQ ID NO: 2469 - DNA, 601 bp, Human
ggtgagaaggtgcagaaaaaaggatagctttgactgagggtgctggtcttgtatgagcaggaagtcctaccctgctctttgcagccagattcttggctgaggtgcaagtatcatccaggttgaaattgtgaaagaatttcctgaagagtcctagagcggcatcactgccaagcagctaggggcttgaactgttgggacttggaagttcctattagtttcccagggctgccataacaaggtaccaccaactgggtgtcttaaataatataaattattgtctctctgggcacggtggctcackcctgtaatcccagcacacagggaggccgaggcgggcagatcatgaggtcaggagatcgagaccatcctggctaacatggtgaaacctcgtctctactaaaaatccaaaaattagctgggcatggtggcaggtgcctgtagtcctagctacttgggaggcttgaggcaggacaatcgcttgaacctgggaggcggaggttgcagtgagctgagaccatgccactgcactccagactgggtgacagagtgagactccatctcaaaaaaaaaaaaaaagaaaaattattgtctcacagactca

SEQ ID NO: 2470 - DNA, 601 bp, Human
gtttctccactggaatgtaattaatgtgaaccaggatcttgtctatctgtttattctgtagcctcagtgcctagaatagtgcttggcacctggtaggtgttcgataagcacacatcaagttgtagaaaagtcttgttaaatatttcagctgtggagcattgagaatgcttggggtgagaaggtgcagaaaaaaggatagctttgactgagggtgctggtcttgtatgagcaggaagtcctaccctgctctttgcagccagattcttggctgaggtgcaagtatcatccaggttgaaattgkgaaagaatttcctgaagagtcctagagcggcatcactgccaagcagctaggggcttgaactgttgggacttggaagttcctattagtttcccagggctgccataacaaggtaccaccaactgggtgtcttaaataatataaattattgtctctctgggcacggtggctcacgcctgtaatcccagcacacagggaggccgaggcgggcagatcatgaggtcaggagatcgagaccatcctggctaacatggtgaaacctcgtctctactaaaaatccaaaaattagctgggcatggtggc

SEQ ID NO: 2471 - DNA, 601 bp, Human
gaggaacacctgcccctgcattgttgcccctaaatttcatgcatgaggagaagctgggcaaagggactggactgggcttggggtgtgcagctagaactgaactggggcaaaattaatttaggtttagggttaaggttgagacttctacctagtgctcttcacaactaaaaacccaggccttggaaatgttaaactatggtttttgttgttgttgttgttgttttgtatttttgatcataggggttgtggtctgtagattaaggggaagtgttgtctctgaagggaccagatacctccaatrtcaatgatcctgaaagaagtcaatcctgagaatgaggtctggaaaggtggttgttagagctaggacaaggtgaaattgtttgctccctctggccttgaagtctgacctctaggagactggggccaccaagggcacccctgtaggtgggagctgttccctgcaacgtcagcaagtcaagagcgaggcaaagacagatgtctagtggaggctgtgtggagagacttgagactatggaatagacatatctagccactaaaacataaattagattaagtaattcccttgcttaaaacttttctg

SEQ ID NO: 2472 - DNA, 601 bp, Human
tgtgttatttctccagcagttggatggagagaggagcttggatagagaggcatgtggaggaacacctgcccctgcattgttgcccctaaatttcatgcatgaggagaagctgggcaaagggactggactgggcttggggtgtgcagctagaactgaactggggcaaaattaatttaggtttagggttaaggttgagacttctacctagtgctcttcacaactaaaaacccaggccttggaaatgttaaactatggtttttgttgttgttgttgttgttttgtatttttgatcataggggtygtggtctgtagattaaggggaagtgttgtctctgaagggaccagatacctccaatgtcaatgatcctgaaagaagtcaatcctgagaatgaggtctggaaaggtggttgttagagctaggacaaggtgaaattgtttgctccctctggccttgaagtctgacctctaggagactggggccaccaagggcacccctgtaggtgggagctgttccctgcaacgtcagcaagtcaagagcgaggcaaagacagatgtctagtggaggctgtgtggagagacttgagactatggaatagacata

SEQ ID NO: 2473 - DNA, 601 bp, Human
gagaagtgttctgtttagcgatgtaaattgggtgaatcttttagcagatttatggctctgcagcttgttttcctgagaaattcttcctcactcactgtactttagcttgccagatactatgtattcttgacgtgttatgtgtgttatttctccagcagttggatggagagaggagcttggatagagaggcatgtggaggaacacctgcccctgcattgttgcccctaaatttcatgcatgaggagaagctgggcaaagggactggactgggcttggggtgtgcagctagaactgaactggrgcaaaattaatttaggtttagggttaaggttgagacttctacctagtgctcttcacaactaaaaacccaggccttggaaatgttaaactatggtttttgttgttgttgttgttgttttgtatttttgatcataggggttgtggtctgtagattaaggggaagtgttgtctctgaagggaccagatacctccaatgtcaatgatcctgaaagaagtcaatcctgagaatgaggtctggaaaggtggttgttagagctaggacaaggtgaaattgtttgctccctctggccttgaagtctga

SEQ ID NO: 2474 - DNA, 601 bp, Human
agacagaggttgcagtgagctgaaattgtgccactgcacgccagcctgggtgacagagagattccgtctcaaaaaaaggagatgttagtagcttagaacaggtgatggcagtacaatggacagtactagacatatgtgctaggcacttaagagatgagatcaataggaattggccatgggtttgtaagatgtgtaggttggggagacagctgtgagggtatagactcagcaaccagcataaccccaagagataggtcttactcacctgtcagggtggccctggtggttggaccaatgcccytggggaccagtacctcatgatattgctcacccgccagggtgctgtacacaaccttgtactcctgaacttcggcttcactgttatcccactcgaggtcaaggctggttgctgtgcgagaaccaactcgcaagttcttgggggcatcgatctctaaaaatagacagacatcaccaacatcgcacatgataatgtaatgtacatttgtggtgcatcttgaactctgaaaagattggtggtgacagcccacaccccctgaccctctggctcacatttgaatgaacactgtggctacccttagct

SEQ ID NO: 2475 - DNA, 601 bp, Human
cattctgcctgctgtcggggtggtctagataaaaatatggcctgcaatggcatcaacctatttaggattttccacctctgctctgtacagccctgagcagctcttcagaccacgggggaccgagcacaggtctgtggggaagagggtgactctgtcctgcctgtcagagatcaaggattaggcatagggtggatgttgtttctaggctgacagttgtcaccagagccctgttcactggaagacattgctttctgattaatttttgctgggacgagcctccatgactccttaggcttatagsctaacctggtcttcttcctcagcagtcctcctactcaccagtcctggcattcatggtggctggcacgctttgctgtgagttcatgacggcagatattccaactccatactcagtgccaggtaccagatctatcagtggatggagaaacaaacattattctgtgtatggggcagggctaggaaggctgaaagtgggaagaaaatgatcttagactcctattcataccttgtgtttagtcctccttgaatcctctcctaatttgaactattaagaaatcccaatttcactatttaggaatcc

SEQ ID NO: 2476 - DNA, 601 bp, Human
ggcgaggatgccccattctgcctgctgtcggggtggtctagataaaaatatggcctgcaatggcatcaacctatttaggattttccacctctgctctgtacagccctgagcagctcttcagaccacgggggaccgagcacaggtctgtggggaagagggtgactctgtcctgcctgtcagagatcaaggattaggcatagggtggatgttgtttctaggctgacagttgtcaccagagccctgttcactggaagacattgctttctgattaatttttgctgggacgagcctccatgactcmttaggcttataggctaacctggtcttcttcctcagcagtcctcctactcaccagtcctggcattcatggtggctggcacgctttgctgtgagttcatgacggcagatattccaactccatactcagtgccaggtaccagatctatcagtggatggagaaacaaacattattctgtgtatggggcagggctaggaaggctgaaagtgggaagaaaatgatcttagactcctattcataccttgtgtttagtcctccttgaatcctctcctaatttgaactattaagaaatcccaatttcac

SEQ ID NO: 2477 - DNA, 601 bp, Human
tccaaccctgaggctattttgacttgttctaaccatagccaggcaggcagctagatctgaggacctggagacttttgtccatgtggttctctagagaggctgaaccttgggacaaggactggtctaaaatccctagcccagcccaggctgctagtaccataggtgctgaaatgactttgaaatttacccaggatttggaagcaaaactgctgaatccagagcagcaagggtctcagctggacttttcttctgccctcagatttaatgggttgttgcaagtctagaccttcacccaagtggygtttgtgaggacctctgtggtgtatgcagggcgaggatgccccattctgcctgctgtcggggtggtctagataaaaatatggcctgcaatggcatcaacctatttaggattttccacctctgctctgtacagccctgagcagctcttcagaccacgggggaccgagcacaggtctgtggggaagagggtgactctgtcctgcctgtcagagatcaaggattaggcatagggtggatgttgtttctaggctgacagttgtcaccagagccctgttcactggaagacattgctttctgatta

SEQ ID NO: 2478 - DNA, 601 bp, Human
tgaggtctcggggactgtcaagttctgtggattgacataaatggcctattttacatgtgttcccctggagggcagtatttattggcctgctttgtgtgtttccaagctatcagcaggcctgctgactatgagcactagcttgtcattgctgacacttatctcatattttgctaagtaccttccctctgaatgatggccaggggcttggcaaatagatgaacaatctgaagaaagccgtgatgagctctgataccactggattgcatccacctctgggacaaagctggctgctgattttcargctcgccatattcattttctcccatcctttctcaatgagccaataaggataaaatggtagctaccaccaagtagggatatgccattcctggcaacagaagcgcaccaccctccaaccctgaggctattttgacttgttctaaccatagccaggcaggcagctagatctgaggacctggagacttttgtccatgtggttctctagagaggctgaaccttgggacaaggactggtctaaaatccctagcccagcccaggctgctagtaccataggtgctgaaatgactttgaaatttaccca

SEQ ID NO: 2479 - DNA, 601 bp, Human
agggtatcttaaaaccatggtcacgctgatgtttcacttgaaaccttgtaggtatgaccaaagctatgttcatggagaatattttaacaacatgaagacaagctggcaagctctgtacctgttacctatctgcaagccaactaggaactttttttttaagttcatatgttttgttttgaattgggagaaacataggcattttctctgaggtaattttttaagataaaccaaattttgcctgtatctcttattctttagcagccacctttggtttcagttttgaaaaactgcctattgactrtacagggatttcagagcacaagtccagaacaaatccattttcctaaattgtatttcatttatgctatgggctttttttttttttttactgctaggggatcacagagttgatcagctaagtgtttaatctacttgtccagtttgtgagttcttgttagtaaggaggaaactacccaaacatacatatcttcacccacatgtacctcatatttgaaactgtgtttgggaataatgagctgggactgatccaattcatctctgagtgcctgtgttttctaagcaacatccaaatcaaccccat

SEQ ID NO: 2480 - DNA, 601 bp, Human
ttgcacactggtctcactccttcattttatgggctccttggagcaaagaaaaatgacctacctattaagtggttttctaacaagctggtcttctctaagacaatgacattaaggcagtgtagagggcaccgatgcaaggagcagtccccacagtccagagacagtgtagtctggaatgctgtcctgtgtcctcactggaagtgagtgtgccctccacttccttaaaaatgccacatgtaccagcaagaactggcaggatgcaggtgaggtctgggccagtttcctctgactcataacttgwctggagtggctgaaatgggaccacatcactgtgcttccctccaaggctccatctggctttgctgggtctttagccatccctctggatcctagtcttgaacttcattcttgtaggaatattcatgtgacccaagctcttggcagattcttttggggctctttttttctcaagacactgcctagataatggtgatcagttacctctgctagtgaagggcctgctctctgggtgaatgtaatcaagcctttctcaagaggcattggtgagtgtggggtttcttggctgctcaccagcccactc

SEQ ID NO: 2481 - DNA, 601 bp, Human
gttcagtctggtgatggtgaattctgtcacagtgttgggcaccactgagctgtctagtcgtcccactggagaagagaagaatctacagttaaaattcagcagccctttcatccaagcagcccatggtacagtctatgtcaataaagcacagatgggtgtgggactccgcactcagtggggagggatgatacatggttcatgggctgggaatgttggagtgtgaagaggctttgcacactggtctcactccttcattttatgggctccttggagcaaagaaaaatgacctacctattaagtsgttttctaacaagctggtcttctctaagacaatgacattaaggcagtgtagagggcaccgatgcaaggagcagtccccacagtccagagacagtgtagtctggaatgctgtcctgtgtcctcactggaagtgagtgtgccctccacttccttaaaaatgccacatgtaccagcaagaactggcaggatgcaggtgaggtctgggccagtttcctctgactcataacttgtctggagtggctgaaatgggaccacatcactgtgcttccctccaaggctccatctggctttgctgggtctt

SEQ ID NO: 2482 - DNA, 601 bp, Human
tgttttcaagagggaggccatgggatttggactacctttcctcactttcccatattgcaagccagtctctcccttgcacctcccttcctctggtcattatgtaggagctgatggaggatgcagaagacatctggatctgactagggggcctgtcagagacatgagctacacggtgcccctgcaggcagcccaggatgcacacggagccacatcaccttcactgctttggtcccgggtgagggagttatggccactttggtgccttctttctccctggagcacaaagcaagagcaaaggcascttcttggtggtttctggctatatctgatgatgaatttcatgaccccattccattactggaataacaacccttttcttctcgaggtgaaattttctcatctgagtcttttacaaaatcagatgaatgattcagatatctgttttagaattcacttccattatatgtctgaaagggcactgtttatgttggaagttccatgaaaattcctaacctaaaccagcaagacttctagagggtgactctctaaacgtttagtattagggaggaatattgggggagagaaattgcaaattgccctg

SEQ ID NO: 2483 - DNA, 601 bp, Human
agtttagttatcagctcaacccaagtgtcataaaatttacttttgagaaccaagatctgctgtggatcttgccctattctctaattgaaagtatttttttcacttgcctatgtcctttatcacaaagaaacaacctgcacaatattttcatgttaaaattggaattgtatccataatctgcatgttcaaagagttcttcaaatgcagcccttagactacacttggcttgatctatctgagacatgcatgataccacgagacaaacatgacaccctgaaggagcactcacttccaaaagttktaagatcatagacctcaacgtaaaaccacaacaaacatacaacagcaaaataagacattctggggcaatctagttattggaagttgctaaaatagctctgcctagacttaaaggagggcagtttggatgggcataccatttgggttggtgtaccaaatatctgctttagagatactagctgctcatgacccaaggatttttttttcttttgagagacaaggtcttgctctgtcactcaggctggcatgcagtggcatgatcatggctcactgtagccttggactcctggattcaagcgat

SEQ ID NO: 2484 - DNA, 601 bp, Human
ggtcaaaagggcctgttagaggaaaagattgtgcttgtcataggatcatcttcctagtcttacttgcccatgctctaagtctttgctttattactgtgcttctcttccatcaggttataatttatcacaagtggatgttattacaacagtttagttatcagctcaacccaagtgtcataaaatttacttttgagaaccaagatctgctgtggatcttgccctattctctaattgaaagtatttttttcacttgcctatgtcctttatcacaaagaaacaacctgcacaatattttcatgtyaaaattggaattgtatccataatctgcatgttcaaagagttcttcaaatgcagcccttagactacacttggcttgatctatctgagacatgcatgataccacgagacaaacatgacaccctgaaggagcactcacttccaaaagttgtaagatcatagacctcaacgtaaaaccacaacaaacatacaacagcaaaataagacattctggggcaatctagttattggaagttgctaaaatagctctgcctagacttaaaggagggcagtttggatgggcataccatttgggttggtgtac

SEQ ID NO: 2485 - DNA, 601 bp, Human
tgcgtgggctcagtcaggttgcctcaaaagtcatatctgattattggatgattgcttcactgctcacaagtctcactcaggactgagtccttggtattctttttgttgcattaagagtcaagaggattcttccaggcttaggtaggtcaaaagggcctgttagaggaaaagattgtgcttgtcataggatcatcttcctagtcttacttgcccatgctctaagtctttgctttattactgtgcttctcttccatcaggttataatttatcacaagtggatgttattacaacagtttagttwtcagctcaacccaagtgtcataaaatttacttttgagaaccaagatctgctgtggatcttgccctattctctaattgaaagtatttttttcacttgcctatgtcctttatcacaaagaaacaacctgcacaatattttcatgttaaaattggaattgtatccataatctgcatgttcaaagagttcttcaaatgcagcccttagactacacttggcttgatctatctgagacatgcatgataccacgagacaaacatgacaccctgaaggagcactcacttccaaaagttgtaagatcat

SEQ ID NO: 2486 - DNA, 601 bp, Human
agaagatccacccatggaatgactgcgtgggctcagtcaggttgcctcaaaagtcatatctgattattggatgattgcttcactgctcacaagtctcactcaggactgagtccttggtattctttttgttgcattaagagtcaagaggattcttccaggcttaggtaggtcaaaagggcctgttagaggaaaagattgtgcttgtcataggatcatcttcctagtcttacttgcccatgctctaagtctttgctttattactgtgcttctcttccatcaggttataatttatcacaagtgsatgttattacaacagtttagttatcagctcaacccaagtgtcataaaatttacttttgagaaccaagatctgctgtggatcttgccctattctctaattgaaagtatttttttcacttgcctatgtcctttatcacaaagaaacaacctgcacaatattttcatgttaaaattggaattgtatccataatctgcatgttcaaagagttcttcaaatgcagcccttagactacacttggcttgatctatctgagacatgcatgataccacgagacaaacatgacaccctgaaggagcactc

SEQ ID NO: 2487 - DNA, 601 bp, Human
acctcacccactggtgccttccactgcagcagggcttctgttggagtgatattggtagcaatcagatccacagggttgtccatggctgaaacagaatagattatcagttacagataagaggagctgcaggatagaaatgcagggaatgatctcagaagttccactcatggtgcaagactgctgctgcactctacaaaacaaagaagtgagcagaaacctcttccctttctcctcttctggttccatcagcctcttccatttctccctgcctcccttctctcaagtatccagttctcccccygtcgcccccagctcttccttttaattaattcaataacttcttatgtgcagaatactgtgccagatactaaagaggatttcaagatatggctggaatgaattttcaacatttaaatctagatggagcaaccaagaacccacagaaattgttataattttttagttaatgagataatcatacttcccaggctatttgcacttttataaatgtaagggtgtgcctcatggaaagatctctgttgaagagcttcaggaagtgtggtggcaactccataggggcaggagtatccccaggacagag

SEQ ID NO: 2488 - DNA, 601 bp, Human
ctgagtttcatcttcctagggctattgctctgtttttgtacttgcccttggttacatgcctttcttgtacctttcagattcagctttctcagctcctagatttgatacagtttgcagagtttggggatatcttctttttttttttttttttttttttttttttagatggagtcttgctgtgactcccaggctggagtgcaatggcgtgatcttggctcactgtaacctccacttcctgggttcaagtgattctcctgcctcagcctcccaagtagctgggactacaggtttgcaccaccasttccggctaatttttgtatttttagaagagatggggtttcaccatgtaggccaggctggtcttgaactccttacctcaagtgatccgcctgccttggcctcccaaagtgttgggattacaagtgtgagccacgatgcccagcatagagtttggggatatcttgagggcttcatagtatacctgaagtaggaacttttctaatctgtccttcagattgaaaaaatgttttgtttattcacatcatactggtctgcagctccaattcccaccattcccacctgcctgatctgcaggcctgca

SEQ ID NO: 2489 - DNA, 601 bp, Human
aaaaacacggaagagtttagcagtcctgaatcttttgtcacctgttagcctgtactctctgtttcaaacttggtcctatatcttcagtgtttttcttgctctgcgaatatttagaaaagcctgctttcttgtttgtagcattttgggggcaagtcttagctctgttctgagtttcatcttcctagggctattgctctgtttttgtacttgcccttggttacatgcctttcttgtacctttcagattcagctttctcagctcctagatttgatacagtttgcagagtttggggatatcttcyttttttttttttttttttttttttttttagatggagtcttgctgtgactcccaggctggagtgcaatggcgtgatcttggctcactgtaacctccacttcctgggttcaagtgattctcctgcctcagcctcccaagtagctgggactacaggtttgcaccaccacttccggctaatttttgtatttttagaagagatggggtttcaccatgtaggccaggctggtcttgaactccttacctcaagtgatccgcctgccttggcctcccaaagtgttgggattacaagtgtgagccacga

SEQ ID NO: 2490 - DNA, 601 bp, Human
taaaacttattcttggtgaatctgtgctgctatatggtaatcactaattccttttccaagttgtttaattgtctgttttagtttttaccttcctaagctttgacaataagtttacttctttgcagctcacagaattagctttctctgtcatttttgaaaaccaagacatctgcctgccttctgtcttctggtatctttgttctctggattcctgaatataacccaaaacaattctgtgatcacatgtttgatgaaggcagggaaataacttccctaagcctagagacttggaggactcaaytctattttgctttgggcttctctgttctgttcaacttcaaatggtgtaaggtgaacaagcatgatacagaagacagtgaacttcaagatttcgtgttagttaaacctgttgggctggatatgaatagagaagacaaaaacacggaagagtttagcagtcctgaatcttttgtcacctgttagcctgtactctctgtttcaaacttggtcctatatcttcagtgtttttcttgctctgcgaatatttagaaaagcctgctttcttgtttgtagcattttgggggcaagtcttagctctgtt

SEQ ID NO: 2491 - DNA, 601 bp, Human
catagtagcccactggacatggcccatggtgttctgtgcatgtctatagcatacactgctcacatcaagttgtaactatttacttctctgcaacatcattagaagtgagttccataaagatgagagctcaatttttgtttctgaatccttatagccttatagagtgtgtggcacatgggagggcatcaaaagtatttgtggaatgaatggaagttcattgctctgttagagctgtgtgtttagtgtctgtgagcagatgtgtctgactgccttcagggaagctttgacagaagagataggkttgaaaccacgacttgaaggatgggttttctaggcaggcaaatgggggagtttcctggtgaaagaaatagcatgtgcaaatgcatggaggcttgagaaagcatggtgataattaaaaaatgcgggatcatgttatgaaaggaggggtgacaggaattgagatggattgtgcatgctcacagaggggttaggacatacccatagtaatgctatcccttcttcatggagggtcattcattcagctacagtcccagctacctccaaatatgacctttcatgtatttttccatgttaactaagg

SEQ ID NO: 2492 - DNA, 601 bp, Human
aaaattcaaactaatgcttaagctttggaagagcatgtataaggatatcatctttttaatgtccccctttgcacatcatgccattgattaatgctccagccataccaaactatggtagttcttcagacttcttacactctcacatctctgcaaatgcccacagtctgctctttttcttgaaattccctttcttctccttttcttctttcactttatctaagacttttcttctttctttccctccacaccttgaccctattcatagtagcccactggacatggcccatggtgttctgtgcaygtctatagcatacactgctcacatcaagttgtaactatttacttctctgcaacatcattagaagtgagttccataaagatgagagctcaatttttgtttctgaatccttatagccttatagagtgtgtggcacatgggagggcatcaaaagtatttgtggaatgaatggaagttcattgctctgttagagctgtgtgtttagtgtctgtgagcagatgtgtctgactgccttcagggaagctttgacagaagagatagggttgaaaccacgacttgaaggatgggttttctaggcaggca

SEQ ID NO: 2493 - DNA, 601 bp, Human
cttttctctgaacacgtaacagtttatcaatgtccctgctaaagtccaaaactcagagaactgagaataatggagaggtactgaccaatgaaataaacagggtcagtctgtgcttgtgccacttatattaattagtaaggttttgggaatgccatgtgatattgttatcacatgccaagattattgctaatcaaagatcttctttgtaaccactccccctacctctcaatccaattttgttagttgattttttatacccatggacagagctttgcatttatttctattgcattttgcctcrttgattgagttttgggccactgtttcagttgattaaaatatttttgaacttggattctattgatcacaattttgttttatacacaaatttggtaagcatgtcttctctgaattcattcaagctgttgataaaactgttcattagttcagggccaactcctctgttgggcaattagaatacttggaaattatttaatatttaacagtttactaggcacattttcagaataggtagggctttgagatttcaagtttcttgtggtctaaaggcatacaaacaagttaaaattcaaactaatgc

SEQ ID NO: 2494 - DNA, 601 bp, Human
ggccaggctggtctcgaactcctggcctcaagtcatcacccgccttggcctcccaaagtgctgggattacaggaatcagccactctgcccagcacctccactgctttattagagatgcatttctcagcaggcaagatccttgggcccaacagacccgcgactgcctttccccagcactctcctgcttaactgtcctttcctcctccttctgtgaggacagatatagttattcctttccctgcctggccagatatatgattggactctgaacatgggccttgagggcaatgaggagccccargatggacatgtggggggtgataaaaggatggccaggaggatggtgaagttggcttggcaggtgctgagctaggtagactagaacactgaggacgcttctgtgcaaggagagcacagattgtacttacaatccagccgcccccgtcggtggtcatatcacagtacacttgtaatttctggctcagctccccattgaggaagatggggtaaaccccactcaaagtgtctccattcatcaaatgctgggcacagtcttggggatgagggaacacccggcctcctgcaaggaaaatagacaatg

SEQ ID NO: 2495 - DNA, 601 bp, Human
catggtctcgtctcactacaacgtccgcctcccaggttcaagtgattcccctgcctcagcctccagagtagctgggactacaggcatgtgccaccatgaccggctaatttttgtatttttagtagagatacaggatttctccatgttggccaggctggtctcgaactcctggcctcaagtcatcacccgccttggcctcccaaagtgctgggattacaggaatcagccactctgcccagcacctccactgctttattagagatgcatttctcagcaggcaagatccttgggcccaacagasccgcgactgcctttccccagcactctcctgcttaactgtcctttcctcctccttctgtgaggacagatatagttattcctttccctgcctggccagatatatgattggactctgaacatgggccttgagggcaatgaggagccccaagatggacatgtggggggtgataaaaggatggccaggaggatggtgaagttggcttggcaggtgctgagctaggtagactagaacactgaggacgcttctgtgcaaggagagcacagattgtacttacaatccagccgcccccgtcggtggtca

SEQ ID NO: 2496 - DNA, 601 bp, Human
aaggggagccagctatccatgtttggggcctcatctgctttcccaactgcaatcctcaattggaggcttctgatcatctctctgtggtggtgatcacctcctcatagagaaatagttttcctcaactgcctgtttgtttgcttgtttgttttgttttttgagtcttactcactctgtcacccaggctacaatgcagtggcatggtctcgtctcactacaacgtccgcctcccaggttcaagtgattcccctgcctcagcctccagagtagctgggactacaggcatgtgccaccatgaccrgctaatttttgtatttttagtagagatacaggatttctccatgttggccaggctggtctcgaactcctggcctcaagtcatcacccgccttggcctcccaaagtgctgggattacaggaatcagccactctgcccagcacctccactgctttattagagatgcatttctcagcaggcaagatccttgggcccaacagacccgcgactgcctttccccagcactctcctgcttaactgtcctttcctcctccttctgtgaggacagatatagttattcctttccctgcctggccagatata

SEQ ID NO: 2497 - DNA, 601 bp, Human
gaaataaaaaaacaaaaaacaaacaaacaaaaaaacaaaacccaaagagatgctaaggaaaataaactgtgataagtaaaattgatataactgggttttatatctgcaatgacaaagatgtccaaagaaggaacatttcagagcagagctcagtatttacacagcagtttttgtaggagacactcagagcatttctcttgaagtgtagaggcccctgatgaataggctccagtgtgatgttgacactaatttgcacccctgcaatgtagaaaggactcaggatacatatcaagccctaaayatcaggggaaataggcttggctctcaaacgaatcttttgcactacagagtgcagtagaaagcatttctcaccaaaagaacaggaccaacttcaaatcagctagtaactgtcatcgtcctattgcaggcaaagcaatattgcatatcattcactttctgagctgtttaagtgcttattttatttagcctccaatatatcagccttggcttcaatttccagttatgctttaagaaggaggcacacatatgtcagaaacataaaagaaaatgtctcccaagagtagctgttatgagcacatca

SEQ ID NO: 2498 - DNA, 601 bp, Human
atgaaccaacctttgcaaagatcatgacagtgagagaaatctaacatggctgattccttgcttctggcctcactggctggctgccctcctcactcatttctgggcataggccaagctaaccatgggaggaatttagtttatagtttaattttaaagcaaggatgataatagtcctccctgaaactgctcccctcctttttcagggactgaaactacctttgcaagactaacgaaaggccaagagattaggattacggagggatttgagttctgctaaaatgtaggcatagtttctataatyccttactgctcagggtcatgtggccagagatttgtgactttcctagttgctcctatagataacagcactattgcagattggtcttttgagatgtttttcagacttttgcattcaggcaacgaagtgaccccacctggaccagtgacacatgactcaactgggcctgcagcccccacccagatgcagactcagggcacgaggaccattttccacactcctatgattttatccccaaccaattggcagcacccattccctagccccctgcccaccaaattatccataaaaaccctagcttct

SEQ ID NO: 2499 - DNA, 601 bp, Human
tagctgtgtctctgaatatacacagatggcactcaccacacaaggaatgtggggaaaggaggacagttggctaggagtgctcctggcagaggaagcatcgggggttttgcatgtgtggagtttggtgttggagaggagtcgggggaagagcaggtgaggtacttagggtgtagaggagtcttcagaggctggtgagagagggcctgtactttggctaaggcattgggccttctcctggtggtaatgtggagtcattgaaaagttttacaaaggggattagccatcgcccatatttggggtrtgaggaagatcattatagtggtcatgaaccaacctttgcaaagatcatgacagtgagagaaatctaacatggctgattccttgcttctggcctcactggctggctgccctcctcactcatttctgggcataggccaagctaaccatgggaggaatttagtttatagtttaattttaaagcaaggatgataatagtcctccctgaaactgctcccctcctttttcagggactgaaactacctttgcaagactaacgaaaggccaagagattaggattacggagggatttgagttctgctaa

SEQ ID NO: 2500 - DNA, 601 bp, Human
ccttccttccttccttccttccttccttccttccttctttcctgcctcccctcctttccctccctccctccctcccttccttcctttctttctttccttcgacggaatctctctctgttgcccaggctggagtggagtggcacaatctcggctcactgcaagctccacctcccaggttcacaccattctcctgcctcaacctcccaagtagttgggactacaggcacacgccaccatgcccagctcattttttgtatttttagtaaagatggggtttcaccgtgttagccaggatggtctygatctcctgacctcgtgatctgcccgcctcagcctctcaaagtgctgggattacaggcgtgagccactgtgcctggccgatattttcttatatacattttcttgcctgcttgtcatgattagccatgccctgggactctccaattttgatctacctgcccaaactttgaaccattcatcttgtgttgctggtaatttctctgagtcctaatttttatctgcttactgaactagagtccccttgctttgctgtgacatctgatctctacttgagtatgccgtgatttagaatcaaacaatt

SEQ ID NO: 2501 - DNA, 601 bp, Human
cttccttccttccttccttccttccttccttccttccttccttccttccttccttctttcctgcctcccctcctttccctccctccctccctcccttccttcctttctttctttccttcgacggaatctctctctgttgcccaggctggagtggagtggcacaatctcggctcactgcaagctccacctcccaggttcacaccattctcctgcctcaacctcccaagtagttgggactacaggcacacgccaccatgcccagctcattttttgtatttttagtaaagatggggtttcaccrtgttagccaggatggtcttgatctcctgacctcgtgatctgcccgcctcagcctctcaaagtgctgggattacaggcgtgagccactgtgcctggccgatattttcttatatacattttcttgcctgcttgtcatgattagccatgccctgggactctccaattttgatctacctgcccaaactttgaaccattcatcttgtgttgctggtaatttctctgagtcctaatttttatctgcttactgaactagagtccccttgctttgctgtgacatctgatctctacttgagtatgccgt

SEQ ID NO: 2502 - DNA, 601 bp, Human
tctttctctctctctttcttttctttctttctttcttttctttctttcttcctttctttctttttctttccttccttccttccttccttccttccttccttccttccttccttccttccttccttctttcctgcctcccctcctttccctccctccctccctcccttccttcctttctttctttccttcgacggaatctctctctgttgcccaggctggagtggagtggcacaatctcggctcactgcaagctccacctcccaggttcacaccattctcctgcctcaacctcccaagtagytgggactacaggcacacgccaccatgcccagctcattttttgtatttttagtaaagatggggtttcaccgtgttagccaggatggtcttgatctcctgacctcgtgatctgcccgcctcagcctctcaaagtgctgggattacaggcgtgagccactgtgcctggccgatattttcttatatacattttcttgcctgcttgtcatgattagccatgccctgggactctccaattttgatctacctgcccaaactttgaaccattcatcttgtgttgctggtaatttctctgagtcctaat

SEQ ID NO: 2503 - DNA, 601 bp, Human
aatttcaagagtcataaaaatgttgttaaaattatacaccagcatttaaccctagaattggtgttaatgaaagggccaataatgccaagtatcaaacattagaatatttgaaaaagcaggttttgtgaaatgtgttataatagaacatgggaaacagattggcaaagcccaagaagcagactgggtgttatgttctgaaaaaactactaatgcaaccaagcttgatgggatggttgttctgcttggtagaaatgctgtaaaaatctacacagaaaacctgactgtctatgtggttcttgcrgaggaatgaaaagaaacatggcaaatgaggaacaggtaagtggcattgtttgctccttgactaggtgttagcatgactgctgatggacagggtggggtgttaggggcatctcagagaggggtgacatctgtatgatttgcactaattcaaagatggttttcctggatgtcattgcatgggagatttctacccagacagtagatgattctgctctcactgcataagagcccatagtgactaatctagacaaagaaaacaatccttcttcatcttcacattgcatcttttttaaaccttaaa

SEQ ID NO: 2504 - DNA, 601 bp, Human
tgcagcagccatcagccgctctatgttcttcgctcggacttactttatcctgtttgtggctgtcacaggaatcttcctaaaccccacttctatttttcttcttgggacctacaatggccctccagtgctaccatgttaagactgaattcctctgccccttggttttccagcttctggatctggctctacctgcctcaccaatcttctctattcctcctgaatttacattttgccctgctctgccagtcccttcacagcctcccctcctccacagcatctgctccttctgtaacttccaggktttattttccttaccatgggaatcccagtcgaatgcagctgcctttatgatgccgtcctccaccacccagactcctcttccacgaacaccccttaaactagaaatgagatgccagatgcagtggctcacacctgtaatcccagcactttggcaggccgaggcaggtggatcaccacaggacaggagctcgagaccagcctggccagcatggcaaaaccccatctctactaaaaatacaaaaattagctgggcatggtggcatgtgtctgtaatcccagctactcaggaggctgaggcagt

SEQ ID NO: 2505 - DNA, 601 bp, Human
atttccaacattagtcaagactcctattgtctcctattaggtctgatgcagcagccatcagccgctctatgttcttcgctcggacttactttatcctgtttgtggctgtcacaggaatcttcctaaaccccacttctatttttcttcttgggacctacaatggccctccagtgctaccatgttaagactgaattcctctgccccttggttttccagcttctggatctggctctacctgcctcaccaatcttctctattcctcctgaatttacattttgccctgctctgccagtcccttcayagcctcccctcctccacagcatctgctccttctgtaacttccagggtttattttccttaccatgggaatcccagtcgaatgcagctgcctttatgatgccgtcctccaccacccagactcctcttccacgaacaccccttaaactagaaatgagatgccagatgcagtggctcacacctgtaatcccagcactttggcaggccgaggcaggtggatcaccacaggacaggagctcgagaccagcctggccagcatggcaaaaccccatctctactaaaaatacaaaaattagctgggcat

SEQ ID NO: 2506 - DNA, 601 bp, Human
ataacagtttataaaacttatagcaggatcaggatttgtggctcaggatgttgtgaagggggctcatgctacttattgaatgaaagaggtcttgggtgcttttgagcttgtgttaagcgaggaaagacctattctgattctgtggcttctgagtccaggctcacagggccactcaatgcctctgatgcctcccaccacaacttaactctcaggaggttgacctttattttatagggaaggctgacgccctcactggggaggccctaactcaacatgacatgatcttcattccgtcttcttygtcttccccttccagtctccagggactcagatttttatgcccatctagagttaaccccaccatctgcaactcactctttcccatctcttccagatcctggaaaagttaaaacatattgcttactttttcctttttcttttatttatttatttttttggtgtgagacagtctcgctctgttgcccaggctggagtgcaatggcacaatcttggttcactgcaatctctgcctcccaggttcaagcgattctcctgcctcagcctcccaagtagctgggattacaggcatgcaccaccacac

SEQ ID NO: 2507 - DNA, 601 bp, Human
acaaacctgcacattgtgcacatgtaccctagaacttagagtgtaataaaaaaagagaggcatatttaggctaaatatacaaggataaattacctaaatattagaggtgttcacaagtggaatagactgcttaaagaggtggtgagatttttattctgaggggcaaacaggctgcgtgttctcttttggggatattgtgcagggggctcaggtaaattgtgtatttaaggtgagggatcagactgtaattaaattataacagtttataaaacttatagcaggatcaggatttgtggctcargatgttgtgaagggggctcatgctacttattgaatgaaagaggtcttgggtgcttttgagcttgtgttaagcgaggaaagacctattctgattctgtggcttctgagtccaggctcacagggccactcaatgcctctgatgcctcccaccacaacttaactctcaggaggttgacctttattttatagggaaggctgacgccctcactggggaggccctaactcaacatgacatgatcttcattccgtcttcttcgtcttccccttccagtctccagggactcagatttttatgcccatc

SEQ ID NO: 2508 - DNA, 601 bp, Human
agacatggcctgtgatcactgtcaccaaatatttgatgggctattgagaaaaaaattaaataaattctgtggggaagtatgaggattagtaggtggagatgaagacatttatgcagccaacagacacataaaaaatgctcatcatcactggccgtcagagaaatgcaaatcaaaaccacaatgagataccatctcacaccagttagaatggcgatcattaaaaagtcaggaaacagcaggtgctggagaggatgtggagaaatagaaacacttttatactgttggtgggactaaaaactakttcaaccattgtggaagacagtgtggcgattcctcaaggatctagaactagaaataccatttgacccagccatcccattactgggtatatactcaaaggattatcagtcattccgctatagagacacatgcacacatatgtttattgcagcactattcacaatagcaaagacttggaaccaacccaaatgtccatcaataatagactggataaagaaaatgtggcacatctataccatggaatactatgcagccataaaaaagaatgagttcatgtcctttgcagggacatggatgaagc

SEQ ID NO: 2509 - DNA, 601 bp, Human
ccacccagtttctcagagtggctgtgctgaactcttactccaccttacccctggggccaaccacttccatgctactctctccaacccacttcctaatccctttgaccacctttgctgagaattttctccacttaaccccatctcattgcccaccccacccccaaccctcagctgtttcctcccagcctgtacgtggacacaggccactcatggttcctcctgtcttcagaggagatggtgatgagccaggcagacttgggccattctagggcaccaccatgcagcctcagcctggcttctmcctggcttaccaggcctgctcagatgacacccaagaaactgcattctgaacttgaggccacatgggaagaggggcatcagcaaattagaattcccatccgtaagaaacaggatgatgaaaaaaacataaccatgtcaaaggagaagtgcttgggacatctgggctgtatcttggggaagagcggacttcaagagggagacatggcctgtgatcactgtcaccaaatatttgatgggctattgagaaaaaaattaaataaattctgtggggaagtatgaggattagtaggtggagatgaag

SEQ ID NO: 2510 - DNA, 601 bp, Human
tggtctctgatagggaaagattgtccagttcacactggtattttcgatgtctaccttcctgggaccatttttagggtaaagttgagtctgtgaagctgtccccaggactgataagctctcttcatgggatcttctggatccaagggcttctctgggtaagttctggctcctgggtcctttcctttccttcctctggcttctactctgtcctgatcttatcccattgtctgcattatttttctcaagactcaaaatatttctttttaaagggaaatgaaggactcacatgtgcttttaaaayataaagctaagggagcacggattccacagctctggctcattcatagcagaggtggagcatcgcttacctgactgtgcctggactccccgtacttcccattgaggttggtccggtggcagttcttataccaccatgctcccttgtacgacatggcacagttagtcactgcaacatcattgtctctatcctctgtggagaaagggcgtccttgatgatagctgagggagtcccctgcaaaaaagatacattcattaggctgtcccatttgtcactgctttatcaggattttctggacacttg

SEQ ID NO: 2511 - DNA, 601 bp, Human
cttccttcacatactcttaatatgttgcaaaacacattgctattaccctccccccttgtttcatattataaaatacaaacaaatgacagaaaatattggttggcttgcagccgcccactgctcagaactgtaaggactgccgttttctccctgccatgagacggtggttgtaggggcgcatcttcatttccacaaaggggatggagaactcatggcctttccaatggtaccagttgatgccctgggcgtgagaaagataagcatgtcaggtcatcccccaccatggaacgccccacttcawaaaaggggtaattatgggaacagggaatccacaatgtggggttagctattttcagctaacatgaagcttcaaggccgagttcccaataaagtgaaaggggcagagtctctttctagctttctccttaaatgtgccggtggcctgggtctttccagggaacatgttgcaggtcattccttattgccagctttgtttttggcttccaggagtggcatgcaccagtagatggttgtgaaatcccaacagggtggaagcatttggaagagaataactgtgtttgactgctcactcctaatggga

SEQ ID NO: 2512 - DNA, 601 bp, Human
gccatctagtggcccaccctgggtgtaggcacccccagggagctggcctgcgggcctgcattcaggccaagagaaggcagagaaatgcctctggagcctgggaaataccctcagacctggctggtttcccaccccctccatcagagacccttaccattctgcaattttgattcctagttaagcctctcctaggccccactactcaattaaaagcccccattagaccaccctggagtcatggccccacactcctacctaagggagctgagtttttgctccaggccctagacccgctctccamccatggcaacagactttagagaccactcctccagtgaaattccctctcattcttccctcccacctcccaaactgtgcctttccccagataactctgtagtattgtccagaagtcctgttcttctagctcacccccttccccaggaacttctgatcccatttatcttcagagaaccccagggttggtcttgataagtgggttctcgcaagaggactccagacattgtgctccttacaggcagccattaataaaaagcctttggcacttaatccttagctgggaggggaggggattccacag

SEQ ID NO: 2513 - DNA, 601 bp, Human
accccttctttatcaggctttctgcccacccatcgcctggagccccggcctgaaccccggcccgatccccggcccggccctgagcttcccttgcccagcatccctgcctggactggtcctgagattcctgaatcaggtttgctagaaagaactgagggcattgggcctgcagcagtggctcacgcctgtaatcccagcattttgggaggctgaggagggtggatcaccaggtcaggagttcgagaccagcctggccaacatggcgaaaccctgtctctactaaaactacaaaaattaactrggcgtggtggcagatgcctgtaatcccagctacttgggaggctgaggcaggagaatcacttgaacccaggaggcagaggttgcagtgagctgagatcgtgccattgcactccagcttgagcgacactccatctcaaaaaaaaaaaaaaaaaaagaattcagggcattgatgggggtattacaggtgggattctggggtaaaagactccaaggtgaagattccaggttacagcaaataggaatggtatgggcagagataagcgtttgaagggttgggtggtagttagatcaggagctggag

SEQ ID NO: 2514 - DNA, 601 bp, Human
cctggtcaccttgtcaccagccccctccgtgtcctcagatgtggacgaatgtcgccgcgtgcccccgccctgtgctcccgggcgctgcgagaactcaccaggcagcttccgctgcgtgtgcggcccgggcttccgagccggcccacgggctgcggaatgcctgggtgagaaatttgccccacccggctccaggcccaccccagggtctcgctcctgctctcactccagagcctctccagccctcccacgcttcccctctcgggtcccgccccaggactgctctgccctggcccttggcccygcccttccctgacccgcctccacccagctccagcctccctttgaccccacccctacccagctcccaaactgccagtttctatcggggcctggtcgcaactcgtattgctccgcccccacgcccaggccccgcccttattggccacgcccctccctgactaactccctcccccaggccccgccactgtcctgcaactgcggcaaccaatctcctgaccgcgaccccgattccaaccctgccacaccagagccctatccccaaactgctcctttcttctctagcccctaccccaccttccct

SEQ ID NO: 2515 - DNA, 601 bp, Human
cccctctcgggtcccgccccaggactgctctgccctggcccttggccctgcccttccctgacccgcctccacccagctccagcctccctttgaccccacccctacccagctcccaaactgccagtttctatcggggcctggtcgcaactcgtattgctccgcccccacgcccaggccccgcccttattggccacgcccctccctgactaactccctcccccaggccccgccactgtcctgcaactgcggcaaccaatctcctgaccgcgaccccgattccaaccctgccacaccagagccstatccccaaactgctcctttcttctctagcccctaccccaccttcccttagcttggtccccaaagctctcctttctgcccttgcgctaccaaaccctgccctccacaattgcctctctcactgtgcccctctccggctgtcctggccgggtccccatcctggctctggcccaagcttggtcccgctcccgcttccctctacccctgcctccttgcgtcgcttctcccggggctgtctgccccagtcccagccgcctggtctgtgcctacagatgtggacgagtgccaccgcgtgccgccg

SEQ ID NO: 2516 - DNA, 601 bp, Human
acaccagagccctatccccaaactgctcctttcttctctagcccctaccccaccttcccttagcttggtccccaaagctctcctttctgcccttgcgctaccaaaccctgccctccacaattgcctctctcactgtgcccctctccggctgtcctggccgggtccccatcctggctctggcccaagcttggtcccgctcccgcttccctctacccctgcctccttgcgtcgcttctcccggggctgtctgccccagtcccagccgcctggtctgtgcctacagatgtggacgagtgccacsgcgtgccgccgccgtgtgacctcgggcgctgcgagaacacgccaggcagcttcctgtgcgtgtgccccgccgggtaccaggctgcaccgcacggagccagctgccagggtgagggcctgggaggggcagctgggaaggggtgtgagcggttgggtagagcgcagtgatgagggccagagagactgaacaatagggcaaagcgagttgatttggagacagaggccaggctctcgagcagacgtgtggcctgatggcagtagagagagacctgggatgcagaggccaagtgatgggaaacag

SEQ ID NO: 2517 - DNA, 601 bp, Human
gagggcctgggaggggcagctgggaaggggtgtgagcggttgggtagagcgcagtgatgagggccagagagactgaacaatagggcaaagcgagttgatttggagacagaggccaggctctcgagcagacgtgtggcctgatggcagtagagagagacctgggatgcagaggccaagtgatgggaaacagaaaggctgagtcatgaaagatggagaagcagaatgaggagggatggagatgtcagtaatcgggtaaggggagcagagttatggaggaaaggggagaaggaggccttctcayggggactacagagacagaaccagccaggcagcttagtagggattggtggaggatgcagagtcagatgatggtgacaaggaggaatagagatggggtcacggggacagaatgttggagggtggaaagccaaagtgacagaggtcagggaggcagaggggaacaagtgaccccgggccccctgccctgtgcagatgtggatgaatgcacccagagcccaggcctgtgtggccgaggggcctgcaagaacctgcctggctctttccgctgtgtttgcccggctggcttccggggctcggcgtg

SEQ ID NO: 2518 - DNA, 601 bp, Human
tgtgacatttgaccctaatcataaccactaaccatagcactgaccataaccttgactgtgtgactcttggtcctatctctttcacagcccctgcctcttctcagaatcccttctctggaacctggttgggttcataatccctgaccctggcccctgacttgaggcagaattctggaccctgactataacttctgatcctaactggattcagattccagtcactaactctgacccatggctcagccgaatcccatccaatgatcctagtttataatacttgactggtcccttgccctagttsatttctgatccctgtctgatccctctcctgactccaaaatcctggcacaggtagttcctagaaacctagacccacaggacttgcaaccatggtccccggaacccgagaaccttggtcagccctacccacctctgccatagagccctcccccagcctccaactcatgagacttcccaccacctcccccagacaccctactccaaggggattggtcgggtgtgtcccgagactggaccctttctgaacacccccaccccccacagatgtggacgaatgcagttcgggtgcccctccctgtgg

SEQ ID NO: 2519 - DNA, 601 bp, Human
ggaacctggttgggttcataatccctgaccctggcccctgacttgaggcagaattctggaccctgactataacttctgatcctaactggattcagattccagtcactaactctgacccatggctcagccgaatcccatccaatgatcctagtttataatacttgactggtcccttgccctagttgatttctgatccctgtctgatccctctcctgactccaaaatcctggcacaggtagttcctagaaacctagacccacaggacttgcaaccatggtccccggaacccgagaaccttggycagccctacccacctctgccatagagccctcccccagcctccaactcatgagacttcccaccacctcccccagacaccctactccaaggggattggtcgggtgtgtcccgagactggaccctttctgaacacccccaccccccacagatgtggacgaatgcagttcgggtgcccctccctgtggtccccacggccactgcactaacaccgaaggctccttccgctgcagctgcgcgccaggctaccgggcgccgtcgggtcggcccgggccctgcgcaggtgagcagcatagggacccgc

SEQ ID NO: 2520 - DNA, 601 bp, Human
tttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgaygagtgcagcgaggaggacctttgccagagcggcatctgtaccaacaccgacggctccttcgagtgcatctgtcctccgggacaccgcgctggcccggacctcgcctcctgcctcggtgagaggccccgccccggcctgatccctcctcccttcgactccccgactcgccgattggcctcccacctctgtctttcctcctccgcttctcccctccccttacctctttcccccgcctcctctcctagcctccccaactctcctctaccccaatcttctcctgccctctcctctgcttccccg

SEQ ID NO: 2521 - DNA, 601 bp, Human
cgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcggtgagaggccccgccccggcctgatccctcctcccttcgactccccgactcgccgattggcctcccacctctgtctttcctcctccgcttctcccctccccttacctctttcccccgcctcctctcctagcctccccawctctcctctaccccaatcttctcctgccctctcctctgcttccccggcctcccccttctgactctcctctcccctctttgtatcccccatcttgcctccctgcttcccacatccgaccacccgacctctctcctcagacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacggtgagcctgcccccacccgccttcgctagcg

SEQ ID NO: 2522 - DNA, 601 bp, Human
tccccaactctcctctaccccaatcttctcctgccctctcctctgcttccccggcctcccccttctgactctcctctcccctctttgtatcccccatcttgcctccctgcttcccacatccgaccacccgacctctctcctcagacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacggtgagcctgcccccacccgccttcrctagcgcttgcaacgcggtgctggaggctgctcccttggggactgaggaggggcgccctgcttcccagacttaggcggagggaaagaacaccctctcaccgtatctctgtagtggaaataagccgccaccgtgtccatgtattttcttgtgtcaggatcacggccaagcctcccttccagccgcagtccattccccctctgcagctgaagcccggtccacattttaggctatgcccccagtaagacaccgccccaaaactgttaggccccgccccttccaatcggcctctggattaaaac

SEQ ID NO: 2523 - DNA, 601 bp, Human
tgtgagaactctcccggctcctaccgctgtgtccgggactgcgatcctgggtaccacgcgggccccgagggcacctgtgacggtgagcctgcccccacccgccttcgctagcgcttgcaacgcggtgctggaggctgctcccttggggactgaggaggggcgccctgcttcccagacttaggcggagggaaagaacaccctctcaccgtatctctgtagtggaaataagccgccaccgtgtccatgtattttcttgtgtcaggatcacggccaagcctcccttccagccgcagtccattcsccctctgcagctgaagcccggtccacattttaggctatgcccccagtaagacaccgccccaaaactgttaggccccgccccttccaatcggcctctggattaaaaccccctcttcaggccccttctcttcctaacagaagtttggacgtgccctttccgcgccctccaccagtcctacttccagccttccctccaaagaggcccaatcccggtggccctaggccccattctttcccaatgagaaattcccaaggtgaaattctcctagcattggcccccgcccgtttaagctctgccctt

SEQ ID NO: 2524 - DNA, 601 bp, Human
ctagacaccagacagaagcgagggaggcagccatgcagagagctgaggggagactgttcctggcagagggaagagccagtgcaaaggctctgaggcaggaccatgcttttgagaaatggcagtgaggacttgagagttatcaactatgctaggtgtggtggcacaagcttgtaatcccagctactcaggaggctaaggtgggagaactgcctgaacccgggaggttgaagctccagtgagccatgatcctgtcactacactccagcctgagcaacagagcaagaccccatttaaaaaaaaraaaaaaaagctggatggggtggctcatgcctataatcccagcactttggaaggctgaggcagctagattgcctgaggtcagaagttcatcaccagcctggccaatatgatgaaaccccatctctactaaagaaaaaaaaaaaagatagtggctgggcgtggtggctcacacctgtaatcctaggacttgaggaggccgaggtggacagatcgcttgaggtcaggagttcgagaccattctggtcaacatggtgaaatctcatctctactaaaaatacaaaaattagctgggcatgatggt

SEQ ID NO: 2525 - DNA, 601 bp, Human
cagacagaagcgagggaggcagccatgcagagagctgaggggagactgttcctggcagagggaagagccagtgcaaaggctctgaggcaggaccatgcttttgagaaatggcagtgaggacttgagagttatcaactatgctaggtgtggtggcacaagcttgtaatcccagctactcaggaggctaaggtgggagaactgcctgaacccgggaggttgaagctccagtgagccatgatcctgtcactacactccagcctgagcaacagagcaagaccccatttaaaaaaaagaaaaaaaagctggatggggtggctcatgcctataatcccagcactttggaaggctgaggcagctagattgcctgaggtcagaagttcatcaccagcctggccaatatgatgaaaccccatctctactaaagaaaaaaaaaaaagatagtggctgggcgtggtggctcacacctgtaatcctaggacttgaggaggccgaggtggacagatcgcttgaggtcaggagttcgagaccattctggtcaacatggtgaaatctcatctctactaaaaatacaaaaattagctgggcatgatggtgcatgcct

SEQ ID NO: 2526 - DNA, 601 bp, Human
tgggctaacatctccagtgggccacccgagagctaaaaagggaggtttttttttcaatatttctagcaaaagcgccaggcctggctttgattgacccagcatgatcactgcctatgtctgaaccagagaaatgccgtcatctgtttggtcattcctggaacttgtgcccacctctcagagtagatatagccctactcaaagaacaggattgaaaatagaggagcacagggttcccaagggaaattcaaggtttctcactagaagaaaaacagatgatgggatctgggccattaaatatacrcattatatttgaaagctgagactttcggacctttggaatcatagaagcttataaccactgagtccctctcccctgttgtctcctgcttacagatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggtgagactgatgtgtctatttaactgatggcggctggccccatgggaaaatcacgtggtct

SEQ ID NO: 2527 - DNA, 601 bp, Human
gggccacccgagagctaaaaagggaggtttttttttcaatatttctagcaaaagcgccaggcctggctttgattgacccagcatgatcactgcctatgtctgaaccagagaaatgccgtcatctgtttggtcattcctggaacttgtgcccacctctcagagtagatatagccctactcaaagaacaggattgaaaatagaggagcacagggttcccaagggaaattcaaggtttctcactagaagaaaaacagatgatgggatctgggccattaaatatacacattatatttgaaagctsagactttcggacctttggaatcatagaagcttataaccactgagtccctctcccctgttgtctcctgcttacagatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggtgagactgatgtgtctatttaactgatggcggctggccccatgggaaaatcacgtggtctaatcattcctgatgtgga

SEQ ID NO: 2528 - DNA, 601 bp, Human
ctgtgtcaggagaattagaccctggtcctgactctaccagattctttcattcaacaaatgttcacagggtgtgcactgtgttcaggccatcttctgggcactgagaacatagtagtgaccagaagggatcactgtctgtcctcaaggggctcacaagccaatggggcagacagagatatcaccagatagtgacaacccagagaaatcaacaagactgtgatggggaaagcccaggggggttttggaggaggcgcctggcccagcatgagaagaggattagggagttcttcctgtaggagasgacatctgaactgagagctgtgggatgaatagaaatgagccaggcccgatgagtgaggagggcattctgggcagaggacacagcaagggcaaaggcctggcaaagccagagagcatctggcatgtgagaagaactgaaacaggttcaacatggcatgatttagagagcaaaggaaggggtagggagagatggggccagggaaagagtcaggtgcccgatcacactgacttatcacagtaagagagcactgcggtaccgtggaaggggtttcggcgttttttttttgaaaattttttttaa

SEQ ID NO: 2529 - DNA, 601 bp, Human
tcttcctgtaggagacgacatctgaactgagagctgtgggatgaatagaaatgagccaggcccgatgagtgaggagggcattctgggcagaggacacagcaagggcaaaggcctggcaaagccagagagcatctggcatgtgagaagaactgaaacaggttcaacatggcatgatttagagagcaaaggaaggggtagggagagatggggccagggaaagagtcaggtgcccgatcacactgacttatcacagtaagagagcactgcggtaccgtggaaggggtttcggcgtttttttttwgaaaattttttttaaatgttttttttttaagacagggtcgtactttcacccaggccggagtgcagtggcgtgatctcagctcactgcaacctccacctcctgtgctcaaggaatcctccaacctcagcctgctgagtaactgggactacaggcacatatcaccacaacagctaatttttgtattttttgtagagatgtggttttgtcatgttgcccaggctgcagtatttttttttttttaatttttaaatgttacatatttaggctaggattggtggctgaaggccataatcccagctc

SEQ ID NO: 2530 - DNA, 601 bp, Human
ctgtaggagacgacatctgaactgagagctgtgggatgaatagaaatgagccaggcccgatgagtgaggagggcattctgggcagaggacacagcaagggcaaaggcctggcaaagccagagagcatctggcatgtgagaagaactgaaacaggttcaacatggcatgatttagagagcaaaggaaggggtagggagagatggggccagggaaagagtcaggtgcccgatcacactgacttatcacagtaagagagcactgcggtaccgtggaaggggtttcggcgttttttttttgaaawttttttttaaatgttttttttttaagacagggtcgtactttcacccaggccggagtgcagtggcgtgatctcagctcactgcaacctccacctcctgtgctcaaggaatcctccaacctcagcctgctgagtaactgggactacaggcacatatcaccacaacagctaatttttgtattttttgtagagatgtggttttgtcatgttgcccaggctgcagtatttttttttttttaatttttaaatgttacatatttaggctaggattggtggctgaaggccataatcccagctctctgg

SEQ ID NO: 2531 - DNA, 601 bp, Human
gagagctgtgggatgaatagaaatgagccaggcccgatgagtgaggagggcattctgggcagaggacacagcaagggcaaaggcctggcaaagccagagagcatctggcatgtgagaagaactgaaacaggttcaacatggcatgatttagagagcaaaggaaggggtagggagagatggggccagggaaagagtcaggtgcccgatcacactgacttatcacagtaagagagcactgcggtaccgtggaaggggtttcggcgttttttttttgaaaattttttttaaatgttttttttttaagacagggtcgtactttcacccaggccggagtgcagtggcgtgatctcagctcactgcaacctccacctcctgtgctcaaggaatcctccaacctcagcctgctgagtaactgggactacaggcacatatcaccacaacagctaatttttgtattttttgtagagatgtggttttgtcatgttgcccaggctgcagtatttttttttttttaatttttaaatgttacatatttaggctaggattggtggctgaaggccataatcccagctctctgggaggccaaggcgggaggatcacc

SEQ ID NO: 2532 - DNA, 601 bp, Human
tgacttatcacagtaagagagcactgcggtaccgtggaaggggtttcggcgttttttttttgaaaattttttttaaatgttttttttttaagacagggtcgtactttcacccaggccggagtgcagtggcgtgatctcagctcactgcaacctccacctcctgtgctcaaggaatcctccaacctcagcctgctgagtaactgggactacaggcacatatcaccacaacagctaatttttgtattttttgtagagatgtggttttgtcatgttgcccaggctgcagtatttttttttttttaatttttaaatgttacatatttaggctaggattggtggctgaaggccataatcccagctctctgggaggccaaggcgggaggatcacctgaggtcaggagttcgagaccagcatggccaacatggcaaaaccctgtctctactaaaaatacaaaaattagctgggtgtagtggtgcacgcctgtaatcccagctattcgaaaggctgaggcaggaaaatcgcttgaatccaggaggcggaggttgtgggattgcaccactgcactccagcctgggtgagagaggaagactccgtcccaaa

SEQ ID NO: 2533 - DNA, 601 bp, Human
agccagtttttttttttctttgagacggagttttgctcttgttgcccaggctagagtgcagtggcgtgatctcagctcactgtaacctccacctccctggttcaagtgattctcctgcctcagcctcctgagtagctgggattacaggtgtccgccaccacgcccagctaattttttgtatttttagtacagacggggtttcatcatattggtcaggctggtctcgaactcctgacctcaggtcatccacctgcctcggcttcccaaagtgcagggattacaggcgtgagccaccatgctyggcccaacagccagtttttcaacccttgtacctctgtccctcccccatctagtggtccccagcaactattgtgggcatctttacatccatgagtacccactgtttagctctcacttgtaagtgagaacatgtggtatttggtcttctgtttctgcattaatttgcttaggataatggcctccagctgcatccatgttgctgctaaggacatgatttcattctttttcatggctgtgtagtattcatggaagggttctaagcaggaaagatagaatcagattttgaaacctccctctggcc

SEQ ID NO: 2534 - DNA, 601 bp, Human
acccttgtacctctgtccctcccccatctagtggtccccagcaactattgtgggcatctttacatccatgagtacccactgtttagctctcacttgtaagtgagaacatgtggtatttggtcttctgtttctgcattaatttgcttaggataatggcctccagctgcatccatgttgctgctaaggacatgatttcattctttttcatggctgtgtagtattcatggaagggttctaagcaggaaagatagaatcagattttgaaacctccctctggccgccatgtgaaggtgattgaagygggtgatatggaggctgggagctcagggaacaggctggggcaggggcctggacaggagagaacagggctggaccaaggcaggggctgtggaaggggaggagaaggtggtgggagaaaaacccaagaggccatgtggacaagctgtggatgtctgggtggggaagctgtgtccaagacaaggcataggttttttgtttgtttgttttgtgacagagtctcgctctgtcgcccaggctagaatgcagtggtgtgatctcggctcactgcaacttccgctcccgggttcaagcgattctcctg

SEQ ID NO: 2535 - DNA, 601 bp, Human
acatccatgagtacccactgtttagctctcacttgtaagtgagaacatgtggtatttggtcttctgtttctgcattaatttgcttaggataatggcctccagctgcatccatgttgctgctaaggacatgatttcattctttttcatggctgtgtagtattcatggaagggttctaagcaggaaagatagaatcagattttgaaacctccctctggccgccatgtgaaggtgattgaagcgggtgatatggaggctgggagctcagggaacaggctggggcaggggcctggacaggagagracagggctggaccaaggcaggggctgtggaaggggaggagaaggtggtgggagaaaaacccaagaggccatgtggacaagctgtggatgtctgggtggggaagctgtgtccaagacaaggcataggttttttgtttgtttgttttgtgacagagtctcgctctgtcgcccaggctagaatgcagtggtgtgatctcggctcactgcaacttccgctcccgggttcaagcgattctcctgcctcagcctcccaagtagctgggattacaggcatgcgccaccacacccggctaattttttc

SEQ ID NO: 2536 - DNA, 601 bp, Human
agcaggaaagatagaatcagattttgaaacctccctctggccgccatgtgaaggtgattgaagcgggtgatatggaggctgggagctcagggaacaggctggggcaggggcctggacaggagagaacagggctggaccaaggcaggggctgtggaaggggaggagaaggtggtgggagaaaaacccaagaggccatgtggacaagctgtggatgtctgggtggggaagctgtgtccaagacaaggcataggttttttgtttgtttgttttgtgacagagtctcgctctgtcgcccaggctrgaatgcagtggtgtgatctcggctcactgcaacttccgctcccgggttcaagcgattctcctgcctcagcctcccaagtagctgggattacaggcatgcgccaccacacccggctaattttttctatttttagtagagaccgggtttcaccatgttggtcaggctggtctcgaactcctgacctcaagtaatccaaccgcgtcggcctcctgaagtgctgggaggacaggcaggagccactgcacctggcgacaaattgtaggttttgagatgaagactcagccagtttgccacacactg

SEQ ID NO: 2537 - DNA, 601 bp, Human
ctggacaggagagaacagggctggaccaaggcaggggctgtggaaggggaggagaaggtggtgggagaaaaacccaagaggccatgtggacaagctgtggatgtctgggtggggaagctgtgtccaagacaaggcataggttttttgtttgtttgttttgtgacagagtctcgctctgtcgcccaggctagaatgcagtggtgtgatctcggctcactgcaacttccgctcccgggttcaagcgattctcctgcctcagcctcccaagtagctgggattacaggcatgcgccaccacaccyggctaattttttctatttttagtagagaccgggtttcaccatgttggtcaggctggtctcgaactcctgacctcaagtaatccaaccgcgtcggcctcctgaagtgctgggaggacaggcaggagccactgcacctggcgacaaattgtaggttttgagatgaagactcagccagtttgccacacactggataagagacccagagaggcatccaggaagccagggaagttccctcaccacccacccaagctgttagctgcagtgacgggaaagtgtgaggtggggaggcaagagatgcag

SEQ ID NO: 2538 - DNA, 601 bp, Human
caggctggtctcgaactcctgacctcaagtaatccaaccgcgtcggcctcctgaagtgctgggaggacaggcaggagccactgcacctggcgacaaattgtaggttttgagatgaagactcagccagtttgccacacactggataagagacccagagaggcatccaggaagccagggaagttccctcaccacccacccaagctgttagctgcagtgacgggaaagtgtgaggtggggaggcaagagatgcagaaatgacaggaggtgacagtgggagaaagagaaacagtgacagaggagygtgagaggtgtggagtctggttctgccactgatggctgccaccctctgtttccctatctatgccagcctcagtttccccatctatgatagtggcggggctggggattcagcccacactgggctaaagctccttgtctccccaggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgc

SEQ ID NO: 2539 - DNA, 601 bp, Human
agacccagagaggcatccaggaagccagggaagttccctcaccacccacccaagctgttagctgcagtgacgggaaagtgtgaggtggggaggcaagagatgcagaaatgacaggaggtgacagtgggagaaagagaaacagtgacagaggagcgtgagaggtgtggagtctggttctgccactgatggctgccaccctctgtttccctatctatgccagcctcagtttccccatctatgatagtggcggggctggggattcagcccacactgggctaaagctccttgtctccccaggcaygttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacaggtgggcatgggctgatggggacacagggctgagggct

SEQ ID NO: 2540 - DNA, 601 bp, Human
ctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacaggtgggcatgggctgatggggacacagggctgagggcttgggtggaaatactgggtggggtgtgggcctgggacaggggacacttttggacagggccttgaggtactagtactgtcagggcaagggcgagctgccaggcrggtgggcatgggcagacataaggctgagaggtgggcactaacaggcacagggccagagggacttttgtgacaagtgggcacgagcaggtcagggctggggctggggctctggtgtcctggctcaggcttgtctctgtgtgtagctgagtaccagtcattgtgccctcacggccggggctacctggcgcccagtggagacctgagcctccggagaggtgaggccagcctttgaccctccaccccactcagctctgaggcccagcttcgtctcttcctgttttctttgcctctgtctctcac

SEQ ID NO: 2541 - DNA, 601 bp, Human
tgtgcaagagtggcgtgtgtgtgaacacggccccgggctactcatgctattgcagcaacggctactactaccacacacagcggctggagtgcatcggtacaagccccacctcccccaacccccggcaactctctccaacccctagccttgccagctcccctctggaatgtggccaccaccagcgggaagtctttcctggagtctagactccatccatcacactgccaatgtgctgggaagagaaatgggaaagggtggggagagttgaaggggatgcctcttaatcatcctctccctagayaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcggtaaccccgcccacgccatccaggccctccttcccttggctcggcctcacacccgcacccgggccacacctttgcgacggccacgccctccgaaggccacgccccatgctcctggctcgaccacgccccactgagccctcactcagtctctgtcc

SEQ ID NO: 2542 - DNA, 601 bp, Human
cgccgatgaggaaccggcctgtgagggcggccgctgtgtcaacactgtgggctcttatcactgtacctgcgagcccccactggtgctggatggctcgcagcgccgctgcgtctccaacgagagccagagcctcggtaaccccgcccacgccatccaggccctccttcccttggctcggcctcacacccgcacccgggccacacctttgcgacggccacgccctccgaaggccacgccccatgctcctggctcgaccacgccccactgagccctcactcagtctctgtcccactgtctgtctctctgaggcgagctggctaggtggttaaaggcaaaagttttagggcaacctttgcatgttgcctcttggactccaggtttctttctgcacactgggtgaatagcccctaccttatagggtggctgtgaggaattttatttaattttatttatttattttttgagacggagtttcgctcttgttgcccaggctagagcgcagtggcgccatctcagctcactgcaacctccacctccggggttcaaacgattctcctgcctcaggctcccgagtagctgggattacaggcatgtgctacca

SEQ ID NO: 2543 - DNA, 601 bp, Human
tgtgggctcttatcactgtacctgcgagcccccactggtgctggatggctcgcagcgccgctgcgtctccaacgagagccagagcctcggtaaccccgcccacgccatccaggccctccttcccttggctcggcctcacacccgcacccgggccacacctttgcgacggccacgccctccgaaggccacgccccatgctcctggctcgaccacgccccactgagccctcactcagtctctgtcccactgtctgtctctctgaggcgagctggctaggtggttaaaggcaaaagttttagggcaacctttgcatgttgcctcttggactccaggtttctttctgcacactgggtgaatagcccctaccttatagggtggctgtgaggaattttatttaattttatttatttattttttgagacggagtttcgctcttgttgcccaggctagagcgcagtggcgccatctcagctcactgcaacctccacctccggggttcaaacgattctcctgcctcaggctcccgagtagctgggattacaggcatgtgctaccacgcccagctaattttgtatttttttctttagtagagacagggttt

SEQ ID NO: 2544 - DNA, 601 bp, Human
actgtcccaaccactcttctctcatttcctgtgccttcagcacttacccccatacagtgagatgtcagacaatgctcagagaagcaaagcaactgccccgaggccacacagccctccagaggccagacttgggtagacccctctcaggccctacctcccagtcattggacaccttcttctgccctctcctcctatatgacagtctccttgttcctcaatccagaaccctggagtgacctcagagaacttccagagttagatcacagctgatgagaaggatttgctgataggcagagggtgsctgggctgctcagcaggggaagggtccagcccctgggaggacctgagtgccaggcccactctgacacatgctgtctccacctacagatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcaggtgctggcactggcctaggctgaactcagaggccttgccccatgggctccaaatctaggcc

SEQ ID NO: 2545 - DNA, 601 bp, Human
ggggacgggccagcgcaaaagggaggagtaattcttccacctgggtggggcttgactgaagaaggcggagtcagggtgccagcagggcagggcttaaccacggggctggagccgggccttgaagcaggatagaggaatagaatagtgctggtgtgacttgcagtgctaccttgggcagtctgcaggacctctttggagagcctcagtcttcccacctgtaaaatgggaatattaatcaagtctgcctaatttggatggcagtaaagccaagtgattaaaatcaagaacatagccgggcgcrgtggctcacgcctgtaatcccagcactttgggaggccgaggcgggcggatcattaggtcaggagtttgagaccagcctggccaatatggtgaaaccccgtctctaaaaatacaaaattagccgggtgtggtggtgcatgcgtgtaatcccagctactcgggaggaacccaggaggcagaggttgtggtgagccaagatcgcgccattgcactccagcctgggcaataagagcaaaactccgtctcaaaaaacaaacaaaactcgaggaggtcacatagacctcagactcagtccagcaac

SEQ ID NO: 2546 - DNA, 601 bp, Human
ggtcaaaggggaaactgtcttcccctgatattgtctcaatgttttctcatgaccaagggtcccatgcagaaaacgaaagctcctttgggctggaaatgtctcagattggtttctccactcatcggctaaaggttggacagattgaccccttcattacttctcccattctctgactcagataacttcaaccacagggccctccagattcctcctttaaccagcctccatgctcaccttcccatgcctttccaactgagcccagcagaccctcagtgatcttttcactcctggaacgtttttytctctttattccccactgtcttctcagtgaccccatctgcttctgtcccacaggatgggattctttttgggatggtgggggcctatgactggggaggctctgtgctatggcttgaaggaggccaccgccttttccccccacgaatggcactggaagacgagttcccccctgcactgcagaaccatgcagcctacctgggtgagcagcagagagttgcagaggacttacagggtaggggaggaaatacatccctagtgggggcgggtatgaaatactccctcttaactcatgcggtttctc

SEQ ID NO: 2547 - DNA, 601 bp, Human
tcagataacttcaaccacagggccctccagattcctcctttaaccagcctccatgctcaccttcccatgcctttccaactgagcccagcagaccctcagtgatcttttcactcctggaacgtttttctctctttattccccactgtcttctcagtgaccccatctgcttctgtcccacaggatgggattctttttgggatggtgggggcctatgactggggaggctctgtgctatggcttgaaggaggccaccgccttttccccccacgaatggcactggaagacgagttcccccctgcaytgcagaaccatgcagcctacctgggtgagcagcagagagttgcagaggacttacagggtaggggaggaaatacatccctagtgggggcgggtatgaaatactccctcttaactcatgcggtttctcactgacctctggctacttcccttgggacctcctgctatgcctttagggaacccccctactctggaccccatcttcttttcctttacctctgttactttgcccacttctaggttactctgtttcttccatgcttttgcggggtggacgccgcctgtttctctctggggctcctcg

SEQ ID NO: 2548 - DNA, 601 bp, Human
gcgaaggtaggaggatcatttgaggccaggagttcaagaacagcctgaccaacatggtgaaaccccgtctctactaaaaatacaaaaaaattagctgagcatggttgtgggcaccagtaatcccagctactcgggaggctgaggcaggagaatcacttgaacccaggaggcagaggttgcagtgagctgagatcgccccactgcactccagcgtgggccacagagtgaaactccatctcaaaaaaaaaaaaagatcaatgacatgaatctattatcttacttctgtcagagggttcggggkagggtgacatgtgcattcagcccctccttctttgttttgaccatggggaagcaaacactgggcttgcacttctcagagggcttacctcctactgctagaatttcttttccacactgttcccagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctgtgagtgact

SEQ ID NO: 2549 - DNA, 601 bp, Human
tgtgcattcagcccctccttctttgttttgaccatggggaagcaaacactgggcttgcacttctcagagggcttacctcctactgctagaatttcttttccacactgttcccagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctgtgagtgactaaaatgcatyacaggcaactctcaattccttgcatgccttcctcactagacccctttccaccctcactcttgcctccttcattcagacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggtaaggagagggcagtaactgcttagcatcagggcctgagaatgaggagaaagctgggtcagaggaggaattttagctgaa

SEQ ID NO: 2550 - DNA, 601 bp, Human
aggccatcagtgtggttcagagggactgtaggcggcgaggccaagaggcagtctgtctgactgcagccctttgcttccaagtgacctcccgtactcctggtcgctgggatcaccaattctgtgagtgactaaaatgcattacaggcaactctcaattccttgcatgccttcctcactagacccctttccaccctcactcttgcctccttcattcagacatgaggttcaccgcatcactggatgaatggactgctggggcacgtgcagcatttgatggctctggccagaggttgtcccctcrgaggctccggctcagtgtggggaatgtcacttgtgagcagctacacttccatgtgctggtaaggagagggcagtaactgcttagcatcagggcctgagaatgaggagaaagctgggtcagaggaggaattttagctgaatcagcaagaaagccaaagccgggaaaatgagatgattcagactttggagtcagggctgatctgggtttgaatcctagctctgccatttaccacctatgaattctggcaagtccaaccctcagttttcttgtctgcaaaggggtgataataataactgtatc

SEQ ID NO: 2551 - DNA, 601 bp, Human
cattcatcattcccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcaggtgcctttggaggagggggtgtgggagaaggaaagaaaggaggaggaagaagattggggtattggcctcagctgtgaggtcctctagagaaaggctcagtgtttagaggctgtgggtaggacagcagttgcagccccagctcsagcttctatctccattcccctgccctcagagagagagcccaataaaggtggaatgtgccgccccttctgctcatgcccggctctgcagtgtggggcatcctgtcttccagactggagccaaggtgggttggggtctaggatgaaaagagggctctaggagggcagaggctgggatctgagggtcctgggacttcagggaagggggcgcacaagggctcctgttcctctgtagttgttccatgaggaagactctaccattaccctgtgtcccctgcccctaggtgacctttctgctagagt

SEQ ID NO: 2552 - DNA, 601 bp, Human
ggtctaggatgaaaagagggctctaggagggcagaggctgggatctgagggtcctgggacttcagggaagggggcgcacaagggctcctgttcctctgtagttgttccatgaggaagactctaccattaccctgtgtcccctgcccctaggtgacctttctgctagagtttgagtttagctgctcctctctcctgagccaggtcttcgtgaagctgactgccagcaggtgagaatgaagggaactttcttccagacctctcctcctactgagtcttgactggaggggtggggaggaacaayattgattcctctattaacagagaagggtgtcttctgaggaggggttgagatgtgagcctctcccctctgaccctacagtgacagcctggagagaaatgggacccttcaagataacacagcccagacctcagcctacatccaatatgagccccacctcctgttctctaggtatgcccagcttctagggtgggacccagttctgacctcagactcatacccttatgctgcttccctccccttccatgtgcctcagtttttccaaaaacccaagcccttgcggctgctcagtctttttgccct

SEQ ID NO: 2553 - DNA, 601 bp, Human
gttggactattgaggctggttcacaatgaatttttccgaagagtaagcctttccttttctagtactccccacttctgctcctttctggaactttagcataggttttggaggtagacagacccacgttcaagtttcacttttgcctcttactagctatttgaccatgagcaagttatttcatctctctaagcctctttttcctaatctctaaaatgggaagataataccaatttcatggggttgttataaagaataaatgaataatgagctggacatatggtgaacactcagtggaagctasttattatccttgtattttcctccactgaccattacttttttttttcctgaccattccttagtgctgtatcaatcaacatttgcaggatacctaaatttaatcagttaagaatccatcacgttcctattacgtaaaaggccctgtattaggttgacactgagaatatctccaacatttagcctcatgcctaactcattgtaggcgcttaacatatttttgctaaatgaatgaattattgatattacatgcaggatttgtactggggagtggtgggaagtaagattgtataggtgagaggga

SEQ ID NO: 2554 - DNA, 601 bp, Human
tttttttttcctgaccattccttagtgctgtatcaatcaacatttgcaggatacctaaatttaatcagttaagaatccatcacgttcctattacgtaaaaggccctgtattaggttgacactgagaatatctccaacatttagcctcatgcctaactcattgtaggcgcttaacatatttttgctaaatgaatgaattattgatattacatgcaggatttgtactggggagtggtgggaagtaagattgtataggtgagagggatctagattacgaaaggcctctgaagccagggagaaaytgaacttaatatgacaggtagtgaggagtcagtgtgagttcctcctgggcagggaaatggcatcttaattgtaatggctgtttggcactaaggtcaatgttgtgctttcccatatctacctggaataacacaagatccctgggatgtcatcatatgttttagggaagttaagtccaataaaccacccttctccaagtctctgtccttctttggtatctttttttcactagtctattcatgctttcaacaaagatttattaagaaaccactacatggccgggcgcggtggctcacgcctgt

SEQ ID NO: 2555 - DNA, 601 bp, Human
gcagagagaacaggatttgtgctgggcagctaaccaggctgtggatgtcatgcccagatctccttcactgtaccccacaaatgttggttaaattattctaagccaaataaaataaatttgaattccatttttggaaacagaacaaaagtgaagacctcagataagtctgagagctactggcaaggttcccagtctaggcatttggcagtgacgcttatcttttcttctacagcttggcttctttgcccataagaaaatccctgaggaagaaaaaagagaagagaagttggagcaatgaatrtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaat

SEQ ID NO: 2556 - DNA, 601 bp, Human
caggtcttgttatgtcacccaggctggtcttgaactcctaggctcaagagagctttccaccttggcttcccaaaacgctgggattataggcatgagtcatcgcactcggccagacataggctcttaaaggggtgactaagttaaagtggggtcctgagggtggcctggaatttggtttgattggtttattttattttatttttttttgagatggagtctcgctttgtgccctaggctggagtgcagtggcgcagtctcggctcactgcaagctccgccttccgggctcacgccattctccygcctcagcctccggagtagctgggactacaggcgcccgccaccacgcccagctaattttttgtatttttagttgagacggggtttcactgtgttagccaggatgatctcgatctcctgacctcaggatccgcccgcctcgtcttcccaaagggctgggattacaggcgtgagccaccgcgcccagcctgattggttttataaggagagattagggcctctgcaagaggcttcaggagaaaccaaccctgccaacaccttgatcttggacttctagcttccagaagtgttagaaaataaat

SEQ ID NO: 2557 - DNA, 601 bp, Human
ggtacatgctaccatctccagctaaattttttatgttttgtagagatcaggtcttgttatgtcacccaggctggtcttgaactcctaggctcaagagagctttccaccttggcttcccaaaacgctgggattataggcatgagtcatcgcactcggccagacataggctcttaaaggggtgactaagttaaagtggggtcctgagggtggcctggaatttggtttgattggtttattttattttatttttttttgagatggagtctcgctttgtgccctaggctggagtgcagtggcgcartctcggctcactgcaagctccgccttccgggctcacgccattctcccgcctcagcctccggagtagctgggactacaggcgcccgccaccacgcccagctaattttttgtatttttagttgagacggggtttcactgtgttagccaggatgatctcgatctcctgacctcaggatccgcccgcctcgtcttcccaaagggctgggattacaggcgtgagccaccgcgcccagcctgattggttttataaggagagattagggcctctgcaagaggcttcaggagaaaccaaccctgccaa

SEQ ID NO: 2558 - DNA, 601 bp, Human
tgcaggtacatgctaccatctccagctaaattttttatgttttgtagagatcaggtcttgttatgtcacccaggctggtcttgaactcctaggctcaagagagctttccaccttggcttcccaaaacgctgggattataggcatgagtcatcgcactcggccagacataggctcttaaaggggtgactaagttaaagtggggtcctgagggtggcctggaatttggtttgattggtttattttattttatttttttttgagatggagtctcgctttgtgccctaggctggagtgcagtggygcagtctcggctcactgcaagctccgccttccgggctcacgccattctcccgcctcagcctccggagtagctgggactacaggcgcccgccaccacgcccagctaattttttgtatttttagttgagacggggtttcactgtgttagccaggatgatctcgatctcctgacctcaggatccgcccgcctcgtcttcccaaagggctgggattacaggcgtgagccaccgcgcccagcctgattggttttataaggagagattagggcctctgcaagaggcttcaggagaaaccaaccctg

SEQ ID NO: 2559 - DNA, 601 bp, Human
cctgggttgctgggactacaggcatgcaccaccacgtctggcaaagttttaatttttttgtagagattgaggtctcactatgttgcccaggctggtctcattctcctgggctcatgcaatcctcctgcctcagcctcccaagaagtggggattacaggtgttagctaccacaccccactaaaaagctgagttctgtgtttcacgacagtgatattatttatagaagtagctggggaagttataaatcatgcgacccctggttacgtgactctggagcacatatagaaaaggaagctaaggratggcaggtcattcttcaacccacgactgttctttagcaaagttccagcaccttcatgattctaaccttgtcttatgaatgtgacttcaggccaggcacagtggctcatggctgtaatcccagcaccttaagaggccgaggtgggaggatcacttgaggtcaggagttggagaccagcctggccaacatggtgaaaccttatctctactaaaagtacaaaagtcacctgggcatgatggcgggcgcctgtaatcccagctactcaggaggctgagggaggagaatcacttgaactcagga

SEQ ID NO: 2560 - DNA, 601 bp, Human
actagagggccccttggtcttggggtaacgccagcgtctgggaagatgcccattgcctagcggaccttggtctagcggttgcgtcagtgcctagagaccaggaaagggagtctccctttccccgggggagttagggaagactctgctccaccgcctcctgtggagggcctgagtgatgtcaggcccgcccgcagttatccagaggcctgaccatctccctgtgatgctgtgcttcagtggtcacactcctgtttcactttcctgttccactctgtatacctggctgcaccctctagatagsagtagcagaattagtgaaagtattaaaatattaaagtctttgatctttctgaaaagaacataaaagaaataatgacataagctatcctctctctctacgccttggctacctaacatagaagggctccctgtccagtggacacgtgactcacatgaccttatcaatcattggagatgactcacactccttactctgccccttattatccaataaataacagcgcagccaggcatttggggccactatcggtctctgcgtcttggtggtagtggtcccccaggcccagctgtcttttcttct

SEQ ID NO: 2561 - DNA, 601 bp, Human
ctgcagccttgaacaccgggactcaagtgatcctcatgtctcagcctcctaagtagcttggactacaggtgtgtaccactatgcttggctaatttttaaaaatattttcttttattgtagagatagggtttcaccatgttgcccaggctagtctcgaactctggggctcaagagatcttcttgcctcggccaccaaaagtgctggggttacaggcatgggccaccatgcccaaccttcagctctttccatctatctccaccaagcgagaggaactgtcacagccctcacctcttgacactyactatgcattccattacacaaatgctctgcttccccatagtggtcagctctaagaggacttaccttcccatggtgcactgcggtcagaaaattctcagtcctcctgccaaagaaatggctcttcttagtcctgtgcccactgttgggcttagcaaagacagtgggggagggctgggactgtcacgggctcatgggttctccttgtccactgcccagacaaaaccaatgcgaacagcaggtgttgcagcaaagagagagagtttaataatctcaggggcggccaagcgaggagaatgggag

SEQ ID NO: 2562 - DNA, 601 bp, Human
ctttcatctcactcaggaccccaaggcaggcaatgtgagcccgcagtcctccgcctgagcccagcacagcaacaactggggcctaggcattggggagaaaatcgatcagaggtttagagcctgaggatggaggtgggaacaagaagaagggtacctggggccgggcaccgtggctcacgcctgtaatcccagcacattgggaggccgaggcaggtggatcacttgaggtcaggagttcaagaccaacctggtcaatgtggtaaaaccccatctctactaaaaatacaaaaattagctgggygtggtggcacacacctgtaatcccagctgctcagcaggctgatgcaggggaatagcttgaacctgggaggtggaggttgcagtgagccaagatcatgccactgcattccagcctgggtgacagagcgagacgttgtctcaaaaaaaaaaaaaaaaaaaaaagaaagaaaagaaaagaaaaagaaaggaggaggaggagaaggaggagacctaggatctcccttaggcaggggcaatgcctgtcccatagaagttcatatccttctatttctatcccatagaagttcatatccttcggtcc

SEQ ID NO: 2563 - DNA, 601 bp, Human
gcaaagaaagatacttggtgttttcccctgcttcctggtgcagagttcctaaaacccttggaattttcttttttagaaaaaaaaaattttttttttgagacagggtctctctgtcacccaggctggtgtgcagtggtgtgattgtagctcaatgcagcctcagcctcccaggctaaagcaatcctcctgcctcaacttcctgagtagctgggaccataggcatgcaccaccacgcctggctaattttttcactttttgtagagatggggtcttgctatgttgccccgcctgggtctcaaaytcctagactcaagcgatcttcctgcctcagcctcccaaagttctgggattacaggcgtgagccaccacacctggcccatcttttgtaatacaccagcaattgtaagtaaagtgtgttcctgagttctgtgagctattccagtaaattattgaacatgaggcggaagctgtgggaaaccccaaactattgccagtcggtcagaagcaccagcggctaggtaattgcaactcgtgtctgaagtgggagcagttttttgggactgagcccctttcacctgtggaatctgatgtgaactccagg

SEQ ID NO: 2564 - DNA, 601 bp, Human
ccatggctttgtgtagcaaagaaagatacttggtgttttcccctgcttcctggtgcagagttcctaaaacccttggaattttcttttttagaaaaaaaaaattttttttttgagacagggtctctctgtcacccaggctggtgtgcagtggtgtgattgtagctcaatgcagcctcagcctcccaggctaaagcaatcctcctgcctcaacttcctgagtagctgggaccataggcatgcaccaccacgcctggctaattttttcactttttgtagagatggggtcttgctatgttgcccmgcctgggtctcaaactcctagactcaagcgatcttcctgcctcagcctcccaaagttctgggattacaggcgtgagccaccacacctggcccatcttttgtaatacaccagcaattgtaagtaaagtgtgttcctgagttctgtgagctattccagtaaattattgaacatgaggcggaagctgtgggaaaccccaaactattgccagtcggtcagaagcaccagcggctaggtaattgcaactcgtgtctgaagtgggagcagttttttgggactgagcccctttcacctgtggaatct

SEQ ID NO: 2565 - DNA, 601 bp, Human
acaaacatgcagacatgagtgtttcatacctgccatctggggcctcctgaatgagacagtcctacacggattaatgcaatactttatcatagaggctgataagttaaaagggctgtattctatccacctgcagtgtgaaaagtgcacctgaacatgtaaatcctcctttaatgtcagaaggtagtattattatgctttgtccatggctttgtgtagcaaagaaagatacttggtgttttcccctgcttcctggtgcagagttcctaaaacccttggaattttcttttttagaaaaaaaaawttttttttttgagacagggtctctctgtcacccaggctggtgtgcagtggtgtgattgtagctcaatgcagcctcagcctcccaggctaaagcaatcctcctgcctcaacttcctgagtagctgggaccataggcatgcaccaccacgcctggctaattttttcactttttgtagagatggggtcttgctatgttgccccgcctgggtctcaaactcctagactcaagcgatcttcctgcctcagcctcccaaagttctgggattacaggcgtgagccaccacacctggcccatcttttg

SEQ ID NO: 2566 - DNA, 601 bp, Human
tgctggctgcaaaaaacatttgactctgatgaggcctttctcccatcgtgctctcattttcctgcctgtgaaatggaaggactgtcccagatgattttgagtgctcctttgaacttgaccgttctgcagttatatttatttcatgtaaattttccatttcctctgtgtgtcgccctctccatgaggcaggcgttcctgtgaaggacctcctcacacacatcctttcccagtcttcatcgtccacacttacaatgctcaacagcggaggaaaccaaggcacaaagaagtatgtctgggctcrtaacagcccacaaaggacagctccaggaactaacccaaagctgttgaaatataaggctttcgttgttgttgtttgtagagatggggtcttgctatgttgcccaggctggtcttgaactcctgggctcaagagatcctcccacctcgacctcccaaagtactgggattacaggtgtgagtccctgtgtccagccaggcctgcctttttaaccacagcagtctcggaaagattccagaagaaatcatggggttcctatctcaatagcgccccctggagttctgcaatgtgcagtacagctaa

SEQ ID NO: 2567 - DNA, 601 bp, Human
tcctcccacctcagcttcccaaaatgctgggattataggtgtgagccaccgtgcccgggctcaataaaaatttttgatgttcttaatgctgcttatcgggtgctatctaccctcacaccatccaatgtattaaacatacatcatagctcttgagcccctgaagtgtggctagcatgatttaaaatatttatttcattttaattagcttaaatttaaacactggtactccattcagttattgggaaactctgaagtatgtttggaacaagctgggtatgaaaagttctttcctttaatatctttttttttttttttttgagatggagtttcactcttgtcacccaggctgaagtacagtggttcgagctcggctcactgcaacctctgcctcccggattcaagtgattctccttcctcagcctcccaagtagctgggattacaggtgcgtgccaccacacccagctaatttttgtatttttagtagagacagggtttcaccatgttggccaggctggtctcaaactcctgacctcaggtgatccacctgcctcggcctcttgaagtgctgggattacaggtgtgagccactgccccgggcct

SEQ ID NO: 2568 - DNA, 601 bp, Human
aatatatattatatatattaatttataaagaaaagaggtttatttagctcacagttctgcaggctgtacaagaagcatggtgcaaaaagcttctactcatggcagaaggcaagggagctggtgtgtcacatagagtctatatatatatatatatatatatttttttttttttttttgagacaggtcttgctctgttgcccagactagagtgcagtggcatgatcttggctcactgcagtctcaaacccccaggctcaaatgatcctcccacctcagcctcccaagtagctgggaccactamccaccaggtgcatcaccatgccctgctcatttttaaatttattttctgtagagatggagtctcactatgttgcccacgctggtctcaaacttgtggcctgaagcaatcctcccacctcagcttcccaaaatgctgggattataggtgtgagccaccgtgcccgggctcaataaaaatttttgatgttcttaatgctgcttatcgggtgctatctaccctcacaccatccaatgtattaaacatacatcatagctcttgagcccctgaagtgtggctagcatgatttaaaatatttatttc

SEQ ID NO: 2569 - DNA, 601 bp, Human
cctcattgttcttcttgccctggatgtctgtgtatctttctagtaaatcatatcactttatttgttgcataaacgaatcagagtcaatttctgtcacttgcaaccacagtaatcctgatatactttagttttgaggcatcaaccgaagtgcccagattttgatgacttgaaaatcctgaaggacttaaaaggtggtgctggtcagcatctttggtaaccccacaccctgagaccccttgctcctacccccaccccaggtccccagctgggaatgacttacttctctggtttgcttagagayaaccatgtaggcccagaagtcggtcagagagtaattctcagacctcgctgcttggatggttttctgtaggctcttagccaagtcccactcctgtcgggtaaatcgatgtttcaggtcagcctcgagagcttccatgtcaccatcattggtgtagagagaagatattgccctggaggacagaggaagagagtgagttgggcattttaagtgtggacgatgaagactggggaaagatgtgtgcaaggaggtccttcacaggaacacctgcctcatggagagggcgacacacagaggaaacgg

SEQ ID NO: 2570 - DNA, 601 bp, Human
tattccatcataagtcctcattgttcttcttgccctggatgtctgtgtatctttctagtaaatcatatcactttatttgttgcataaacgaatcagagtcaatttctgtcacttgcaaccacagtaatcctgatatactttagttttgaggcatcaaccgaagtgcccagattttgatgacttgaaaatcctgaaggacttaaaaggtggtgctggtcagcatctttggtaaccccacaccctgagaccccttgctcctacccccaccccaggtccccagctgggaatgacttacttctcyggtttgcttagagataaccatgtaggcccagaagtcggtcagagagtaattctcagacctcgctgcttggatggttttctgtaggctcttagccaagtcccactcctgtcgggtaaatcgatgtttcaggtcagcctcgagagcttccatgtcaccatcattggtgtagagagaagatattgccctggaggacagaggaagagagtgagttgggcattttaagtgtggacgatgaagactggggaaagatgtgtgcaaggaggtccttcacaggaacacctgcctcatggagagggcgac

SEQ ID NO: 2571 - DNA, 601 bp, Human
acaacaaaaacccgatgtgttaggataggctggatgcagtggctcatacacgtaatcccagcacttcgggaggctgagataggaggatcacttgaacccagtagttggaggattgcttgagctcaggagtttgagaccagcctgggcaatatagcaagatccctgtctctacaaaaaaaaaaataattaaaaattagccaggcacgatggtgcatgcctgttgccccagcttactcaaaaggctgaggcaagaggattgcttgagcccaggaggtcgaagctgcagtgagccatgatctcrccactgcactccagcctgggtgacagagcaagaccctgtctcaaaaataaaatgaaataaaataaaatagtgaattcaagacatcaaatggccaagcagagatggagaggaaagttgtcttgggtctgacactttccctatttctgccttattccatcataagtcctcattgttcttcttgccctggatgtctgtgtatctttctagtaaatcatatcactttatttgttgcataaacgaatcagagtcaatttctgtcacttgcaaccacagtaatcctgatatactttagttttgagg

SEQ ID NO: 2572 - DNA, 601 bp, Human
aggctgagctgggaggattgcttgagcccaggaggtcaaggctgcagtgagctgtgattgcaccactgcactccagcctggacgacagagtgaaaccctgtctcaagaataaacaaaacaaacaaaaaacaacaaaaacccgatgtgttaggataggctggatgcagtggctcatacacgtaatcccagcacttcgggaggctgagataggaggatcacttgaacccagtagttggaggattgcttgagctcaggagtttgagaccagcctgggcaatatagcaagatccctgtctctacaaaaaaaaaaataattaaaaattagccaggcacgatggtgcatgcctgttgccccagcttactcaaaaggctgaggcaagaggattgcttgagcccaggaggtcgaagctgcagtgagccatgatctcgccactgcactccagcctgggtgacagagcaagaccctgtctcaaaaataaaatgaaataaaataaaatagtgaattcaagacatcaaatggccaagcagagatggagaggaaagttgtcttgggtctgacactttccctatttctgccttattccatcataagtcctcattg

SEQ ID NO: 2573 - DNA, 601 bp, Human
ggctgaggtggaaggatcacttgagcccaggatttggagaccaccccgagcaaaaaagcgaaaccctatctctaaaaaaaaaaaaaaaaaaaaaaaaaaaaaaaaaaaaaaatttgtcaggcccagtggtgcgtgcctgtagtcccagctacttgggaggctgagctgggaggattgcttgagcccaggaggtcaaggctgcagtgagctgtgattgcaccactgcactccagcctggacgacagagtgaaaccctgtctcaagaataaacaaaacaaacaaaaaacaacaaaaacccgawgtgttaggataggctggatgcagtggctcatacacgtaatcccagcacttcgggaggctgagataggaggatcacttgaacccagtagttggaggattgcttgagctcaggagtttgagaccagcctgggcaatatagcaagatccctgtctctacaaaaaaaaaaataattaaaaattagccaggcacgatggtgcatgcctgttgccccagcttactcaaaaggctgaggcaagaggattgcttgagcccaggaggtcgaagctgcagtgagccatgatctcgccactgcactccagc

SEQ ID NO: 2574 - DNA, 601 bp, Human
ctgggacttccctcttctctcgtctaagctgagcaccctgttttctgcaatcctgagcccttccctcttcctgggctccccaaggggagggcagggaaacattcttccattccactccgtgctgttccatcccttactacctctccctccctctaaatgtttgcttacctggtgctcttgcctcctgccaggaaggttgcaggtcattgtcaatggctgcaaatatcgggtagggtagtgtcccttcttccacgggcttcttcatattggacaaatgagactccggcagctttgggagaakgtgccaagacagtgtgagggaggcatgtgggtcccacagggtggaacctctgcacgtaggccacattttttttttagaggggtctcagtctgtcacccaggctggagtgcagtggtacaataatgggccactacagcctcaacctcctgggctcaagcaatccacccacctcaacctcccaagtagctgggactacagatgcatgtcaccatgcccggctaatttattttttgatagagacaggcttttgctatgttgcccaggctggtctcgaactcatggcttcaagcaatcctcccg

SEQ ID NO: 2575 - DNA, 601 bp, Human
gcgtgagccaccatgttggcctcttaaaggttttcttgatccatgcaaagcaagtgcatgtcctctggtcacttctgggacttccctcttctctcgtctaagctgagcaccctgttttctgcaatcctgagcccttccctcttcctgggctccccaaggggagggcagggaaacattcttccattccactccgtgctgttccatcccttactacctctccctccctctaaatgtttgcttacctggtgctcttgcctcctgccaggaaggttgcaggtcattgtcaatggctgcaaatatygggtagggtagtgtcccttcttccacgggcttcttcatattggacaaatgagactccggcagctttgggagaatgtgccaagacagtgtgagggaggcatgtgggtcccacagggtggaacctctgcacgtaggccacattttttttttagaggggtctcagtctgtcacccaggctggagtgcagtggtacaataatgggccactacagcctcaacctcctgggctcaagcaatccacccacctcaacctcccaagtagctgggactacagatgcatgtcaccatgcccggctaattta

SEQ ID NO: 2576 - DNA, 601 bp, Human
tgggatctcactatgttgcccagggtggtctccaacttctggtttcaggcgatcctcccacctcagcctcccaaaccactgggattacaagcgtgagccaccatgttggcctcttaaaggttttcttgatccatgcaaagcaagtgcatgtcctctggtcacttctgggacttccctcttctctcgtctaagctgagcaccctgttttctgcaatcctgagcccttccctcttcctgggctccccaaggggagggcagggaaacattcttccattccactccgtgctgttccatcccttaytacctctccctccctctaaatgtttgcttacctggtgctcttgcctcctgccaggaaggttgcaggtcattgtcaatggctgcaaatatcgggtagggtagtgtcccttcttccacgggcttcttcatattggacaaatgagactccggcagctttgggagaatgtgccaagacagtgtgagggaggcatgtgggtcccacagggtggaacctctgcacgtaggccacattttttttttagaggggtctcagtctgtcacccaggctggagtgcagtggtacaataatgggccactacag

SEQ ID NO: 2577 - DNA, 601 bp, Human
ttgttgttttgagatgggatctcactatgttgcccagggtggtctccaacttctggtttcaggcgatcctcccacctcagcctcccaaaccactgggattacaagcgtgagccaccatgttggcctcttaaaggttttcttgatccatgcaaagcaagtgcatgtcctctggtcacttctgggacttccctcttctctcgtctaagctgagcaccctgttttctgcaatcctgagcccttccctcttcctgggctccccaaggggagggcagggaaacattcttccattccactccgtgcygttccatcccttactacctctccctccctctaaatgtttgcttacctggtgctcttgcctcctgccaggaaggttgcaggtcattgtcaatggctgcaaatatcgggtagggtagtgtcccttcttccacgggcttcttcatattggacaaatgagactccggcagctttgggagaatgtgccaagacagtgtgagggaggcatgtgggtcccacagggtggaacctctgcacgtaggccacattttttttttagaggggtctcagtctgtcacccaggctggagtgcagtggtacaata

SEQ ID NO: 2578 - DNA, 601 bp, Human
taatgttgttgttttgagatgggatctcactatgttgcccagggtggtctccaacttctggtttcaggcgatcctcccacctcagcctcccaaaccactgggattacaagcgtgagccaccatgttggcctcttaaaggttttcttgatccatgcaaagcaagtgcatgtcctctggtcacttctgggacttccctcttctctcgtctaagctgagcaccctgttttctgcaatcctgagcccttccctcttcctgggctccccaaggggagggcagggaaacattcttccattccactcygtgctgttccatcccttactacctctccctccctctaaatgtttgcttacctggtgctcttgcctcctgccaggaaggttgcaggtcattgtcaatggctgcaaatatcgggtagggtagtgtcccttcttccacgggcttcttcatattggacaaatgagactccggcagctttgggagaatgtgccaagacagtgtgagggaggcatgtgggtcccacagggtggaacctctgcacgtaggccacattttttttttagaggggtctcagtctgtcacccaggctggagtgcagtggta

SEQ ID NO: 2579 - DNA, 601 bp, Human
gagccactgcgcccggcccctttttgtcttttgtccctcctctcctctgttttcttttttctttcttctttttggggggacagggtctcactttgtcactcaggctgtagtacaatggtgcaatcacagctcaccgaagccttgaattcctgggctccagtgatcctcctgccccagtctcctgggtagattcttcaggttcctgccaccatgcttggctaatttattgtgtttttttgttttgttttgttttttaatgttgttgttttgagatgggatctcactatgttgcccagggtgrtctccaacttctggtttcaggcgatcctcccacctcagcctcccaaaccactgggattacaagcgtgagccaccatgttggcctcttaaaggttttcttgatccatgcaaagcaagtgcatgtcctctggtcacttctgggacttccctcttctctcgtctaagctgagcaccctgttttctgcaatcctgagcccttccctcttcctgggctccccaaggggagggcagggaaacattcttccattccactccgtgctgttccatcccttactacctctccctccctctaaatgtttgc

SEQ ID NO: 2580 - DNA, 601 bp, Human
tgacctcgtgatccacccgcctcggcctcccaaagtcctgggattacaggcgtgagccactgcgcccggcccctttttgtcttttgtccctcctctcctctgttttcttttttctttcttctttttggggggacagggtctcactttgtcactcaggctgtagtacaatggtgcaatcacagctcaccgaagccttgaattcctgggctccagtgatcctcctgccccagtctcctgggtagattcttcaggttcctgccaccatgcttggctaatttattgtgtttttttgttttgtttkgttttttaatgttgttgttttgagatgggatctcactatgttgcccagggtggtctccaacttctggtttcaggcgatcctcccacctcagcctcccaaaccactgggattacaagcgtgagccaccatgttggcctcttaaaggttttcttgatccatgcaaagcaagtgcatgtcctctggtcacttctgggacttccctcttctctcgtctaagctgagcaccctgttttctgcaatcctgagcccttccctcttcctgggctccccaaggggagggcagggaaacattcttccatt

SEQ ID NO: 2581 - DNA, 601 bp, Human
ctcctgcctcagcctcccgagcagctgggactacaggcgcccgccgccacgcccagctaattttttgtatttttagtagagacggggtttcactgtgttagtcaggatggtcttgatctcctgacctcgtgatccacccgcctcggcctcccaaagtcctgggattacaggcgtgagccactgcgcccggcccctttttgtcttttgtccctcctctcctctgttttcttttttctttcttctttttggggggacagggtctcactttgtcactcaggctgtagtacaatggtgcaatcasagctcaccgaagccttgaattcctgggctccagtgatcctcctgccccagtctcctgggtagattcttcaggttcctgccaccatgcttggctaatttattgtgtttttttgttttgttttgttttttaatgttgttgttttgagatgggatctcactatgttgcccagggtggtctccaacttctggtttcaggcgatcctcccacctcagcctcccaaaccactgggattacaagcgtgagccaccatgttggcctcttaaaggttttcttgatccatgcaaagcaagtgcatgtcct

SEQ ID NO: 2582 - DNA, 601 bp, Human
cgggttcatgccattctcctgcctcagcctcccgagcagctgggactacaggcgcccgccgccacgcccagctaattttttgtatttttagtagagacggggtttcactgtgttagtcaggatggtcttgatctcctgacctcgtgatccacccgcctcggcctcccaaagtcctgggattacaggcgtgagccactgcgcccggcccctttttgtcttttgtccctcctctcctctgttttcttttttctttcttctttttggggggacagggtctcactttgtcactcaggctgtagtrcaatggtgcaatcacagctcaccgaagccttgaattcctgggctccagtgatcctcctgccccagtctcctgggtagattcttcaggttcctgccaccatgcttggctaatttattgtgtttttttgttttgttttgttttttaatgttgttgttttgagatgggatctcactatgttgcccagggtggtctccaacttctggtttcaggcgatcctcccacctcagcctcccaaaccactgggattacaagcgtgagccaccatgttggcctcttaaaggttttcttgatccatgcaaa

SEQ ID NO: 2583 - DNA, 601 bp, Human
ttttttttttttgagacggagtcttgctctgtcgcccaggctggagtgctgtggcgcgatctcagctcactgcaacctccgcctcccgggttcatgccattctcctgcctcagcctcccgagcagctgggactacaggcgcccgccgccacgcccagctaattttttgtatttttagtagagacggggtttcactgtgttagtcaggatggtcttgatctcctgacctcgtgatccacccgcctcggcctcccaaagtcctgggattacaggcgtgagccactgcgcccggcccctttttktcttttgtccctcctctcctctgttttcttttttctttcttctttttggggggacagggtctcactttgtcactcaggctgtagtacaatggtgcaatcacagctcaccgaagccttgaattcctgggctccagtgatcctcctgccccagtctcctgggtagattcttcaggttcctgccaccatgcttggctaatttattgtgtttttttgttttgttttgttttttaatgttgttgttttgagatgggatctcactatgttgcccagggtggtctccaacttctggtttcaggcgat

SEQ ID NO: 2584 - DNA, 601 bp, Human
aaaaaaaaaaagtgagagacagccccacccacccaccccgccatccttcaaacatcccttattacagttttctttacttttttcttttttctttttttttttttttttttgagacggagtcttgctctgtcgcccaggctggagtgctgtggcgcgatctcagctcactgcaacctccgcctcccgggttcatgccattctcctgcctcagcctcccgagcagctgggactacaggcgcccgccgccacgcccagctaattttttgtatttttagtagagacggggtttcactgtgttagycaggatggtcttgatctcctgacctcgtgatccacccgcctcggcctcccaaagtcctgggattacaggcgtgagccactgcgcccggcccctttttgtcttttgtccctcctctcctctgttttcttttttctttcttctttttggggggacagggtctcactttgtcactcaggctgtagtacaatggtgcaatcacagctcaccgaagccttgaattcctgggctccagtgatcctcctgccccagtctcctgggtagattcttcaggttcctgccaccatgcttggctaatttatt

SEQ ID NO: 2585 - DNA, 601 bp, Human
gatcgtgccattacactccagcctgggcaacaagagcaaaactctgtctcaaacaaacaaacagacaaacaccattcacactgggggcttctgagccttgagatgccaggagacgcccaaccacaggtaactggtaacattgcctgatgtatcgtgagaacttaccaggacacagttgctgaacaagtgagtgcattttatgcttaggaaatagggtaaggaggtctggatctcaggagagagatgagctcaaaagagaaactggaatgtctggagagctgccagcatttgggtgataatyggacctatggagaaggaagacatctaaaaagtgagagatggccgggtgcggtggctcatgcctgtaatcccagcactttgggaggccgaggcgggtggatcacctgaggtcaggagttcgagaccagcctgaccaacagggagaaaccacgtctctactaaaaatacaaaattcgctgggcgtgatggcgcatgcctgtaatcccagctactcgggaggctggggcaggagaatcgcttgaacctgggaggcggaggttgtggtgagccgagatcgtgccattgcactctaacctgggca

SEQ ID NO: 2586 - DNA, 601 bp, Human
gcacaaaggatgaaaatgaggagggggtgatttctaggtctgggaatgactgaatttgtggggcttatggaaaggacggagtcagctgtatctgctctggtgagaaaacagcacaaggatccacaccgaggagagagataaaacattcatggccgggcgtggtggctcacgtctgtaatcccagcactttgggaggcggaggtgagtggatcacctaaggtcaggagttcgagaccagcctgattaacatggtgacaccccatccctactaaaaatacaaaaattagccaggcgtggtggygcatgcctataatcccagctacttgggaggctgaggcaggagaatcacttgaacctgggaggcagaggttgcagtgagccgagatcgtgccattacactccagcctgggcaacaagagcaaaactctgtctcaaacaaacaaacagacaaacaccattcacactgggggcttctgagccttgagatgccaggagacgcccaaccacaggtaactggtaacattgcctgatgtatcgtgagaacttaccaggacacagttgctgaacaagtgagtgcattttatgcttaggaaatagggta

SEQ ID NO: 2587 - DNA, 601 bp, Human
aaccctcagccctgcctctctcttccatctcattgtggctgcaactccatggaatcctggagtgcaagggaagagtgtagccacacgattgcatggaggattgtctgtgggcataaatctaatgcatgattccaatgtgagtcattagaatattccagggaagaaaatgacatgatcagattttcatcctggaaacttccatcaggtagccagggaaggaggtggacagcttgggatgggcgggccagtgaggaactaattacaagagtctcccaggagactgggagacctggtctggggrtgatgtagaagagcacaaaggatgaaaatgaggagggggtgatttctaggtctgggaatgactgaatttgtggggcttatggaaaggacggagtcagctgtatctgctctggtgagaaaacagcacaaggatccacaccgaggagagagataaaacattcatggccgggcgtggtggctcacgtctgtaatcccagcactttgggaggcggaggtgagtggatcacctaaggtcaggagttcgagaccagcctgattaacatggtgacaccccatccctactaaaaatacaaaaattagc

SEQ ID NO: 2588 - DNA, 601 bp, Human
gccgcattaaggagacctttgagagacactgaagactcagcagaaggaatacaccattcctctttctggaagcctaccaagtccttttctttcccccaagaaatttaagagctgggcaaactagaccctcagaaggaaaattcttgcctctcctccacttcccacccccttttaatcccctctgaccccagcgctgacctctcaggaaagtcaggtctctctcagggtgagttctgaccagtcttcccttcttgaatttgcttccgaagtgggttatggaaacaaaggcccccagtgcagrgaagccagcgtggtgaggggtgaactcgaaccaggtctctgcagaggaaatacaacggcaagtgagtcccagcacagaaccaggaatgtagcgggtatgcaggaaaaagaaatctattaatgaggaattacaaccatgacaggagaatgttagagatggactgtgtggtatcagaaaccactggggatctcatcctcagacctgagtctacgctgctggtggcagctcataacttccacagcagcctgtttccaatattttccagagcttgaaccctcagccctgcctctctcttccatc

SEQ ID NO: 2589 - DNA, 601 bp, Human
atagtcccagctacttgggaggctgaggcaggggaataacttgaacctgggaggttgcagtgagcagagatcacacaactgcactccagcctgggagacagagtgagactccatctcaaaaaaaaaaaaaaaaaaaaaaaaaagacacacccattaggatggctggtatccaaaaaaccccagaaaacaataagtgttgatgaggacgtggagaaattggaaacctgggacaccattgggcagaatataaaatggtacagccactgtggaaaatggtatggtcgttcctcaaaaaaaaaattttttttttttttgagatagcccaggctggagcgcaatggcgcgatctccgctcactgcagcttccgcctctcgagatcaagagattctcctgcctcagcctcctgagtaactggaattacaggcatgcaccaccatgcccggctaattttgtattttttgtagagatggggtttcaccatgttggtcaggctggtctccaactcccaacctcaggtgatccacccgcctcggcctcccaaagtgctgggattacaggcattagccaccacacctggcctcaaaattttaaaagtagaat

SEQ ID NO: 2590 - DNA, 601 bp, Human
agacctgtattgggctatgactgtgcttttgcacggcagcttgagtgacagagagagaccctgacttcaaaaaaaaaaaaaaaagttgcagcttcattggatgcagccgccatcccgtggtgtggaggagttcagcatgagggtgacttaatatgctaaggatggaggagcagaaaatctagaataaacctgggtccttctgcttaatgttgcacagctaaaccaatgtcaccagccacctaactttgtattatttatttattttgagatgggatctcgctctgttgcccaggctggagtkcagtggtgtgatctcggctcactgcaacctctgcctcccagattcaagtgattctcctgcttcagcctcccgactagctgggattacaggcatgcaccaccacgccctgctaatttttgtattttttaagtagagacggggtttcaccatgttggcccgtctggtcttgaactcttgacctcaagtgatctgcccgcctcggcctcccacagtgctgggatttcagctgtgagtcacggtgctcagtctgtctttttcttttgtaagaaaattaatcccacatgtcctcggggcactgtg

SEQ ID NO: 2591 - DNA, 601 bp, Human
cagcacacaggcaggaagggcaaatatttcccagcctcccttgcagctaggggacggtcaagctctggtccatgcacactgctggggggacttctgcaaagtgcttgttctccttctcagaaggagcaggccaggtatggtggcatgcaactctagtctcagctacttgggaggctgaggcaggaagatcacttgaggccaggagttcaagacctgtattgggctatgactgtgcttttgcacggcagcttgagtgacagagagagaccctgacttcaaaaaaaaaaaaaaaagttgcagyttcattggatgcagccgccatcccgtggtgtggaggagttcagcatgagggtgacttaatatgctaaggatggaggagcagaaaatctagaataaacctgggtccttctgcttaatgttgcacagctaaaccaatgtcaccagccacctaactttgtattatttatttattttgagatgggatctcgctctgttgcccaggctggagtgcagtggtgtgatctcggctcactgcaacctctgcctcccagattcaagtgattctcctgcttcagcctcccgactagctgggattacaggc

SEQ ID NO: 2592 - DNA, 601 bp, Human
tcctgtccatgccaacccttctcagcacacaggcaggaagggcaaatatttcccagcctcccttgcagctaggggacggtcaagctctggtccatgcacactgctggggggacttctgcaaagtgcttgttctccttctcagaaggagcaggccaggtatggtggcatgcaactctagtctcagctacttgggaggctgaggcaggaagatcacttgaggccaggagttcaagacctgtattgggctatgactgtgcttttgcacggcagcttgagtgacagagagagaccctgacttcaaaaaaaaaaaaaaaagttgcagcttcattggatgcagccgccatcccgtggtgtggaggagttcagcatgagggtgacttaatatgctaaggatggaggagcagaaaatctagaataaacctgggtccttctgcttaatgttgcacagctaaaccaatgtcaccagccacctaactttgtattatttatttattttgagatgggatctcgctctgttgcccaggctggagtgcagtggtgtgatctcggctcactgcaacctctgcctcccagattcaagtgattctcctgcttcagcctc

SEQ ID NO: 2593 - DNA, 601 bp, Human
ctcctgtccatgccaacccttctcagcacacaggcaggaagggcaaatatttcccagcctcccttgcagctaggggacggtcaagctctggtccatgcacactgctggggggacttctgcaaagtgcttgttctccttctcagaaggagcaggccaggtatggtggcatgcaactctagtctcagctacttgggaggctgaggcaggaagatcacttgaggccaggagttcaagacctgtattgggctatgactgtgcttttgcacggcagcttgagtgacagagagagaccctgacttcmaaaaaaaaaaaaaaagttgcagcttcattggatgcagccgccatcccgtggtgtggaggagttcagcatgagggtgacttaatatgctaaggatggaggagcagaaaatctagaataaacctgggtccttctgcttaatgttgcacagctaaaccaatgtcaccagccacctaactttgtattatttatttattttgagatgggatctcgctctgttgcccaggctggagtgcagtggtgtgatctcggctcactgcaacctctgcctcccagattcaagtgattctcctgcttcagcct

SEQ ID NO: 2594 - DNA, 601 bp, Human
aatgaattaactcatcaaatattcataactactgttattatcacccgcatggcacagaggcagaaaccgaggcacagagaggttaagtaacttttcggaggtcacaaagcttacatgtaccagagcaacattccttccaagggagtctgtactctcatccactctgtggtcatcctggctgcccaattatatgagaataaatgtcaggaaaagcagttgctagaacaattacacacaggtctctcttctgccatgagtaggaaaagtactgtgaatctccttgcataaaatatctctaggstttgacctttctgttccccaaatactcaccaaaaatgtattccctaatgacttcagtgttaccaagagcacttccccataaacctgccaagaaaagagcaataaaattcaaacattctccatcacgtgactgtcatgtttgatattcaaagcaccagcagactggcataaagcactgcagggatctgcagcaggaagaaagatctttcttccattccataaatatttatgaagcaattagtgggcacccggcactcttctggctgttggaatagagcagtaaacaagacagataaggtcc

SEQ ID NO: 2595 - DNA, 601 bp, Human
ctacagacctgaagcctgaaccatcaaaccagtcaataaaatactggggaaaaaattgcatgccttgtggggaatgagttaagcttcaagagtcttctaccattccagccctgtaggcaacagtgaacttgctcacacagtgagcacatcgcttctacaaccagcatatgagaaagccatcacacgaagactccctatatccaaggaactcttacaatcttcacccctgaaagcaccaaggaccaaattaggctataattagctagggacattaaagtcacatccttaagcggaaaaaagaaaaaaaaaacacagtcaaatccaacataaattcaagaataattaaaagaaatagtctactcaaatgagaaggaatcagaaaagtaactttggtaatatgacaaaacatggttctacagcacccccaaaagatcacactacctctccagcaacagatccaaatcaagatgaaatctttgaaataccagataaagaattcaaatgggcaccaaatgaatcatacatgtaatgttcctaggacaatggctggcctcaagcaagtgtgcggtccccattatcatcagggattcatgatgaagta

SEQ ID NO: 2596 - DNA, 601 bp, Human
actcaggaggctgcggcaggagaattccttgaacctgggaggcggaggttgtggggtgagctgagatcatgccattgtattccagcctgggcaacaagagccaaactctgtctcaaaaaaaaaaaaaaaaaatctcgatgcaactcactgagagctcctccagccacctctgtcaaggctgggacctttgctcaccattgggtgttgcatttactcacatgttttggccacaatcacttcctatgcactcccctacagacctgaagcctgaaccatcaaaccagtcaataaaatactgggraaaaaattgcatgccttgtggggaatgagttaagcttcaagagtcttctaccattccagccctgtaggcaacagtgaacttgctcacacagtgagcacatcgcttctacaaccagcatatgagaaagccatcacacgaagactccctatatccaaggaactcttacaatcttcacccctgaaagcaccaaggaccaaattaggctataattagctagggacattaaagtcacatccttaagcggaaaaaagaaaaaaaaaacacagtcaaatccaacataaattcaagaataattaaaag

SEQ ID NO: 2597 - DNA, 601 bp, Human
cgcaggttgaaagaagcccccagctgggtttcatgagataactgtgggtggaggtgaacttctccacccacatggggtgaatgaaaagcaagctgcagacacgtgtgcaggaccctggcacatggctaggtgggatagatggggaggggcatggcctgagagcagtggttgctatctctgcagggaaagcttatgacttgggggcatttgcaagttctgagcacaggctgcctggaacttagctcaccactgccagtggaacagggtgggaggggatctgcctcgccaagtgtgtgggatacgcgtggggcttactgccacctgccactccccactccctacacaaactcttctgtgcagcagaggcagaaacattcctctctggattatcagcacatgggtctgaaaaccacccccaccccctgatacccacaggagctgctgcttgccctgcacagggagagttagagcacaaaactgcctgacccagcccacacctggctttgccctgccacccgccctggtggctttaatacaaaggacggaaacttttgggaactctgtggctctgcccattgcctgagaaacaagagtagccacc

SEQ ID NO: 2598 - DNA, 601 bp, Human
agtcacgcatcctttccatgacccggtggctctcagcaaaatggaggggacaacagcatccacttcttcaggtcattcaaagggttaaatgatgaacaggtaacgaatgccaattttgtgtgtgtgtgtgtgtgtgtgtgtgtgtgtgtgtgtgtgtgtgatggagtcttgctctgttgcccagactggactgtagtggtgtgatcttagctcactgcagcctttgcctcctggtttcaagcgattcttgtgcctcaacctcctgagtagctgggatcacaggcgtgcaccaccatacttrgctaatttttgtatttttagtagagacgcattttcaccatgttacccagcttgcactcgaacccctgacctcaagtgatctgtccgcctgggcctcccaaagtgctgggattacaggcatgagccactgcgccgggccaggctgcttgcatcttgttgcccaggctggagtgcaatggtgtgatctcagctcactgcaacctccgcctcctgggtttaagagcttctcctcttggcacaaggtctccttgtctgttccatgagaggagagagctggagagccacagaaggccttttgtag

SEQ ID NO: 2599 - DNA, 601 bp, Human
tgttgttgattttcttttctttttttttttttttttgtttgtttcatttcttttttttctttttctttttcttttttctttttttttttttgagactgtgtttcactcttgttgcccaggctggagtgcaatggtgtgatctcagctcactgcaacctccacctcctgggttcaagcgattctcctgcctcagcttcccgtgtagctgggattacaggcatgtaccaccacgcccggctaattttgtatttttagtagagatggggtttctccacgttggtcaggctggtctcaaactccygacctcaggtgatctgcccacctcagcctcccaaagtgctgagattacaggtgtgagccactgcgcccggcccctcatttctttattttttaatttttttcacagagaatttaagcagctttctagggtcactaacgcatgagaggtggagctgggatgtggattcaggcagacaggctttggatcagaaccaccatacgattcccctatagatccctgtgtctgcactcaccaaccagttacataggtgagtcacgcatcctttccatgacccggtggctctcagcaaaatggagggga

SEQ ID NO: 2600 - DNA, 601 bp, Human
ggccctggcttgctttttctaacaatacaagacataataaaaataatattgacatttaagaggacactcccatgtgtcaagctttgctctaagtactttacatacatgaggtcatttaaaccccacatcaaatagtacatagtcccaatcttgtatatttgatgtatatttacatttatttgatataaatatacaagattggggctatgcactattgtatccattttacaaaggagaaattgggtcacagagaattttgttgttgttgttgattttcttttctttttttttttttttttgkttgtttcatttcttttttttctttttctttttcttttttctttttttttttttgagactgtgtttcactcttgttgcccaggctggagtgcaatggtgtgatctcagctcactgcaacctccacctcctgggttcaagcgattctcctgcctcagcttcccgtgtagctgggattacaggcatgtaccaccacgcccggctaattttgtatttttagtagagatggggtttctccacgttggtcaggctggtctcaaactcctgacctcaggtgatctgcccacctcagcctcccaaagt

SEQ ID NO: 2601 - DNA, 601 bp, Human
aaaattagccgggcatggtggtacgtgcctgtaattccacctactagggaggctgaggcaggagaagcacttgaacccaggatacagaggttgcagtgagacgagatcttgctactgcactccagcctgggcaacagagtgagactgtcacaaaaaacaaaaccaaaaaactacatattgaatgcaacatactctaaaacatacactgatgggtggactacagtctcagaatttactactacataattcatcgtgtaacagaaaccacttgtaccccaaaagctattgaagtaaaaattcaaaaaaaaacaaaaaaatcttaatatttaaaaatattattacctaatagtagcagtgttgatccttataattaaaatattgtacatgttataactttttacttgagaccaaatcaaaattcaatttttccacatgtgctgaaaatgcgatagaaagctaagtcctgatacacgtcggttaggtcaagcttctgcttcatctttttcaaatttttgaattgtcaataaataaattttgtctgcttttttttctttttctttctttctttctttttttttttttttttttttgagacacagtc

SEQ ID NO: 2602 - DNA, 601 bp, Human
ctgaggcgggcagattgcttgagctcagaagttcgagaccagcctgaccaacatggcaaaacctcatctctactaaaaatataaaaattagccgggcatggtggtacgtgcctgtaattccacctactagggaggctgaggcaggagaagcacttgaacccaggatacagaggttgcagtgagacgagatcttgctactgcactccagcctgggcaacagagtgagactgtcacaaaaaacaaaaccaaaaaactacatattgaatgcaacatactctaaaacatacactgatgggtggaytacagtctcagaatttactactacataattcatcgtgtaacagaaaccacttgtaccccaaaagctattgaagtaaaaattcaaaaaaaaacaaaaaaatcttaatatttaaaaatattattacctaatagtagcagtgttgatccttataattaaaatattgtacatgttataactttttacttgagaccaaatcaaaattcaatttttccacatgtgctgaaaatgcgatagaaagctaagtcctgatacacgtcggttaggtcaagcttctgcttcatctttttcaaatttttgaat

SEQ ID NO: 2603 - DNA, 601 bp, Human
agctacttgggaggctgaggcaggagaatcacttgaacccacgagttggaggttgcagtgagattgcaccactgcattccagcctgggcaacagagcgagactctgcctcaaaaaaaaaaaaaaaagacacatgcacatgtatgtttatagcagcacaattcacaattgaaagatatggaaccagccgagcatggtggctcatgcctgtaatcccagcactttgggaggctgaggcgggtggatcatgaggtcaggagatcgagactatcctggctaacaccggtctctactaaaaatacaaaaaaaaaaaaaaaaaaaaaattagctgggcgcagtggtgggtgcctgtagtcccagctactcaggaggctgggccaggagaatggcgtgaacctgggaggcggagcttgcggtgagccgagatcgcgccactgcactccagcttgggtgacagagtgagactgtctcaaaaaaaaaaaaaagatatgaacccacctaagtgcccattgacaaatgagtggatacagaatatgtggtatataaacaccatggaatatgactcagccataaaaaagaataaaataatgtcttttgcagaaa

SEQ ID NO: 2604 - DNA, 601 bp, Human
atatggatatatgggaacgatggctcacgcctgtaatcctggcactctgggaggcccagctgggcggatcttcaggtcaggagttccagaccaacatgacgaaaccccatctctattaaaaatacaaaaattggccaggtatggtgttggatgcctgtaatcccagctactcaggaggctgaggcaggagaattgcttgagtctgggaggcggagattgcagtgagccgagatcgtgctgctgcactgaagcctgggtgatggagtgagactccgtctcaaaaataaacaaatatatgggmcctgagtaaattaaaaagcttctgtacagcaaaggaagtaattatcagagtaaacacacaacccactgaatgcgagcaaatatttgcaaactaggcatccacaaaagacgattatacagaacctataaggaactcaaagaaatcagcaagaagaaaacgaataatcccaccgaaaagcatcccaatgatatgaatagacatttctcaaaagaagatattccagtggccaagaaacatatgaaaaaaatggtcagcatcactaatcattaaagaaacgcaaatgaaagccacaatgagata

SEQ ID NO: 2605 - DNA, 601 bp, Human
atgaccaagctgagattcaaatcaagaactcaaccccttttacaacagctgcaaaaaaataaaataaaatactcaggaatatacctaaccaaggaggtgaaagactgctacaaggaaaactacaaaacactgctgaaagaaatcatagatgacacaaacaaatggaaacacatcccatgctcatggatgggtagaatcaatattgtgaaaatgaccatactgccaaaagcaatctacaagtccagtgtaattcccatcaaaatactatcatttttcacagaacaaaaaatcctaaaatcctttttttttttttttttgagacttagtctcgctctgttgcccaggctggagtgcaatggccaattttggctcactgcaacctctgcttcccaagttcaagcgattctcctgtctcagcctcccaagtagctgggattacaggcgcatgcaccatgcctggctaatttttgtatttgtagtagagatggggtttcgccatgttggccaggctggtctcaaactcctgacctcaggtgatccacccgccttggcctcccaaagtgctgggattacagacgtgagctaccatgcccagccacaa

SEQ ID NO: 2606 - DNA, 601 bp, Human
gattgtacacctagaaaaccctaaagactcatccaaaaagctcctaggtctgatgaatgaattcagtagagtttcaggatacaaaatcaatgtacacaaacagtagcactgctatacaccaacaatgaccaagctgagattcaaatcaagaactcaaccccttttacaacagctgcaaaaaaataaaataaaatactcaggaatatacctaaccaaggaggtgaaagactgctacaaggaaaactacaaaacactgctgaaagaaatcatagatgacacaaacaaatggaaacacatcccrtgctcatggatgggtagaatcaatattgtgaaaatgaccatactgccaaaagcaatctacaagtccagtgtaattcccatcaaaatactatcatttttcacagaacaaaaaatcctaaaatcctttttttttttttttttgagacttagtctcgctctgttgcccaggctggagtgcaatggccaattttggctcactgcaacctctgcttcccaagttcaagcgattctcctgtctcagcctcccaagtagctgggattacaggcgcatgcaccatgcctggctaatttttgtatttgt

SEQ ID NO: 2607 - DNA, 601 bp, Human
agccaacattacactgaacagggaaaagtttaaagcattccccctgagaactgcaataagacaagaatgcccactcttatcacttgtattcaacatagtactggaagtcctagccacagccatcagacaagagaaagaaatgaagggtatccaaaccagtaaagaggaagtcaaactgttagtgttcactgatgatatgattgtacacctagaaaaccctaaagactcatccaaaaagctcctaggtctgatgaatgaattcagtagagtttcaggatacaaaatcaatgtacacaaacartagcactgctatacaccaacaatgaccaagctgagattcaaatcaagaactcaaccccttttacaacagctgcaaaaaaataaaataaaatactcaggaatatacctaaccaaggaggtgaaagactgctacaaggaaaactacaaaacactgctgaaagaaatcatagatgacacaaacaaatggaaacacatcccatgctcatggatgggtagaatcaatattgtgaaaatgaccatactgccaaaagcaatctacaagtccagtgtaattcccatcaaaatactatcatttttcaca

SEQ ID NO: 2608 - DNA, 601 bp, Human
agagcagaggcagggggaatgtttaactgtaaagtcactagttatagaaaatacagattacctgcagcgacgtctctttaatagaaatggcagccatgggttggagtctgttgatacgggttctggagagctaattttgtacccgtcttccaactctgtgctcggtgacctcatgttggtagcttgaaatttgccatgatgtgatcaagtgggtttcatactaggaatgcagggatggcttaacatatgcaagtcaacaaatgtgatatatcacagaaacagaattaaaaacaaaaatcayaggagatgcagaagcatttcacaaaatcccacatccctttatgattaaagccctcaacaaaatcggtatacaagagacatacttcaatgtaataaaagccatctatgacaaacccacagccaacattacactgaacagggaaaagtttaaagcattccccctgagaactgcaataagacaagaatgcccactcttatcacttgtattcaacatagtactggaagtcctagccacagccatcagacaagagaaagaaatgaagggtatccaaaccagtaaagaggaagtcaaactgttagt

SEQ ID NO: 2609 - DNA, 601 bp, Human
ttgaactccgatcctgcccctcctggctgcgtggcctcaggcacctgggagagtccatgctcctctccattcccaaaggagcaccacatgaatcagacacgtaaagtttttaggacaatggctggcttcaagccagtgtgcagtccacactatcattagggattcatggcaaagtaggatgcttaccttctgggggaggatgttccccttgtgaactttcttgcagcctcagtaatcgggctgcaaaagagcagaggcagggggaatgtttaactgtaaagtcactagttatagaaaatayagattacctgcagcgacgtctctttaatagaaatggcagccatgggttggagtctgttgatacgggttctggagagctaattttgtacccgtcttccaactctgtgctcggtgacctcatgttggtagcttgaaatttgccatgatgtgatcaagtgggtttcatactaggaatgcagggatggcttaacatatgcaagtcaacaaatgtgatatatcacagaaacagaattaaaaacaaaaatcataggagatgcagaagcatttcacaaaatcccacatccctttatgattaaagccc

SEQ ID NO: 2610 - DNA, 601 bp, Human
aggcatacctagggtatatctgacgactatgtacatggatcctatggttagactcatccaaaaagctcctaggtctaatgaatgaattcagtagagtttcaggatacaaaatcaatgtacacaaatcagtagcactgctatacaccaacaatgaccaagctgagattcaaatcaagaactcaaccccttttacaacagctgcaaaaaaataaaataaaatactcaggaatatacctaaccaaggaggtgaaagactgctacaaggaaaactacaaaacactgctgaaagaaatcatagatracacaaacaaatggaaacacatcccatgctcatggatgggtagaatcaatattgtgaaaatgaccatactgccaaaagcaatctacaagtccagtgtaattcctatcaaaatactatcatttttcacagagtgtcagtttgaactccgatcctgcccctcctggctgcgtggcctcaggcacctgggagagtccatgctcctctccattcccaaaggagcaccacatgaatcagacacgtaaagtttttaggacaatggctggcttcaagccagtgtgcagtccacactatcattaggga

SEQ ID NO: 2611 - DNA, 601 bp, Human
cgcattccttggagtgagctctctgaggcttcttttataagggattaatccaaatctagagggctccaccctcatggtctcaacacctcccaaaggccccatctcttaataccatcaccttggggttgccatttcttttttgttgttgttgttgttgagacaggttgtcgctctgtcaccaggctggagtgcagtggtacaatcaccagcctaccatcccacaacattagttagccatttgcaggttggagatagattctccttccagacttgtctataaccagcatatggtgaatgctgrtgtcaaaaaacaacattaaagcccgccatgtggcaagaagttggctctctgcaacccagaagagggttccccagaatccaaccctactggtactctgatcttgggcttccagcctccagaactgagaaattaatctctgttgttgctaagccagccagcctatgtatggcactttgttctggcagccttcacaactaaaacagggagggaggcatgaagtggatgaagggctgtgctcaggacctaccttcactctgtacctgactgttgacctgtgaaaaagccacacttgcatcttcc

SEQ ID NO: 2612 - DNA, 601 bp, Human
gtctcgaactcctgacctcaagtgatccacccccctcagcctcccaaagtgctgggattacaggcattgagctatcatgcctggcatcccctcttatttttatccacactcatgaattagatgatgttcaactctctctctctcacacacacacactgataatagctctgctcacgtttgctgagaacgtcacctgccaggctcatcttggcattttgcataaattctacccttcaaccttcaccgcattccttggagtgagctctctgaggcttcttttataagggattaatccaaatcwagagggctccaccctcatggtctcaacacctcccaaaggccccatctcttaataccatcaccttggggttgccatttcttttttgttgttgttgttgttgagacaggttgtcgctctgtcaccaggctggagtgcagtggtacaatcaccagcctaccatcccacaacattagttagccatttgcaggttggagatagattctccttccagacttgtctataaccagcatatggtgaatgctgatgtcaaaaaacaacattaaagcccgccatgtggcaagaagttggctctctgcaacc

SEQ ID NO: 2613 - DNA, 601 bp, Human
gtttgctgcacctatcaacccatcacataggtattaagccccacatgcattagctaattttcctggtgctcttcttctccccacccgcccccaacaggccccagtgtgtgttgttcccctccctgcgtccatgtgttctcatcattcagctcccacttataagtgagaacatgtggtgtttggttttctgttcctgcaatagtttgctgaggataatgacttccagctccacccatatccctgcagaggacatgatcttgttcctttttctggctgcatagtattccatggtgtatatgtrccacattttctttatccagtctatcactgatgggcatttgggttgattccatgtctttgatattgtgaatagtgctgcagtgaacatacatgtgcctgtatctttctaacagaatgatttacattcctttgggcatatacccagtaatgggattgctgggccaaatagtatttctggatctagatccttgaggaattccacactgtctcctacaatggttgaactaatttacattgggggattacattccaacatgagatgtggaagggaacaaatatccaaactgtaccagtgggacat

SEQ ID NO: 2614 - DNA, 601 bp, Human
tctaaacaaccgtatctcacatgaactcagagcaagcacttactaatcaccaagaggatgacgctaagccattcatgagggatccgcccccatgatccaatcacctcccaccaggccccacctccaacactggggattacatttctttttcttttaatttaatttaatttaatttaattttaagttccgggacacatgtgcaggacgtgtagatttgttacacaggtaaacatgtgccatggcggtttgctgcacctatcaacccatcacataggtattaagccccacatgcattagctarttttcctggtgctcttcttctccccacccgcccccaacaggccccagtgtgtgttgttcccctccctgcgtccatgtgttctcatcattcagctcccacttataagtgagaacatgtggtgtttggttttctgttcctgcaatagtttgctgaggataatgacttccagctccacccatatccctgcagaggacatgatcttgttcctttttctggctgcatagtattccatggtgtatatgtaccacattttctttatccagtctatcactgatgggcatttgggttgattccatgtct

SEQ ID NO: 2615 - DNA, 601 bp, Human
atagagggtgggcgtatcagtccattcttgcattactataaagaagtacctgaggttggataatttataaagaaaagaggtttaattgtctcacagttctggatgctgtacaggaagcgtggtgctggcatctgcttctggtggggcctcaggaagcttccaatcatgatggaaagtgaatggggagcaggcacatcacttgccgagagcaggagcaagagagcgagggggaaggtgccacacacttctaaacaaccgtatctcacatgaactcagagcaagcacttactaatcaccaagrggatgacgctaagccattcatgagggatccgcccccatgatccaatcacctcccaccaggccccacctccaacactggggattacatttctttttcttttaatttaatttaatttaatttaattttaagttccgggacacatgtgcaggacgtgtagatttgttacacaggtaaacatgtgccatggcggtttgctgcacctatcaacccatcacataggtattaagccccacatgcattagctaattttcctggtgctcttcttctccccacccgcccccaacaggccccagtgtgtgt

SEQ ID NO: 2616 - DNA, 601 bp, Human
attatttcatgctaatgactcaagacatcctagatggatggatggccggttgggtggatagagggtgggcgtatcagtccattcttgcattactataaagaagtacctgaggttggataatttataaagaaaagaggtttaattgtctcacagttctggatgctgtacaggaagcgtggtgctggcatctgcttctggtggggcctcaggaagcttccaatcatgatggaaagtgaatggggagcaggcacatcacttgccgagagcaggagcaagagagcgagggggaaggtgccacacrcttctaaacaaccgtatctcacatgaactcagagcaagcacttactaatcaccaagaggatgacgctaagccattcatgagggatccgcccccatgatccaatcacctcccaccaggccccacctccaacactggggattacatttctttttcttttaatttaatttaatttaatttaattttaagttccgggacacatgtgcaggacgtgtagatttgttacacaggtaaacatgtgccatggcggtttgctgcacctatcaacccatcacataggtattaagccccacatgcattagc

SEQ ID NO: 2617 - DNA, 601 bp, Human
agcctgctagtaggagagttattatttcatgctaatgactcaagacatcctagatggatggatggccggttgggtggatagagggtgggcgtatcagtccattcttgcattactataaagaagtacctgaggttggataatttataaagaaaagaggtttaattgtctcacagttctggatgctgtacaggaagcgtggtgctggcatctgcttctggtggggcctcaggaagcttccaatcatgatggaaagtgaatggggagcaggcacatcacttgccgagagcaggagcaagagagygagggggaaggtgccacacacttctaaacaaccgtatctcacatgaactcagagcaagcacttactaatcaccaagaggatgacgctaagccattcatgagggatccgcccccatgatccaatcacctcccaccaggccccacctccaacactggggattacatttctttttcttttaatttaatttaatttaatttaattttaagttccgggacacatgtgcaggacgtgtagatttgttacacaggtaaacatgtgccatggcggtttgctgcacctatcaacccatcacataggtat

SEQ ID NO: 2618 - DNA, 601 bp, Human
gcaggcacttggtctgacatttcccctttgtcacccctacccccagcctgctagtaggagagttattatttcatgctaatgactcaagacatcctagatggatggatggccggttgggtggatagagggtgggcgtatcagtccattcttgcattactataaagaagtacctgaggttggataatttataaagaaaagaggtttaattgtctcacagttctggatgctgtacaggaagcgtggtgctggcatctgcttctggtggggcctcaggaagcttccaatcatgatggaaagtgartggggagcaggcacatcacttgccgagagcaggagcaagagagcgagggggaaggtgccacacacttctaaacaaccgtatctcacatgaactcagagcaagcacttactaatcaccaagaggatgacgctaagccattcatgagggatccgcccccatgatccaatcacctcccaccaggccccacctccaacactggggattacatttctttttcttttaatttaatttaatttaatttaattttaagttccgggacacatgtgcaggacgtgtagatttgttacacaggtaaacatg

SEQ ID NO: 2619 - DNA, 601 bp, Human
ttgatttcctttccttggtgagctgctgatgagctggtcaggaggactctgggtgtgtctgtgcctggacaccgggtcatcacagaggtgagaggttggatgtctgggggtgagactggctgtacctgggtcatctcaggaaggcagtggcttcagcgaccaactgtcttcattgtccctcatccacgctacttcactctcagaatttttcaccggatacctgctctcgcctctccttgtctctccatataatttacttatttattattttttcgagacagggtcttgctctgtcacccasgctggaatgcagtggcacaatcatagttcactacagcctcgacctcttgggctcaagtgatcctcctgcctcagcctcctgagtagctgggaccatgggaacgcactaccatgtccagctaattttttacaaaaaattttgtagagatggggtcttgctatgttgcccaagctggttttgaactcctgggctcaagtgatcttcctgcctcagcctcccaaagtgctgggattacaggtgtgagccactgcacccagccctctccatagaaattagcccagtcggggatggacttgcctg

SEQ ID NO: 2620 - DNA, 601 bp, Human
ggctgaggcaggagaatcgcttgaacccgggaggcagaggttgcagtgagccaagattgcaccaccgcactccagcttgggtgacagagcgagactccatctcaaacaaacaaacaaaaacaaaaaacaaaacaaaaaaaagtacgttctttaaaagaaaactttttaagggatgggggtctcactctgagtgcagtggtgcattcatagctcactgcagcctccaactcctgggcttaaggaatcctcccacctcagcctccccgaatagctgggactacaggtgcacgcaccaccatgsccggctaggatgcatgttctcatttcagcacaggagccaggcattatagaaagtcatagtgaggcttcgtgtggcacattccatctctctccattacccaccggaggggtaaacccaagcctctcatctgccagactgaagtcagtagatgaactctggctgactttccccacatttccacttggtaggctcattgtcactcattcttcaagttgcttctgagctatcaccttggaaaaggaggcttcttcattaatcccatctaaggggagcttggccaacaatagctcagagacatca

SEQ ID NO: 2621 - DNA, 601 bp, Human
taatcccagcactttgggagcctgaggtgggcggatcacaaggtcaggagttcaagaccagcctggccaatatgatgaaaccctgtctctactaaaattacaaaaattagccgggtgtggtggtgcatgcctgtggtcccagctactcgggaggctgaggcaggagaatcgcttgaacccgggaggcagaggttgcagtgagccaagattgcaccaccgcactccagcttgggtgacagagcgagactccatctcaaacaaacaaacaaaaacaaaaaacaaaacaaaaaaaagtacgttytttaaaagaaaactttttaagggatgggggtctcactctgagtgcagtggtgcattcatagctcactgcagcctccaactcctgggcttaaggaatcctcccacctcagcctccccgaatagctgggactacaggtgcacgcaccaccatggccggctaggatgcatgttctcatttcagcacaggagccaggcattatagaaagtcatagtgaggcttcgtgtggcacattccatctctctccattacccaccggaggggtaaacccaagcctctcatctgccagactgaagtcagtag

SEQ ID NO: 2622 - DNA, 601 bp, Human
attttgtatttttgcatttttagtagagacagagtttgccatgttggccaggctggtctcaagctcctgacctcaagcgatccgcccaccttggcctctcaaagtgctgggattaaagccatgagccaccacacccggccattctatcttatatttttatttatttattttagagaggaggtctcactacgttgcccaggcttgctggtcttgaactcctggcctcaagcgaccctcccgcctcagcctcctgagtagctgggactacaggcgtgagccatcacacctggcttttttaaaygttttatctatttattaattttgtttaaaaaagatgaggtctcacagtgttttccaggctagtcttgaatacctgggctcaagtatatcttatagtaagttaagaattggccgggcacagtggctcacatctgtaatcccagcactttgggagcctgaggtgggcggatcacaaggtcaggagttcaagaccagcctggccaatatgatgaaaccctgtctctactaaaattacaaaaattagccgggtgtggtggtgcatgcctgtggtcccagctactcgggaggctgaggcaggaga

SEQ ID NO: 2623 - DNA, 601 bp, Human
aatgtggcctgaggactccatactttctttttttttgagacagagtttcactcttgttgcccaggctggagtgcaatggcgtgatctcagctcactgcaacctccgcctcccgggttcaagcgattctcctgcctcagcctcccaagtagctaggattacaggcatgtgccaccacgcccggcgaattttgtatttttgcatttttagtagagacagagtttgccatgttggccaggctggtctcaagctcctgacctcaagcgatccgcccaccttggcctctcaaagtgctgggattamagccatgagccaccacacccggccattctatcttatatttttatttatttattttagagaggaggtctcactacgttgcccaggcttgctggtcttgaactcctggcctcaagcgaccctcccgcctcagcctcctgagtagctgggactacaggcgtgagccatcacacctggcttttttaaatgttttatctatttattaattttgtttaaaaaagatgaggtctcacagtgttttccaggctagtcttgaatacctgggctcaagtatatcttatagtaagttaagaattggccggg

SEQ ID NO: 2624 - DNA, 601 bp, Human
tatttaacatgttaaagaaaactaaatgtggcctgaggactccatactttctttttttttgagacagagtttcactcttgttgcccaggctggagtgcaatggcgtgatctcagctcactgcaacctccgcctcccgggttcaagcgattctcctgcctcagcctcccaagtagctaggattacaggcatgtgccaccacgcccggcgaattttgtatttttgcatttttagtagagacagagtttgccatgttggccaggctggtctcaagctcctgacctcaagcgatccgcccacctyggcctctcaaagtgctgggattaaagccatgagccaccacacccggccattctatcttatatttttatttatttattttagagaggaggtctcactacgttgcccaggcttgctggtcttgaactcctggcctcaagcgaccctcccgcctcagcctcctgagtagctgggactacaggcgtgagccatcacacctggcttttttaaatgttttatctatttattaattttgtttaaaaaagatgaggtctcacagtgttttccaggctagtcttgaatacctgggctcaagtatatctt

SEQ ID NO: 2625 - DNA, 601 bp, Human
aataaaataaacaaattagctgggcatattaatgcatgcctgtggtcccagctattcagaaggctgaggcaggaggatcacttgaacccagtagttcaaggctgaagtgaactatgtatgattgtgccactgcactccagcctgggcattccagcctcacttgtatcactcagatcatttagatacaagggagaccttgtatctaaaaaaaaaaaaaaaagaaaaaaaggaagacaccaagaataccaagaatgcgtgtgcactgaggaaaggctgggctgagaggatgcggtgagaaggyggccatccctctgcaagccatggagagaggcctcaggagaaactgaccccactggcaccttgatcttggacttcctgcctgcagaattgtaagaaaataaggctgggcacagtgactcacatctgtaattccagcactctgggaggcccaggtgggtgggtcacttgaggtcaggggttcgagaccagcctgggcaacatggtgaaaccccatctcaaaaaaaaaaaaaaaaacggtgaggaaataaaagcctatagttgaagccaccccacttcaacttttgttagggcagcagagctg

SEQ ID NO: 2626 - DNA, 601 bp, Human
atacaagtgtttttgaagaccaggtcctaggactagctgacaagaaattagggttttttgcatttttgcaaaaccagagaaagccatcagtgaggcttttcacgatgactgggactcgcagcgaggccacacatttttcagtatggaccacaccactgagcgaaagttcccctaatcagatccctgggcactttgacaccacccccctccaaagctctggggaaggaccagcctgggattgtttcaggcccacccccttcccctactccagcccattcacacgcaaggacagaccagggcrgtgggaagagggtcttctcaccgtgtttgtacaggaagttgtgagtggtcccccattcccactttgaagcgcaaatgcctgttttcttcacaaaatccatcaagttactgagtgagcctagggaaagaagccgagacagccaaggtgagttcaggagactgagtggtttctgcccccaccaaagtcatatgtggaagccctcatcccccatggggttgtatctggagacaggacttttaaagaggtcattcagggccggcgcgttggctcacgccagtcatcccagcactttgggaggcc

SEQ ID NO: 2627 - DNA, 601 bp, Human
gggttttaccatgttggccaagctagtcttgaactcctgacctcaagtgatccgcccgcctcagcctcccaaagtgctgggattacaggcatgagccactgcgcccagcccatacaagtgtttttgaagaccaggtcctaggactagctgacaagaaattagggttttttgcatttttgcaaaaccagagaaagccatcagtgaggcttttcacgatgactgggactcgcagcgaggccacacatttttcagtatggaccacaccactgagcgaaagttcccctaatcagatccctgggcmctttgacaccacccccctccaaagctctggggaaggaccagcctgggattgtttcaggcccacccccttcccctactccagcccattcacacgcaaggacagaccagggcggtgggaagagggtcttctcaccgtgtttgtacaggaagttgtgagtggtcccccattcccactttgaagcgcaaatgcctgttttcttcacaaaatccatcaagttactgagtgagcctagggaaagaagccgagacagccaaggtgagttcaggagactgagtggtttctgcccccaccaaagtcata

SEQ ID NO: 2628 - DNA, 601 bp, Human
gaggagggtataaggaggcatgtccgacccccacttcccatcagggactgaacccatttttcaggttaactttggagtgccctggctgacaggagaggtctattcagatggttgggtggtggggggcttagaattttatttttggtttacactctcatatattgctactgagaaagcgacttcatccaaccccttcagggagaaatttgatgctaaaacactcatcgccatgatccagtgacttgatgcttgatggtgtattccgaggccataagacccggcagctgcatggcatggtgckcagacacagctgaagtcctgtgtgccttgtaggaagcaccccaggagaggtgagcaggactgacatccagccagggttcccttcccaggccacacacagccctggccaggggggcacattttggaattcacccccctggaagatgcaccttttctcgatttgcacaagggcaacaggaccacaaacataaagatgttcacgatagtcttgtaacaaaagagtggggaaggccaggtgtggggtggctcacacctgtaatcccagcactttgggaggctgaggtgggaggatcgcttgagc

SEQ ID NO: 2629 - DNA, 601 bp, Human
ggtcccgatccagaccccaagaaagggttcttggatctcatacaagaaagaattcagggtgagtccacagtgcaaagcgaaagcaagtctgttaagaaagcaaaggggtgaaagaatcgttactccacagagtagggtgttacggaaagtaagaggagaaatgcaaccacctcctccttttgttatatataggaaaacaacaacaacaaaaaaacatggggagatgtgctctgctacaagtatttgtgataaaggattaattttcataattactctattttggccgggcacggtggctcaygcctgtaatcccagcactttgggaggccaaggtgggtggatcacctgaggtcaggagttcaagaccagcctgaccaacatggtgaaatcctgtctctactaaaaacacaaaaattagccaggcgtggtggcacctgcctgtaatctcagctactcgggaggctgaggcaggagaatcgcttgaacccgggaggcggaggttgcagtaatctgagattgtgccactgcactctagcctgggcaacaaagagcaaaactctgtctcaaaaaaaaaaaaaaaccaaaaaccataattactata

SEQ ID NO: 2630 - DNA, 601 bp, Human
taacctgaaaacctagttctggccgtgacaggaagggagggtcagacatgcctcacgatgccctcctccctttggggatttaaggaaagctgaccagcatttaatatccacccagagcttaagtctgacaagaatcatttacaatctattctctctgaagcttgctacctggagccttcatcagttactggaaaggggtcccgatccagaccccaagaaagggttcttggatctcatacaagaaagaattcagggtgagtccacagtgcaaagcgaaagcaagtctgttaagaaagcaaargggtgaaagaatcgttactccacagagtagggtgttacggaaagtaagaggagaaatgcaaccacctcctccttttgttatatataggaaaacaacaacaacaaaaaaacatggggagatgtgctctgctacaagtatttgtgataaaggattaattttcataattactctattttggccgggcacggtggctcacgcctgtaatcccagcactttgggaggccaaggtgggtggatcacctgaggtcaggagttcaagaccagcctgaccaacatggtgaaatcctgtctctactaaaa

SEQ ID NO: 2631 - DNA, 601 bp, Human
agcccgcgtcctcagttcctccgcaaagtcagcttcgccgcagcccacctcccacccaggaccggccccaaagcccttctcgattacctcgaaaggatctccggcactgaagtcgaaggagaggatgaggtgaacctcccgcgtcgggggcagcacgagtgggaagggagtgttgatggctaaaccagcatccaccaggtggaggtgcttccggctgctcattatcttgtcccggatgccacctgtggtgcccaggaagaaagaggatcagctgcttctggggactgaaagcaagacttgkaaatggaaggcagagagggggatgggaaaatgatcgttgtcagtgtagacagcagttgtgaggttgccaactaggagctgacttctctctcttcccagattcatatgttgaagccctggctgggtgcggtgcctcacgcctgaaatcccagcactttgggggctgaggcaggcggatcacttgaggtcaggagttcaagatcagcctggccaacacagtgaaaccctgtctctactaaaaataccaaaattagccaggcgtggtggcgggtgcctgtaatcacagctacttgggaggctg

SEQ ID NO: 2632 - DNA, 601 bp, Human
gggctggagacgtgcacacctggggaaggaggtgcacaggtgaggagctaggctgttgcagttcaaactggtatgaatgggcaggcaggacgcagaagcggggagagtcatctgccaggaagaggggcccgggaaggtctgggatggctttggatcagaagttcgttggatgtggccgactgcgggtgcttcgggagcgatgggtgagttgatttggctctctggacttcccagccagcacctccccattgcccgcttcccagcccgcgtcctcagttcctccgcaaagtcagcttcgccrcagcccacctcccacccaggaccggccccaaagcccttctcgattacctcgaaaggatctccggcactgaagtcgaaggagaggatgaggtgaacctcccgcgtcgggggcagcacgagtgggaagggagtgttgatggctaaaccagcatccaccaggtggaggtgcttccggctgctcattatcttgtcccggatgccacctgtggtgcccaggaagaaagaggatcagctgcttctggggactgaaagcaagacttggaaatggaaggcagagagggggatgggaaaatgatcgttg

SEQ ID NO: 2633 - DNA, 601 bp, Human
actgggaaggtgcaatatgtactaagacaaatatacttgcatatgttctcactcagcaaacatttattgagggccactatttgcccaggaaacccagatgagcaggaagacacgcgctcggggctggagacgtgcacacctggggaaggaggtgcacaggtgaggagctaggctgttgcagttcaaactggtatgaatgggcaggcaggacgcagaagcggggagagtcatctgccaggaagaggggcccgggaaggtctgggatggctttggatcagaagttcgttggatgtggccgacygcgggtgcttcgggagcgatgggtgagttgatttggctctctggacttcccagccagcacctccccattgcccgcttcccagcccgcgtcctcagttcctccgcaaagtcagcttcgccgcagcccacctcccacccaggaccggccccaaagcccttctcgattacctcgaaaggatctccggcactgaagtcgaaggagaggatgaggtgaacctcccgcgtcgggggcagcacgagtgggaagggagtgttgatggctaaaccagcatccaccaggtggaggtgcttccggctgctc

SEQ ID NO: 2634 - DNA, 601 bp, Human
ggactcccaagaccttgatatctcattccacctttatcatattgtcttgggatatttatttcagcagaaatcctaagaccagaaagcctgggtattcctgggccaagggtctagaaagatggtgacaagttggttctggatcatggtatggggaggaggatggatgttcctaattcatattacagaatgtaaactgatagaagtgtgtgaatataaatatatattacattacacataaatataatagatgatatgttttaccatgattattttatatatactactatgtattggtatgtaycatgtaatagatatagttatatattatgtaggtgtatatattttttaataaaatagctgggcagggcggcttgtgcctgtaatcctagccttgggtggtgggagaatcgcttgaggccaggagttcaagaccagcctgggcaacatagcaagaccctgtctctaaaacaatttagaaaactagcctggtgtggtggtgtgtgcctgcagtcccagctacttgggagggtgaggtgggaggatcgcttgagcccaggaggttgaggctgcagtgagctatgatcacaccataagacccagt

SEQ ID NO: 2635 - DNA, 601 bp, Human
tgttaatccagaacaccagctatggaccaggcatggtgcagagactctgcagatctcctgcgagccagatgatgtgattcccattttcaggatgagaaaactgaggttcagaggttaagcctatcgctcggggtcatgcagcagagatttggcagaaaaggactcccaagaccttgatatctcattccacctttatcatattgtcttgggatatttatttcagcagaaatcctaagaccagaaagcctgggtattcctgggccaagggtctagaaagatggtgacaagttggttctggatyatggtatggggaggaggatggatgttcctaattcatattacagaatgtaaactgatagaagtgtgtgaatataaatatatattacattacacataaatataatagatgatatgttttaccatgattattttatatatactactatgtattggtatgtatcatgtaatagatatagttatatattatgtaggtgtatatattttttaataaaatagctgggcagggcggcttgtgcctgtaatcctagccttgggtggtgggagaatcgcttgaggccaggagttcaagaccagcctgggc

SEQ ID NO: 2636 - DNA, 601 bp, Human
accaggctggtctcgaactcctgatcttctgatccacccgcctcggcctcccaaaatgctgagattacaggcgtgagccaccaggcctggctgggcttccctacttttgaggctttcggactcggactgagccactattggtttgtttcttcctcagctcgcagacggcctattgtaggactccaccttgtgatcctgaaactccctttcatctagacatagatcctattggttctgtccctctggagagccctgcctagtatgtcaatataccaattacgaataaggtctttgacatgcrttttccatactcggtcattaaaatccgaggtgtattttatcttcatagcacacttcaacttgggccaggcacatttcaagtgctcaagtgccacatgtggccggcaaccactgtagtggacagcttaggtctctgaagtcgtctttgattgaagtttaacaaatgctgccggttttcttcctattactcttgctattctcatcatcaccagataagcattgttgttaatccagaacaccagctatggaccaggcatggtgcagagactctgcagatctcctgcgagccagatgatgtgat

SEQ ID NO: 2637 - DNA, 601 bp, Human
aatttttttgtatttttagtagagacgggatttcaccaggttgaccaggctggtctcgaactcctgatcttctgatccacccgcctcggcctcccaaaatgctgagattacaggcgtgagccaccaggcctggctgggcttccctacttttgaggctttcggactcggactgagccactattggtttgtttcttcctcagctcgcagacggcctattgtaggactccaccttgtgatcctgaaactccctttcatctagacatagatcctattggttctgtccctctggagagccctgccwagtatgtcaatataccaattacgaataaggtctttgacatgcgttttccatactcggtcattaaaatccgaggtgtattttatcttcatagcacacttcaacttgggccaggcacatttcaagtgctcaagtgccacatgtggccggcaaccactgtagtggacagcttaggtctctgaagtcgtctttgattgaagtttaacaaatgctgccggttttcttcctattactcttgctattctcatcatcaccagataagcattgttgttaatccagaacaccagctatggaccaggcatg

SEQ ID NO: 2638 - DNA, 601 bp, Human
tgcttaaatttctgtttattggccgggcgtggtggctcacgcctgtaatccctgcactttgggaggccgaggcgggcagatcacaaggtcaggagttcaagaccagcctggccaacatggtgaaaccccgtctctactaaaaatacaaaaattagctgggtgtggtggcgcatgcctgtaatctcagctactcgggaggctgaggcaggagaattgcttgaacccaggaggtggaggttgcagtgagccgagattgtgccactgcactccagcctatgtgatagagcgagactctgtctcaaaaaaaaaaaaaaaaaattctgtttattactttgtaaccacccaatttgtaggaaaaagtttcatctcatgcaatatgtcaaaagtgtgattgcctcgatgtgtaatcaattgtgatggtgaatattaggtgtcgacttgattgaagggtgcctggaaagctggtattgtttccggatgtgtctctgagggtgctgtcagaggagatgaacatttgagtcagtggactaggagaggaagactcacccacagtgtgggcggacaccctccaattggctgccagtgtgactagaacaaagca

SEQ ID NO: 2639 - DNA, 601 bp, Human
gatcgcaccacagcacaccagcctgggcgacacagaagactccatctcaaaaaaaaaaaaaagatttgacattcaactatagtagctacatgttggttagtttccttataagccccatcatggaaagaattaaagatgaatttgagaaaaatgaaaaaaaacttagacaatcaggttctgttaaattgttacagatatgtcttgcttaaatttctgtttattggccgggcgtggtggctcacgcctgtaatccctgcactttgggaggccgaggcgggcagatcacaaggtcaggagttcragaccagcctggccaacatggtgaaaccccgtctctactaaaaatacaaaaattagctgggtgtggtggcgcatgcctgtaatctcagctactcgggaggctgaggcaggagaattgcttgaacccaggaggtggaggttgcagtgagccgagattgtgccactgcactccagcctatgtgatagagcgagactctgtctcaaaaaaaaaaaaaaaaaattctgtttattactttgtaaccacccaatttgtaggaaaaagtttcatctcatgcaatatgtcaaaagtgtgattgcctcg

SEQ ID NO: 2640 - DNA, 601 bp, Human
gcggaggttgcagtgagccaagatcgcaccacagcacaccagcctgggcgacacagaagactccatctcaaaaaaaaaaaaaagatttgacattcaactatagtagctacatgttggttagtttccttataagccccatcatggaaagaattaaagatgaatttgagaaaaatgaaaaaaaacttagacaatcaggttctgttaaattgttacagatatgtcttgcttaaatttctgtttattggccgggcgtggtggctcacgcctgtaatccctgcactttgggaggccgaggcgggcrgatcacaaggtcaggagttcaagaccagcctggccaacatggtgaaaccccgtctctactaaaaatacaaaaattagctgggtgtggtggcgcatgcctgtaatctcagctactcgggaggctgaggcaggagaattgcttgaacccaggaggtggaggttgcagtgagccgagattgtgccactgcactccagcctatgtgatagagcgagactctgtctcaaaaaaaaaaaaaaaaaattctgtttattactttgtaaccacccaatttgtaggaaaaagtttcatctcatgcaatat

SEQ ID NO: 2641 - DNA, 601 bp, Human
aatcccagcactttgggaggccaaggcgggcagatcacctgaggtcaggagtttgagaccaacctggccaacatggtgaaaccccgtctctactaaaaatacaaaaattagccaggcatgttagcaggtgcctgtaatcccagctacttgggaggctgagacaggagaatcgcttgaacccgggaggcagaggttgcagtgagcccagatagcgccattgcactccaacctgggtgacaagagcaagaaagaggctgggcatggtggctcatggctcatgcctataatcccagcactttgrgaggctgaggtgggtggatcacgaggtcaggagatcgagaccatcctggctaacacagtgaaaccccatctctactaaaattacaaaaaattagccgggcatggtggcacatgcctgtagtcctagctacttgggaggctgagacaggagaatcgcttgaacatgggaggcagagattgcagtgagcccagatagcaccactgcactccagcctgggcaacaagaacgagactctgtctcaaaaaaaaaaaaaaaaaaaaaagataaatgtataaatgtgtttccaggaacagaaaacca

SEQ ID NO: 2642 - DNA, 601 bp, Human
gtttcctgaggcctctccatccatgctgaactgtgagtcaattaaaccttcttcctttgtaaattacccagtctcaggtatgtttttattagcagtgtgagcatggactaatacaggtggcttctcacctgctcctcccctgcacctacctccacaggcatctatgttgaacaggggaaaatgcatcaccactggtccagtttctcctttcaggatgtagcagctggcgggggccttggaccacaaatccagctcagcctcttctacttggggaaaggggatcttgtggcggcggcagtartcagtggtagcccggatggtctgagaaggaggcaataagaaatggttgcaagacctctccagaagacccctccagaagacccctggggcctggagacccaacgggacctcagctaacagcccagacacacaacagagcaagggtcagcttggacagggacaacatcttctgtaagggaaagagtaagcctctgccatcacccgcactccccagcccacctagagacaacattcgcgaggttagagagtaacctttggggctgggggctgcgggactcagagggcaaggaaaatggtgcct

SEQ ID NO: 2643 - DNA, 601 bp, Human
cagagagaggcagcaacatgcataaacatgcaagaccgagagaggcagcctggcatcctccaggcccaagggtggacaggatgactcactcaaccatcagatgttggagcgtaacaagatgtccccagggcacagcacagctccattcggcctggcctggtggtgatatggtttggctgtgtccccacccaaatctcatcttgaattgtagttcccataatccccaagtgtcgtgggaggtaattgaagcatggaagtggttaccctcatgctgttctcgtgacagtgagttgagttctcrcgagacctgatggtatgtatttatttatttatttgagaaggagtcttgctctgtccccaggctggagtgcaggagcgcgatctcagctcactgcaacctccgcctcccaggttcaagcgattctcctgcctcagcctcctgagtagctgggattacaggcacgcaccaccaagcccagcaatttatttttttttttttttgtatttttagtagagatggggtttcactgtgttagccaggatggtctcaatctcctgaccttgtgatccgcccgcctcagcctcccaaagtgctgggatt

SEQ ID NO: 2644 - DNA, 601 bp, Human
cccaaagtgctgggattacaggcgtgagccaccgcgcctggcccccgcttcctgtcttctttactactctagcctgcctctcctggaaccatggctgatgcagcataggtaaccaataaatgttcgttaaatgaaggaagaaaacagacacaatttatccctaatgggagtctcatcgcaggagacacgattgacaagctaaaaggagcccactgtgggaagtggcacaatcaggccccggaggaccacccatcctggatgctaggccttccaagcagctgctcacctgagactggatgargaatgtgggatgcccaggtggaaggggttggatattcaggtaggacaagaaggctgcagagagaggcagcaacatgcataaacatgcaagaccgagagaggcagcctggcatcctccaggcccaagggtggacaggatgactcactcaaccatcagatgttggagcgtaacaagatgtccccagggcacagcacagctccattcggcctggcctggtggtgatatggtttggctgtgtccccacccaaatctcatcttgaattgtagttcccataatccccaagtgtcgtgggaggtaat

SEQ ID NO: 2645 - DNA, 601 bp, Human
cacctcctagattcaagcgattctcctgcctcagcctcccaagtagctaggattacaggcgtgcatcaccacgcttggctaattttttgtattttttaatagagacggggtttcaccctgttggccaagctggccttaaactcctgatctcaggtgatctgccccggcttggcgtcccaaagtgctgggattacaggcgtgagccaccgcgcctggcccccgcttcctgtcttctttactactctagcctgcctctcctggaaccatggctgatgcagcataggtaaccaataaatgttcrttaaatgaaggaagaaaacagacacaatttatccctaatgggagtctcatcgcaggagacacgattgacaagctaaaaggagcccactgtgggaagtggcacaatcaggccccggaggaccacccatcctggatgctaggccttccaagcagctgctcacctgagactggatgaggaatgtgggatgcccaggtggaaggggttggatattcaggtaggacaagaaggctgcagagagaggcagcaacatgcataaacatgcaagaccgagagaggcagcctggcatcctccaggcccaa

SEQ ID NO: 2646 - DNA, 601 bp, Human
ttttttttttttttttttttttgagacagaggctcgctcttgtctcccaggctggagtccaatggcacaatcttgggtgactgtaacctccacctcctagattcaagcgattctcctgcctcagcctcccaagtagctaggattacaggcgtgcatcaccacgcttggctaattttttgtattttttaatagagacggggtttcaccctgttggccaagctggccttaaactcctgatctcaggtgatctgccccggcttggcgtcccaaagtgctgggattacaggcgtgagccaccgcrcctggcccccgcttcctgtcttctttactactctagcctgcctctcctggaaccatggctgatgcagcataggtaaccaataaatgttcgttaaatgaaggaagaaaacagacacaatttatccctaatgggagtctcatcgcaggagacacgattgacaagctaaaaggagcccactgtgggaagtggcacaatcaggccccggaggaccacccatcctggatgctaggccttccaagcagctgctcacctgagactggatgaggaatgtgggatgcccaggtggaaggggttggatat

SEQ ID NO: 2647 - DNA, 601 bp, Human
tatttttatgatccatgccccttccggtccttttttcttttttttttttttttttttttgagacagaggctcgctcttgtctcccaggctggagtccaatggcacaatcttgggtgactgtaacctccacctcctagattcaagcgattctcctgcctcagcctcccaagtagctaggattacaggcgtgcatcaccacgcttggctaattttttgtattttttaatagagacggggtttcaccctgttggccaagctggccttaaactcctgatctcaggtgatctgccccggcttggcrtcccaaagtgctgggattacaggcgtgagccaccgcgcctggcccccgcttcctgtcttctttactactctagcctgcctctcctggaaccatggctgatgcagcataggtaaccaataaatgttcgttaaatgaaggaagaaaacagacacaatttatccctaatgggagtctcatcgcaggagacacgattgacaagctaaaaggagcccactgtgggaagtggcacaatcaggccccggaggaccacccatcctggatgctaggccttccaagcagctgctcacctgagactggatg

SEQ ID NO: 2648 - DNA, 601 bp, Human
gggcttggcaaactacagttgtggaccaaatccagtcggcccactactttggctttataaataaagttttattgacacatgaggttatggatttatctatatttttatgatccatgccccttccggtccttttttcttttttttttttttttttttttgagacagaggctcgctcttgtctcccaggctggagtccaatggcacaatcttgggtgactgtaacctccacctcctagattcaagcgattctcctgcctcagcctcccaagtagctaggattacaggcgtgcatcaccacgcytggctaattttttgtattttttaatagagacggggtttcaccctgttggccaagctggccttaaactcctgatctcaggtgatctgccccggcttggcgtcccaaagtgctgggattacaggcgtgagccaccgcgcctggcccccgcttcctgtcttctttactactctagcctgcctctcctggaaccatggctgatgcagcataggtaaccaataaatgttcgttaaatgaaggaagaaaacagacacaatttatccctaatgggagtctcatcgcaggagacacgattgacaagct

SEQ ID NO: 2649 - DNA, 601 bp, Human
gtgtcgtatgtgtcactccatgcctcaatatcacctgaagcataaccaaaccaacaaagaaaaggcatcatgagtttggacaattaattctgcagatttttgtctatttacatcagggcttggcaaactacagttgtggaccaaatccagtcggcccactactttggctttataaataaagttttattgacacatgaggttatggatttatctatatttttatgatccatgccccttccggtccttttttcttttttttttttttttttttttgagacagaggctcgctcttgtctcccasgctggagtccaatggcacaatcttgggtgactgtaacctccacctcctagattcaagcgattctcctgcctcagcctcccaagtagctaggattacaggcgtgcatcaccacgcttggctaattttttgtattttttaatagagacggggtttcaccctgttggccaagctggccttaaactcctgatctcaggtgatctgccccggcttggcgtcccaaagtgctgggattacaggcgtgagccaccgcgcctggcccccgcttcctgtcttctttactactctagcctgcctctcctg

SEQ ID NO: 2650 - DNA, 601 bp, Human
cagcaagcttgaatgtgtcgtatgtgtcactccatgcctcaatatcacctgaagcataaccaaaccaacaaagaaaaggcatcatgagtttggacaattaattctgcagatttttgtctatttacatcagggcttggcaaactacagttgtggaccaaatccagtcggcccactactttggctttataaataaagttttattgacacatgaggttatggatttatctatatttttatgatccatgccccttccggtccttttttcttttttttttttttttttttttgagacagaggctcrctcttgtctcccaggctggagtccaatggcacaatcttgggtgactgtaacctccacctcctagattcaagcgattctcctgcctcagcctcccaagtagctaggattacaggcgtgcatcaccacgcttggctaattttttgtattttttaatagagacggggtttcaccctgttggccaagctggccttaaactcctgatctcaggtgatctgccccggcttggcgtcccaaagtgctgggattacaggcgtgagccaccgcgcctggcccccgcttcctgtcttctttactactcta

SEQ ID NO: 2651 - DNA, 601 bp, Human
gagtagcaccaccacatctagagtgtaggtgtcagcaagcttgaatgtgtcgtatgtgtcactccatgcctcaatatcacctgaagcataaccaaaccaacaaagaaaaggcatcatgagtttggacaattaattctgcagatttttgtctatttacatcagggcttggcaaactacagttgtggaccaaatccagtcggcccactactttggctttataaataaagttttattgacacatgaggttatggatttatctatatttttatgatccatgccccttccggtccttttttctttcttttttttttttttttttgagacagaggctcgctcttgtctcccaggctggagtccaatggcacaatcttgggtgactgtaacctccacctcctagattcaagcgattctcctgcctcagcctcccaagtagctaggattacaggcgtgcatcaccacgcttggctaattttttgtattttttaatagagacggggtttcaccctgttggccaagctggccttaaactcctgatctcaggtgatctgccccggcttggcgtcccaaagtgctgggattacaggcgtgagccaccgcgcct

SEQ ID NO: 2652 - DNA, 601 bp, Human
caaaaggaaagacagtttcttgcatgactcagcttaattaagctttcagcttaatttttttttttttttttttttttttagaggcaaggtcttgctctgtcgcccagcctggagtggggtggtaccatcatagctcactgcagcctcaaactcctgggctccggcaatcctcccacctcagcctcctgagtagctgagactataggcttgtgctaccacacccagctaatttttaaaattatttgtagagacttggtctcactatgttgcccaggcagatcttgaactcctgggctcaagygatcctcctgtcttggcttcccaaagtgctgggattacagacatgagccacagtgcccagccacagcttaagtttttccttttggcatagtgaattggggtcctgagatttcattttcctttcacagagatatggtttggctctgtgtccccacccaaatctcatctcaaattgtaattcccatgtgttggggtaggggcctggtgagaggtgattgatgggagcgtacttcccccttgctgttcttgtgatagtgacggagttctcatgaaatccggttgtttgaaagtgtgtagcact

SEQ ID NO: 2653 - DNA, 601 bp, Human
acttaaaaaccatcagatctcgtgagaactccctcactctcacgagaacagcataagggaagccacccccaagatccaatcacctcccaccaggtccctctcttgacatgtggggattacaattcgagatgagatttgggtggggacacagagccaaaccatatcgatagagtaagttacctgtggagatatctgtggccttttatctgtggcttaggaacaaaaggaaagacagtttcttgcatgactcagcttaattaagctttcagcttaatttttttttttttttttttttttttaraggcaaggtcttgctctgtcgcccagcctggagtggggtggtaccatcatagctcactgcagcctcaaactcctgggctccggcaatcctcccacctcagcctcctgagtagctgagactataggcttgtgctaccacacccagctaatttttaaaattatttgtagagacttggtctcactatgttgcccaggcagatcttgaactcctgggctcaagcgatcctcctgtcttggcttcccaaagtgctgggattacagacatgagccacagtgcccagccacagcttaagtttttcct

SEQ ID NO: 2654 - DNA, 601 bp, Human
agccacctgatctgtggtacttttttctttgagacggaatctccctctgtcagcaggctggagtgcagtggcatgatctgggctcactgcaacctccaccttctgggttcaagcgattctcctgcctcagcctcccaagtaactgggactacaggtgtgcactaccatgcccatctaagttttgtatttttagtagaaatggggcttcaccatgttggccaggttggtctcgaactcctgacctcatgatctgcccacctcggcctcccaaagtgctgggattacaggtgtgaaccaccakgcccggcctctgtggtactttttaatggcagccccagcaaactaatatacaacccctcattagaagacagatgagcagcaaataaccgccctgccccatgccaggcagggcttttggggaaactctctggggaacatagactggtccagaggcccagaatggctttctcttccctctaccttgcgaccctgaggtcattgacccaaactgctcctcagggtgctaattatctcacctagggaccaaccgcacaggagctagggtgggcctttgaaaaggtgactcagataaagctacttc

SEQ ID NO: 2655 - DNA, 601 bp, Human
aagccacctgatctgtggtacttttttctttgagacggaatctccctctgtcagcaggctggagtgcagtggcatgatctgggctcactgcaacctccaccttctgggttcaagcgattctcctgcctcagcctcccaagtaactgggactacaggtgtgcactaccatgcccatctaagttttgtatttttagtagaaatggggcttcaccatgttggccaggttggtctcgaactcctgacctcatgatctgcccacctcggcctcccaaagtgctgggattacaggtgtgaaccaccrtgcccggcctctgtggtactttttaatggcagccccagcaaactaatatacaacccctcattagaagacagatgagcagcaaataaccgccctgccccatgccaggcagggcttttggggaaactctctggggaacatagactggtccagaggcccagaatggctttctcttccctctaccttgcgaccctgaggtcattgacccaaactgctcctcagggtgctaattatctcacctagggaccaaccgcacaggagctagggtgggcctttgaaaaggtgactcagataaagctactt

SEQ ID NO: 2656 - DNA, 601 bp, Human
cccctgttcacaccttgatcttggacttccagcctccagaactgtgagacaataagtgtcggttgtttaagccacctgatctgtggtacttttttctttgagacggaatctccctctgtcagcaggctggagtgcagtggcatgatctgggctcactgcaacctccaccttctgggttcaagcgattctcctgcctcagcctcccaagtaactgggactacaggtgtgcactaccatgcccatctaagttttgtatttttagtagaaatggggcttcaccatgttggccaggttggtctcraactcctgacctcatgatctgcccacctcggcctcccaaagtgctgggattacaggtgtgaaccaccatgcccggcctctgtggtactttttaatggcagccccagcaaactaatatacaacccctcattagaagacagatgagcagcaaataaccgccctgccccatgccaggcagggcttttggggaaactctctggggaacatagactggtccagaggcccagaatggctttctcttccctctaccttgcgaccctgaggtcattgacccaaactgctcctcagggtgctaattatc

SEQ ID NO: 2657 - DNA, 601 bp, Human
caggcacagaggaaaatcatgtgtagacacagggaggcaccatctgcaagccaaggagagaggtctcaggagaaaccacccctgttcacaccttgatcttggacttccagcctccagaactgtgagacaataagtgtcggttgtttaagccacctgatctgtggtacttttttctttgagacggaatctccctctgtcagcaggctggagtgcagtggcatgatctgggctcactgcaacctccaccttctgggttcaagcgattctcctgcctcagcctcccaagtaactgggactacargtgtgcactaccatgcccatctaagttttgtatttttagtagaaatggggcttcaccatgttggccaggttggtctcgaactcctgacctcatgatctgcccacctcggcctcccaaagtgctgggattacaggtgtgaaccaccatgcccggcctctgtggtactttttaatggcagccccagcaaactaatatacaacccctcattagaagacagatgagcagcaaataaccgccctgccccatgccaggcagggcttttggggaaactctctggggaacatagactggtccagaggc

SEQ ID NO: 2658 - DNA, 601 bp, Human
ataagccctgagttctacaggtgagaaggtggggagtggacaggcacagaggaaaatcatgtgtagacacagggaggcaccatctgcaagccaaggagagaggtctcaggagaaaccacccctgttcacaccttgatcttggacttccagcctccagaactgtgagacaataagtgtcggttgtttaagccacctgatctgtggtacttttttctttgagacggaatctccctctgtcagcaggctggagtgcagtggcatgatctgggctcactgcaacctccaccttctgggttcaagygattctcctgcctcagcctcccaagtaactgggactacaggtgtgcactaccatgcccatctaagttttgtatttttagtagaaatggggcttcaccatgttggccaggttggtctcgaactcctgacctcatgatctgcccacctcggcctcccaaagtgctgggattacaggtgtgaaccaccatgcccggcctctgtggtactttttaatggcagccccagcaaactaatatacaacccctcattagaagacagatgagcagcaaataaccgccctgccccatgccaggcagggctt

SEQ ID NO: 2659 - DNA, 601 bp, Human
acagaatgttatagacataggtaagacacagatcaaggtctttcccactccagacactttgcatttacttttcctttgcacagaattctgttccccaagacttcctcatggccaccccttctcagtattcagccccaggtgaaaggtctctccctcaggatgccttcccagacccccagaccctttcctaaaaagctttcacttcactcctcagcacaccgcacgttcggtcgtctccatggcacttactctccatggccatcctgttgacttctttgtttacctgtttatgtcatgttgcccccccgggaggaggtacattctacaagagcaagagcctcatctgacctgtatgcagccacggctgcaggacctgggcggactggatctagcaggcatccaggaaatgtttgtggaatcaatgaatgaaagaatgaacaccatggtgagcaaagtgatgtggttcctgaccccacactgctgcacaccttattatgaggagagagagtcaacaaataagcataaataagccctgagttctacaggtgagaaggtggggagtggacaggcacagaggaaaatcatgtgtagacacagggag

SEQ ID NO: 2660 - DNA, 601 bp, Human
aggcgccatgcttcttgcacagcctacagaaccatgagccaaataaacctctttcctttataaattaccgagcctcagatatgcctttatattagtacagaatgttatagacataggtaagacacagatcaaggtctttcccactccagacactttgcatttacttttcctttgcacagaattctgttccccaagacttcctcatggccaccccttctcagtattcagccccaggtgaaaggtctctccctcaggatgccttcccagacccccagaccctttcctaaaaagctttcacttyactcctcagcacaccgcacgttcggtcgtctccatggcacttactctccatggccatcctgttgacttctttgtttacctgtttatgtcatgttgcccccccgggaggaggtacattctacaagagcaagagcctcatctgacctgtatgcagccacggctgcaggacctgggcggactggatctagcaggcatccaggaaatgtttgtggaatcaatgaatgaaagaatgaacaccatggtgagcaaagtgatgtggttcctgaccccacactgctgcacaccttattatgaggagaga

SEQ ID NO: 2661 - DNA, 601 bp, Human
gggagatgtttggatcatgggagtggatccttcatgaatgggttggtgccttccctgcggtaatgagtgagttcttgctctattagttcacttgagatctggttgttaaaaggaaactggtgctttcctcccttctctctctcttgctctctctcaccatgtaacacgccagccccccttccccttccaccaggattggatgctctctgaagccttcaccagaagtagatacaggcgccatgcttcttgcacagcctacagaaccatgagccaaataaacctctttcctttataaattacygagcctcagatatgcctttatattagtacagaatgttatagacataggtaagacacagatcaaggtctttcccactccagacactttgcatttacttttcctttgcacagaattctgttccccaagacttcctcatggccaccccttctcagtattcagccccaggtgaaaggtctctccctcaggatgccttcccagacccccagaccctttcctaaaaagctttcacttcactcctcagcacaccgcacgttcggtcgtctccatggcacttactctccatggccatcctgttgactt

SEQ ID NO: 2662 - DNA, 601 bp, Human
agtcataaaggagcagtggaaggcattggtctgaactatcacattcattctggccatctggacattggacatgatgcttctgattgtcagacactcatgctccagctccaggatctcccgagggacctgcaggacaaatttcaccaccttcagctccttggacgccttcttctgaatgacgctatcaaaatcacagtctagctggtcactggtgattggccctgttaggacagccaaggtgaactcaaggccatgaagcgtgtggctgaagggagtgaagaacaggaaggccaggtggacwtcagggccctagtagaccaacaggcccacagtgccctggaagctgaggctcatctatgccaagcagcaacttcgggcactatccttcgggtagtagagcctggggagaaaggaaagttagaagttaccactgtgctttgtaggcagtgttgcacactggataagattagaagacctggaagcctctacaggtcatacatgacttaggagaaagacattcatccattctttcattcattgagaagacctggagctccaccacctcctcctgtggagctcttgtgatctacttttaccacgt

SEQ ID NO: 2663 - DNA, 601 bp, Human
cggctcactgcaacctctgcctcccgggttcaagcagttctcctgcctcagcctcctgagtagctgggactacaggcgcaggctgccacgcctggctaactttttttttttttttttttttttttgagacggagtctcgctcttgttgaccaggctggagtgcgatggcgcgatctcggctcactgcaacctccgcctcccggattcaagtgattctccttctgcctcagcctcccgagtagctgggattacaggcgaccgccatcacgtccggctaatttttgtatttttagtagagacrgggtttcaccatggtggctaggctggtctccaactcctgacctcaggtgatccgcccgcctcggcctcccaacgtgctgggattacaggcgtgagccaccgcgaccggcctgggttaacgttatgaacgaacgaacgaacgaacgaacgagaggcaaccgctctgtggcttcctgaggttcactccggggtttccatcttgactccctccctccgctgattctggaacttcctctggggcagctcagtgcggtcctcgccgcacgggacagccagggggagcgcgcgctctgctccctcg

SEQ ID NO: 2664 - DNA, 601 bp, Human
agtctcgctctgtcgcccaggctggagtgcagtggtgcaatctcggctcactgcaacctctgcctcccgggttcaagcagttctcctgcctcagcctcctgagtagctgggactacaggcgcaggctgccacgcctggctaactttttttttttttttttttttttttgagacggagtctcgctcttgttgaccaggctggagtgcgatggcgcgatctcggctcactgcaacctccgcctcccggattcaagtgattctccttctgcctcagcctcccgagtagctgggattacaggcgmccgccatcacgtccggctaatttttgtatttttagtagagacggggtttcaccatggtggctaggctggtctccaactcctgacctcaggtgatccgcccgcctcggcctcccaacgtgctgggattacaggcgtgagccaccgcgaccggcctgggttaacgttatgaacgaacgaacgaacgaacgaacgagaggcaaccgctctgtggcttcctgaggttcactccggggtttccatcttgactccctccctccgctgattctggaacttcctctggggcagctcagtgcggtcctc

SEQ ID NO: 2665 - DNA, 601 bp, Human
ccactttcagggttctataggaaatgaaagttacaaaaaacagcgttggaaagctttttcacaggctgtttgttaaactgatctccaagaaacacgtgtaacagtgtaaacatagggttaattttgtttgtttgtttgtctgtttttgttaaggcagagtctcgctctgtcgcccaggctggagtgcagtggtgcaatctcggctcactgcaacctctgcctcccgggttcaagcagttctcctgcctcagcctcctgagtagctgggactacaggcgcaggctgccacgcctggctaactttttttttttttttttttttttttgagacggagtctcgctcttgttgaccaggctggagtgcgatggcgcgatctcggctcactgcaacctccgcctcccggattcaagtgattctccttctgcctcagcctcccgagtagctgggattacaggcgaccgccatcacgtccggctaatttttgtatttttagtagagacggggtttcaccatggtggctaggctggtctccaactcctgacctcaggtgatccgcccgcctcggcctcccaacgtgctgggattacaggcgtgagccacc

SEQ ID NO: 2666 - DNA, 601 bp, Human
tagagttcacattcccaaaactgtgaaattcaggttgctggtcttgtctacacaggtcatccacacattctctcttcagggccactgtcctgacacagccattcttctagctgcctcaggtaggtccacccactataaactattgtagaagtcagttgtgtaatttttgagaggtgaaaatgtcactgctgttctgaatttagtattacttcgttgaaagaaaacatggagactctcatggttcatgtaatcttgttttatcctccccgttttgttttttggtattacgtaagaaaccttagaaagcactgttggcagaaacgtcagtcactcagaaaaagtcctggcagtctgcacatcttatttttatgtccttcttgtgcaccccactaccaatctcagtttccaaacccaactcacaacgagaactttacatcttttatgcctaaggaaggggccatcccgcggtcctgcctatgggatacagaggggacacacgggtggcagtggaagacactgactgcaagcaccttggttaaccgcttcctgccactttcagggttctataggaaatgaaagttacaaaaaacagcgttggaaa

SEQ ID NO: 2667 - DNA, 601 bp, Human
aagctggtgcgcatggacatgtggacacacgatacatacaagggtatttagtacaatgctgttggaattagcaaaggcaaatttgctttgggttatatcccatcgggatgggatataaccagctgcctctagatggcaacagtgaattaacctgtggcttacccatgtagtaaaatacaatacccttgtttaaaagaaaatcaatctgaatgtactgccataaaacatctaatgtgatttgtgctagctccaaaattttaaaaagcaactgtgcattgaaatgcatttaataaggcaagaytgatggagggatcaaagcctcctttgggacgcatagagttcacattcccaaaactgtgaaattcaggttgctggtcttgtctacacaggtcatccacacattctctcttcagggccactgtcctgacacagccattcttctagctgcctcaggtaggtccacccactataaactattgtagaagtcagttgtgtaatttttgagaggtgaaaatgtcactgctgttctgaatttagtattacttcgttgaaagaaaacatggagactctcatggttcatgtaatcttgttttatcctccc

SEQ ID NO: 2668 - DNA, 601 bp, Human
tctaaggagttgcccaataagctggtgcgcatggacatgtggacacacgatacatacaagggtatttagtacaatgctgttggaattagcaaaggcaaatttgctttgggttatatcccatcgggatgggatataaccagctgcctctagatggcaacagtgaattaacctgtggcttacccatgtagtaaaatacaatacccttgtttaaaagaaaatcaatctgaatgtactgccataaaacatctaatgtgatttgtgctagctccaaaattttaaaaagcaactgtgcattgaaatscatttaataaggcaagattgatggagggatcaaagcctcctttgggacgcatagagttcacattcccaaaactgtgaaattcaggttgctggtcttgtctacacaggtcatccacacattctctcttcagggccactgtcctgacacagccattcttctagctgcctcaggtaggtccacccactataaactattgtagaagtcagttgtgtaatttttgagaggtgaaaatgtcactgctgttctgaatttagtattacttcgttgaaagaaaacatggagactctcatggttcatgta

SEQ ID NO: 2669 - DNA, 601 bp, Human
attctacttctaaggagttgcccaataagctggtgcgcatggacatgtggacacacgatacatacaagggtatttagtacaatgctgttggaattagcaaaggcaaatttgctttgggttatatcccatcgggatgggatataaccagctgcctctagatggcaacagtgaattaacctgtggcttacccatgtagtaaaatacaatacccttgtttaaaagaaaatcaatctgaatgtactgccataaaacatctaatgtgatttgtgctagctccaaaattttaaaaagcaactgtgcrttgaaatgcatttaataaggcaagattgatggagggatcaaagcctcctttgggacgcatagagttcacattcccaaaactgtgaaattcaggttgctggtcttgtctacacaggtcatccacacattctctcttcagggccactgtcctgacacagccattcttctagctgcctcaggtaggtccacccactataaactattgtagaagtcagttgtgtaatttttgagaggtgaaaatgtcactgctgttctgaatttagtattacttcgttgaaagaaaacatggagactctcatgg

SEQ ID NO: 2670 - DNA, 601 bp, Human
agtaaaattctacttctaaggagttgcccaataagctggtgcgcatggacatgtggacacacgatacatacaagggtatttagtacaatgctgttggaattagcaaaggcaaatttgctttgggttatatcccatcgggatgggatataaccagctgcctctagatggcaacagtgaattaacctgtggcttacccatgtagtaaaatacaatacccttgtttaaaagaaaatcaatctgaatgtactgccataaaacatctaatgtgatttgtgctagctccaaaattttaaaaagcaaytgtgcattgaaatgcatttaataaggcaagattgatggagggatcaaagcctcctttgggacgcatagagttcacattcccaaaactgtgaaattcaggttgctggtcttgtctacacaggtcatccacacattctctcttcagggccactgtcctgacacagccattcttctagctgcctcaggtaggtccacccactataaactattgtagaagtcagttgtgtaatttttgagaggtgaaaatgtcactgctgttctgaatttagtattacttcgttgaaagaaaacatggagactc

SEQ ID NO: 2671 - DNA, 601 bp, Human
aaacttctgaaatgatttatcccacggaagtagaagtaaaattctacttctaaggagttgcccaataagctggtgcgcatggacatgtggacacacgatacatacaagggtatttagtacaatgctgttggaattagcaaaggcaaatttgctttgggttatatcccatcgggatgggatataaccagctgcctctagatggcaacagtgaattaacctgtggcttacccatgtagtaaaatacaatacccttgtttaaaagaaaatcaatctgaatgtactgccataaaacatctaatgygatttgtgctagctccaaaattttaaaaagcaactgtgcattgaaatgcatttaataaggcaagattgatggagggatcaaagcctcctttgggacgcatagagttcacattcccaaaactgtgaaattcaggttgctggtcttgtctacacaggtcatccacacattctctcttcagggccactgtcctgacacagccattcttctagctgcctcaggtaggtccacccactataaactattgtagaagtcagttgtgtaatttttgagaggtgaaaatgtcactgctgttctgaattt

SEQ ID NO: 2672 - DNA, 601 bp, Human
tgtagggatacaggcacatgtgtgaactaggtgtgagtgtaagctgagttcaatggtcttttggaagaaaattcgtaaacatctaaagaaacttctgaaatgatttatcccacggaagtagaagtaaaattctacttctaaggagttgcccaataagctggtgcgcatggacatgtggacacacgatacatacaagggtatttagtacaatgctgttggaattagcaaaggcaaatttgctttgggttatatcccatcgggatgggatataaccagctgcctctagatggcaacagtgaactaacctgtggcttacccatgtagtaaaatacaatacccttgtttaaaagaaaatcaatctgaatgtactgccataaaacatctaatgtgatttgtgctagctccaaaattttaaaaagcaactgtgcattgaaatgcatttaataaggcaagattgatggagggatcaaagcctcctttgggacgcatagagttcacattcccaaaactgtgaaattcaggttgctggtcttgtctacacaggtcatccacacattctctcttcagggccactgtcctgacacagccattcttctagctg

SEQ ID NO: 2673 - DNA, 601 bp, Human
ggggccacaccagtgtcacagagctggaggggaagcacagcagggcccagctgttcccagcctccaatctcaggagtccttgagagcctcagagtccgagattctgggccgttggatcttttcgattcctactttgataaagagaagggcggggcggaagcctctgtcacacagattggaacagtccaacgctgacagagccaggacctggggtcaggaactgagctcagctccaggctcatctgatgtcctcctgacagcctgaagatggagaccttatctccatttacaggcgtggcakgtggcagggtactggccccagctgaccacggttctccaagttcacagctgggaattcagtcttccctgccaccctcccctgctgtctcatctggatcccccggtcatctactcccactaccaaaactcccgtatccttgaaaattcctaataccattaaggaatgaaagtacataacaatgtgatgaatcaccttttacttcctagactagcaacgaatgaaagctaagtgtaacaagggtgtagggatacaggcacatgtgtgaactaggtgtgagtgtaagctgagttcaatggtctt

SEQ ID NO: 2674 - DNA, 601 bp, Human
atatataagtaactgactctcactgcttctctgtgctaggtaaaacttgcattaaataaatgtgtgtgttggctgggcatggtggcacacacctgtaatcccagcattttggaaggctgagatgggcggatcacctgagctcgacttcgagaccagcctggacaacatgacaaaaccccgtctctactaaaaatacaaaaattagccaggcgcaagggtgggcacctgtaatcccaaggtactcaggaggctgaagcaggagaatcgcttgaatctgggaggcggaggttgcagtgagccragattgcaccactgcactccagcctgggtgacagaacaatactccatctcaagaaaaaagaagtcgtacgtgcttttctcctgtgtacctgtcttatgtcaatttaattctcaggtccagccaaaaaaaaaaagcccttcaaggggagcttcgcttccctctatgactctcaatggtgactctaaccaaacaccatcctccacgccaacaataccacatcctatagccttgcaccaacacggcctctctggaggagggggaggcaatggtggtgagatctcaggcctccctcatgctacc

SEQ ID NO: 2675 - DNA, 601 bp, Human
tccactttaactgggtactgactttttatgcatacctatttccatgatctatgtgcaagtgctatagggaatacagtatacactcaagtgcttatattctattgaaggtttttttaaaatagatttattgtggtataatggatatgaaacaaagtgtacatttttgaagcatgtagtttggtaggttgagatgtacgtatacactgtggaactatcgccgcgataagataatgacatgtctaccgtcctgcagtgtttcttcatttttcaatgtaatcctctcttctgctttgctcctatrtccccagcaatgcttcttctgctttttatcacaatagattagttgtattttaataagatgaggaatcacatggtatgcattctgcttgtattccttcacacgacatgattttctgtgtgtgtgtgtgtgtctgtgtctgtggtttttggttttattttggtttttggttttgagacagcattttgctatgtttcccaggccggtcttgaactcctgggctctaaggatgcacccacctgggcaggactatacatgtgagccatcgcacctgcccacccaccctggcccattgactattat

SEQ ID NO: 2676 - DNA, 601 bp, Human
gttgggcgaccatcaggtggttgataaccgtgtctctaaagtaagaactggttacagccaatgccagaaaaaggcagtctcctaatacatagaaaacacctgaaactgatcagcagcttcccaataagatttcaggagtggggagaagtaaggcaagatcctggaagtaggccaacctataaaaccccaactcaggcagtccggctgtgcactgtttctcaagtcacctgctcggccatctttcaagttgtactttccttcttttctttccgttccttcctttccttcctgttctaaagcttttttaataaactttcactcctgctctgaaacttgcctctgtctctccttctgccttatgcccctcagtccaattctttcttctcaggaggcgaagagctgaaggtgctgtggacccatacggattcgccgccttcaacgtagggtaactcggatctcgtccaccgctaacaaaatcaacttcatgtgatactgagatagccacggcagttttcttggccttacactctgcgtggggtatctttttccatctatttgctttccacagacagcatctgtgtcttccttttaaggcccatct

SEQ ID NO: 2677 - DNA, 601 bp, Human
acagagaaacagctgatttaatctccttttcattctctttttgcatcatgtgttctgcagctgtattactaggcatatacaatttgtgattattattatactccttgaagaattaacctttttaactacaagggtcccttttgagctcccataatattctatgtcctaaaattgttacagtaggcagctagtcaggtatgagcagggtaggagagggctccccgcttctgacaccagcagtgttgggcgaccatcaggtggttgataaccgtgtctctaaagtaagaactggttacagccratgccagaaaaaggcagtctcctaatacatagaaaacacctgaaactgatcagcagcttcccaataagatttcaggagtggggagaagtaaggcaagatcctggaagtaggccaacctataaaaccccaactcaggcagtccggctgtgcactgtttctcaagtcacctgctcggccatctttcaagttgtactttccttcttttctttccgttccttcctttccttcctgttctaaagcttttttaataaactttcactcctgctctgaaacttgcctctgtctctccttctgccttat

SEQ ID NO: 2678 - DNA, 601 bp, Human
tcgcgtgttttatatcccagaacccagtctatcttggtgaaagtatcatgagcatagaaaggaatcagtgttcagtggatgttccactcctgctctttaaatgtcagttaagtcaaggtggttgatagtgtgcagatcgcttgccactttaccggggttttcatctgaccgttctgtcaattacagagaaacagctgatttaatctccttttcattctctttttgcatcatgtgttctgcagctgtattactaggcatatacaatttgtgattattattatactccttgaagaattaacctttttaactacaagggtcccttttgagctcccataatattctatgtcctaaaattgttacagtaggcagctagtcaggtatgagcagggtaggagagggctccccgcttctgacaccagcagtgttgggcgaccatcaggtggttgataaccgtgtctctaaagtaagaactggttacagccaatgccagaaaaaggcagtctcctaatacatagaaaacacctgaaactgatcagcagcttcccaataagatttcaggagtggggagaagtaaggcaagatcctggaagtaggccaacct

SEQ ID NO: 2679 - DNA, 601 bp, Human
taaaagctacttaccttgggctctgttcaactacctggctctcagcaagacaaaatgtagctttcttccacatgaaagcctgcctagtagttggtgacagtgaagctaatgcacatttcccaaatcctcccttctagagctggggtccctctaggttcaggcgatgtctctgtcacctttctctgctctcacacccttactccttttcaagagcaactattcattttctcaactctttttttttttttttcttttttggagacgggatctccctctgtcatccaggttggagtgcagtggygtaatctctgctcactacaatctctgcctcccgggctcaagtggtcctccaacctcagtccctaagtggccgggaccacagacaggagagtgccccaatgcctgggctaatattggtgtattttatacagctggggtttcatcacgttgcccaggctggtctaactcctgagctcaagcgttctgcctgcctgagcctcccaaagtactaggattacaggcgtaagccaccacacacagtccgttttgtcagttctttttgtggtttctattctatttccttgatttatgttcctccttg

SEQ ID NO: 2680 - DNA, 601 bp, Human
tgtaaatttacatttaattaaatttaatataatcttgctcctgagaaaaaacaaaatggttacaataaaagctacttaccttgggctctgttcaactacctggctctcagcaagacaaaatgtagctttcttccacatgaaagcctgcctagtagttggtgacagtgaagctaatgcacatttcccaaatcctcccttctagagctggggtccctctaggttcaggcgatgtctctgtcacctttctctgctctcacacccttactccttttcaagagcaactattcattttctcaactctttttttttttttttcttttttggagacgggatctccctctgtcatccaggttggagtgcagtggtgtaatctctgctcactacaatctctgcctcccgggctcaagtggtcctccaacctcagtccctaagtggccgggaccacagacaggagagtgccccaatgcctgggctaatattggtgtattttatacagctggggtttcatcacgttgcccaggctggtctaactcctgagctcaagcgttctgcctgcctgagcctcccaaagtactaggattacaggcgtaagccaccacac

SEQ ID NO: 2681 - DNA, 601 bp, Human
agaccatcctggttaacacagtgaaaccccgtctctactaaaaatacaaaaaattagctgggcatggtggcgggcacctgtaaccccagctacttgggaggctgaggcaggagaacggcgtgaacccaggaggcggagcttgcactgcactccagcctgggcgaaagagcgagactctgtctcaaaaaaaaaaacaaaaaacaaaaaacaaaaaaaccacacatatgagcccttcaagcagaaatagcatctaatgtatttagtttgaccaagtgtttaattgaccagtgggtgaatattttctctctctctctctctcgcacacacacagacacacacataaaaatacacatttttacaaatgagggttacaatataaccttaaagaaagtcaggatatagcatcaaacattaagtaatttctgcttcacaaaggaccttgacaagctgttcccactaaatatcaaagagtgacagaaaaagataaaacagcaattcagggattatggccatgatctctgtgttataaatgacgacgagaagacaactggagaatcggaatagagtctgcatattagatagtggtaatgtgttgatgtta

SEQ ID NO: 2682 - DNA, 601 bp, Human
ttcgtcctgccgggggatggtggcagagtcaacccggacctgtggggacaaggcagagatgggcttgagtggcttccagaccttacctctcccaggctccgtctcacattcccttcaccccaagtgacaaaacccatgagagcctggacttttttcccattccaaactttcattcttttgcatccgtgtttgtcccctggcctgttaggtagctattttctataaagaaaaacacctccgtatccttttatcatattataacataaaatatatttaccccagaaaatatgagcagaagagtttttttttttttttgatagagtcttgctatgttgcccaggctagaatgcagtgtctattcacaggtgtgatcatagtctactacagcctggaacttctggcctcaagtgatcctcctgcctcagtctcccaagcaagttgggtaacaggaacacaccactgtagttggcaagaaaagattttataagaacacaaaaggccaggcgcggtggctcaggcctgtaatcacagcactttgggaggccaaagtgggtggatcatgaggtcaggagattgagaccatcctggttaacacagtgaa

SEQ ID NO: 2683 - DNA, 601 bp, Human
tttaagttatctctactctttaggagacagccactctttaagagagccaagatggagaaggatgttaggttcagatgtgtcaattagggaaaacacagaggaagcaacacaacaaaacacaggaaacacagaagtggtgtattacttacagactccagagagaagaggatagcacactttgcagcacttacgggaagtggggagctatccagtccgaggacactaaccggtgtgtggggagcaagagacagagagagaggacccgtgggactacacctttataaagatccatgggcattayaccccaggctttcccacagggattgtggaagacaacacctgcaaagaaggttcacactgctctgctgtgaaccattaggttttattgtagtcagctcctgtgggatgtgttgggtttggggtcagggagatgatgaacaaatgtgctagatcaaaaacaattgaacagggaaaggaattattaattgggcaaaagatgctgtggtatgattgggttttaaacaacttacattgggcctaaaaatggatgtcaaggcagcaactcttttaaataaatttgtgacagaggtggaagatgtga

SEQ ID NO: 2684 - DNA, 601 bp, Human
gagttgattaatcggaagaaagaatcagtgagcttgaaaacagatcatttgaaattaccaagtcacaggaagaaaaaaaaaataaagaatgaaaaagagggaagaaagccaacagtaccaacggttactgtgaagcaaaacaatatatgcattatggtggtccaaggagcatcagagaaagtgaaaggaacagaaagtgtaattaaagaaataattaaagaaaatgtcccaaaacaggatgggaatggacatccacattcatgaagcccaaaaaacccctaacagataaatatgaagagawcttcaccaagacacatcttaaacaaattcccaaacatcaaaggcaaagagaattttgaaaccagcaagagacaagcaatgtacaaaggaacccctataaaactaccaaaggcttctcagcagaaaacctacaggccaggagagagtggaatcatacaaagtacagaaaggaaaaattccttgccaaccaagaatactacacctggcaagcctgtcctttagaaatgcagagcagtaaagactttatcagacaaagaaaaaaaaaaacggggggagttcatctttagcatgtattgcctta

SEQ ID NO: 2685 - DNA, 601 bp, Human
catccaacatgtccctatggaataaagaaccagaaagtgcaggaaacagaagtctggaaacacatagagataagggcatgataaaggcatgataagctaagatatcagtcttagcttgtgccttcgggctagcactacagacccaggatcctgacccacctccatagattcagcttccagatctgtcctagtgccaggtcagtccccatgaactcaggctccaggcccttccctgtggacccaaggatgagacccatcacagcacctggctgacatctgcagacccaagtacaaggcctaytccagtgccagttcagccctcatggagccaggcctcaggtcacctctctggatactggctctgaccacccttgaaccacaccacatggcctgcccagaatctgtgaacaggctgactggtgaagggcgttccctgacaaagccagtctgtaaatactggattaagtccctgcttcttcaaagtgcacattccaacatattgccacaggctcctgagcaatcagggaacagtgacggcaccaaagaaacaaaatgaagcacaagtaaccaacccgaaaggaatagacatttacaacagcct

SEQ ID NO: 2686 - DNA, 601 bp, Human
aattctatgaaagccacattaaaatagtacaaagaatgaggtcaaattaattttaactattttttagcctaaaaatatccaaaacactacatttcaatatgtaatcaatataaatatttgaaatattttatctttttttggccaggcacggtggctcacgcctgtaatcccagtacttagggaggccaaggcggacgaatcacgaggtcaggagatcgagaccatcctggctaacacagtgaaaccccatctctactaaaaatacaaaaaattagccgggcgtggtggcaggcacctgtartcctagctactcgggaggctgaggcaggagaatggcgtgaacccgggaggcagagcttgcagtgagctgagactgtgccactgaactccagcctgggcgacagagcaagactctgtctcaaaaaaaaaaaaaaaaaagaaaagaaaagaaaagaaatattttatcttttttaaaattttttttggagacagagtttcactcttgtcacccaggctggagggcaatggcgcgaccttggctcactgcaacctccacctcccaggttcaagcgattctcctgcctcagcctcctgagtagct

SEQ ID NO: 2687 - DNA, 601 bp, Human
ctattacatacctttgactggcactgctgacagaaatataatacaaatcacatgcaaaattcaaattctatgaaagccacattaaaatagtacaaagaatgaggtcaaattaattttaactattttttagcctaaaaatatccaaaacactacatttcaatatgtaatcaatataaatatttgaaatattttatctttttttggccaggcacggtggctcacgcctgtaatcccagtacttagggaggccaaggcggacgaatcacgaggtcaggagatcgagaccatcctggctaacacrgtgaaaccccatctctactaaaaatacaaaaaattagccgggcgtggtggcaggcacctgtaatcctagctactcgggaggctgaggcaggagaatggcgtgaacccgggaggcagagcttgcagtgagctgagactgtgccactgaactccagcctgggcgacagagcaagactctgtctcaaaaaaaaaaaaaaaaaagaaaagaaaagaaaagaaatattttatcttttttaaaattttttttggagacagagtttcactcttgtcacccaggctggagggcaatggcgcgaccttg

SEQ ID NO: 2688 - DNA, 601 bp, Human
gactcacatcggctacagctcccacctcatcactatgcactccacctctgggcaaggggtccacacattctgtacctgatttacaaactgtacatagcaggcaagaaggcaaattgttggaagcaatggtgtaatccacaccctctgtgcacgggttacaggctccagtatattctgatctatgagatcctgggaagggagagaaaagttaatgaatgagtcaccacagaattcccagaggctgacaatggctggcaaatttctcttttggccctcagtggaatccagacagagaaatctrctcttcttggcttggtcttgtcatcaattctgcatctattacactattacatacctttgactggcactgctgacagaaatataatacaaatcacatgcaaaattcaaattctatgaaagccacattaaaatagtacaaagaatgaggtcaaattaattttaactattttttagcctaaaaatatccaaaacactacatttcaatatgtaatcaatataaatatttgaaatattttatctttttttggccaggcacggtggctcacgcctgtaatcccagtacttagggaggccaaggcgg

SEQ ID NO: 2689 - DNA, 601 bp, Human
actaaaaatacaaaaaaaaattagccgggtgtggtggcgggcacctgtagtcatagctactcaggaggctgaggcaggagaatggcgtgaactcaggaggcggagcttgcagtgagccgagatcgcgccactgcactccagcctggacaacagaacgagactccgtctcacaaaaaaaaaaaaaaaaaaaaaaaaattagctgggtgtggtggtgcatgcctgtgatcccagctacttaggaggctgaggtagaagaatcactaaacctgggaggcagaggttgcagtgagccaagatcaygccattgccctcaagcctcagcaacaagagtgaaactgtcttcaaaaaaataaataaataaaagaaaagaaaaaaaagatttctattttttttttttaatcaactagtcataatcatggaacagggcatgatgaagactaccaagttgggctagaacttggttccccgactcacatcggctacagctcccacctcatcactatgcactccacctctgggcaaggggtccacacattctgtacctgatttacaaactgtacatagcaggcaagaaggcaaattgttggaagcaatggtgta

SEQ ID NO: 2690 - DNA, 601 bp, Human
tggctcacacctgtaatcacagcactctgggaggctgaggcaagcggatcacctgaggtcgggagttcgagaccagcctggccaacatggagaaaccctgtctctactaaaaacacaaaaaactggctgggcacggtggctcatgcctgtaagcccagtactttgggaggccgaggtgggtggatcacgaggtcaggagatcgagaccatcctggctaacacggtgaaaccccgtctctactaaaaatacaaaaaaaaattagccgggtgtggtggcgggcacctgtagtcatagctactyaggaggctgaggcaggagaatggcgtgaactcaggaggcggagcttgcagtgagccgagatcgcgccactgcactccagcctggacaacagaacgagactccgtctcacaaaaaaaaaaaaaaaaaaaaaaaaattagctgggtgtggtggtgcatgcctgtgatcccagctacttaggaggctgaggtagaagaatcactaaacctgggaggcagaggttgcagtgagccaagatcacgccattgccctcaagcctcagcaacaagagtgaaactgtcttcaaaaaaataaataaataa

SEQ ID NO: 2691 - DNA, 601 bp, Human
tcatacaggacacccaccctgtatgtaaggaccaatacaaaaggaccgtgattcattatttattatatcaggttaggggaaaagcattgtttagatggcatggtcagtagcaagggaggcgcaagggcatcacctgagagactctgcaaggagaggggcccttgggggacttcccaaaagccccggccttgctggggaagaggaaggggcctgagaacctgaaggctaagtgaggccaagcacctttcaggagcacagagcccgggaggagagagcctggccacggagcagacctgtgccrctgctggaacccagccctgtccactgggccaggcctcctctatgctgtaatgatgcccccacccggctgcaggcaatagtttagaagatttcccagcctggtggcatgcattacagaaaagattttggccaggcgcagtggctcacacctgtaatcacagcactctgggaggctgaggcaagcggatcacctgaggtcgggagttcgagaccagcctggccaacatggagaaaccctgtctctactaaaaacacaaaaaactggctgggcacggtggctcatgcctgtaagcccagtact

SEQ ID NO: 2692 - DNA, 601 bp, Human
caacgcaggctcaggaaaccccacaggctcagggaggcctcgggcctggaggatccatggggtcagcggagagatagaggtaccaggtgaatcaggtcttttcaggttcctgaaagctgttgggagcccctggctgctgtcttaccctgttctacacgtccggcacatctcaggggagtttttatcctggaagcttcctttttcacactgacacacggtgtctctggtcgtggtacaggaacttttatttgtttgacctgacaacagagcataaggttttgagaatgtgtttccctgacaygtctgtccacccttcctcaccaccccatcccctcccactcagctcaactcagttcaccaaggagttctgagggctggtttctgcaccagcacactcgggactcatacaggacacccaccctgtatgtaaggaccaatacaaaaggaccgtgattcattatttattatatcaggttaggggaaaagcattgtttagatggcatggtcagtagcaagggaggcgcaagggcatcacctgagagactctgcaaggagaggggcccttgggggacttcccaaaagccccggccttgctggggaa

SEQ ID NO: 2693 - DNA, 601 bp, Human
ccctgagaaggcgtcaggaggacaggctcctcgtgtcagcagtgggtccccctgtgctcccttcttgaggctggggaagggtctgagcatgcacacttcagcccctcggcctccctgctctggggtcagagctgtagatccaggagccttctgtgctgggcacacactgagcttccctgggctgcaggggaggcctgcgttaggaggagccgcactccaggggaagatcacaagcccctgtggccacaagctgagccccttcctccagttaacacacagtacaagtgagtcctcgccccaycctgtctgccgctggttcctcccaaccacagcaaacactggagggccagagaagagcaagttactctttgcccctaaaacccaaataggataaagaaggacttagtgagaaatcgggggccaggggtgaggccggctgggtgggctcaggtcctcatgggaacttaagggagctccacccatggccttattatgacttttgtgggctacggacacttttgtctttatgggtccctgcccacataaaaaatattaaaaattacattttttaaaccaacttagagtaaggaaaaatacaagc

SEQ ID NO: 2694 - DNA, 601 bp, Human
cagtcctcagtgaaccctgtgacacccactctatgcctgtggagatccaggctctggggacacagcaaggacaggacagggagtaagaagcagatgtcctgcagactggcacggtcaccacctcagtgcagctgctccgtcccctgcagtcccctgtctcccaaaggctccatgtccccttgggccaggaaagaggaggcactgccatgtcccactgtctacaaagtcctgtgcaggctgcacgccaggcagggcacagtccctcctcaactcaccagcagacgctgtggctcctctggcractctacagtcacacctgttagctctgccagctcctgaccttggatttcctgctcagagacctgggtgggctgcaagtatctgttactcagggtctcgttgcgggcattgtcctccgccccaggaactcgtgaaggacatgaacgccgccggaaaaggaccttgggaagacaaagagcccactcaagtccacaccccgggctcagcttcagggtccccagtacacagctggacctgccatccccaaccccttccaatgaggtcaccccaggcagctgaggctcagcacatccaggacccc

SEQ ID NO: 2695 - DNA, 601 bp, Human
aaaaactgatggttataaaataaacccgtttaaagtgctttgagcattttacaggaagggctaagagcagagagattcaagatatttgccaaatttgaatgcccatttaaacttaactgtaacatctttgatggcaggtactacagcttcattttctgttatccctagacaatggggtctaaagccaccacggagcatctgagaatcataatgatattagttaaattaaatactgtcactattacacgagaccaaatctctgtctgcaggtgttctctgtgtaaagtagtttaagtctgcytttgatggtgacatttctctccctgggtctcagatccctgttgacactgctttctccagcactttcctctctctcccccgtttctcaccaaaaagttttgtgggtaaagtttagttcattatttctgccagagacagctgaaggtgtagccttgaccaactgaaagggaaatcttcatcctctgaaaaaacatatgtgattctcaaaaaacgcatctggaaaattgataaagaagcgattctgtagattctcccagcgctgttgggctctcaattccttctgtgaaggacaacatatggt

SEQ ID NO: 2696 - DNA, 601 bp, Human
ccctgagcagggtttcccaaaagtgtctcccagatgagcgtggtggctctgacacttgtttataatgtaggttccattgttcttctccttgagaatctgatttaataagtcctcaggaagcccaaaaatctgcatttgtaataagggtttcgggtgattcttataatcaagatgatttgagaaacactgtcccagagtgatagctgcagcctgcaatcagccccaggcagctggaggtctgaggccagttggtgggtgggtgcatcagtaggcagtatctgtcatctcaaggttggcggamattcctgagtgctggagactgctgggcatcgtggtaactaatttgctataggcttggacatttagacataaattgcgggatggtagagctgggaggatcttagcaaccatctgatcttatgatttacaagtcagggagcttttttaaaaattacaaatatcccgacttaaacatcagaaattctgattccctcattctaaggtggaggaactactgatacagtccagacattttattttgcaggtaagaaagctgaggtccaaaaagagcctaagtgacttaattggagccacacagtat

SEQ ID NO: 2697 - DNA, 601 bp, Human
aacaagtcattactgagctcctgttatcagctaggcactattcctgcagagaggctgcaggactcagaaagacaaactcagttcctgctgggatggaacttatattctagttggggagaagttttaggagtaagatattttcagacaataatatgtgctaagacaaaagtcatttaaaatgagtagcaagagagatggttgatggcaagaagggagagggcgcttctttatccaggtggtcagggaacgactctctgaggaagaaatcagggaagacatgagagagccaaacgctacagcrttttgtccatggtgctctggaatctgtgcttcatcacatgggtggtgggagccggtgacgttttgggcatggaaatgaaatgcccaggcttgctgcttaggaagatgtgtctggtggtggagttggaggactgttctttcggagactttgtggacaagggaaaggcaagtggggagaccacatctttaaaggccattgctgatcctgccttgttccttggttgcagtccttgtaagaagagctgtcagttgtcagcaatggggataatgcagtgaccttaacacctatccgtggcattct

SEQ ID NO: 2698 - DNA, 601 bp, Human
gtactttcctgtactttctggctccacctggacaaagtggtctgggcagactttccttttcacctgcatggttctacctgcctcttgtccaagattaatctccccatggtatcagggaccccacttcttctggcttcctgggagaaagcagtccatgcaccctctcctcactctcacttgtatttgtcctcactgacctgctgacgcattcccctcgcagtggaatcctacccaaggccctctcatctccagaaatgagcaaacacttcctcctgtcttcctgcatcatgcagactctagsaggcgtggttcttccccgcttcccacattccctctactcctctctctccaccctgaagctctccgttatctcaccccagctgcacatgctgagcttttggtggccaaaccaagactctttggtggacacttttcagtccttctcatgcccaactcctctgcagcttctgaaactgatgtctagtctctcctccaagctttctctgtctggattgccaaggtggtctctctgctctgctccttgcattccttttaggtttgtcattctttattttccattagccctggcctacttttaaag

SEQ ID NO: 2699 - DNA, 601 bp, Human
cacctgcatggttctacctgcctcttgtccaagattaatctccccatggtatcagggaccccacttcttctggcttcctgggagaaagcagtccatgcaccctctcctcactctcacttgtatttgtcctcactgacctgctgacgcattcccctcgcagtggaatcctacccaaggccctctcatctccagaaatgagcaaacacttcctcctgtcttcctgcatcatgcagactctaggaggcgtggttcttccccgcttcccacattccctctactcctctctctccaccctgaagckctccgttatctcaccccagctgcacatgctgagcttttggtggccaaaccaagactctttggtggacacttttcagtccttctcatgcccaactcctctgcagcttctgaaactgatgtctagtctctcctccaagctttctctgtctggattgccaaggtggtctctctgctctgctccttgcattccttttaggtttgtcattctttattttccattagccctggcctacttttaaaggttgaggttcctcagggaagttcatctgccctcccttatggggcaacagaaacaatccag

SEQ ID NO: 2700 - DNA, 601 bp, Human
actcctctctctccaccctgaagctctccgttatctcaccccagctgcacatgctgagcttttggtggccaaaccaagactctttggtggacacttttcagtccttctcatgcccaactcctctgcagcttctgaaactgatgtctagtctctcctccaagctttctctgtctggattgccaaggtggtctctctgctctgctccttgcattccttttaggtttgtcattctttattttccattagccctggcctacttttaaaggttgaggttcctcagggaagttcatctgccctcccytatggggcaacagaaacaatccaggcttgttacagatgccccaggctccctccagctgctgaaactgagaccctgctctgagccatatgcctccccacccctctgccctgggaatgctccagctggatccccaagatatttcaagtaagtggtttgaaaggtcccatgactgccttatcaagagaggggactcaagtcctttggacacagcccagatctgattctctggaggggacctgctccccctttcatatttgagagttgatagtggtgccatccagtgacaattttccctcttgc

SEQ ID NO: 2701 - DNA, 601 bp, Human
tcctgtgtgagatgcactttgttcactggttctgacttcttcatttcccatttcttgatttacagaaatgaaggggatactcagggcagagttctgaatctcaaaacactctactctggcaaaggaatgaagttattggagtgatgacaggaacacgggagaacaatgctctgtttgggctggatatttctttggcttgttgcaggagagcgaattaaaggatttaatatttcaggtaggggttttcacttttcatgttagcactgtgagtctgtggtcaagtgtaaagtgatggataacstgatatatcagcagtgtgatatattaatacaaacctttccatcctactattaaaaggggactgagaggagaattattagggtgaacagctttcagctgataccaagcattgtcgaggtaccctgttactgtagttgagtgttcagtgagatcagctgacgagggatgagccagagttctaccatcttttccaggaaaccagggctgctgctggtatgctggagtccactgggagggaattagaacaggcacttcctttcccctacaaaatagacagtgaagaagaaagacacacaaggaa

SEQ ID NO: 2702 - DNA, 601 bp, Human
cagcagtgtgatatattaatacaaacctttccatcctactattaaaaggggactgagaggagaattattagggtgaacagctttcagctgataccaagcattgtcgaggtaccctgttactgtagttgagtgttcagtgagatcagctgacgagggatgagccagagttctaccatcttttccaggaaaccagggctgctgctggtatgctggagtccactgggagggaattagaacaggcacttcctttcccctacaaaatagacagtgaagaagaaagacacacaaggaagctagatckcttgttaaatcaagtactagatgtaaatataagctagaattccattttctaatgtgtttccatgtgctttgtttattatgattttcaggttgttccacaaaaaaactcctttggacatattctacaaggagtgaagaggaatttgtcttattttgtgatttaccagagccacagaaatcacatttctgccacagaaatcgactctcaccaaaacaagtccctgagcacctgcccttcatgggtagtaacgacctatctgatgtccaatggtaccaacaaccttcgaatggagatccatta

SEQ ID NO: 2703 - DNA, 601 bp, Human
agagccacagaaatcacatttctgccacagaaatcgactctcaccaaaacaagtccctgagcacctgcccttcatgggtagtaacgacctatctgatgtccaatggtaccaacaaccttcgaatggagatccattagaggacattaggaaaagctatcctcacatcattcaggacaaatgtacccttcactttttgaccccaggggtgaataattctgggtcatatatttgtagacccaagatgattaagtatgatccaaatacatttctatctgaaaacatttccaaatcctctattatytagacaaaatatctatgttcacaggatcttgttaatttcctaggagcccctatgatgtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacctggtacaaggtaagagtgaattctctaaaattaatataagagcattgtttttatggtatcttcttcatgggcttttcatgga

SEQ ID NO: 2704 - DNA, 601 bp, Human
cctgagcacctgcccttcatgggtagtaacgacctatctgatgtccaatggtaccaacaaccttcgaatggagatccattagaggacattaggaaaagctatcctcacatcattcaggacaaatgtacccttcactttttgaccccaggggtgaataattctgggtcatatatttgtagacccaagatgattaagtatgatccaaatacatttctatctgaaaacatttccaaatcctctattatctagacaaaatatctatgttcacaggatcttgttaatttcctaggagcccctatgrtgtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacctggtacaaggtaagagtgaattctctaaaattaatataagagcattgtttttatggtatcttcttcatgggcttttcatggaaaagcgtgtttgagaatctgaggtatacagcttctcaaaaactggccctgtgcct

SEQ ID NO: 2705 - DNA, 601 bp, Human
actgtgagttcgtggacagtcagagctgttgttcaagtgagaaccattggtaagtgagatttttatctcaagatttgagatctgagcagcaaattaaaattatcttcttttggcttagtaagtttttcctcttagggaaagaaaaggatagtcatatacttgtaatcatgtaaaacctttcatgtgggcaaacatcaaagttgccatcccccagggaaggctaagttctgaaacagtttcaaattctcacaagttgggttgtccatgaatatgtccctgatttgcttttgtaataaatttwaaaaatgtatgaaacatttcacacacagaaatattgtgacatccaggtacctatcaccagttttaactatgttaccattttcccacatgcttcaaatcataattttttttctttaaagtaacaaaatattgcaaagacaacttgaggtctatgaccccattctcttccaggcctttgctcccacagtatagtaacatcttgtcatttatatcatttccatttatgtttttatgctttttctacatatgtatgcatctattaacaaaatagaatattgttttgagttatgaaatatgtttg

SEQ ID NO: 2706 - DNA, 601 bp, Human
ggtacctatcaccagttttaactatgttaccattttcccacatgcttcaaatcataattttttttctttaaagtaacaaaatattgcaaagacaacttgaggtctatgaccccattctcttccaggcctttgctcccacagtatagtaacatcttgtcatttatatcatttccatttatgtttttatgctttttctacatatgtatgcatctattaacaaaatagaatattgttttgagttatgaaatatgtttgtgtcataaacacttggtattttattaaattattggtttgccaattyacagccccattagcagtaaatgccctttattcccaaataatacttggtgttatcagactttatgactggtgttaagtggagctttgtttttatttgtttcttttctgctccatagtatacttccctgactaatatgaggttgaacattttgctatatgttttttggttcattggctttcttccgcaacttgtctgtttttgtcctaacctttcccttgggtcgttcttaccagatctgcaagcatcagcttgaatcaactatgtgatagaattaatttaaatgtggtctaagaagtgaaa

SEQ ID NO: 2707 - DNA, 601 bp, Human
cacagtatagtaacatcttgtcatttatatcatttccatttatgtttttatgctttttctacatatgtatgcatctattaacaaaatagaatattgttttgagttatgaaatatgtttgtgtcataaacacttggtattttattaaattattggtttgccaatttacagccccattagcagtaaatgccctttattcccaaataatacttggtgttatcagactttatgactggtgttaagtggagctttgtttttatttgtttcttttctgctccatagtatacttccctgactaatatraggttgaacattttgctatatgttttttggttcattggctttcttccgcaacttgtctgtttttgtcctaacctttcccttgggtcgttcttaccagatctgcaagcatcagcttgaatcaactatgtgatagaattaatttaaatgtggtctaagaagtgaaaacataagacagccagtcactcatgctttatatcaaagagcaacagagtggttgacgtagctgttagttaagatattaatcttttcttattacaagatacaaaccacacagagcaccccaagaccaagtgaaactct

SEQ ID NO: 2708 - DNA, 601 bp, Human
gtttgctgggtcggaagtgggtttgtaagagcaggaatggaggcagggagaagagttaggaagttctgtggtcaagcaggcagttgctgatagggatctgaactagggagtggtagagggaatggagagaagtggatgactttggaaatgtttaagaggtacatttaaaggatttggtgttcgggagcaaggaagagggaaagcaggagccatggatacaagccagcctttgagctggtcaaggagggaatgtgctgacagagcacaacagtacagaggatgagagcaggcacagtcgtgkagcagcaagcttgactcatggttaaaccatgcctctgcttgtgctgtaaatagacctagcagaggtgatgagaagtagctggacttgtaggtcaacagagcatgataatggtttttacataaaaggtaggagaaagagaagaatcaaggatgttttttgttttctgccctggataagttagtgaatggtggtaccatttaaggagactgaaaaagctgaagggaaagagcatttgaagaggagattaagtattaggcttaaaaggacttttagtcatccaagtcatgacgacaagtaggt

SEQ ID NO: 2709 - DNA, 601 bp, Human
agagcaggaatggaggcagggagaagagttaggaagttctgtggtcaagcaggcagttgctgatagggatctgaactagggagtggtagagggaatggagagaagtggatgactttggaaatgtttaagaggtacatttaaaggatttggtgttcgggagcaaggaagagggaaagcaggagccatggatacaagccagcctttgagctggtcaaggagggaatgtgctgacagagcacaacagtacagaggatgagagcaggcacagtcgtggagcagcaagcttgactcatggttaaaycatgcctctgcttgtgctgtaaatagacctagcagaggtgatgagaagtagctggacttgtaggtcaacagagcatgataatggtttttacataaaaggtaggagaaagagaagaatcaaggatgttttttgttttctgccctggataagttagtgaatggtggtaccatttaaggagactgaaaaagctgaagggaaagagcatttgaagaggagattaagtattaggcttaaaaggacttttagtcatccaagtcatgacgacaagtaggtatttggacaagccagtctggagaagtt

SEQ ID NO: 2710 - DNA, 601 bp, Human
ctgaagggaaagagcatttgaagaggagattaagtattaggcttaaaaggacttttagtcatccaagtcatgacgacaagtaggtatttggacaagccagtctggagaagttagggctggagatgtgaatgtgaagatgatcgatttttacataatatctgaagccaaagagctgaatgagatcacctaggaagtgggcatagagacagaaggggctagagccaaacccggaaatgcttgaagaggtggagaagaggaagacaatcctcaaagaggatgggaacatacatcagcaagtgartatcagtggaagggtggtgagaagagaaacaaacgaagtgaaattgatgatgtaggaaagacataacctcaggcaccaagacctttcatagggaagaggcctagagagtaaacttactacccaggggtatcaggaggagtgaaagaacactaggagaggactaatagttaaaagagacacagaggaagggacaggcacagagaagtgaatatagcggttgaaagtaagcagtagagtacgggaacatggaaccaaaagaagagagggtttcaaagagagcatggccaacagtgtccaatg

SEQ ID NO: 2711 - DNA, 601 bp, Human
ctttcagttcaattactcagccagatggcaccacaaagaaatcttgtgggaaaagacagggataggagctcaggtctgcaaggggcaggattagtgtgaaagagaatgcacacaagcagatatggatcaattaacaactaatgttttaccagcacccacaacctgatgtggcagtcattttagggggcaagctttttacatggaaaccggaattcctaacttacaggtaattagtaaaatgtgaagacagagctccaagacatttagatcaaagtgtggctgtgcacctaaatcttcatcragcaggccttcagactttccaatgcaaatagtaatctttgttttcatctttcagtgggagacactaaactcaaaccagatattctggatcctgtcgaggacacactggaagtagaacttggtaagctgggcctcatcgcctttgaatgacatcgtgctgctgggagcaggtctaagtgtgatagaaggaaaacagcattgggatttccagtcaaacagaattgggtgtgaatcttaactcagccattgactagttttgtgactttgcacagttacttcatcctttaagcctcagtactta

SEQ ID NO: 2712 - DNA, 601 bp, Human
aacagcattgggatttccagtcaaacagaattgggtgtgaatcttaactcagccattgactagttttgtgactttgcacagttacttcatcctttaagcctcagtacttaaatccgcaaatagctatcataaaactgaccctaaaagattatattgcaggccgggcatggtggcttatgcctgtaatcccagcactttgggaggctgaggtgggtagatcacttgaggtcaggagtttgagaccagcctggccaacatggtgaaaccccatctctactaaaactacaaaaattagccgggygtgggtgtgggtgcctgtaatcccagctactcaggatgacaaggcaggagaatcacctgaacctgggaggcggaggttacagtgagccgagatcgagccattgcactccatcctgggtgacagagcaagattccatctcaaagaaaaaaaaaaattatactgagaaataatgggacaatgtatgttaagtggctggagcatgaaacctgatcaatagattttattcttccttaacttccccaggaacaggtggtttcgtacatgttggttaggtctatcagttatgactacaaattcgcc

SEQ ID NO: 2713 - DNA, 601 bp, Human
ttcgccaacctgagtaacattaactcttatgaatatgacatttaatctggcatttaagagaactgtagtagaattctacaacccctgcccaaacaatttgtattccaaagtagtgtcttctttggggttgaggagaaattgacttccctgtgggtctccttttattttgtcaacttcaataatatctatgtctttctacacagacaaataagaattgctgtattaaaaataaaatgctgtttttcttttaataatataaatttttttattattattatactttctaaaatgctactaaaayatttattattttagaaagaaacataaaaatacatgttatgatataagatcactagatggcaggagtggtgtgttctgactctagaaatagcactaactatgtgctcaacgtcacaggaatggaaggaaggaggaaagaaggaggaaaaaattagattaattcatatagtcaagttacatatgtattagtgaattataaggtattaccagtggaaaaacgttaaggtgcaaagatgagtattcaaatggagctcctagtcatttcatggttaaatattagatttgaggcagagcatatgtg

SEQ ID NO: 2714 - DNA, 601 bp, Human
acctgagtaacattaactcttatgaatatgacatttaatctggcatttaagagaactgtagtagaattctacaacccctgcccaaacaatttgtattccaaagtagtgtcttctttggggttgaggagaaattgacttccctgtgggtctccttttattttgtcaacttcaataatatctatgtctttctacacagacaaataagaattgctgtattaaaaataaaatgctgtttttcttttaataatataaatttttttattattattatactttctaaaatgctactaaaacatttatkattttagaaagaaacataaaaatacatgttatgatataagatcactagatggcaggagtggtgtgttctgactctagaaatagcactaactatgtgctcaacgtcacaggaatggaaggaaggaggaaagaaggaggaaaaaattagattaattcatatagtcaagttacatatgtattagtgaattataaggtattaccagtggaaaaacgttaaggtgcaaagatgagtattcaaatggagctcctagtcatttcatggttaaatattagatttgaggcagagcatatgtgaatattc

SEQ ID NO: 2715 - DNA, 601 bp, Human
aaagaaggaggaaaaaattagattaattcatatagtcaagttacatatgtattagtgaattataaggtattaccagtggaaaaacgttaaggtgcaaagatgagtattcaaatggagctcctagtcatttcatggttaaatattagatttgaggcagagcatatgtgaatattcctcatggaaaaaaatgggtagaaaaaagttagtctcataatatgcatgcccatccatagtgaattgttcagaaaaattgcttaatatcgaaataatttttttatttaaaccacgtgctacaataackttatgatttttacttaataaacaaatattggatagtaaaattttctttatggacacaccttgtacttcaacagtagtgcagaagaccgggctgatctcagaaactcctcattttcttagttttcttagtgtctccctcaatccacataaggacccttagtgatataatcatgctcatcttcattttaagaacatatagtcatatggttgagatagaaggattgcccattagaaaaaatgtacctggttttatgcatttctgaatgagagctgtgtagacgtttcattatttctggcacac

SEQ ID NO: 2716 - DNA, 601 bp, Human
gttaaggtgcaaagatgagtattcaaatggagctcctagtcatttcatggttaaatattagatttgaggcagagcatatgtgaatattcctcatggaaaaaaatgggtagaaaaaagttagtctcataatatgcatgcccatccatagtgaattgttcagaaaaattgcttaatatcgaaataatttttttatttaaaccacgtgctacaataactttatgatttttacttaataaacaaatattggatagtaaaattttctttatggacacaccttgtacttcaacagtagtgcagaagmccgggctgatctcagaaactcctcattttcttagttttcttagtgtctccctcaatccacataaggacccttagtgatataatcatgctcatcttcattttaagaacatatagtcatatggttgagatagaaggattgcccattagaaaaaatgtacctggttttatgcatttctgaatgagagctgtgtagacgtttcattatttctggcacacatattctacctgcaaacctgattgcatcaggagacagcttctggcgacgtcttcctcccagatgtaggacaaagtgttctcacca

SEQ ID NO: 2717 - DNA, 601 bp, Human
aaaatggtacatcaaagattctgacctagagtgggaagtctcagtacctgaggcgaaaaggtaagaaaaaaactcacggattctgttctctgcaattcagaagagatacttctacctttagaaatgcctaaagtatacagttgatggtgtagccaccagcaccgactagtggtgaaaataaaagcacaaaaatgcaaagtgcaaacggccgttgaatgaaatatttaagttgttttaaacctcaatttgtaggaacagtttgacgtggctgctctcaaagtcaagctattgagcagacagwtgtactgacccagactgcttggagataagtaatatgtccaagaaatgggaggaaatgctgcttaccctcactctgcttttcaccggtgccacccgttcagagagtgtgggggtacagggatccagatgtgtggggtaatgaacagtctagaaaacctccaggggaaatggcatcataataataagtctgacaaaaaatatgtgaagtgaggaatacctgaagcaacttaaccccgaaaaagaggctcagaggagggctctctgtcttgaaatccttgggagctattacattgtttgagaa

SEQ ID NO: 2718 - DNA, 601 bp, Human
tgagcagacagttgtactgacccagactgcttggagataagtaatatgtccaagaaatgggaggaaatgctgcttaccctcactctgcttttcaccggtgccacccgttcagagagtgtgggggtacagggatccagatgtgtggggtaatgaacagtctagaaaacctccaggggaaatggcatcataataataagtctgacaaaaaatatgtgaagtgaggaatacctgaagcaacttaaccccgaaaaagaggctcagaggagggctctctgtcttgaaatccttgggagctattacrttgtttgagaaatttgacttggtttgttgctctctggagcacagaacccggatcagtggtttgaatttactggtgagatattttggccagtagaaaaccctagatatttggagctatccaatcacaaaaaaagttgatctccagtccccagaaggatcaaagggcctggatccagtgatgtccaatcagatgtgtctccaaaggatgcattccctgatttttcgaagatgtgacccagagtaagagtctatgcattaagtaccttcttctgatacttaacagatatcaataagaaaatgc

SEQ ID NO: 2719 - DNA, 601 bp, Human
cggtgagcctccatcacccattgataatctatggataatagcctgcactttgcaagctcactgggaggcgtggttacagcagaggtgttatgcctatcacaatgtgtgacaggtaggaagcactcagtgaataggagctggcatcgtggtctcagagcaacacagcctaaaacatcattcacatacacaagatttcttaacacaaagatggattgtagattggtaacttcagagaactcaaattgtgaataaatgccaagactcccaacttcctgggtggagcagcgtggcacaagcccargaatcaagctgcccattccctgcagtgtggtctggggctactcacccaccttctttgccttgtccttgtcactggccaaggccattatgatcctattatactctagggttcctgggaggtgaggaatggaggacattagagtccatattttgtgcacagaagagggactgatacatagtaaaccttcagtaggagttggtcattttaaatatttttcttaaggtattgttattatctattctcaaggggaattcttaagagtaaggaaggtcagatgagtctcacaaataaataatgtct

SEQ ID NO: 2720 - DNA, 601 bp, Human
ggcatcgtggtctcagagcaacacagcctaaaacatcattcacatacacaagatttcttaacacaaagatggattgtagattggtaacttcagagaactcaaattgtgaataaatgccaagactcccaacttcctgggtggagcagcgtggcacaagcccaggaatcaagctgcccattccctgcagtgtggtctggggctactcacccaccttctttgccttgtccttgtcactggccaaggccattatgatcctattatactctagggttcctgggaggtgaggaatggaggacattaragtccatattttgtgcacagaagagggactgatacatagtaaaccttcagtaggagttggtcattttaaatatttttcttaaggtattgttattatctattctcaaggggaattcttaagagtaaggaaggtcagatgagtctcacaaataaataatgtcttagcgtgaatgcttagaagagtcaataattgaatcaagaatgagccctttttgaccatcttacattctcgtggtatcttatactattgatctcacagttctctaaaagccaaactgttggctgcttatacgtgttccaa

SEQ ID NO: 2721 - DNA, 601 bp, Human
tgcctctacaagaaattttttaatgttagctgggcgtggtggtacccacctgtagttccagctacttaggaggctgaggtgggagaatcacctgagccccggaggtcaaggctgcagtgagccatgattacatcactgcactccagcctggatggcagagcgataccctatctcaaaaaaaaaaaaaaaaaaaaaaaagtgaccgggagcagtggctcacatgtgtaatcccagcactttgggaggtccaggtgggcggatcacttgaagtctggatttgagatcagcctggccaacacgrtgcaaccccatccttactaaaaatacaaaatgtagccaggcttggtggcaggcacctgtaatcccagctactcaggaggctgaggcaggagaatcacttgaacctgggaggtggaggttgcagtgagccgagatcatgccactgcactccagcctgggtgacagagcaagactccttttcaaaaaaaaggaagaaagaaatgcatcagtcacatctttctttaaacttactatagagaatacatactagaaatccttaagagaaatgtttttaagatttattttaataacttttttgaat

SEQ ID NO: 2722 - DNA, 601 bp, Human
aatctgatgtatcccattccgaagcctgtgagttaagtgttgggattttctacttcttccagtgagttccttagtctcagtaatcatatgcatttatgaagtatgcatatgaaaatatcctataacaagttatatacatatagttttccatctagaatagaggggaatggacatttatcttgcacctcctatgagccaggcaccaagaagttcatatacattatctcatgaaacccttaaaacagcctgcccaggagttatgattgtctttattttacatatggggattcacatatcagcrtatgggccatcaactctccgagcaagtactttttctccttggatacgatgtgctgggtgttagcagtactttgcttactggatatcatcatgttggatggggcagactcctgcttgatgtgtgactaatgagacagaaacactgcaggtgcaaagaaggctcagagaaactcctgagttcatgtgacttaatcaaagaatgcctcagccatttgacctaaaatcagtaaaaatgcaagactgcttcataaattagaattcgatttggggtgaaaaatcaataccgctcagtggtatgatt

SEQ ID NO: 2723 - DNA, 601 bp, Human
gattcacatatcagcatatgggccatcaactctccgagcaagtactttttctccttggatacgatgtgctgggtgttagcagtactttgcttactggatatcatcatgttggatggggcagactcctgcttgatgtgtgactaatgagacagaaacactgcaggtgcaaagaaggctcagagaaactcctgagttcatgtgacttaatcaaagaatgcctcagccatttgacctaaaatcagtaaaaatgcaagactgcttcataaattagaattcgatttggggtgaaaaatcaataccrctcagtggtatgattttgaaatgaatttttaaaatcaatttagtcaggatcccaaatattatttcttattcatttaccatatgattcaagcatatgtatgtgtaccataacagtaaaaaaaagagtaaatgacttatgtttttataaattttcctattcttcagataaaaaggattttgatgctttcgtatcctatgcaaaatggagctcttttccaagtgaggccacttcatctctgagtgaagaacacttggccctgagcctatttcctgatgttttagaaaacaaatatggatatag

SEQ ID NO: 2724 - DNA, 601 bp, Human
atgattcaagcatatgtatgtgtaccataacagtaaaaaaaagagtaaatgacttatgtttttataaattttcctattcttcagataaaaaggattttgatgctttcgtatcctatgcaaaatggagctcttttccaagtgaggccacttcatctctgagtgaagaacacttggccctgagcctatttcctgatgttttagaaaacaaatatggatatagcctgtgtttgcttgaaagagatgtggctccaggaggaggtaagtccaacatgtcaagaaaaactgcagtgcaaaaagggcagttcaatgcaatccccaagtcttttttgtcattctttgttttggaatatagatctgggagattacatgaggttagaacatcttgggcaacaacacagaaactatatgttccagagatgtgttccattatcaaacaaatccatctgcagaagaagacaatcacatggggccctaggcagtccttctaggacaaagatacctctcctggcttcgcagctgaaggctgcgaagtgaactactcgctcaccccaatttagtggcccctctgatttctgggactctgccttccacaaagctcact

SEQ ID NO: 2725 - DNA, 601 bp, Human
tgttccagagatgtgttccattatcaaacaaatccatctgcagaagaagacaatcacatggggccctaggcagtccttctaggacaaagatacctctcctggcttcgcagctgaaggctgcgaagtgaactactcgctcaccccaatttagtggcccctctgatttctgggactctgccttccacaaagctcactcagcactgggtcaagcaggcttctcaggcctgggccacgccctggacaccctgagaagtccagatctcagcctgtcctgctggcctcctcctcctcagataccccyaccaaggagcctgggatgttccatggctcccattatcccagcttacctagttccagtcagctttattcctagaggaattgccaatttggggagactggacacaaagcagggaatgtaaaggtgagggtcactagacactggagcgtatctccaactggcaatagagctgatacagtgtaagtggtagagtaaacatgtctcccttcctccttatgtaagagaatccattgcaaggacctctctgactcaaggtttaacaatatccattgcaaataatcaaatgttttatttccagtgtat

SEQ ID NO: 2726 - DNA, 601 bp, Human
ttttgagatggagtctcgctccgtcaccaggctggagtgcagtggcggcgatctcggctcactgcaacctccgcctcccaggttcaagtgattctcctgcctcagcttccgaagtagctgggattataggcgcttggctatatccgaagtagctgggattataggcgcaagccaccatgcttggctaattttttgtatttttagtagagatggggtttcaccgtgttagctaggatgatctcgagctactgaactcgtgatccgcccgtcttggcctcccaaagtgctgggattacaggcmtgagccacctagcccggccgctgccatctttcttgaaatgccaaaagtttttgtgggaaatggcacatccagataggaatgagcctcctatgagcgcttttcacgaggaatctgcttaaggcagggagtaagcatggagtatgttccagacctcactggagaacctgtgctaagaaatatgaataacacaggcctgctggtgactgtggtcagctggaaaacacatgcccctcaaaggtagctgtctattcaggtcaagcccatcttctcacttttcaagggaatatggaaatcggaatt

SEQ ID NO: 2727 - DNA, 601 bp, Human
actatttaaatctgggagctgtgaaatgaggaaaagtaatctttaatagaaattgacgaagatattatctgccatgaaagaaaatgaacatgaattctccaagacttttattactaacatccagataggatacgtgtttaggaaactgtatatttttactttttgctttgaaataattttaaatttaaataaattttgcaggaatagtatcaagaacttccttctaccctttatctagattcctcgtttttaagaatatatttttacatttatcttataattttctctttcacaatatatrtgatataaattacaaacaatatttttctcctaaaccattttttaaaccatttcagttgaaaaaactgaatactgccttagcccttaatcatcataccctcttagcccttaatatttcaatgtatatttcctatcaacagtgtatgtttcctatttcctttcaatgtatatttatttatttcttacataatcatagtatagttatcaaattcaggaaacttaaacatcatataataccttaatctataatctatattctaatcttatcaatgatctcattgaagaccttttataatgtttt

SEQ ID NO: 2728 - DNA, 601 bp, Human
tctttcctgctaccgttccatatttgttctgggctcatcacaccttcctcaactgtggctaccatgattagtgccctgtgattattcttgtatgatgctatactagcaaataaaaatatatagtctagctctttctagcccttccttttttacgctcatctttctgcactttgtgttttcatcttcaaaagttctcttttcttgatgatcctggcatatgttgacatagaaggtaactcttggcatggaggagcacaggctagtcatttgagattggaattagtttttcctgcttgttaaygcctgccagcacacccctctgggtcatgagttttctttatgggaagattttcatctattgattcaatttctttaatggtgaaagaattacgcaaatttcttactttctcttgtgtgagtttggtaagattttgtgtcttaggaagtttctcatttcattaaaggtctcatatattctggaaaattgtttagcagctcttctcttttaatgtctgcagacatcaaaaccttcaaagtaaggttcaccttcagtcattattcattctctcttacacacatacacacacacgtgcacacacac

SEQ ID NO: 2729 - DNA, 601 bp, Human
acgcctgccagcacacccctctgggtcatgagttttctttatgggaagattttcatctattgattcaatttctttaatggtgaaagaattacgcaaatttcttactttctcttgtgtgagtttggtaagattttgtgtcttaggaagtttctcatttcattaaaggtctcatatattctggaaaattgtttagcagctcttctcttttaatgtctgcagacatcaaaaccttcaaagtaaggttcaccttcagtcattattcattctctcttacacacatacacacacacgtgcacacacrcacacacttacttgattagtttcatcagagacttgtcagttctagtactcttttcaaaagctaacttttgactttgttgatcctttctgttatatgtttcatgttcatttaggttgtttagtttccctcttttacaagaaatgtggaagtgagtgtccttatacctgtattttaaggcacgtttgccagtgaatgcattcctttaagattactagccctagaattgctcatttgtagggcatgcagatgaacaaagtattcaactttgttgatgttacacaaattgcttcacagaatttt

SEQ ID NO: 2730 - DNA, 601 bp, Human
ttttactttattttatgacagagtctcactctgttgtccaggctggagtgcagtggtgtgatcatggctcactgcagcctaattcctgggctcaagtggaagcccaggtaattttttaaattttttgtgtgacagaatcttgctatgatgcccagactggtctcgaactcctggcctcaagtggtcctcaggccttggcctcccaaagtggtgggattacaggcatgaaccaccatgcatggctcaccaggagtattctagatttcctacaaccttgtgttgaactttgtattataagcckttgatttttaaaatcaatttggtgggtataaaatgtacctttttattttattttgcttttccttaattattagtgagattgaccacatttttcagtttattggccatttctggatcctcttctgaactgcccactcatatcttttggtatatttcttattttacttttcatgccattttcttgtgacttataggagattttatatatttatatatcctgggtatgattgtttgcaatgcattaaaaaaaccccttttcattgaagtataacgtatacatataaaatgcagaaatcataat

SEQ ID NO: 2731 - DNA, 601 bp, Human
gatttcctacaaccttgtgttgaactttgtattataagccgttgatttttaaaatcaatttggtgggtataaaatgtacctttttattttattttgcttttccttaattattagtgagattgaccacatttttcagtttattggccatttctggatcctcttctgaactgcccactcatatcttttggtatatttcttattttacttttcatgccattttcttgtgacttataggagattttatatatttatatatcctgggtatgattgtttgcaatgcattaaaaaaaccccttttcaytgaagtataacgtatacatataaaatgcagaaatcataattggacaagcttgttggattatcagaaagtgaacataccttttaattaccctttcccatgaaagttaagaaagaaaacattactagcacctccgaaggcccacctcttccatcttgcaaaaactatgcctccctagtcccccaaataaccacttccctgatttatgctatcatagattggatttaccagtttttgaattttatttaatttgaataaaatcatatgtagtgtttatgtctagcttccttggctcaatagcaa

SEQ ID NO: 2732 - DNA, 601 bp, Human
aaagaccttttttcctatattttcttcttgaagtttcattgtttttctttttccactgatttttaagtgtgtagtgttggtagggtcaaatgtaatttttttctctgtggacttatagtttacctgttcttttcacgttgctttgcatgcaacgtaaatcatattggtctttgtgtgtagatctgtttcagaaccctctgtagcattcccttattctatttctttctttctctttctttctttctttctttctttctttctttctttctttctttctttctttctttctttctttctttctctctctctctctctctctttctctttctttctttctttctttctttctttcttctttcttccttccttccttctttctttctttttttttttcttttttcagatggagtctcagtctctctcctaggctagagggcagtggtgcggtcttgactcattgcaacctctgcctcctgggttcaagccattctcctgcctcagcctccagagtagttgggattacaggtgcacaccactatgactggctaatttttggtatttttactagagacaggatttcaccgtgttggccaggctgtct

SEQ ID NO: 2733 - DNA, 601 bp, Human
aagaccttttttcctatattttcttcttgaagtttcattgtttttctttttccactgatttttaagtgtgtagtgttggtagggtcaaatgtaatttttttctctgtggacttatagtttacctgttcttttcacgttgctttgcatgcaacgtaaatcatattggtctttgtgtgtagatctgtttcagaaccctctgtagcattcccttattctatttctttctttctctttctttctttctttctttctttctttctttctttctttctttctttctttctttctttctttctttctytctctctctctctctctttctctttctttctttctttctttctttctttcttctttcttccttccttccttctttctttctttttttttttcttttttcagatggagtctcagtctctctcctaggctagagggcagtggtgcggtcttgactcattgcaacctctgcctcctgggttcaagccattctcctgcctcagcctccagagtagttgggattacaggtgcacaccactatgactggctaatttttggtatttttactagagacaggatttcaccgtgttggccaggctgtctc

SEQ ID NO: 2734 - DNA, 601 bp, Human
ccttttttcctatattttcttcttgaagtttcattgtttttctttttccactgatttttaagtgtgtagtgttggtagggtcaaatgtaatttttttctctgtggacttatagtttacctgttcttttcacgttgctttgcatgcaacgtaaatcatattggtctttgtgtgtagatctgtttcagaaccctctgtagcattcccttattctatttctttctttctctttctttctttctttctttctttctttctttctttctttctttctttctttctttctttctttctttctctctytctctctctctctttctctttctttctttctttctttctttctttcttctttcttccttccttccttctttctttctttttttttttcttttttcagatggagtctcagtctctctcctaggctagagggcagtggtgcggtcttgactcattgcaacctctgcctcctgggttcaagccattctcctgcctcagcctccagagtagttgggattacaggtgcacaccactatgactggctaatttttggtatttttactagagacaggatttcaccgtgttggccaggctgtctcaaac

SEQ ID NO: 2735 - DNA, 601 bp, Human
ttttcctatattttcttcttgaagtttcattgtttttctttttccactgatttttaagtgtgtagtgttggtagggtcaaatgtaatttttttctctgtggacttatagtttacctgttcttttcacgttgctttgcatgcaacgtaaatcatattggtctttgtgtgtagatctgtttcagaaccctctgtagcattcccttattctatttctttctttctctttctttctttctttctttctttctttctttctttctttctttctttctttctttctttctttctttctctctctctytctctctctttctctttctttctttctttctttctttctttcttctttcttccttccttccttctttctttctttttttttttcttttttcagatggagtctcagtctctctcctaggctagagggcagtggtgcggtcttgactcattgcaacctctgcctcctgggttcaagccattctcctgcctcagcctccagagtagttgggattacaggtgcacaccactatgactggctaatttttggtatttttactagagacaggatttcaccgtgttggccaggctgtctcaaactact

SEQ ID NO: 2736 - DNA, 601 bp, Human
ctctgtggacttatagtttacctgttcttttcacgttgctttgcatgcaacgtaaatcatattggtctttgtgtgtagatctgtttcagaaccctctgtagcattcccttattctatttctttctttctctttctttctttctttctttctttctttctttctttctttctttctttctttctttctttctttctttctctctctctctctctctctttctctttctttctttctttctttctttctttcttctttcttccttccttccttctttctttctttttttttttcttttttcakatggagtctcagtctctctcctaggctagagggcagtggtgcggtcttgactcattgcaacctctgcctcctgggttcaagccattctcctgcctcagcctccagagtagttgggattacaggtgcacaccactatgactggctaatttttggtatttttactagagacaggatttcaccgtgttggccaggctgtctcaaactactgacctcagatgatccacttgtctcagtctcccaaagtgctgggattacaggtgtgagccagcgcatcgggcccttatgcttgttaattattat

SEQ ID NO: 2737 - DNA, 601 bp, Human
acacgtgaatccaggatggacaggaaaggaaatgatacctgaaagagcttggaaattagacaaaagtagagaggtcaggtgggctaattccagttaagatagaaaagtgagttgaatggatagaaagttcaggtggaaaagtgtaatgcccatggtgagtctttttatcctgtagaggccataaaactaaaaagacacaggaacaaaatgaccataccaccttacattttgctgagtcacctactgctaaggctctggatggaattccatgtctccagctggctttgctgaaaggtaaagktgaggatggaggatcttcctgctctttctgctggaaagcagagccctggagacacggaaatttctccagcagcattgaagtgtccagtctccagttctgtgggagctgagtattccactttatttgttggggtggctcttcctgatgtggcattacttgacacactggagttgcataagcggcaactcctggtctctgaattgcaggtggtgtatttcagagttgattccccactttccagattgtggtagaggtagcggctctcagggcaagctacttctgcagtgtggttctggcctc

SEQ ID NO: 2738 - DNA, 601 bp, Human
ttggggtggctcttcctgatgtggcattacttgacacactggagttgcataagcggcaactcctggtctctgaattgcaggtggtgtatttcagagttgattccccactttccagattgtggtagaggtagcggctctcagggcaagctacttctgcagtgtggttctggcctcgatgccacttcctgagtactttcacagatttagcaaagcacctagtatcttgtcttgaatccttttctgcataaaatatagaatgatttttgtttgctaaatccagacagagatatatggcttcatggctctgtttcaaagattaaatgatctaatctatccacgaagcatttagttcagcatgagtacataataggtacgtaataaataaatattagagattattatgttacaataaaggaatgaatgagctggaatagggaatcagtcagaaagtaataaatttaattttaagaattttgagacagaggttctggataatggcaaatccctacgaaaatcctggcttacgtctgggagaattgaaaactgaaagtccccaggaagtctttgaaattgaagagcttacagaggacaaggtttgggt

SEQ ID NO: 2739 - DNA, 601 bp, Human
tccaggggtggagaatgaagtgtgactctgaaccatgcctaagtgaggagagagcctaacacttgggcaggtaaatatttatttaattaggagtttgcatgttgattttatcttttagattgtgcacttcctgaggagagggattgcatcttagtcctgcatggccaggcctgtcacagtgcaggcaaactgcaggaattcaaatgtttgaatgaacaaatggactcaattagctaagcagtcactctgtggactgcagcttcttggaggacagggagcaggtttgggagaattcagaagktggcccaagggatggaagaactggtgattagcatgagaatgtgagcctaggacaggacagagaaacagtgaggcttgccctctgggtggttgctgggagagaaagcattcctgagactcactggtcttctggttggttgggtgtgaggttgttgccttgtccatggaggaggcatgggaagcgggagaagtgatgtgacatctgcccaccataaacctggccagcttcctttgatcactgttcagaccttcaaattggatgttggtgaagaattattttggacttctataaagtccaatg

SEQ ID NO: 2740 - DNA, 601 bp, Human
ttcagaaggtggcccaagggatggaagaactggtgattagcatgagaatgtgagcctaggacaggacagagaaacagtgaggcttgccctctgggtggttgctgggagagaaagcattcctgagactcactggtcttctggttggttgggtgtgaggttgttgccttgtccatggaggaggcatgggaagcgggagaagtgatgtgacatctgcccaccataaacctggccagcttcctttgatcactgttcagaccttcaaattggatgttggtgaagaattattttggacttctataamgtccaatgcttgataagtgcagaaagtgtaattgggcccgcaaggcagtgggagcagttgttattcacctgggtttccagtcttggcagagggtcttgggccattaagcgggagtccactggcagacatgggcccctgaaggtggaggacattcctgcctgttcatgtcctcctgcaaaaaactgacccaggctcagttttcctccatgaagtcttccttccaactcacgtaggccactctcctctcaagtcctactagacttattgtttgtatcattcacttcagcctgtaaaatatcc

SEQ ID NO: 2741 - DNA, 601 bp, Human
cagagggtcttgggccattaagcgggagtccactggcagacatgggcccctgaaggtggaggacattcctgcctgttcatgtcctcctgcaaaaaactgacccaggctcagttttcctccatgaagtcttccttccaactcacgtaggccactctcctctcaagtcctactagacttattgtttgtatcattcacttcagcctgtaaaatatcctttgtcaaatctgtgtatatctatatacacacacatgcacatatatatgtacacacacacacatatatacacattatatacagactrggcagggaattctgctgcctatctatccatctatcatcaatctatcatctacctatttttctatttacctagctagctagctatctgttgtcttccagttagactgtaaattacctaaatactagggatcacacaggtttctaagtattcattgaattgaattttgtttttatttgtattaggactgtaacgagattaaaggggagcggttcactgttttggaaaccaggcttttggtgagcaatgtctcggcagaggacagagggaactacgcgtgtcaagccatactgacacactcag

SEQ ID NO: 2742 - DNA, 601 bp, Human
tagacaaaaatctcaagatctcacaaaatagaaagttttatgtgtcttagtgtatcaaactatataatgctaaaagtctcagaaatacaatacaacaaaacaacacaattgtttcagttgtagggggagattttaacatactcttgctttgagaaatttactaggaaagtaagagtctacatggttcgaggaatatagtaaaagtaatgtgtctaatacatagatcactctcagaaacatctatgaaaaaccagagtccaaaagaggaaattgtacagatcatggggtataataacgatayagtaaatgtaaaaatttatatctaaaccaaaacaataaaataatcgcacttaataagtatgtgaagtgacggatttgttaattagcttgatttaattattctacaatataaacatatatcaaaacatcacatcgtacccataaatatatgtaattattatttgtctattaaaactaaagaaaaatttaaaaacttaaacaacaacaaaaaatctcttaattatttgcatttttgattagagagccaaagccatagttaaagaatatttagaaaataatgatagtgagaatacgtcatatc

SEQ ID NO: 2743 - DNA, 601 bp, Human
agatctcacaaaatagaaagttttatgtgtcttagtgtatcaaactatataatgctaaaagtctcagaaatacaatacaacaaaacaacacaattgtttcagttgtagggggagattttaacatactcttgctttgagaaatttactaggaaagtaagagtctacatggttcgaggaatatagtaaaagtaatgtgtctaatacatagatcactctcagaaacatctatgaaaaaccagagtccaaaagaggaaattgtacagatcatggggtataataacgatacagtaaatgtaaaaayttatatctaaaccaaaacaataaaataatcgcacttaataagtatgtgaagtgacggatttgttaattagcttgatttaattattctacaatataaacatatatcaaaacatcacatcgtacccataaatatatgtaattattatttgtctattaaaactaaagaaaaatttaaaaacttaaacaacaacaaaaaatctcttaattatttgcatttttgattagagagccaaagccatagttaaagaatatttagaaaataatgatagtgagaatacgtcatatcaaatttcatggcata

SEQ ID NO: 2744 - DNA, 601 bp, Human
agcacagaaacccaggatggcagcatagagaggggaggaaatcaccctttctctgtcactctgtttcccccaccaagattgacttggagccaagagaaacttctctttgcagggaaaaggtaagcagaaggcctctgccaccttcattattaccacagacacctgcagttcttgctacagaagaaagctgcagtcctcacaggtcctgagcccagtttggggagcagcctggagttctcatggctatattgctccagtgcaggaaactacattgtgcatacccttatcccctatgacccaygctgctacatcatgccactgtcttggaattatagctactgctagagtgagtcctgttctgggggccagtagccactgcatctctccatccccaatgctttcccgtcatttcaccatgttcatacaggtggctacaactccaaaatcctggttacttagagtatgggccctatgaaattactgtgatcctggttcccaaatgcacatggtgccctgcttcctgtatggacaggcagtcctgcacaactggggaagctttccctagccagcagacctactctgctcaccctcatacccatga

SEQ ID NO: 2745 - DNA, 601 bp, Human
ataataggctattttaatctgattacaatttaactttggtcacataaaaatacccttgacttttattgtccccctaacagtttatacttttgttgccttaattcacatcattatacattgcgtgttctttaataaccaattgtgtctgtagttatttttgaccattttgacctttaaacttattactagagtcttgaaagatttacatagcgccatttcagaattgagatattctgaatttgattttgaatttatctctactggttagttttcacatgtttttatgatggtaattatcacyctttcactttcagttgcagcatttccttagggatttcttgtaaggctggtctagcagcaatgaattcccttagtttttgcttgtctggaagggactttatttttcttacatttctgaaagatagttttgctgggtatagtattcttggatagcagtttttatttttgttcagcactgaatataatatcctttgttcatgaattggaagaattaatattgttcaaatgtccatcctactgaaagcaacttacagattcaatgcaatccctactaaaataccaatgacattattttgacaga

SEQ ID NO: 2746 - DNA, 601 bp, Human
atcctttgttcatgaattggaagaattaatattgttcaaatgtccatcctactgaaagcaacttacagattcaatgcaatccctactaaaataccaatgacattattttgacagaaagagaagaaacagtcctaaaatttgtataggaccataaaacaccctgaatagccaaagcaatcttgagaaaaagaccaaaaggcccaaaaccaaaaacaaagctggaggtatcacactacctgacttcaaaatatactaaaaagctatagtaatcaaaacagcatgatgttagcatgaaaacagrcacatagatcaatggagcagaatagagagtccagaaataagtccacaaatcaacagccaactgatatttgacaaaagtgccaggaacacacattaaacaagtaacagtctcttcaataaatggtgataggaaaattggatatccacatgcagaagaatgaaactagacccctatcttttaacatattcaaaactcaacttgaaatggattaaagacttaaatataagcctgaaactatgaaactactagaagaaaacatagaggaattgctcatgacattggactgggcaagatgttttg

SEQ ID NO: 2747 - DNA, 601 bp, Human
gagtgaggctgtgattttattgcagtatattttgaaagtgccatattttcaatacatccagattttatacatcaaaacagaaagaaaacaaaagcttttctttattaagcgtgattgccaaatgttttgcttttgattttcaacttttagatttagtataaataatttgatataaagccaaaatgcctatgtatatttttaccatggaactttgtaaaattatctgtagaggctgaattctgatatttaagcaggagggcttccaactcaatgtgtgtatacgaattgcactctgagtacygtacagaactaattgattatgcattggaagtaataaagtcagtgaaaagatagtggagggtgaagccagaatcaggagaacaactttaaattcgtaacctatcaggggaggtgtgtgaaataccttgcaaaatgctgtgtggtttaccaagacagttgttcttgattctattaatatcattagtgtatgtgtgtgtgtgtgtgtgtgtgtttgcacacgcacgtgtgtggctagctacatgcaagagagaggacttgaatttgctgatgtcctttaatgatcagttaaacctatgcttgc

SEQ ID NO: 2748 - DNA, 601 bp, Human
tgtatatttttaccatggaactttgtaaaattatctgtagaggctgaattctgatatttaagcaggagggcttccaactcaatgtgtgtatacgaattgcactctgagtaccgtacagaactaattgattatgcattggaagtaataaagtcagtgaaaagatagtggagggtgaagccagaatcaggagaacaactttaaattcgtaacctatcaggggaggtgtgtgaaataccttgcaaaatgctgtgtggtttaccaagacagttgttcttgattctattaatatcattagtgtatgtgtgtgtgtgtgtgtgtgtgtttgcacacgcacgtgtgtggctagctacatgcaagagagaggacttgaatttgctgatgtcctttaatgatcagttaaacctatgcttgcatacatcaagctaaagccccaccaaatatttttctagaacctaacagaaaacacagtggttgctgtatggagttagcaatcgtgcctttgcccctgccaagctcctggcctcctaagtgcccgttacctcccttagaattgcagtgaatagggatctgtgcatggcagcttgcagctctgggtgtgcac

SEQ ID NO: 2749 - DNA, 601 bp, Human
agaaaacacagtggttgctgtatggagttagcaatcgtgcctttgcccctgccaagctcctggcctcctaagtgcccgttacctcccttagaattgcagtgaatagggatctgtgcatggcagcttgcagctctgggtgtgcacattctctgcttcacttctgtgtcctgaaggccagtgtcgttctggcctcagctgccttaactgtgagtgagcacagcaccctctactcaccctgagcacatggggaatccttcttgggttgcaacatgtggaaggacccttgggttcatctgtcacyactgcccattttttctcttctcactggcttttctttgtcataaagcatccttctccatcactttcccccagtcagtcttgtgtttgccatctctctctctctggtacctctaagaggttcatcatctgtgctgcttttctttctgtgtcctcatccctcaaatctctttcccctttatggcatcaactgtcattcctgagcaggtgcaaacaggttccatatattgagctgtatactgtcttcccccatgacagctctgcgtttccagctgtgtaagggactgcagatacactggctgat

SEQ ID NO: 2750 - DNA, 601 bp, Human
tttctcttctcactggcttttctttgtcataaagcatccttctccatcactttcccccagtcagtcttgtgtttgccatctctctctctctggtacctctaagaggttcatcatctgtgctgcttttctttctgtgtcctcatccctcaaatctctttcccctttatggcatcaactgtcattcctgagcaggtgcaaacaggttccatatattgagctgtatactgtcttcccccatgacagctctgcgtttccagctgtgtaagggactgcagatacactggctgatgtcagaaagcaygtttaaactctccaacctcctggttctgttttttcttacctttgttagtgggactcctgtatcttccacgttgttcaggctcaaaatctggggtcattttatgccttcccttatcctccctcatgccaacacccaatgagttgccaagctctgtggattcctcccctcctgcccattcccactaacgagctggatggtagggtgactcctgccctacactttaaggtcaggttttcaggctcagatcctatcttgtccacttaggagctgggtgaggacagcactgtcactcaacctctc

SEQ ID NO: 2751 - DNA, 601 bp, Human
ttcaggctcaaaatctggggtcattttatgccttcccttatcctccctcatgccaacacccaatgagttgccaagctctgtggattcctcccctcctgcccattcccactaacgagctggatggtagggtgactcctgccctacactttaaggtcaggttttcaggctcagatcctatcttgtccacttaggagctgggtgaggacagcactgtcactcaacctctctgtgcccatgtctcctcatctgggaaatgaggaggatagcgacttccttccacgactgttgtaagaatcagctrgaattttcttttatacttttttattgtggaatataatgcatatatgtgttataacatatgcacatatatggtaaaggaacacagaatttctacatcacataacaagtcattgtatagcaaacactcatgaaactaccacctggattaagaaaaatgcattgcctgaaaaactcctggatgttcttccctgatcctcccctcctgataatcatccccccaacttttaggaaagtcgtttctttgattttctatctatgctgatagtcctaataatacaatttatttttgcctgtttttgag

SEQ ID NO: 2752 - DNA, 601 bp, Human
aaaacctgttttcacccaagcagagcctgctggcgtttcctcccttctgactttccattggcttacagcagaaatgcagcctcgcttaggccagagacagagactcagggtccaccccagagaaaagagaagctgttgtaagaagccttggagagtccaggagacctgaagtggttacaacttaaatctgtcccaacctagaagtttgagttctttactgaataatatagactgaagctgaccaatagcgatttccatcccaatactgacttgttgaactttttgaaagcactgtgttccraaggattctgaggccaagtccaagctcagaggagctaatgctgtgaccagttagttaacacctgtcaagcttgtggagggatggagtcctttatcccctttgttttaagctcatgcttcttaaatcccttagttcctggcaatgctcattttatctcaaatgtagagtattttggttctgttgacttagttttgtttgtcctgagttcctaggaacttcacccttttaaatccaaacctcttgttggtttacttggggacagagctaaggttatagcttctccatttgacttccttatgt

SEQ ID NO: 2753 - DNA, 601 bp, Human
ccgaaggattctgaggccaagtccaagctcagaggagctaatgctgtgaccagttagttaacacctgtcaagcttgtggagggatggagtcctttatcccctttgttttaagctcatgcttcttaaatcccttagttcctggcaatgctcattttatctcaaatgtagagtattttggttctgttgacttagttttgtttgtcctgagttcctaggaacttcacccttttaaatccaaacctcttgttggtttacttggggacagagctaaggttatagcttctccatttgacttccttaygtttgttaaagacacctccagatttgaatcttatttggtttttctgaagcagggtctctagaaggttgtttaaattgggtgtgctcttccgtgaattcgcgtattacttatgctcactcaccatctcagttgaaggctggtagtagtcaaatgactcagatggtgaataccaccattaacctttaacaggacatctagtacatcaacagtgggctccccatttatttctatttcaaaaccctgagtccctctgaatgtattcattgatgtcctgtttccaatttcattctcttttagctc

SEQ ID NO: 2754 - DNA, 601 bp, Human
tttagctcgtttacagagcagagggcatcagtactctcgaaggcaatgagtgaagagcccgagaattttagagcatcactcctgtctatgtgccagaggctttctgagcctcattagtattgtgggcatggtcttcttatcaggacagttaacaaaaccaagatctccaaaacagacactaaatattcccagacacgagtcgtcccaaagggagaggtggcaatgttacccctagaaagaattataacaaagggcaaagaagagtagaggatgaggaagcaggaaggatctgtcttatgaytgaagtgagaggttctcacaagtgcccaggattggattgggcaccggtgtgtggtgcagtgcgtctatactggctgcattgggacttactcaatgaattaatttttttggcaccaaatgtgttcttagttattgtgccatgtatttaaagatgtgcaatagtaaatgagaaatcttgggcctcaagatgtttacaacacggcgtggcctagggcaggtggcaataagctctttaatgagtattttatagccactgtggaaaacattatagtggttcctcaaaaaactaaaaatataacaa

SEQ ID NO: 2755 - DNA, 601 bp, Human
ttacagagcagagggcatcagtactctcgaaggcaatgagtgaagagcccgagaattttagagcatcactcctgtctatgtgccagaggctttctgagcctcattagtattgtgggcatggtcttcttatcaggacagttaacaaaaccaagatctccaaaacagacactaaatattcccagacacgagtcgtcccaaagggagaggtggcaatgttacccctagaaagaattataacaaagggcaaagaagagtagaggatgaggaagcaggaaggatctgtcttatgattgaagtgagrggttctcacaagtgcccaggattggattgggcaccggtgtgtggtgcagtgcgtctatactggctgcattgggacttactcaatgaattaatttttttggcaccaaatgtgttcttagttattgtgccatgtatttaaagatgtgcaatagtaaatgagaaatcttgggcctcaagatgtttacaacacggcgtggcctagggcaggtggcaataagctctttaatgagtattttatagccactgtggaaaacattatagtggttcctcaaaaaactaaaaatataacaaccatatgatc

SEQ ID NO: 2756 - DNA, 601 bp, Human
aattttagagcatcactcctgtctatgtgccagaggctttctgagcctcattagtattgtgggcatggtcttcttatcaggacagttaacaaaaccaagatctccaaaacagacactaaatattcccagacacgagtcgtcccaaagggagaggtggcaatgttacccctagaaagaattataacaaagggcaaagaagagtagaggatgaggaagcaggaaggatctgtcttatgattgaagtgagaggttctcacaagtgcccaggattggattgggcaccggtgtgtggtgcagtgcrtctatactggctgcattgggacttactcaatgaattaatttttttggcaccaaatgtgttcttagttattgtgccatgtatttaaagatgtgcaatagtaaatgagaaatcttgggcctcaagatgtttacaacacggcgtggcctagggcaggtggcaataagctctttaatgagtattttatagccactgtggaaaacattatagtggttcctcaaaaaactaaaaatataacaaccatatgatccagcaatcctactgctggttatatacccaaaagaaaggacattagcatattaa

SEQ ID NO: 2757 - DNA, 601 bp, Human
aagatctccaaaacagacactaaatattcccagacacgagtcgtcccaaagggagaggtggcaatgttacccctagaaagaattataacaaagggcaaagaagagtagaggatgaggaagcaggaaggatctgtcttatgattgaagtgagaggttctcacaagtgcccaggattggattgggcaccggtgtgtggtgcagtgcgtctatactggctgcattgggacttactcaatgaattaatttttttggcaccaaatgtgttcttagttattgtgccatgtatttaaagatgtgcaayagtaaatgagaaatcttgggcctcaagatgtttacaacacggcgtggcctagggcaggtggcaataagctctttaatgagtattttatagccactgtggaaaacattatagtggttcctcaaaaaactaaaaatataacaaccatatgatccagcaatcctactgctggttatatacccaaaagaaaggacattagcatattaaagagatatgtgaactcccatgtatattgcagcactgtttacaatagccaagatgtagaatcaacctaagtgtccatcaatggatgaatggataaag

SEQ ID NO: 2758 - DNA, 601 bp, Human
caagtgcccaggattggattgggcaccggtgtgtggtgcagtgcgtctatactggctgcattgggacttactcaatgaattaatttttttggcaccaaatgtgttcttagttattgtgccatgtatttaaagatgtgcaatagtaaatgagaaatcttgggcctcaagatgtttacaacacggcgtggcctagggcaggtggcaataagctctttaatgagtattttatagccactgtggaaaacattatagtggttcctcaaaaaactaaaaatataacaaccatatgatccagcaatcytactgctggttatatacccaaaagaaaggacattagcatattaaagagatatgtgaactcccatgtatattgcagcactgtttacaatagccaagatgtagaatcaacctaagtgtccatcaatggatgaatggataaagaaattctgtcatagatgtacaatggaatattattcatccataaaagagaatgaaattctgtcatttgcagcaaagtggatggaactggaggccattatgttaagtgaaataagccaggcacagaaagacacatattgcatatttttactcatttgtgaga

SEQ ID NO: 2759 - DNA, 601 bp, Human
acacggcgtggcctagggcaggtggcaataagctctttaatgagtattttatagccactgtggaaaacattatagtggttcctcaaaaaactaaaaatataacaaccatatgatccagcaatcctactgctggttatatacccaaaagaaaggacattagcatattaaagagatatgtgaactcccatgtatattgcagcactgtttacaatagccaagatgtagaatcaacctaagtgtccatcaatggatgaatggataaagaaattctgtcatagatgtacaatggaatattattcakccataaaagagaatgaaattctgtcatttgcagcaaagtggatggaactggaggccattatgttaagtgaaataagccaggcacagaaagacacatattgcatatttttactcatttgtgagaactaaaaaaattgatctcatgaaggtagagagaagaatggtggttaccagaggctgggaagggtagtggtgaagcggggataaagagaggttggttaatgggtaaaagaaaaaaatacagtttgatagtaggaatgagatctagtgtttggtagcacaacaaaatgactatagatag

SEQ ID NO: 2760 - DNA, 601 bp, Human
atatacccaaaagaaaggacattagcatattaaagagatatgtgaactcccatgtatattgcagcactgtttacaatagccaagatgtagaatcaacctaagtgtccatcaatggatgaatggataaagaaattctgtcatagatgtacaatggaatattattcatccataaaagagaatgaaattctgtcatttgcagcaaagtggatggaactggaggccattatgttaagtgaaataagccaggcacagaaagacacatattgcatatttttactcatttgtgagaactaaaaaaatygatctcatgaaggtagagagaagaatggtggttaccagaggctgggaagggtagtggtgaagcggggataaagagaggttggttaatgggtaaaagaaaaaaatacagtttgatagtaggaatgagatctagtgtttggtagcacaacaaaatgactatagataggaataatttattgtataattcagtataactagaggaatgaatttggaatattcccagcacaaagaaatgatgaatgtttgaggtgatggttatcccaattgccctgatttgatcattacacattgtatgcctgtg

SEQ ID NO: 2761 - DNA, 601 bp, Human
aggacattagcatattaaagagatatgtgaactcccatgtatattgcagcactgtttacaatagccaagatgtagaatcaacctaagtgtccatcaatggatgaatggataaagaaattctgtcatagatgtacaatggaatattattcatccataaaagagaatgaaattctgtcatttgcagcaaagtggatggaactggaggccattatgttaagtgaaataagccaggcacagaaagacacatattgcatatttttactcatttgtgagaactaaaaaaattgatctcatgaaggtrgagagaagaatggtggttaccagaggctgggaagggtagtggtgaagcggggataaagagaggttggttaatgggtaaaagaaaaaaatacagtttgatagtaggaatgagatctagtgtttggtagcacaacaaaatgactatagataggaataatttattgtataattcagtataactagaggaatgaatttggaatattcccagcacaaagaaatgatgaatgtttgaggtgatggttatcccaattgccctgatttgatcattacacattgtatgcctgtgtcaaaatattacaca

SEQ ID NO: 2762 - DNA, 601 bp, Human
gcactgtttacaatagccaagatgtagaatcaacctaagtgtccatcaatggatgaatggataaagaaattctgtcatagatgtacaatggaatattattcatccataaaagagaatgaaattctgtcatttgcagcaaagtggatggaactggaggccattatgttaagtgaaataagccaggcacagaaagacacatattgcatatttttactcatttgtgagaactaaaaaaattgatctcatgaaggtagagagaagaatggtggttaccagaggctgggaagggtagtggtgaagsggggataaagagaggttggttaatgggtaaaagaaaaaaatacagtttgatagtaggaatgagatctagtgtttggtagcacaacaaaatgactatagataggaataatttattgtataattcagtataactagaggaatgaatttggaatattcccagcacaaagaaatgatgaatgtttgaggtgatggttatcccaattgccctgatttgatcattacacattgtatgcctgtgtcaaaatattacacataccctataaatatgtgcaactattatgtacctataaaatttttttaa

SEQ ID NO: 2763 - DNA, 601 bp, Human
ccataaaagagaatgaaattctgtcatttgcagcaaagtggatggaactggaggccattatgttaagtgaaataagccaggcacagaaagacacatattgcatatttttactcatttgtgagaactaaaaaaattgatctcatgaaggtagagagaagaatggtggttaccagaggctgggaagggtagtggtgaagcggggataaagagaggttggttaatgggtaaaagaaaaaaatacagtttgatagtaggaatgagatctagtgtttggtagcacaacaaaatgactatagatagsaataatttattgtataattcagtataactagaggaatgaatttggaatattcccagcacaaagaaatgatgaatgtttgaggtgatggttatcccaattgccctgatttgatcattacacattgtatgcctgtgtcaaaatattacacataccctataaatatgtgcaactattatgtacctataaaatttttttaaaattaaagtgctctagaggctcagaaaaaaaaaccctcttcctcccctcctctgcccaccccaccatccagtgaggactggaggatgaggaaagggctgaaga

SEQ ID NO: 2764 - DNA, 601 bp, Human
ttctgctccttggccatctcctgcccaccacttaggctcataattactctgcaatgtactcatgaaacaggctagggtgtaaacattctttctgagactgtgcctctcgcacaggcacccagcctggaaatcaatggcacagaaaggatgaggtgagagtttggctcttggcctgtcttgtggagccagccatgctggcttccagaggggacaactgttggctctttaaggatgatgggagtccagctgttcaactttgaatggctgggaaagcagttacaatatgattgtaatcaagaamgggcagcagaaccagctggagaaggtgccccatgaacatactcaggcgccacctctggacagtctcatgttgactcagcagaacctggacgtgtgtgttttgaaagcagttctcgtccagttgggtccatgctgcgtctaccaccggaaactagggctctgcagacttttactcttataagttcccaggagctgacttgtttcctaacaatcatggtgcagatcagattattctgctcccataccacttttttgactttaaagaaatgtttaagcagtgccctcattgacatccaaaacc

SEQ ID NO: 2765 - DNA, 601 bp, Human
cacaaggtttgtttgtttgttttaaaaatcagaaacagtaggaaaaaagagaaacagattgagagaagagagataactagtggcagggtctgggacaagtggcaataagcctgcatgtctgctgtagtttagaatagaccaggaaacactgtatttaccagagaggttattctctgtggtgaaccgagcatcaactcacccagcccttcatcagaaaccaaaggattaatatgatcacatttttaagtgggaaaattgaattccttctccaaaagttcagaaacataagaaacttatgaartgtttcttttcccattttctatctacggaaaaaaaatcctctggctttggaaagtcaaatgtgtgctatgaaatttcacacagaaaagtatccacttatttgagcggtggccctgatcagtgacctttatgattccacaaggagtttcagctatgttgggtttttgccaattcaagacacaaattagttatcccttttgtgcctgccctgtgatcccactttaaaaagctgagtctgatctcagattcatccccaacatagatataagctctttgagcctccgtaaaatcaagcttcatt

SEQ ID NO: 2766 - DNA, 601 bp, Human
agcccttcatcagaaaccaaaggattaatatgatcacatttttaagtgggaaaattgaattccttctccaaaagttcagaaacataagaaacttatgaaatgtttcttttcccattttctatctacggaaaaaaaatcctctggctttggaaagtcaaatgtgtgctatgaaatttcacacagaaaagtatccacttatttgagcggtggccctgatcagtgacctttatgattccacaaggagtttcagctatgttgggtttttgccaattcaagacacaaattagttatcccttttgtrcctgccctgtgatcccactttaaaaagctgagtctgatctcagattcatccccaacatagatataagctctttgagcctccgtaaaatcaagcttcatttggatattcggtgagcactgatgaaggcctcctctgcgcccggtcctgctccagtggctgagggcagggcagggagccaacgaagtctccactcttacacagcttcctttcatgatggggtggggaggcagacaaggagtgtgcacgtgtgtgtgtgcatgcgtgtatatgactacatgtgcaagcatgggtgtgcatgca

SEQ ID NO: 2767 - DNA, 601 bp, Human
cacccctgcaagactgtttaccatccactcttagaccctcacttttttcccctcaactctcccaccctttaaaatccaggagctccagcctggccaacataacgaaaccccgtctctgctaaaagtacaaaaattagccgggcctggtggcgggcgcctataatcccagctactcaggagactgaggcaggagaatcgcttgaacctgtgaggtggaggttgcagtgagccaagatggcgccactgcactccagcttgagagacatgagtgagactccatctaaaaataaaataaaaaaataaaataaaataaaatccaggagcggtcccatgttcattgtgagtttttttttttcaagaactccagaccatggggattttttattcttgctgtcttttctgttcgtttgactctcgtcgcctcgtagagtcttgtgtttaacttctgtgcatgtggatggtctgcccagtgaggtcttgttcatctcttcattggccaatgcaggggctgcttttgaggttgctcaataaatactgatgacgacgacatgcgccattgggtttgacttctctcaacggcactgcagattactagagtctg

SEQ ID NO: 2768 - DNA, 601 bp, Human
ttttcccctcaactctcccaccctttaaaatccaggagctccagcctggccaacataacgaaaccccgtctctgctaaaagtacaaaaattagccgggcctggtggcgggcgcctataatcccagctactcaggagactgaggcaggagaatcgcttgaacctgtgaggtggaggttgcagtgagccaagatggcgccactgcactccagcttgagagacatgagtgagactccatctaaaaataaaataaaaaaataaaataaaataaaatccaggagcggtcccatgttcattgtgagtttttttttttcaagaactccagaccatggggattttttattcttgctgtcttttctgttcgtttgactctcgtcgcctcgtagagtcttgtgtttaacttctgtgcatgtggatggtctgcccagtgaggtcttgttcatctcttcattggccaatgcaggggctgcttttgaggttgctcaataaatactgatgacgacgacatgcgccattgggtttgacttctctcaacggcactgcagattactagagtctgctcaattgctttttctcttgtttcacagatgtgagtctgtgggt

SEQ ID NO: 2769 - DNA, 601 bp, Human
ctccagcctggccaacataacgaaaccccgtctctgctaaaagtacaaaaattagccgggcctggtggcgggcgcctataatcccagctactcaggagactgaggcaggagaatcgcttgaacctgtgaggtggaggttgcagtgagccaagatggcgccactgcactccagcttgagagacatgagtgagactccatctaaaaataaaataaaaaaataaaataaaataaaatccaggagcggtcccatgttcattgtgagtttttttttttcaagaactccagaccatggggatttttkattcttgctgtcttttctgttcgtttgactctcgtcgcctcgtagagtcttgtgtttaacttctgtgcatgtggatggtctgcccagtgaggtcttgttcatctcttcattggccaatgcaggggctgcttttgaggttgctcaataaatactgatgacgacgacatgcgccattgggtttgacttctctcaacggcactgcagattactagagtctgctcaattgctttttctcttgtttcacagatgtgagtctgtgggtttgtagtgatggaattcactggtgggcctgaatcaaga

SEQ ID NO: 2770 - DNA, 601 bp, Human
ccatctaaaaataaaataaaaaaataaaataaaataaaatccaggagcggtcccatgttcattgtgagtttttttttttcaagaactccagaccatggggattttttattcttgctgtcttttctgttcgtttgactctcgtcgcctcgtagagtcttgtgtttaacttctgtgcatgtggatggtctgcccagtgaggtcttgttcatctcttcattggccaatgcaggggctgcttttgaggttgctcaataaatactgatgacgacgacatgcgccattgggtttgacttctctcaamggcactgcagattactagagtctgctcaattgctttttctcttgtttcacagatgtgagtctgtgggtttgtagtgatggaattcactggtgggcctgaatcaagagggagtcatccagttttgcctggtgcagttaggacagtgcttcgtcatacaggacacgctgagggtaacatgggtaaatggctagagtttcctgctttttgtttgtttattttagagatcctttttttgtttgttttagagatgtggtcttattctgtcatccaggctggagtgcagtggcgtgatcatagctc

SEQ ID NO: 2771 - DNA, 601 bp, Human
caggctggtcttgaactcctgacctcaggtgatccacctgctttggcctcccaaagtgctgggattacaggcatgagccacatgcctggccacatccttgaactcctaagctcccatttcagcctcctgagtagctgggatttcaggcctgagctatcatgcctggctaactttttgaaaattattttctttggagagtcttgttatgttgccgaggctagtcttgaattcctggcctcaagctatcctcctgcttcagcttgtttattacagccatgcaccactgcgctggacgagtctyctgcctttaattctcatttctggccacatcacagggagtggtggacttagactcaaaagacgtggggtaggggtagggttagggattgcagatgtgatgcagcctacccagcctcagcttcactcttgagcattggggataagaccacctccctcaggggtccatttgtgagaggagatgatgtcccttggcagcccctggcaccaagtcagccaactgggcactcagaagtcatggaacccaggccaaaggacaccatggtagccgctcaggcttccggtttattaacatgagagaatt

SEQ ID NO: 2772 - DNA, 601 bp, Human
ttacagccatgcaccactgcgctggacgagtcttctgcctttaattctcatttctggccacatcacagggagtggtggacttagactcaaaagacgtggggtaggggtagggttagggattgcagatgtgatgcagcctacccagcctcagcttcactcttgagcattggggataagaccacctccctcaggggtccatttgtgagaggagatgatgtcccttggcagcccctggcaccaagtcagccaactgggcactcagaagtcatggaacccaggccaaaggacaccatggtagccrctcaggcttccggtttattaacatgagagaatttggtagcaacaattccacaagcttgtccaattccttttcagatgggaagctgtatgacgcctatgtcttataccccaagccccacaaggaaagccagaggcatgccgtggatgccctggtgttgaatatcctgcccgaggtgttggagagacaatgtggatataagttgtttatattcggcagagatgaattccctggacaaggtgggttttaagtgaggtgtaaaaataacaaataaaagaaggaaagcgacccctctgttcctcc

SEQ ID NO: 2773 - DNA, 601 bp, Human
tctgtaaaatggggatggggtgcttccctgactcagatgagagaactgaatgagaaaacctgagaaggggtccccggcatggagctcagcacactttagacactcacacaacagtgctttcctgtccctttgttctccttcttggaaggctatacagcaaaatggctgaaatctgaaataaacattcttttctagtcaccagtaaatgccaattcactcacttattcaacaaatatttactgaaaacctctatgtgatggacagtattctaggcactagaaatatgaaaatcagccaagcrgaagggcctgtcctcagggaggttccagtctattcttatttcccatgagaggcaactgtagactgaatagcatctgcagagctgggtatttagagaaacctccctttcccaagcaatcatcagggcatgttatttggtttctaaattactcacataaatcctggtcatttaaataactataaagaacaaaaggaaaacacagattcaagattaatgcaacatttcagctaactacattttcctatccttttaaaatctatttttaaaaacgtgttcatctgctaatatacaccagacctt

SEQ ID NO: 2774 - DNA, 601 bp, Human
acaaaaggaaaacacagattcaagattaatgcaacatttcagctaactacattttcctatccttttaaaatctatttttaaaaacgtgttcatctgctaatatacaccagaccttcagctagtctggggatacagagttaggaaccatcagatacttgttggccagggaaagtgacatacaaagaaaccacatgcaaaacatgattcatgactatagaggaccaaggctccagggaaagccacaaaggcttcacagaagaggtgacaaatattaaaaaaaagaaaaaaacccaaaacttgwattaatccattcctgactaagtcatgtttattttaaagtccatttttggccaggcaaggtggctcacacctgtaaccccagcaccttgagaggccgaggtgggcagatcacttgaggtcaggagttcaacaccagcttgtggtaaaaccccgtttctactaaaaatgcaaaaattagctggacgtggtggtacgtgtctgtaatcccaggtacttaggaggctgaggcaggagaatcgcttgaacctgggaggtggaggttgcagtgagctgagattgcatccctgcactccaacctggg

SEQ ID NO: 2775 - DNA, 601 bp, Human
aagtcatgtttattttaaagtccatttttggccaggcaaggtggctcacacctgtaaccccagcaccttgagaggccgaggtgggcagatcacttgaggtcaggagttcaacaccagcttgtggtaaaaccccgtttctactaaaaatgcaaaaattagctggacgtggtggtacgtgtctgtaatcccaggtacttaggaggctgaggcaggagaatcgcttgaacctgggaggtggaggttgcagtgagctgagattgcatccctgcactccaacctgggcaacacagtgagacttcayttcaaaaaaaaaaagtcaattttctcctggcctgtttcaaacattctcactagcattaagacccgggctgttttaattgtgagttcttctgagccttctttctttatttccagccgtggccaatgtcatcgatgaaaacgttaagctgtgcaggaggctgattgtcattgtggtccccgaatcgctgggctttggcctgttgaagaacctgtcagaagaacaaatcgcggtctacagtgccctgatccaggacgggatgaaggttattctcattgagctggagaaaatcgaggactacac

SEQ ID NO: 2776 - DNA, 601 bp, Human
tcattgtggtccccgaatcgctgggctttggcctgttgaagaacctgtcagaagaacaaatcgcggtctacagtgccctgatccaggacgggatgaaggttattctcattgagctggagaaaatcgaggactacacagtcatgccagagtcaattcagtacatcaaacagaagcatggtgccatccggtggcatggggacttcacggagcagtcacagtgtatgaagaccaagttttggaagacagtgagataccacatgccgcccagaaggtgtcggccgtttcctccggtccagctgcygcagcacacaccttgctaccgcaccgcaggtgagcgggtgggaggacacgaggtttgtcacgcactgatggagggtctatcattgcgtggtggctcacagctggaggaggacacgtttcatcggggccgtctgctctgaagctggcagttgcgtactagtgagaggatctgttgtgtttgttgtcatttgtttgcttcgatcagagctgcttcttcagggaaacacacggcttctgcagaaggccctctttagcctatgggcttattgacacatgcccactcactgaggcctggatggat

SEQ ID NO: 2777 - DNA, 601 bp, Human
ttcagtacatcaaacagaagcatggtgccatccggtggcatggggacttcacggagcagtcacagtgtatgaagaccaagttttggaagacagtgagataccacatgccgcccagaaggtgtcggccgtttcctccggtccagctgctgcagcacacaccttgctaccgcaccgcaggtgagcgggtgggaggacacgaggtttgtcacgcactgatggagggtctatcattgcgtggtggctcacagctggaggaggacacgtttcatcggggccgtctgctctgaagctggcagttgcrtactagtgagaggatctgttgtgtttgttgtcatttgtttgcttcgatcagagctgcttcttcagggaaacacacggcttctgcagaaggccctctttagcctatgggcttattgacacatgcccactcactgaggcctggatggatacagcacttgggccccttgagaacaggacatggagggttttagaaatggcagtggacatgcccggaagtttgcccatgatgtggcacccatagagtctgagatgggagcctgtgctgtcgggggaccacaggagggcagtctagcaccaggag

SEQ ID NO: 2778 - DNA, 601 bp, Human
aagctgtgggttgttgacactgagacttagtaagcagtcagtgggggctggaagggagtcagccctgagagccagccggcaggggtgagagagggagccagagggtgtcaggaggcctgtggccttaggatggcatggggagcagggtgggttaggaggtgctgtgccctcgttcacaggcgatgggtggtacccagtgtgggatggactttcaggtgctaaggaacccactcctgtctttgaagagtttatgttccaaggtgacctcacattacacatttgtttagcatcctatggaggyctcgacttgacattggtccactctttatttaacatttgctttttaaaatttttatttcagtaaactatatgaacataaaattcaccattttaacaatttttaagtggcattaagtacattcacactgttgtgcggccatcaccaccatccattccagaattgtttcatcctctcaagctgaaattctgtgcccattaagctatgcctccctattgccttcccattgccttcccattgcctccccattgctctgaggtaggacataaaatacattttaagaataacagcattaaaaaatgg

SEQ ID NO: 2779 - DNA, 601 bp, Human
cagccctgagagccagccggcaggggtgagagagggagccagagggtgtcaggaggcctgtggccttaggatggcatggggagcagggtgggttaggaggtgctgtgccctcgttcacaggcgatgggtggtacccagtgtgggatggactttcaggtgctaaggaacccactcctgtctttgaagagtttatgttccaaggtgacctcacattacacatttgtttagcatcctatggaggcctcgacttgacattggtccactctttatttaacatttgctttttaaaatttttatttcrgtaaactatatgaacataaaattcaccattttaacaatttttaagtggcattaagtacattcacactgttgtgcggccatcaccaccatccattccagaattgtttcatcctctcaagctgaaattctgtgcccattaagctatgcctccctattgccttcccattgccttcccattgcctccccattgctctgaggtaggacataaaatacattttaagaataacagcattaaaaaatggctactataattcattactactattacatttttgatacttttcaataaaaagaaagtagt

SEQ ID NO: 2780 - DNA, 601 bp, Human
gggaaggaagggggaagggtgctgagatgccctcaaatctgaatggggtgggtgtattccccaaatcctcaccaaaccacgagccagtgaccactcaccctttgcggtccagatcttactgccccggggttagtcaagtggccagaggtggtgcccactgccctcagggggtttcctggcgtggcctggtctcacatgcactccgcagaaggaaggacgaagcgtcctcagccagcccgcagccaccctgcccactccagcactgcaggcagccttcagagaccagcccagagaagagaayggcagcgagtgaggggacagagtgcggaacagatcagtaatgcccattttcctcttgggtgcaataggagaaacagcctgttttaattaaactagcgaatcctccatgaggaataacgactctcatgttggagagagaaatcgagatgcaaagaaactttttaaagttctactaattcctaatgaaataatagggatgcaatgcagcaagaatacaaataattgaagtagcctggcatcaccgctgacatgtaggcaggttggcaggtaacagctccgctcatggtctcaagtccaaatt

SEQ ID NO: 2781 - DNA, 601 bp, Human
acccccctgggaatccccagggactgacctggaggtagggctgcgagcggagattggaccagagaggtgaaatacaggtgctgagtcgctgggttacctttacattcaccttcccataatgactgagtcagccacaaaacccactacctttggtatctcccctcaaataccctgagtcggctcatgagagaggccctgggaaagacccagtcacattaaataaagggaccgggaaggtgtggtctttccccggaggaccaagcaagatgaagatatacatgtgaaaagtgcttggcaaacygtgggatgccatgaggagctggcctgccaaaatatggaatgtgctcagggagcctcagtccccagggccccccacacccatcagcaccccatagtgacgcagaccacttcctgccacgtcatggttggttgacctttcctcggcacttggtcctgttttttatttataaacttccctctaacacatgcttgtttggtattgatctggggctgtgtaaagtggaaaattccttcctggtttccttgaagaacagaggctgttccagatgaggtctggagtgagctacagagggtgatgctg

SEQ ID NO: 2782 - DNA, 601 bp, Human
gcagagtgaaaaacttgcatcttgaaataaattacatttgtctgaggtgaaaatttatttcatgttatttgaaactgaggaggtggcagccatctttattattgggttttaggaagtttgaaacacactttctccttcctgagagggaggcaaagattcatctcattatttaggtaataatgagaaaagtaaacgacaaatatattagacagcttaaaaaaattagagtgagacagaatatacaaaaaagagactggctagaccaaggagctcaagtaggcttcatagtagatgtcaaatrccaattttaatttattagcagtgattgcctagagttttttttttttatttgagaaggattctgagacttcattctttagcgttccatgattgaatagcaaggcattccttaggctttgggggagaaagtgggagcacaaatattaatttgccttgatctattatctaggagagggaaacacatgggctcatttccctactttgataattactgctgaagagatagctgaattaagcttttggtactttcaaataacacaggtccaatctcagggtatatttacttacgtgaatccattta

SEQ ID NO: 2783 - DNA, 601 bp, Human
atttgtctgaggtgaaaatttatttcatgttatttgaaactgaggaggtggcagccatctttattattgggttttaggaagtttgaaacacactttctccttcctgagagggaggcaaagattcatctcattatttaggtaataatgagaaaagtaaacgacaaatatattagacagcttaaaaaaattagagtgagacagaatatacaaaaaagagactggctagaccaaggagctcaagtaggcttcatagtagatgtcaaatgccaattttaatttattagcagtgattgcctagagttttttttttttatttgagaaggattctgagacttcattctttagcgttccatgattgaatagcaaggcattccttaggctttgggggagaaagtgggagcacaaatattaatttgccttgatctattatctaggagagggaaacacatgggctcatttccctactttgataattactgctgaagagatagctgaattaagcttttggtactttcaaataacacaggtccaatctcagggtatatttacttacgtgaatccatttattattgagatccctgcaatggaaccctacccagat

SEQ ID NO: 2784 - DNA, 601 bp, Human
acatcagatcttatgagaactcactcactatcaggagcacagcatgagggtaatcacccccatgattaaattaccttccaccaggtccctcctatgacacatggggcttatgggaactacaattcaagatgatttgggttggggtatagccaaatcatatcattccacccctggcctctcccaaatctcatgctctcacatttcaaaacacaatcatgcccttctaacagtcccccaaagtcttcactcattccagcattaactctaaaatccaagtccaaagtctcatctgagacaaggmaggtcccttcctatgagtcagtaaattcaagagcaatttagttacttcctagatacaatgggagtacaggcattgagtaaatacaccccttccaaatgggagaaattgactaaaacaaaggggctactggccccatgcaagttctaaatttaatagggcagtcattaaaccttaaagttccaaaatagtctccttcaactccatgtctcatatccaggtcacgctgctgcaagaggtaggatcccatggccttgggcagctatgctcctgtggctttgcagggtacatctttcttcctgg

SEQ ID NO: 2785 - DNA, 601 bp, Human
aactgttccaaactgccctccaaactgttccaacctctgcctgtatgcagttccaaagtcacttccacattttgtgtatctttacagtagcaccccacttctggtaccaatttactttattagtccattctcacactgctaataaaggcatacctgagaccaggtaatatataaaggagaaagatttaatggactcagttctgcagggctggggaggcctcaggaaacttacaaaagggggaaaagccccttacaaaaccatcagatctcatgagaactcactcactatcatgagaacagmatgagggtgactgcccccatgattaaattcaagatgaggtttggatggggacacagccaaaccatatcagaatacttctatcacatcacttcctctttatgttgtggttaacaattttgagttaaaaccagactgctgctttgagaaacaaaccctgactatagagaaggcattctgtccatgtcctaagggaaatgtttcgttcagtttaaatactctcattctcaaaatgtggtaaaagtgcacccgagagtcactggagggtagattatgagaaagacccattaatgctgaacttga

SEQ ID NO: 2786 - DNA, 601 bp, Human
aatgaaggcacaatttaaaggaataaagtattctggacaggcctgagagagcacgttgagaggaacagccaggcatctatgatcatcacttggagataacagaagcaaatggcattggccatctttctgatacgggtagtagagaatacagcctggcttaggaagcaacaatggaagcaagagattgaggcaggatgtcagagagaggtgtggagagacagggtagcagataggagatgctaagaaaaatgaggtgtcccagagtggatattggagactgatcactatgagagtaaagtgwtgaggagagaagcagctttgacaatggccttgaaaataaatgggattctacatggaagcaggttgttttagacacccaggagcatagaagatacagacatattcaaatatagcataattagtaagcagtatttactgcagatgtgtgtgtatacacatatgtgttctaacttaggtgtgtaaccctttgtagtttgatgtgggatctatcagtgaacagactttacacctgaaaatttcccgttagaacagtaattctttaatttttaggagtacattgctaataatcaaatgccactga

SEQ ID NO: 2787 - DNA, 601 bp, Human
agaaaaatgaggtgtcccagagtggatattggagactgatcactatgagagtaaagtgttgaggagagaagcagctttgacaatggccttgaaaataaatgggattctacatggaagcaggttgttttagacacccaggagcatagaagatacagacatattcaaatatagcataattagtaagcagtatttactgcagatgtgtgtgtatacacatatgtgttctaacttaggtgtgtaaccctttgtagtttgatgtgggatctatcagtgaacagactttacacctgaaaatttcccrttagaacagtaattctttaatttttaggagtacattgctaataatcaaatgccactgaggactgataatttaatcctgcagtgaaaatcactttatcccaccaaattttaagaacgaaatcaactaagaaggaaggggatacaaaagggatagttttcaatgatagagatgaagaaatgaaggtagagggaaatgtacacacagaaatctaataaaccaatcctaggctgacaggcagcaagttcagcttggtgagcagcctcagaagtgggggctggtgtttatcccctggtgtctgtg

SEQ ID NO: 2788 - DNA, 601 bp, Human
agacatattcaaatatagcataattagtaagcagtatttactgcagatgtgtgtgtatacacatatgtgttctaacttaggtgtgtaaccctttgtagtttgatgtgggatctatcagtgaacagactttacacctgaaaatttcccgttagaacagtaattctttaatttttaggagtacattgctaataatcaaatgccactgaggactgataatttaatcctgcagtgaaaatcactttatcccaccaaattttaagaacgaaatcaactaagaaggaaggggatacaaaagggatarttttcaatgatagagatgaagaaatgaaggtagagggaaatgtacacacagaaatctaataaaccaatcctaggctgacaggcagcaagttcagcttggtgagcagcctcagaagtgggggctggtgtttatcccctggtgtctgtggacaaaaatgagtggttttcataaccaggatgggctgggcctgcagcaggaaagtgtggtcacagctttgggtcagttggcctcagtgttaaccccagccttggagctcctggatggcaggtgcagtgtgttgttgattgtttcagtgttccc

SEQ ID NO: 2789 - DNA, 601 bp, Human
gatcctgaatccatttcaagagccaggtagctctatcatgtcccatggccatggacccactgcctataactgtgacaacagcctgccacattctccagtcacggccaatcttttataaattcatgcccaaggtgaaggggccagattcattggattgtgaaagtgtagaattgtgcagagcacttctggcctctggggccaaatagatgtgcatttgtatcctggccccatcttgtagcaagtgtgtggcctgagtgagttgtttaacctgtctgagatttagcattctcatctgagcctraggaaaatagtcatctcccttgcatgtacatagtctaatacctggaactcagtaagtgttagtcttttcttccttctatcctattgtagacctaaaggggaactggaagagcctaaggtgggcacaaatgtgtcaggcatagaggataacttaaaaacacgcatctgctgtatttagcaaataaatctatacatcacaggtgcagtggaagcaaacatgaaatttgaaacattttctctttaaaatcttcatttaaaaaatactgtattgttttccaattccagatcaccttttttttgt

SEQ ID NO: 2790 - DNA, 601 bp, Human
attggattgtgaaagtgtagaattgtgcagagcacttctggcctctggggccaaatagatgtgcatttgtatcctggccccatcttgtagcaagtgtgtggcctgagtgagttgtttaacctgtctgagatttagcattctcatctgagcctaaggaaaatagtcatctcccttgcatgtacatagtctaatacctggaactcagtaagtgttagtcttttcttccttctatcctattgtagacctaaaggggaactggaagagcctaaggtgggcacaaatgtgtcaggcatagaggatracttaaaaacacgcatctgctgtatttagcaaataaatctatacatcacaggtgcagtggaagcaaacatgaaatttgaaacattttctctttaaaatcttcatttaaaaaatactgtattgttttccaattccagatcaccttttttttgttgttgttgttgttgtttttttgagatggaatttcgctcttgttacccaggctggagtgcaatggcgcgatctccactcactgcaacctccgcctcctgcctcagcttcccgagtagctgggattaccgtacccagctaatttttgtag

SEQ ID NO: 2791 - DNA, 601 bp, Human
tggcctgagtgagttgtttaacctgtctgagatttagcattctcatctgagcctaaggaaaatagtcatctcccttgcatgtacatagtctaatacctggaactcagtaagtgttagtcttttcttccttctatcctattgtagacctaaaggggaactggaagagcctaaggtgggcacaaatgtgtcaggcatagaggataacttaaaaacacgcatctgctgtatttagcaaataaatctatacatcacaggtgcagtggaagcaaacatgaaatttgaaacattttctctttaaaawcttcatttaaaaaatactgtattgttttccaattccagatcaccttttttttgttgttgttgttgttgtttttttgagatggaatttcgctcttgttacccaggctggagtgcaatggcgcgatctccactcactgcaacctccgcctcctgcctcagcttcccgagtagctgggattaccgtacccagctaatttttgtagttttagtagagacggagtttcaccacattggccaggctggtctcaaactcctgacctcaggtgatccacctgccttggcctcccaaagtgctgggatt

SEQ ID NO: 2792 - DNA, 601 bp, Human
tctcccttgcatgtacatagtctaatacctggaactcagtaagtgttagtcttttcttccttctatcctattgtagacctaaaggggaactggaagagcctaaggtgggcacaaatgtgtcaggcatagaggataacttaaaaacacgcatctgctgtatttagcaaataaatctatacatcacaggtgcagtggaagcaaacatgaaatttgaaacattttctctttaaaatcttcatttaaaaaatactgtattgttttccaattccagatcaccttttttttgttgttgttgttgttktttttttgagatggaatttcgctcttgttacccaggctggagtgcaatggcgcgatctccactcactgcaacctccgcctcctgcctcagcttcccgagtagctgggattaccgtacccagctaatttttgtagttttagtagagacggagtttcaccacattggccaggctggtctcaaactcctgacctcaggtgatccacctgccttggcctcccaaagtgctgggattacaggtgtgagccactgcacctggcctagtgatagtcctgatcactaatttctgatcaggagtaacaa

SEQ ID NO: 2793 - DNA, 601 bp, Human
tctatacatcacaggtgcagtggaagcaaacatgaaatttgaaacattttctctttaaaatcttcatttaaaaaatactgtattgttttccaattccagatcaccttttttttgttgttgttgttgttgtttttttgagatggaatttcgctcttgttacccaggctggagtgcaatggcgcgatctccactcactgcaacctccgcctcctgcctcagcttcccgagtagctgggattaccgtacccagctaatttttgtagttttagtagagacggagtttcaccacattggccaggcyggtctcaaactcctgacctcaggtgatccacctgccttggcctcccaaagtgctgggattacaggtgtgagccactgcacctggcctagtgatagtcctgatcactaatttctgatcaggagtaacaacaactataaaatctattcacactcacttttggtcagtaaggcatttaaagagctaattcaattacactgagggcagcaactccagactttggtttattcaacagtaaaagaaggggattggaagaagttgccttgagaaacaaaacctaatatatatatacacacatttaga

SEQ ID NO: 2794 - DNA, 601 bp, Human
gaccttttgaaaccaaagccaccctcccatcctgggccaagactctctgaacttatccatcagtgaagatcactgacattgtaaagatttgcttttctgacatccataatatattgtctgcagtaggatatgtgcgtgtgtgcgtgtgcatgtgtgtgtctctgtgtgtagactgcttaggttttcatttattaccccctgctcccatgacagtttttaaagttcttgctcttctgaatcaagcggaggcagagcagggtttgcacatcaatgaatcaatctctttaataaaaataaaggaaaatattgtaactggttactaaagggaagatgggtgatatttgcaaagtttctgtagcattataaaatacctttacacttttattccatagaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataaggtaatgcttttataatattttaactttaagacttgatggaaaa

SEQ ID NO: 2795 - DNA, 601 bp, Human
ctaacccccttgtttcgtctaactaatcccattgttattggacatttgtgaattgcctatttttcactattatttaaaggctaaaatgaataccatttccacaaatccttgggtgtttatatgatttgtccttcaaccaaatccctaaatgtagaattactggatcagaggctgtgagcatgtttttatgtctttttcctcacactatcaaacttgtctccagggagctctgccaattttaccccacacttgaaaaaagaatcccaattttttgtcacctccacaacacagggaaataatrgtcccagaatgtttaaaatttgatatgaaaaatttctaaaactcctagtggttttttcacttttcttagtaataaattaaacttttgtatatatttattgcatcttactgcaatcaggcaattttgtgggttgcctgtttatttttttctgttttcttcagttggtataccttttacctgttgaattttaaaagctcttatacaccatggaatactatacagccataaaaaagcatgagttcatgtcttttgtagggacatggatgaagctggaaaccatcattctcagaaaactaacac

SEQ ID NO: 2796 - DNA, 601 bp, Human
atgagaatctaatgcctgatgatctgtcactgtctcccatcacccccagataggaccacctatttgcaggaaaacaagctcagggctccactgattctacattatggtgagttgtataattatctcattatatattacagtgtaataacaatagaaataaagtgcacaataaatgtaatgcgcctgaatcatccccaaaccaaccattccccgctcaacccctgcccaccctggtccatggaaaagttgtcattcatgaaatcagtctctgtgtcaaaacggttggggacagctgatgtastttatatggaataacaaatctgaataatatgactctgtcgtggaaactttaaagacctataagagagtggtctgaacagaacttgggaaatctgaagcgagtgatgataatatccttgaaatttttgtttgtgccttattcttgaacactgtttacttgtgatttccaaagacagctcttatctgaaatgttttctaaacactcgaatcagtcctgagttgactttattctatttcccatcaatgtacaaatgtgttacagtatatgtaaattagtgaggcttggtgtgctgagttttaa

SEQ ID NO: 2797 - DNA, 601 bp, Human
tgtaataacaatagaaataaagtgcacaataaatgtaatgcgcctgaatcatccccaaaccaaccattccccgctcaacccctgcccaccctggtccatggaaaagttgtcattcatgaaatcagtctctgtgtcaaaacggttggggacagctgatgtactttatatggaataacaaatctgaataatatgactctgtcgtggaaactttaaagacctataagagagtggtctgaacagaacttgggaaatctgaagcgagtgatgataatatccttgaaatttttgtttgtgccttatkcttgaacactgtttacttgtgatttccaaagacagctcttatctgaaatgttttctaaacactcgaatcagtcctgagttgactttattctatttcccatcaatgtacaaatgtgttacagtatatgtaaattagtgaggcttggtgtgctgagttttaagaaattccgttcgggtgcagtggctcacacctgtaatcccagcactttgtgaggctgaggtgggcggattattaggtcaggtgatcgagaccatgctggctaatatgatgaaaccccgtctctactaaaaatacaaaaaa

SEQ ID NO: 2798 - DNA, 601 bp, Human
atattaataatgataatcatgccaacagcaatgggatcgcatttaattgtttcagtaaaagtagtaccaagtaactgggacatatgtccaggaattgctactttccattcttttttcctttttctctaaagatctttaactcaaaaatttggatcactgtaatatcaatttggcttttacttaaagtattttaacttgttttattaaaaacagaactgtaaaaagctactactggagaacaataaaaacccaacgataaagaagaacgccgagtttgaagatcaggggtattactcctgcrtgcatttccttcatcataatggaaaactatttaatatcaccaaaaccttcaatataacaatagtggaaggtaagggaaatcttagaattgggaagaaacagacgtattttagtaaaatggaattttttcattcttcaaaactgtgtaggaattgagagtccacttagttggggttgtgaccacaccactagttcaaatatgatggtcaaaatcttcattccggtgctcctctacttggctaaataaacctttctttttggcaggaaatgaaaatctgtatgaataaacctcacatgagtc

SEQ ID NO: 2799 - DNA, 601 bp, Human
ctgtggccttgggtgagttaatttccttagttcctctctgcctcagattcctcatcatgaaatgggacagtaatggttcatccctcgtagggttggctgacaatgactgagtgagtgtgtgtacagctctaggatggctctagggacagtaagagttctgctgtaatgaccatctcccactgctaggttcccaaacctcacctgcagcacaagctattcttctcccataattgtccatcttatttttcttgtcttcttggagaatgtcaactgagtctctcaggactccactcaaatgtcrctcctccttcatgcccccatggcctcttgtttgtatttctgattgctgtcagaattgcaatacatgtgtgtctctgtcaataacttgaaaggtttctggaaaggtttgcactgacttctgttcctcatctttgcatcttggatacctacaattggcacttggcacataaaggtgctcattacatgcctgttgtgtgcatcactgagacagaaacaactcctttgatgccacatacaacaagaagtctagacacttcaccatcctggctatttttctttggatttggcaaagtttgccacg

SEQ ID NO: 2800 - DNA, 601 bp, Human
gctgacaacctctatgccattttgactctgatagcctcctaggtaggctggccatgtcaagggcatgcactaagatgttgtcttccttccatgacctacatgggactgcacccttcactttacaccagttgtgcaaactcagggctgatctggatttccaatgatataatttgagtgttagtagacagcatcctttgctgaagatgtacttcacactgccccttctcaagtctcccatgtaagtttctgggggaaaaaatggatccagagaaaggtagtcagtagcagttttccccctcayaccgaaattgcctcctgccctttgtctttgaattcaagccggtgttgcttcttactgtcagacctgagagttagttctttccctggatacatctcagctcctcctgcctgtttgccaacattccaggcttgcccagagactccaaatcccaggataacccagacctgactctgaactccggagtccactgtgctggtttcattctcctgttcttgctcacatatctgcccactgcattctcaactgctcactctggcactgcactttctgagagggctcagggaggtgtgggagctgcag

SEQ ID NO: 2801 - DNA, 601 bp, Human
ccttaagcaagagcctgttgggtgatgacttacttcccaagcatcaccagatggggactgagggggcagaatttatgtgcagtacttccagtcggggtcagaagccactcaggagcagaagtagaacttggcctacaggcatgaacttaacagcagggccagggccaaggtgaggttcctggggcacaatattgaagggacactgctctcagcatcctgcaagggaacggtgggcacatagagtgagggatttgcttttctcaacctgtcttggccctgcaacctgtaaatccatcactgkccagctgaggaggacagatggagagaatcgagacagggcagaaaggctcttcccagtgattttgcatggtttgactcttgcacgtttgatcatctgagagtcaggctgcagtggatgggcatcttcctctgccttttagttgaattgagcagaagctgcagatctgagtgagagaaaaccagatacaaggtgctttcaacatctgtgacctttagttaatgcaaataggactcaagtgaacgtaaaccagtaactattggaatctttgttacatgaaatgagcatattatcatagatgct

SEQ ID NO: 2802 - DNA, 601 bp, Human
cttaagcaagagcctgttgggtgatgacttacttcccaagcatcaccagatggggactgagggggcagaatttatgtgcagtacttccagtcggggtcagaagccactcaggagcagaagtagaacttggcctacaggcatgaacttaacagcagggccagggccaaggtgaggttcctggggcacaatattgaagggacactgctctcagcatcctgcaagggaacggtgggcacatagagtgagggatttgcttttctcaacctgtcttggccctgcaacctgtaaatccatcactggycagctgaggaggacagatggagagaatcgagacagggcagaaaggctcttcccagtgattttgcatggtttgactcttgcacgtttgatcatctgagagtcaggctgcagtggatgggcatcttcctctgccttttagttgaattgagcagaagctgcagatctgagtgagagaaaaccagatacaaggtgctttcaacatctgtgacctttagttaatgcaaataggactcaagtgaacgtaaaccagtaactattggaatctttgttacatgaaatgagcatattatcatagatgctt

SEQ ID NO: 2803 - DNA, 601 bp, Human
ccaaggtgaggttcctggggcacaatattgaagggacactgctctcagcatcctgcaagggaacggtgggcacatagagtgagggatttgcttttctcaacctgtcttggccctgcaacctgtaaatccatcactggccagctgaggaggacagatggagagaatcgagacagggcagaaaggctcttcccagtgattttgcatggtttgactcttgcacgtttgatcatctgagagtcaggctgcagtggatgggcatcttcctctgccttttagttgaattgagcagaagctgcagatmtgagtgagagaaaaccagatacaaggtgctttcaacatctgtgacctttagttaatgcaaataggactcaagtgaacgtaaaccagtaactattggaatctttgttacatgaaatgagcatattatcatagatgcttgtcataaagaagctcaaggcaacactaatacatttgtcttttcttttgtcacttctagatcgcagtaatatagttccggttcttcttggaccaaagcttaaccatgttgcagtggaattaggtatatttcaatatacatatattctgcatttataagtagggg

SEQ ID NO: 2804 - DNA, 601 bp, Human
atgagctgaaatcacaccactgcactccagcctgggcaacggagcaagactctatctcaaaaataataataataataacaataataaatttaaaaattccgtgagagcactctggagagatgagtcaaactaattttgtggtgtgaatgtttgattaattgattcactttgaatcaattgactgaattgattgtatatttggagtttgtctagataagtcttatgaatcaacatgtccaattgagtaatttctttcaaaagagaaaggaaagaaagaaaggaagaaattcacatatgctamatatgctaagccaggtatcatgctaggtcattgaaatatattgttgaattaaatcctccaagcaacactgaggcatgtattctcattttatgaattaaataattgaagtgcaaaaaggctaagtaacttgtctaaagttaaatcactaaaaagtggcaagtctctgtttggggactttgcttccaaagtccccaccttataaccacagttggggtcacagtggtttatatgaccacatgggcccagtgcagctgggtcctatgccatttgtacatgaggtttacctgctttatattttta

SEQ ID NO: 2805 - DNA, 601 bp, Human
tcagaattgagttggggtggctgggatgtaggtatgttcactccaatctgtcttcatctctgatagctggtgagggagggggtgctgcagtcatgtgtttgatgcaggcctcttctctaatgagacttgctctcctgattaccatgagactgcaagtgatatcatacagcctttacatccttttacgctgtccgagcgcttagcagtaattctgcaagcctgtgcagctgccgagagcttcactggattttcttgtttctatgagactctttctgttaattacaaaccaaagcaaattctkccatggaatgaaatggccacctatcttagctcaccctagaaaggatccttcttaagtacgcttgtagttcaaaaatttctctttattttctctgtactttgatgtctttaatgtttgcttaatttaatttttttgtgatttatccatttggtttatctagaagtctcagtgagagtattgtcctgatgctacgaaaagaaagtacactgatcactctaagttttaatagttgattaaaaaataaatgtttaaaaagaagccaaatcatgttttgatgatgacttgtaattgctacctatt

SEQ ID NO: 2806 - DNA, 601 bp, Human
cattttttggtaccttctttgttaccatgcttgcagctctacattcttgctgacacttgtctacaagctctttacaccacaaagtctggcttcttgcccgggagcaggcatgtggttcatgcccactacatgttgaattcatttgaaatttgtggatctcctgccatcatatctcatcctcagccactggcctccatttgagttttgtatttctccctttggataatctctttctaatttttagaggggtagaaaaccacagtgaatttcttagaaatgcagcttaagctacaaaagcagrgaggtctttctttatagttgggtgcacacacctttgatatcatctgttttgtcctctcaatggcctcctgtgttttacttctggatttcattggttttagatggttgttatttctggatgggtgacttaggaaaagaattacattccaaaatgtacttgaggcagttggaggctacagtggggctctgtgtcccgggtcctagatatccctgttgctaggaatgtgggcacatggggcccatgtctggctgtgttgactggtgtagctatcagagcctgtcattggtgggggaagtggat

SEQ ID NO: 2807 - DNA, 601 bp, Human
taaggaagagaaaaagaacgtgctgccagtggctttctcaagtcattttctgacactcatggaacaacttaactggcacttctcatgtgcctcggggtgcttgagaacagtgttatgttttttaatgctgaacacattaaaccagtttgttggattccatggacaaatgtaatacgaatctgcatctatgctaaacaacttacagccttgtcataattagtgggaaccactctgtggaaagaaccccaagttgttaggaagagagaagtagagaaaaataattgagagagaatattttctyatattttcaacttagcatcatgatcttccagccatttaaacttcaggtaattgacagcaccattcccaaatggcctcaggagggctgtttctgtcagttctgatgctccacggaggaggggacgtttattgtagtccatgctttaagagtactggccagaaagggaagaaataatgcaggcaacatcacagctgccttcaagcattttaaacatgtgaattcccctctcaagggtaacgaacagagcctactgctaaattattttgccctcttacaggactccagaaggcaaatggcatg

SEQ ID NO: 2808 - DNA, 601 bp, Human
tgctctcacagtcatattccatcccatgtggaaatcggggggcctgaggcttggagatacagatgctgagagtgaggctcatggggaggccatcaggacaacccctgcacccagcactgcacccagagcagccagaggggagtttgcagatctgcgtggggtgaggccagtgcaaacttggtgtgactgctgctccagcctgcctcagcagggtaccaggctcagggtccttgtgtgtgctcattcattcattgcctcctgaacttggcaagcaggccattgatagccctgatctgtgggmtcttaaagtttttcagtgctcacctgatggagggccccagggtcgccatccctttcctccaccaaagtagcacagcccagggccttcagcccagtagctgctcagaaatggctgtgactggagccagaaagctgtgatttccagttgtcactactcattcactgttcattcccaggctccaccatcaactccctggatatgtagagaaaggtcaagatctgcaagagagagagaaagggagagagacagagactaacacacccagagacagatggagacggagagagacagacacagaga

SEQ ID NO: 2809 - DNA, 601 bp, Human
tctcaaaactatgcacctcaacccacttgctaatatttctgtgagtccctatgtgtttcagcctagtatctcttcaccccagaaatctgatttccacgggtacggatagaatacattactgtgtaatgttttcacttcagttctctaaatatccgtgtacacatttttattctttaaaaatctgagtagaaatatcactactccagactaaaggcaggaatgtggagtcactcagtggaatgtgtcagcacgtgggttggcaactactgcattagtgttagcagtaaaaatggacaagcaygtgatgatggacaacactggtaagatttcttgattattttcttttcctttttccctttcttttctagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacaggtaacacatataatgctggaatttcttaccttatgttctcattaagaaatcagataaataggcattaatct

SEQ ID NO: 2810 - DNA, 601 bp, Human
aacttttatcacaatttaatactgctgcaatatctaagaaagtgttcagtattggtttctgaaggattggaaatgaaactaatcaataaacaacaacaaaaaaaggcaaatttaaattaaaacatggtcattcaccaagcatagtttgaggaacatttgtttaacttactccttgaagtcccaaatatccacttgaattataatttcctttataattttcctttatgtttgaatatagagaataaaaacattaccattagttttcaaattcctttttttgaatactttactctgtcaattstcaagtcccctaaaccttttaaaacctgaatttaaaatatattgtaataaaattagcatatttatattaaaagaattgcttaaaataaggaatttgaaagcaattaatagttgaaaagctaatttttcataggtaagagcaaagctatattgtatgtaatataaacccatatttgatgaaatcgtcttcccagtttgttgcaatccattacatcataagaaaattatgccctttaaaaaagtgtgctcatttaattgtcttacatgttgatgcctgttttgtcactgacacagtgacaac

SEQ ID NO: 2811 - DNA, 601 bp, Human
ctgaaggattggaaatgaaactaatcaataaacaacaacaaaaaaaggcaaatttaaattaaaacatggtcattcaccaagcatagtttgaggaacatttgtttaacttactccttgaagtcccaaatatccacttgaattataatttcctttataattttcctttatgtttgaatatagagaataaaaacattaccattagttttcaaattcctttttttgaatactttactctgtcaattctcaagtcccctaaaccttttaaaacctgaatttaaaatatattgtaataaaattagcrtatttatattaaaagaattgcttaaaataaggaatttgaaagcaattaatagttgaaaagctaatttttcataggtaagagcaaagctatattgtatgtaatataaacccatatttgatgaaatcgtcttcccagtttgttgcaatccattacatcataagaaaattatgccctttaaaaaagtgtgctcatttaattgtcttacatgttgatgcctgttttgtcactgacacagtgacaaccctagtggaagcactagctcttacttaactagtagatagttatatttgatagcagttt

SEQ ID NO: 2812 - DNA, 601 bp, Human
tttgaggaacatttgtttaacttactccttgaagtcccaaatatccacttgaattataatttcctttataattttcctttatgtttgaatatagagaataaaaacattaccattagttttcaaattcctttttttgaatactttactctgtcaattctcaagtcccctaaaccttttaaaacctgaatttaaaatatattgtaataaaattagcatatttatattaaaagaattgcttaaaataaggaatttgaaagcaattaatagttgaaaagctaatttttcataggtaagagcaaasctatattgtatgtaatataaacccatatttgatgaaatcgtcttcccagtttgttgcaatccattacatcataagaaaattatgccctttaaaaaagtgtgctcatttaattgtcttacatgttgatgcctgttttgtcactgacacagtgacaaccctagtggaagcactagctcttacttaactagtagatagttatatttgatagcagtttaagaaaagtttgagggggaacctacttactgattgataactggttttatttttaccaacatttcatacctttgatatttatgtaag

SEQ ID NO: 2813 - DNA, 601 bp, Human
aatatccacttgaattataatttcctttataattttcctttatgtttgaatatagagaataaaaacattaccattagttttcaaattcctttttttgaatactttactctgtcaattctcaagtcccctaaaccttttaaaacctgaatttaaaatatattgtaataaaattagcatatttatattaaaagaattgcttaaaataaggaatttgaaagcaattaatagttgaaaagctaatttttcataggtaagagcaaagctatattgtatgtaatataaacccatatttgatgaaatygtcttcccagtttgttgcaatccattacatcataagaaaattatgccctttaaaaaagtgtgctcatttaattgtcttacatgttgatgcctgttttgtcactgacacagtgacaaccctagtggaagcactagctcttacttaactagtagatagttatatttgatagcagtttaagaaaagtttgagggggaacctacttactgattgataactggttttatttttaccaacatttcatacctttgatatttatgtaagcctgaaatttttaccaacatttttcatctttcaatgcat

SEQ ID NO: 2814 - DNA, 601 bp, Human
ccctaaaccttttaaaacctgaatttaaaatatattgtaataaaattagcatatttatattaaaagaattgcttaaaataaggaatttgaaagcaattaatagttgaaaagctaatttttcataggtaagagcaaagctatattgtatgtaatataaacccatatttgatgaaatcgtcttcccagtttgttgcaatccattacatcataagaaaattatgccctttaaaaaagtgtgctcatttaattgtcttacatgttgatgcctgttttgtcactgacacagtgacaaccctagtgraagcactagctcttacttaactagtagatagttatatttgatagcagtttaagaaaagtttgagggggaacctacttactgattgataactggttttatttttaccaacatttcatacctttgatatttatgtaagcctgaaatttttaccaacatttttcatctttcaatgcatgcaattctgcaaagcaattgctttaaatcaacaataggttctaacccaaattgctggacagaatgctgtaagtagaactgaagaagattttgccagaagcagaaagtgttgtttggtgaccatga

SEQ ID NO: 2815 - DNA, 601 bp, Human
agcatccattgcattttttaggacctgactcaaaatttcctcctttcagaaagcatgtccatcgggatcactctttattctctggccaggttattttgtctgtgagttttgttattctttttttgttatgctatttttcttctgctaatgtgttgtctgtaactttttccaagttgttgcatgcatctgctttgcttttaaaaatagattggatgaagctagaagagagagtggtatcatgttttaattacccaattaggagcatggtctttgttatttaggagacattttcaccttcttrggggtctttctgagcatagaaattgtgatggtggtagaattaaatgatatgagtaaaccagggtgagattttctttccactcctggaatgaggacacctttgggctcttggccttctaaggaacttaaagacttaagttcctttagtgcccagatctatggctcatatatctctgtattcttctgtggtgtcaagcagtgggatcttaaagtagatgcttaaaaacacattggctaattggttgcttggttagcatgggaggtttaaatataaacaactttatatataatttgttttttc

SEQ ID NO: 2816 - DNA, 601 bp, Human
ccatcgggatcactctttattctctggccaggttattttgtctgtgagttttgttattctttttttgttatgctatttttcttctgctaatgtgttgtctgtaactttttccaagttgttgcatgcatctgctttgcttttaaaaatagattggatgaagctagaagagagagtggtatcatgttttaattacccaattaggagcatggtctttgttatttaggagacattttcaccttcttgggggtctttctgagcatagaaattgtgatggtggtagaattaaatgatatgagtaaamcagggtgagattttctttccactcctggaatgaggacacctttgggctcttggccttctaaggaacttaaagacttaagttcctttagtgcccagatctatggctcatatatctctgtattcttctgtggtgtcaagcagtgggatcttaaagtagatgcttaaaaacacattggctaattggttgcttggttagcatgggaggtttaaatataaacaactttatatataatttgttttttcaatgattctatactcattacttacgacattcacttaagtttgtacttaaataaaattt

SEQ ID NO: 2817 - DNA, 601 bp, Human
cctggaatgaggacacctttgggctcttggccttctaaggaacttaaagacttaagttcctttagtgcccagatctatggctcatatatctctgtattcttctgtggtgtcaagcagtgggatcttaaagtagatgcttaaaaacacattggctaattggttgcttggttagcatgggaggtttaaatataaacaactttatatataatttgttttttcaatgattctatactcattacttacgacattcacttaagtttgtacttaaataaaattttatttacacatgaattaaaagagycaatcttacctcctagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggaggtaagagggaatgccagatagaaaaatattcaagatagtttctttttaaaaaatgaatgagctagcccccagagagctatcccattttccttaaaaacaaatgaataaggtcctttaagcaagaa

SEQ ID NO: 2818 - DNA, 601 bp, Human
catgggaggtttaaatataaacaactttatatataatttgttttttcaatgattctatactcattacttacgacattcacttaagtttgtacttaaataaaattttatttacacatgaattaaaagagccaatcttacctcctagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggargaggtaagagggaatgccagatagaaaaatattcaagatagtttctttttaaaaaatgaatgagctagcccccagagagctatcccattttccttaaaaacaaatgaataaggtcctttaagcaagaaataaccacgtaagtcaacaatcgatagtgagaaaacaaactaatgagcttccaatagtctcttctcttgggctctgttctttgtgcttcacggttctctgaaactttggggaaagggagagggcatttccttttcagaaccgggcccagagctggcgttatcatgaagcctt

SEQ ID NO: 2819 - DNA, 601 bp, Human
acatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggaggtaagagggaatgccagatagaaaaatattcaagatagtttctttttaaaaaatgaatgagctagcccccagagagctatcccattttccttaaaaacaaatgaataaggtcctttaagcaagaaataaccacgtaagtcaacaatcgayagtgagaaaacaaactaatgagcttccaatagtctcttctcttgggctctgttctttgtgcttcacggttctctgaaactttggggaaagggagagggcatttccttttcagaaccgggcccagagctggcgttatcatgaagcctttatttagaaatgacccacggtgagaatatctgtaccacagcagcagttcctaatttaacatgtgatgtgtggactagttaatcctcactagtaactcttactagaaataaacacgggttaattattactagaaaatgcatgggtttttattgt

SEQ ID NO: 2820 - DNA, 601 bp, Human
aattattactagaaaatgcatgggtttttattgtgttgatattggtgacgaaatttaagtagaaaataggaaaattgaaaagggaaaaataacaggaaagcggtgatccccatcagatcatagctatgaaattcaatgttttttttattaatataggaatacaaatggccatagtgcctatattaaagcaaattactgttaaatttttctttttaatgagtaacatttttagattttctctgaagtctttagaacaaacatttaaaatctggtgtcaaattattctggatactgatgcttaaaaaaaaaaaacaaatgtttgattattaccatcattcatgtattaatctaatatttattggatactattcctgtgccaagttgtgaactgggcatcaaagatataacagtgagaaagaaatagttacattcccccccatattacaaagtagaaaggaaaatattgctaacttacactactgtttagtaataaacaacttgtcaaaaaaatatgccagattatcagatgcatacattgtagtatttttggatagcagttctttgcatctaagaaggcatattgttacttaggaagcattta

SEQ ID NO: 2821 - DNA, 601 bp, Human
caaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagasgcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaa

SEQ ID NO: 2822 - DNA, 601 bp, Human
ttataggatgttattttcaggaaagttcattgagggaagttaagaccaatttctcttaggaggtatttctttctgtttttgtttttaaacactttgtccattccgttactgtttttgatagcagggcagttttcagacttcatcttcctggtgatttgtgaaagctgcttagctttgtatctgtgtttctctgaaataccagttcccttggttttagaaagagggttcaatacctgtctccttcagattcatctgccaaaaaataacctgaagaatggagaattgattcttggatgtgaaytacggtttctacaagaagtagaattggtttcctgacccgaagtcaaccaatagacaagactctgttggttgacttcaggcagttgtaacttccccaatcacagtttctcatccctagagtagagagagtcgagctacagggaattgatcaagcaagtaattatggggggaataatggcttcaattattttaaatactggaaagatatgaaatgtggtgtttactttgtaatctctgtgtcttggagtgctctgaatggaaatagaaacttccatatgaagctatctgttaaactaaaagg

SEQ ID NO: 2823 - DNA, 601 bp, Human
cctcatagagtggcagagaaatcagcgagacagcatgagacagggactaggaaactgctgtgtgttatacaagcacaaagtattggtttttgtttttgtttttctcaatcctgcttctgtaagggtattgtttctaattaagtactgtagtagcattttacaaacaatcagggtgaaattaagtagtagtgttttacaaagaatgaatttggaaaggggtgtttgtgttcaggtcatgctctttttggttagtaaagtagacatctatttacctaaacactttaagactacttaaaatgcktactgaattttgacattcaagtagtatgtgaaggtcatagccatgacttgaggagtaattggttccccacttggctctgtcgttgcttcctgtggtatgcaccttgcactggttactacttctcttctgtatccaggtgaattgatcctgtgaactgactaagtcatttattttaatggaaatacactgtgtagatgatgcctctaagtcatagacttgagccatctttcgagcagtcctcaggtagtgctgggtcctggctctgcagagctggcacttggaggggtcaggcactaatgt

SEQ ID NO: 2824 - DNA, 601 bp, Human
gggttttggtgatgcagtaaggaggaaaacaaagttcttgccttcacggaccctggggtctcatgggggaggcaagtaggaaacacgagccaatatttaactgagtttatgaaaaggcaaaacagtgatggggagagagacagtggtgttggttagaagcagcttcaggaagcttctcggctgtaacaagattactctgtgtgttgtggagaaggaaccaaacaggacaagggtggatgtgggcaattgcttgtgtacacagctcctgtccctgtgcagaccagagatgacgatggcccasctggcttcgtgacagcgggagtggaaggtgtggactgacaagaaatcttttccttgtggaattgccatgcctgtctgcttaccttcccagagcaggctgtgccaccagcagcctacctttgtacagaattgtttcttttcctagaaggcctctttcctttgtgccctccctgtcttctgttcctcctaggacccagcttatggatcattcctgctttgcgatgcttcttccttttggaattccttttcttcctcctgtgttgccaccacaccgtctgcttgtctccatgatgacatcttc

SEQ ID NO: 2825 - DNA, 601 bp, Human
ctggtgatggataccctaaaagccctaagttgaccaccaggcctataacaaaactgcacttgtaccccatgaatttatattaaaaaatataaaaagagagctcatctctacttggtggaaaagaccttgcaattatatagttttcaagatgaattattttatggagactcaaaattcttactttgtgatgagcatgcaaattacttctacagttcttatgtcaggcaatttaggaagtgggtcgcttccttgctgatattttatttttaagaagaagctattctgggatttccttcccccrcccctttattttgcccaaaccagtcagttgggtagcaacagaccacttgtggaaaagtgaagtagttggccttttatggacatgatctcagtaacctttaaaaatatgaatcttccattacttcgtttttggatatgagagagagtgtgtacgctgcctgctcttcaaatcagtcaggcagctttgactttctcaattcacattctggagggtacaacgtggagctcgagcaactcagctgcagagtaagagctcgcagccgtgcgtgtttccacgtgtgggagcgcctctcattccccc

SEQ ID NO: 2826 - DNA, 601 bp, Human
ataaaaagagagctcatctctacttggtggaaaagaccttgcaattatatagttttcaagatgaattattttatggagactcaaaattcttactttgtgatgagcatgcaaattacttctacagttcttatgtcaggcaatttaggaagtgggtcgcttccttgctgatattttatttttaagaagaagctattctgggatttccttcccccgcccctttattttgcccaaaccagtcagttgggtagcaacagaccacttgtggaaaagtgaagtagttggccttttatggacatgatcycagtaacctttaaaaatatgaatcttccattacttcgtttttggatatgagagagagtgtgtacgctgcctgctcttcaaatcagtcaggcagctttgactttctcaattcacattctggagggtacaacgtggagctcgagcaactcagctgcagagtaagagctcgcagccgtgcgtgtttccacgtgtgggagcgcctctcattcccccaccacacacgcccagtttccgcttctcgcccccaagggcacagctttgcctgctgggtgctgtgccctgctgggcacacgcgggcctc

SEQ ID NO: 2827 - DNA, 601 bp, Human
cagtgaacttggaatgcatggtcaagataaggctcagccccggatgctgcagaagcttgcagaggagggaggggcgggtgtcacagacagaccccatcagcagacaccgcattggaatgtggtggcgtgaaggctgcaggaggggccctggcacggtgtgtggggcccagagaagaaaggagctactctgcttggtgggtttgataattgcctctaagtgggtgtattttaaaggatagaaatacaccccttctagcctggtgaggcaggctagaaaatgtttaatagacaacaaaatttrattgggtaatgttgatggtaaaagttctgtgaagcttggaaaagtgttaatgggctcaacttaagaaaattttctggggctatgtagttaggactgtcatagggacagcagccagcggagaaggaatagtgttccttttcttgaagcttctcctgacgccagggctgactgcactttgaaggggcgtctgggtgccaagacacacctcaaggagggtacgggaaggtcagcactttgaaaaatcagagggaggagattttccaggtaggtggatggtgaagattggctgggctattacag

SEQ ID NO: 2828 - DNA, 601 bp, Human
agcatttactacatgcatggccttaatggcggtgtataaaccctgtgctctgtcagttgctagataaggagctctcagtggcttcgtcacagagaccatgtgtcatttgtgctatttatcctgtacctggccctgtgtcatttccctaccctgacatacgtggactctgcccctttaggcctaggcacgtagcaggggaccagctggggctctgccagccctgagattgtgttctataaaatatgaggcatgagcttttcttacagctgcctccatcatgacaggcagaaatccttagttytcttacttcccctctttctgtaatgacgtctctgtgtgctaacacgtcagcagggacagtttgtgttgtggggacttgtttttaaaaagccattaaaaagtaagttttaaagataattttactatattttcactacaatgtgggtatcataatgtgaatttagtataaatccatttccttgttaataaaaggaatgtatctaaacatatatctagtgattttagagaaattgctaaactacttgacagcataaagttccctgttggcagtttggtgagctctattttattgtaagttctt

SEQ ID NO: 2829 - DNA, 601 bp, Human
ttcttctgcctctgggttcgcgtatcttacatgcccaaatctggccttcatcacagagatctctgccaggggccacctgcctgcctctcctgccaagctgctaggtagcctggctctggcctccatgtcaccctcagtggaggactcgtttgttgattcacacatccagctaccctttcttccactgttaccctaagccagcactccacaaacacaacagaacaagatggatcaggttatcatctcttcaggggatcatgctctgggggtggggacagagaagcaattggggtgcagtgtratgagagcactcgtggacatcagctccaggaagcagtgtctgcccagtgcgggctgggcaggtgccatcagggatgacttcccaaaggctgtgatacctgggatggagcttagaaggatgattaggagttggcaggccaggcatggtggctcacagctatagtcccagcactttgggaggccaaggcaggtggattgcttgagtccaggagttcaagaccatcctggccaacatagtgagattccatctctaccaaaagtcaaaaaaattggccagttgtagtgacatgcacgtgtagtc

SEQ ID NO: 2830 - DNA, 601 bp, Human
ccttctgagaaaatgtggaagctgggaccatcctcatcccatgaatgcgtgtgtgccctagtttatccagaggctcaagtgctgtgtgaactttctgtggaaatgagttcatttctcccctcctgggctctgcttgtttcagggttggttgtcagttcagtaatggagagtgcctccgcatgttactgattgctcacgtggagttttttggtttttcttttttggcagagtttaaaaagtcagtgctagacactcatgtgcatgggttggaagacttattgtgaagataacagtactcccytaattgatctacacattcagtgcagtccccatcagaaatcccagctgcctttgtgcagaaattgacaagctgatcctgaagttcatgtggaaacgcaaaggacccagaatcgtcaaaacaatcctgaaaaagaagaacaaagttggaggattcacatttcctgatttctgaacttaccacaaagctgtaataatcaagacagtgtggtactggcataaggagagacatatagaccaatgaaatagagctgagagtccagaaataaatccttacatttagagatgatttatttttaacaag

SEQ ID NO: 2831 - DNA, 601 bp, Human
tcttacacaatctaaaattttaaaaaatgatcagtcatgaagaaagaagaaaacagcttccttctaaaagcctgacaaatcgggaaaaaatagaacggcacgattagaatggagaatcactgataatctctgcctgcatggcaaactctaaagctgttgcatcttttttttaccattccttcccaagttttctactaaactagggcttctcaaattaaattctcaagaaaatactggtattttgtgaattagatgaaaccgttctatatctcaattaactgatgacacttttttgtttgtytgtttgtttgtttgtttgtttttttctttttgagacggagtctcgctgtgttgcccaggctggatggctcactgtgacctctgcctcctgggttcaagcagttctcctgcctcagcctcccaagtagctgggactgcaggtgcatgccaccatgcccagctaatttttgtatttttagtagagactaaaaatctctactaaatcagccaggtcaggctgatctggaactcctgatctcaggtgatctacctgcctcagcctcccaaagtgctgggattacaggcgtgagctactgcgccc

SEQ ID NO: 2832 - DNA, 601 bp, Human
ctgcctcagcctcccaagtagctgggactgcaggtgcatgccaccatgcccagctaatttttgtatttttagtagagactaaaaatctctactaaatcagccaggtcaggctgatctggaactcctgatctcaggtgatctacctgcctcagcctcccaaagtgctgggattacaggcgtgagctactgcgcccaggtgacactgtatttttccaaattgcaacagggaaggattttaatggatagaattttctcccataaatttttctaatagctttactgtttgctaatacttaatctrtgtacttaatatttaacctgaatagcaaacagttattaatgtaaaacagaactgctggtgatattgcttaagatcaacttgtgtgttttgtggacccattcttatggttgtcattttttaatatgtaggcacatttatgtcttcataaattattcctacttcaaacaaaggtgctgaatatttttctctattttgtggtatgctgcgaagtgagaaatctatctttgatagtagttaagaacgaacacctttccccgtatcacagggaaaaaggaagactgcaaggtggaggtggggagg

SEQ ID NO: 2833 - DNA, 601 bp, Human
gcttaagatcaacttgtgtgttttgtggacccattcttatggttgtcattttttaatatgtaggcacatttatgtcttcataaattattcctacttcaaacaaaggtgctgaatatttttctctattttgtggtatgctgcgaagtgagaaatctatctttgatagtagttaagaacgaacacctttccccgtatcacagggaaaaaggaagactgcaaggtggaggtggggagggagaatgagttgtagtaatttaagttgtggttctttgctgctcttaaagataagtccaggcaagcraccgccttccatggatacccacgtcgaggacagggagggtggcagttgagccccgagccctggagccagcctgacttgttggaatcctagcttccccgctccctagctgtataacctcaaccagattatttggtctgtccgggccagtgtctttagctacaaaattggtgtagttcctacctcaaagggcagttaggaaaattaaatgaattatttcatgaaaaatgtttagaacagtgcctgccttgtataggtatataataaaaatagctgagtaaatgtagctattgttattcaaag

SEQ ID NO: 2834 - DNA, 601 bp, Human
gagatatctacagattatggagaatatctgactaacctgtagaggaaaagaccaacacagccacgaaccaggagagtctagtacaaccctgtttatctgactttatctgactttcactagtccaaacttacatttattaacccaaatccttcacgctgcaaggatgggttcaactctcccaccctaactctgtagacttactggaaggaagctgctgggcctgtaagtgcttgagggtttcacaggtctgtccaggtgtagatgcatatgtgtatgtatctggattaatcccaaattcagktttttttcatcttgaagtgaccggtgggcaagggaagtggggcccaagaacgatggaagtttaagacattcttatttgatctttcctttagcagcttggtaggtgggtaagataagcccactcccatttggatattcctccaagatttctaagaggtattctgctgttcgaaatttttgtttctgaaattatcttcttaccctcagtcctttgctttcttggactaagtatgatcttttttttgaaactgtaataaaatagccatttttcatacacctctgatgaaagtatgttgtgatc

SEQ ID NO: 2835 - DNA, 601 bp, Human
tgactaacctgtagaggaaaagaccaacacagccacgaaccaggagagtctagtacaaccctgtttatctgactttatctgactttcactagtccaaacttacatttattaacccaaatccttcacgctgcaaggatgggttcaactctcccaccctaactctgtagacttactggaaggaagctgctgggcctgtaagtgcttgagggtttcacaggtctgtccaggtgtagatgcatatgtgtatgtatctggattaatcccaaattcaggtttttttcatcttgaagtgaccggtggscaagggaagtggggcccaagaacgatggaagtttaagacattcttatttgatctttcctttagcagcttggtaggtgggtaagataagcccactcccatttggatattcctccaagatttctaagaggtattctgctgttcgaaatttttgtttctgaaattatcttcttaccctcagtcctttgctttcttggactaagtatgatcttttttttgaaactgtaataaaatagccatttttcatacacctctgatgaaagtatgttgtgatcgcttggtgtcgtgtgtgggggagagggt

SEQ ID NO: 2836 - DNA, 601 bp, Human
ttcttcagactctagactgatttgtaaaataaaatggactttatcctgtgtcaaacacccatcctgactcagtctagtaaggtccacagattctcatcaaagcttgcctttcattcatacaagatgttataaaatgctgagtactggccagagtttaaaatgtgattgcaagccaggtgtggtggtgtgatcctgtagtcccagctactcgggaggctgaggtaggaggatcacccaagctcaggagtagacgtccagccttggtaacatagcaagaccctaactctttaaaacacacacaaacacacacacacacacacacacaaacacacacaccactgctgggatacctgtgtctagctagcaaaaaaggcttgaattgaagagtttcagaaaacctgatggtgtaatctgatgtctgccagtggctggggctaactcagggttttaggcctttctgttttctgaactagtaacacacaagaagccatgcgttaaaatgcccatccttaactcataagcaataatagtgaacctatcacctggaggtgggtgtagggacttcttccctcaactgccctaggcccctccagcatgctcc

SEQ ID NO: 2837 - DNA, 601 bp, Human
ttcagactctagactgatttgtaaaataaaatggactttatcctgtgtcaaacacccatcctgactcagtctagtaaggtccacagattctcatcaaagcttgcctttcattcatacaagatgttataaaatgctgagtactggccagagtttaaaatgtgattgcaagccaggtgtggtggtgtgatcctgtagtcccagctactcgggaggctgaggtaggaggatcacccaagctcaggagtagacgtccagccttggtaacatagcaagaccctaactctttaaaacacacacaaacacacacacacacacacacacaaacacacacaccactgctgggatacctgtgtctagctagcaaaaaaggcttgaattgaagagtttcagaaaacctgatggtgtaatctgatgtctgccagtggctggggctaactcagggttttaggcctttctgttttctgaactagtaacacacaagaagccatgcgttaaaatgcccatccttaactcataagcaataatagtgaacctatcacctggaggtgggtgtagggacttcttccctcaactgccctaggcccctccagcatgctccaca

SEQ ID NO: 2838 - DNA, 601 bp, Human
acatcctgagaaggtgagggacatggggtcaagacctgattctggctgattgaggagcatctgtcttcacccctctcagattcctcctctacttcctcaccagcctcatgggatgagtatcaccaagatgcttttgaactctcaagatgcttttgaactgcctgggtgggccaggcagtggctcatgcctgtaatgcaagcactttgggaggccaaggtgggaggattgcttgaggtcaggagttcgagaccagactgggcaacatagcaagacctacaaaaaatttaaaaatagtgcagyatggtgacatgtgcctttggtcccagctactcagggagctgagatgggaggatcgcttgagttcaggaggttgaggttgcagtgagttgtgttcgtgccattgcactccagcttggacaacacagcaagactgtctaaaaaaaaaaaaagacatttgggcagttggggaagtcaagtggaggcacatgcattgaggcagtgagggtgatattttctgtgtgcatctgccaggcactccatggtcacccattcctcctcttcctcatctggtcagttcatcttggaatctgcccagagaac

SEQ ID NO: 2839 - DNA, 601 bp, Human
actctcaagatgcttttgaactgcctgggtgggccaggcagtggctcatgcctgtaatgcaagcactttgggaggccaaggtgggaggattgcttgaggtcaggagttcgagaccagactgggcaacatagcaagacctacaaaaaatttaaaaatagtgcagtatggtgacatgtgcctttggtcccagctactcagggagctgagatgggaggatcgcttgagttcaggaggttgaggttgcagtgagttgtgttcgtgccattgcactccagcttggacaacacagcaagactgtctaaaaaaaaaaaaagacatttgggcagttggggaagtcaagtggaggcacatgcattgaggcagtgagggtgatattttctgtgtgcatctgccaggcactccatggtcacccattcctcctcttcctcatctggtcagttcatcttggaatctgcccagagaactcagaagagcaatagactggctggctggttgcagttacttcctacaagatgttcctttaccatccttgctcctaaacaggggcttcccattctcatgaaggtggaattggggccaggggcagtggctcacacctata

SEQ ID NO: 2840 - DNA, 601 bp, Human
ggacaacacagcaagactgtctaaaaaaaaaaaaagacatttgggcagttggggaagtcaagtggaggcacatgcattgaggcagtgagggtgatattttctgtgtgcatctgccaggcactccatggtcacccattcctcctcttcctcatctggtcagttcatcttggaatctgcccagagaactcagaagagcaatagactggctggctggttgcagttacttcctacaagatgttcctttaccatccttgctcctaaacaggggcttcccattctcatgaaggtggaattggggccrggggcagtggctcacacctatagtccaagctacttgggaggctgaggtggggggatcacttgagtccaggagtttgaggctgcagtgagctgtgattgtgccactgcactgtagcctgggtaatagagggagaccttgtctctttaaaaaaagaaaaagatgtaaatgagcatgggcttttctaggaggatggttctgtggcaaggccggcccttctgggagctcatctaatccattgcctgcagaccgaccccactcatagcaaattcaagtcctgagccattatccgcgaaccccata

SEQ ID NO: 2841 - DNA, 601 bp, Human
ctttaaagagagtgtagtggaggggattcttgcttgaagtttttcctcagaggtttgcctcctgcttgtgcagtttttacacgtcagaatgcagaaattggccaggtgcggtggcccacgcctgtcatctcagtactttgggaggctgaggtgggaagatcgcttgagcctgggagattgaggctgcagcgagctgtgcactgcacgtttgcaccactccactccaacctgggcagcagagtgagactccgtctcaaaaaaaaaaaaaaaagaaaaagaaaaagatgccatggtgttgtaraaagtggtcgggccagaagtccaggaaccaagttctgctgctggctatgcttgttttttgcagcttagcctctctaggcttcagccctcacccagtcacttaccaagagttgttctaagaaccaacgtgctttcaggagtaaacaccactacagagaggtggcgtgtccactcacttttaggagcacagatgttcgttgtgtttccctaagaagagaattggtacttgtcatcattctgccatctgcaaaagctggattcccctgcccctgcttttctttattaaatataattttatttt

SEQ ID NO: 2842 - DNA, 601 bp, Human
attctatccagaaccccatgttacatttagttgtgattttatcctggtctcttgcagtctgtatcggttctgtagtctcacttgtttttcatgatgccttcttaaagagtattgacctgttttttggtcagactccccttaatttggatttctctagtgttttctcatgagtggattgaggttatatgtttttggcaagagcagcacagaatgatgctgccacatcccacacagccgcctccctgctgcacacacacacaggtccacagcctggcaaaacacttgtaaaactgtgctgacrccagcagtatgtaagtgtaggattttatattcgaccattatttaacacactcctcttgatttagctacatttctagtatttgattctcaaagcatattattcttagaatttctcatactaatctttttctgagaaagccagaaaacttctaagatattctttttaaaaaaggtttttattattcaaagggcttgaacaattactttttgggggccaactctgtagtgagttaaaatgaagctattgagaggatagtgatggttttcattgaatagcttcagtttttagaagcggcgtctt

SEQ ID NO: 2843 - DNA, 601 bp, Human
cttccttgcttggaatctgctctcttctccctttatcctactttgcagaacttctgaagtagctttaagccgctgtctggctctgtgaccctgggagagccacttgctttgttaaacatcgattttcctgtctgtaaagtgaagggacaggaccctttcagctgacacattctgtgaaataagattttatttttacattttgataaagcatattaggggctttatagtaggatgtgatttaaggaatttgcttattctaattgagacacaatggtggggagtgggggtcggggactacacaggtgcattttctgaacatttataaaatgaaaaagatggaggcttggctagaatggttaatccccttttcattcctctaattctatgacaatttttcttaaaaaaccaaacacaaccaaaataagagtggacagttgagaattacctttaggttcccatgaccctgaagactgtatttggccttggatccattaaaaaaaaaaaaagaataccgactgggtgcagtgactcatgcctgtaatcccggcactttggaagactgaggcgggcggatcacttgaggtcaggagttcaagaccag

SEQ ID NO: 2844 - DNA, 601 bp, Human
cttttggcattctaatccattttggtaagctagtggttgttgatatgttgccagattggtttggataattagaaactcattgataattcttcatttttagctacttgtggttgagggcacttcttgttgcaaaactttattcttaaatgaataaaggggagtgaaaccaaaacaggagcattgagagtggtgtgagattctacagaaatggagtaagatggtgacatagaccagctcaccccatccattagacagatgtggaatgcaacgtctaaagacaggaaagtacttgttttccctyatcaccagcgatttctgacaaggctgtggtgacaacttgcctcaagcctccgacttctccctaccccagattgtcccccatggggggagatattggtcttcatttttactgcctttgtttcttaagtctttcattcttggttcagtggtaacacttaagccatgtgatagagataggaggagacagaagcattttctgtgaagtggctttcaagagtatcgagactgtagtcccacaaggtccatcagacagggtgcttctggccacctaatacatgagctttcatgactgtcttcccta

SEQ ID NO: 2845 - DNA, 601 bp, Human
ttcttaagtctttcattcttggttcagtggtaacacttaagccatgtgatagagataggaggagacagaagcattttctgtgaagtggctttcaagagtatcgagactgtagtcccacaaggtccatcagacagggtgcttctggccacctaatacatgagctttcatgactgtcttccctagaaagcagttcttgaattctctcctgggatagctggatgttgacagtaaacagtaagtagatagtgattggcattgattttaatgttgaatttaaaagtttacatgtagggaatttaaygtcaagagcaatagtcttgacagaaaatcaatagttgtggaccatgttcctctcaaggggccatcagtcttattgatgacttcgaatccagtgtgtctgaacttcgaatgcattttgaactctcttgtcaaacctttccagtctttctaggaattcctttatggtcttgaaagacagagttgggagaaactacagtggatcctggcagcctagttagtaacatccttagttacttacagtttaaaactaagctagactcacttaaaatgtaaaactaaggaactccaaacagtgccttcc

SEQ ID NO: 2846 - DNA, 601 bp, Human
ccctgctttccctgagctctggctggtcctctgtggttcacaggaggtggacatctccccacggctcccccaatccattttttgtatgctaggagtgtggtcatggtgtcgtggctctaaaccttattccttagcccttcagttaagcagtacgtagggtgtcaggtgttagtattcattggcaaagcttggaaatttcaaggcttctttctttcttttcttttcttttttctttctttctttccttcctttcttttcttttccttttccttttctttttttgacagggtctcactccatracccaggctggagtccagtagcacaatcttagctcactgcaacctctgcctcctgggttcaagcaatcctcccacctcagcctcctcagtagctgagactacaggcaagtgctaccacgcctggctaagttttgcatttttggtagagatggtctttcgccatgtccaggctggtctcgaactcctggacccaagtgatcctcctgctttggcctcccaaaatgctgggattacaggtgtgagccactgcgcttggcctcaagccttttaaaagtatccagattgttttattttgcttag

SEQ ID NO: 2847 - DNA, 601 bp, Human
ctcccacctcagcctcctcagtagctgagactacaggcaagtgctaccacgcctggctaagttttgcatttttggtagagatggtctttcgccatgtccaggctggtctcgaactcctggacccaagtgatcctcctgctttggcctcccaaaatgctgggattacaggtgtgagccactgcgcttggcctcaagccttttaaaagtatccagattgttttattttgcttagacaatcaggtactgggatgaaggatttcctgaagtctttttacctctttatcttatctctttctctgcgtgtgtgtgtgtgtgtgtgtgtgtgtgtgtgtgtgtgtatttagaattatgtctgacacaccgttaagaaccataaagtattagttatcattgttatctcctttaacaaaatcctttcagaaaaatggtccccatgtgctagcatgtgaacccccagggaggccatgcatggtctgtctggttgtctgttcttacgaacctttccaattcagagttgcatgccatgcagggcctcggctgacttgcttattgaagtatgttttattgtatagtgagtgttcattaggccccttggtgcctt

SEQ ID NO: 2848 - DNA, 601 bp, Human
tctgcttaacacaaactaggaggcatcagggtggttggcccctggctcatagagggggccacagtgatttttgtcactcaacttgggaaaaccattgtgctcacctggggacagtgtcctgcttggattgtatgctgcctggctataaaccaggcgctctgacattggggttcagtcctggatctgacaccagctgcctgagaaacccttcacagggcattagcttcctggtgcataggtacctgtcaccttaagtggtgtgccacctgaccattctgttgtccctgggaaaattgcaacrcagcctctaggcttttgcctcctgactgatggcttgaggtcccagagccaggactgagcaaggaggtggagttggttaatgttttatgctttgggccgcctagaaaaagctttttccacgtgtcaagggccgggttgaattaggaaagctcatcatccagctattaggctaccccacataattcttctgtttttaaaaaattgcgtctgcatcctccactagcccactagcccatttcaccgtttgatgttatttgccgccaggaagttccagtgtatctaacccagacctcttgggctc

SEQ ID NO: 2849 - DNA, 601 bp, Human
attgtatgctgcctggctataaaccaggcgctctgacattggggttcagtcctggatctgacaccagctgcctgagaaacccttcacagggcattagcttcctggtgcataggtacctgtcaccttaagtggtgtgccacctgaccattctgttgtccctgggaaaattgcaacgcagcctctaggcttttgcctcctgactgatggcttgaggtcccagagccaggactgagcaaggaggtggagttggttaatgttttatgctttgggccgcctagaaaaagctttttccacgtgtcargggccgggttgaattaggaaagctcatcatccagctattaggctaccccacataattcttctgtttttaaaaaattgcgtctgcatcctccactagcccactagcccatttcaccgtttgatgttatttgccgccaggaagttccagtgtatctaacccagacctcttgggctctccttcagtcagttccctacaagagatagacccgatttcaggctgcagcagcctctcccaaagcatgtttgttaactcctttgcctgcataattttttttttttttttttgtagagatggagtctc

SEQ ID NO: 2850 - DNA, 601 bp, Human
ccagctgaggactcagtcaaacccaacccaggcagcgacatgtaagtatgggactggctattctcatttgctgagtaaaggtttgcctttgcccgagccccgggaggcaggggaataagaagttttgggtgcatccatcgttgcttctttagggaataaatcagcctatgttgggttttcttagtcactttaaccttttgggtgaccaaatagaaatttttttaggaagaagccaaaagcaggcaggtttcgcagatgctgtgcgtgtgtgcagcgggtatgtagagagcctcactcgccwctggtgggtggaagaccctggacttttcacctgtgctgtctgttctgttgagtcacttccccgtcttggtctctctgcataatcctgagccaccgagatggctggttgtggtagatatgtgattatgtagcgtccttcttgccaacgtccttgcctccttgcaaatgtggaatgtgttacttccttcaaaaaatgtttgtgtttgtgttattgttgatacacaacttgacggagaagcttttttttttttttctgggagacggagtttcactcttgttacccaggctggagtgcagtggc

SEQ ID NO: 2851 - DNA, 601 bp, Human
taggaagaagccaaaagcaggcaggtttcgcagatgctgtgcgtgtgtgcagcgggtatgtagagagcctcactcgccactggtgggtggaagaccctggacttttcacctgtgctgtctgttctgttgagtcacttccccgtcttggtctctctgcataatcctgagccaccgagatggctggttgtggtagatatgtgattatgtagcgtccttcttgccaacgtccttgcctccttgcaaatgtggaatgtgttacttccttcaaaaaatgtttgtgtttgtgttattgttgatacamaacttgacggagaagcttttttttttttttctgggagacggagtttcactcttgttacccaggctggagtgcagtggcacgatctcggctcactgcaacctctgcctcccaggttcaagcgattcttctgcctcagcctcccaagtagctgggattataggcacatgccaccacgcctggctaatttttatatttttagtagagacagagtttcaccatgttggccaggctggactcgaactcctgacctcaggtgatccactcgctgcagcctcccaaagtgctgggattacaggcgtg

SEQ ID NO: 2852 - DNA, 601 bp, Human
aatgtctttaagggtggtttcacaaataggtggtagtgtatggaccctttgtaaagggagagaatttagatttttttttccccttcaagacctcttgcccaggctggagtgcaatgatgtgatctcggctcactgcagcatccgcctcctgggttcgagtgattctcctgcctcagcctcctgagtagctgggacaggcacatgccaccacacccagctaattttttgtatctttagtagagatggggtttcaccatgttggtcaggctggtcttgaactcctgacctcgtgatctgcccmccttggcctcccaaagtgctgggattacagacatgagccactgtacctggcctagattttttttaaccattttgtgtggcatgtctttgagaaacggagattgcaggacctgtattctttctgcgttttgctgatgtaacttgatacagtgaaagagccagaacattgcgagggagtgaacagggaccatgtgcattacagtctttcaggtatcaggtatctcaggtgagcgatttagttgttgttggattaaagtcagtttatgtttgaatcctgtaacaagtgtttgtggtgtcgcat

SEQ ID NO: 2853 - DNA, 601 bp, Human
gcccatgtttgtgtaggagctgccttcggggcctccaagccctgggcagatgagtaaatacattaaaaaacaagtaaaggaagtccactttctctctatccctttcctgtggaggtcgcagtaatgattgtcccacagtgatgattgaaagtgcatgaaactggacaactgtccagtctaactgcctgtcagaagaggcatttacatcattaaatgggctgcccaccatgacactcgccaggccaggaatggagcatctccctgggtgtcacactgtgctggaggccctaagaggagaacmtgcaggaataaaatgggtcttcccttgtaggcccaccagctgcctgaggaaacagaatccagtttccctttatggacttcagtgtacagtaaatcctgaatgttccagaaactcaaaggtttctggaaacctgtgactttaagcaaaatgatgtataagaaaccagttttaccctatgccaattgatgtaaaccagagttcagttcctaccatgtatttctgatcatgagaacatcaccaaacttttgaataaaggcccagaacacttctaatattaaacattgaaatatgagcgatgca

SEQ ID NO: 2854 - DNA, 601 bp, Human
cctctgcccactcagttccgtctgggtgctgtgggagtaatggcttctcatcttaggctggcccatcttcaagggaccccagggtagacaggatctctactccctgcctccagtggcatgtccagggagctcaggctccccttctggggggccagttgttccacggggatttagggcaggtacagaaaagtcaacaactgctccagcagccatggccccttgccatagtcagctgagtgagagagcggaggtcaggagggaaccgtgcggggactccagctcgaaggggagcagccgcatktgtcctcagattgtaggcagtgctgtgttacaaatggatgcaactgatctgcccctgcctggctcttgcctgattctcaagattcaaagagtccctgggcagtgaccctcaaccttcagaattgggattgtaaaatgcatgtactctgtgaccagtgagctgctgtttcgctctccctcttgtaagttcactgggtctttccaaggcccgggacccactgtgtgtgctgcaggtgtgttgacgcacatacgtctcatggtgctactgtgaggatgtattgtgtgcattttcgcaagtcag

SEQ ID NO: 2855 - DNA, 601 bp, Human
catggccccttgccatagtcagctgagtgagagagcggaggtcaggagggaaccgtgcggggactccagctcgaaggggagcagccgcatttgtcctcagattgtaggcagtgctgtgttacaaatggatgcaactgatctgcccctgcctggctcttgcctgattctcaagattcaaagagtccctgggcagtgaccctcaaccttcagaattgggattgtaaaatgcatgtactctgtgaccagtgagctgctgtttcgctctccctcttgtaagttcactgggtctttccaaggcccrggacccactgtgtgtgctgcaggtgtgttgacgcacatacgtctcatggtgctactgtgaggatgtattgtgtgcattttcgcaagtcagacttacaagtctagagagatgaaatacttattcaagttcaaagcagcagtgtgtggtgggagtgggatttgaactcaggcttctttggcccccttttgttcctgcttctgtaggctctttggatggggcggagtctgagcatgttgccacataaaggccagaaagtagaacacaaagaggactgccatttcatttcagttcatctgatag

SEQ ID NO: 2856 - DNA, 601 bp, Human
atggggcggagtctgagcatgttgccacataaaggccagaaagtagaacacaaagaggactgccatttcatttcagttcatctgatagtgcctttcataccaggcatggtgcctacaaaaaagaggtcatagtccatgccccaaggagctcatgggcctgtcgggcagtgaggcaggcaggccttcatgtagagaatgttggaacagaggttggccagggctgcatggagggcaggggcagggccttcctgggggaggaggcgcagggcatgcggattggaaggacctgaataagaagggygtggaggtgacgagggcgacagtgaggtcagatcacagaacttaggagtgaggggagggagacaaggcagagaggcgggtgggctgagagaacatggggagttgtccccctggccagttcccaggaggtcgcagtgaagaccagtgcagccgtagaaccacatggcggccactcccgctttgtgtttcggggccagcggtgcttaccagggacatggcgcaggaaccgttaacatggccttagacaaagggaggccggacggcgggtagaagcccttcatgatttgcaaggcaattacgt

SEQ ID NO: 2857 - DNA, 601 bp, Human
aggagtgaggggagggagacaaggcagagaggcgggtgggctgagagaacatggggagttgtccccctggccagttcccaggaggtcgcagtgaagaccagtgcagccgtagaaccacatggcggccactcccgctttgtgtttcggggccagcggtgcttaccagggacatggcgcaggaaccgttaacatggccttagacaaagggaggccggacggcgggtagaagcccttcatgatttgcaaggcaattacgtttggtttcaggaatgcaagaaaggactacatcacagccaagtayatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgtaagagtgtgggttgttgctactttaaaaaaaaaaaaaaggccggccacggtggctcatgcctgggatccagtactttacttcaggaggccaaggcggaggatcctttgagctcaggagtttgagatcagcctgggcaccata

SEQ ID NO: 2858 - DNA, 601 bp, Human
cgttaacatggccttagacaaagggaggccggacggcgggtagaagcccttcatgatttgcaaggcaattacgtttggtttcaggaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgtaagagtgtgggttgttgctactttaaaaaaaaaaaaaaggccggccacggtggctcatgcctgggatccagtactttacttcaggaggccaaggcggaggatcctttgagctcaggagtttgagatcagcctgggcaccatagggaggccccatctctacaaaaaaaaaaaaaaaaaaaagtaaaattggccaggcatggtggtgtacatttgtagtcccagctactcaggaggctggggtgagaggaatcggttgagcccagaaatttgaaactccagtgagccgtgattgtgccactggactccagcctggccgacagagtga

SEQ ID NO: 2859 - DNA, 601 bp, Human
aggggcggttccctggaacccacaccccactgtgctccccctcagagggaatagagtaggagcaagacccctcctttcctgggggagctgtcttgagagggtgggcatccagctggagtgggtttgcagtaacataccagcacccaagtggggtggcatgtgtccagattctggtccacaaataccctgtagatgcacatttggtcccctggaacctcctgacctcaggactgggctggctgcctatcagcaaggatgcctcacggctgcagcatctttctcttggtaacaggcatgtccrtgcaggctctgagctggtcccactctctccccatccccagaaagaactcatgcccaccaatgcagtgtggagggtgcccagcactgagctgtgctgccgccagagggcccagcaggcagggcaggcggcctgggaagcaccttcctttgccctcacctcctgtcttctgtatctgtccttctcctctggttctctcacccacccacctgctgaaacaatccttgttcatctcttctcccccacctgccaggtgtactttcagaaaaggcagtggagttggggaatccccagtatgagttg

SEQ ID NO: 2860 - DNA, 601 bp, Human
cataccagcacccaagtggggtggcatgtgtccagattctggtccacaaataccctgtagatgcacatttggtcccctggaacctcctgacctcaggactgggctggctgcctatcagcaaggatgcctcacggctgcagcatctttctcttggtaacaggcatgtccgtgcaggctctgagctggtcccactctctccccatccccagaaagaactcatgcccaccaatgcagtgtggagggtgcccagcactgagctgtgctgccgccagagggcccagcaggcagggcaggcggcctrggaagcaccttcctttgccctcacctcctgtcttctgtatctgtccttctcctctggttctctcacccacccacctgctgaaacaatccttgttcatctcttctcccccacctgccaggtgtactttcagaaaaggcagtggagttggggaatccccagtatgagttggagacagtgcagttattagcattcgtagccttgtctgtaagtgtagaacgcaaaactttaagcctgcttaagaaacatatgtttctactcaaggagcaggtaaagagattggattgtaggtggcctggggga

SEQ ID NO: 2861 - DNA, 601 bp, Human
ctttaagcctgcttaagaaacatatgtttctactcaaggagcaggtaaagagattggattgtaggtggcctgggggaccttcctggatcctttgaacaagattcttgcttgcaggcagggatctgccttgtggtgctgatgcagggatggggacaggtcgattgagaggacttagaaatgaaactcctgaacttctcatttatttcccatggagtcaggagaaacaggacgaatctccaaattgcacgttcccaagggcaaagagcttgtgtagagattaaagagactctatgtaagagakaagtttctcgaagggaaagataaaagacttttggaagagttgtacacgatttcaccggtgttggacacagaattgaatgctcccattagaattctggaatgcctttgtttggtttttcaggagccggatgaaacggccctccaccttgcagtcagatccgtggatcgaacctctcttcacattgtagactttttagttcagaacaggtaggtgttctgaaattaagggaggcactcgttttctccttggtatttctggggaaggaatcggacgctgcctcatcgcttctgatgtgttgtc

SEQ ID NO: 2862 - DNA, 601 bp, Human
aaaggaaatggaaaattccaaaatgcaaaagccatgggatagtttgcattttgtgtcctctgctttttcctcccatttctgagcagaggagtgaagaaatggccagaaagtaggggagtgtggggtggtcaaccccaagacctgcagcttcttcctgaggaggctgagttcactggactcgtggtggaagctgccctgatgccccatctctgagtgccagcccggctcctagaacgcagcaggggtttcgtaaacatttggttgatagctgcgtgatgcctctccctccatgcacattttyagggggcaggagagggaaggtcccagtttctttttttccagagtggaaggaggacaaaagtgggggagaattctgaaaatgaaacacaccccccgctccccatgcccacaatttggtgaaaaagaaactccttttttgatattgaaaatgtaattggtttccttctcatggaagcagcaggtgccacttcctgagatcgcctttctgtctccactttgtgcaggggcacaaagctcactgcccctcctcagaatgtgacagtggccatgtttgctaggattgagggcctgtcccatgtct

SEQ ID NO: 2863 - DNA, 601 bp, Human
gctgcgtgatgcctctccctccatgcacattttcagggggcaggagagggaaggtcccagtttctttttttccagagtggaaggaggacaaaagtgggggagaattctgaaaatgaaacacaccccccgctccccatgcccacaatttggtgaaaaagaaactccttttttgatattgaaaatgtaattggtttccttctcatggaagcagcaggtgccacttcctgagatcgcctttctgtctccactttgtgcaggggcacaaagctcactgcccctcctcagaatgtgacagtggccmtgtttgctaggattgagggcctgtcccatgtctgccaagcctgagcaccttttgtgggtgacctggtcttgtgatatgttggaagaacttttgaaaatctcaagattcccctttagcctgttttcagagggtattcccagggcaaacaggccgaggagcctggggactctgggctttgggaaagtgacttttccctttcctggagggaatatcaaataatgatagagaaaagctcagcctccgtcctcccgtgggacaggatggatgagtcacacaggcatccagaggccctgcatccag

SEQ ID NO: 2864 - DNA, 601 bp, Human
tgtgcaggggcacaaagctcactgcccctcctcagaatgtgacagtggccatgtttgctaggattgagggcctgtcccatgtctgccaagcctgagcaccttttgtgggtgacctggtcttgtgatatgttggaagaacttttgaaaatctcaagattcccctttagcctgttttcagagggtattcccagggcaaacaggccgaggagcctggggactctgggctttgggaaagtgacttttccctttcctggagggaatatcaaataatgatagagaaaagctcagcctccgtcctccygtgggacaggatggatgagtcacacaggcatccagaggccctgcatccagcacagctggccggcctagcacagcagcctcggcgcagccagtgggacgtgagaaggacgctgggctctaggttcaccccggtagtgcactgccccaccttggccccacatgctcagcaacaacagggatgcccccctccccttttgacctcttctgccatcatcgtgttatttccctgatgaccttctgctaaggcttccccagccatgtaggcagggacggtgccaggtcccaccaccttggcgatgat

SEQ ID NO: 2865 - DNA, 601 bp, Human
atgaatcgctttattcaatgagttacagtttggatgtggattttaattaggtggctgcttcaacagtttttgtttttgtttttgttttttgttttttttgaggcagagtctcgctctgtcaccaaggctagagtgcagtggcacaatctcggctcactgcaacctctgcctcccaggttcaagcgattcttctgcctcagcctcctgagtagctgggaccacaggcatgtgccaccacgcctggctaatctttatatttttagtagagacggggtttcaccatgttggccaggctggtctygaactcctgacctcaaatgatccacccacctctgcctcccaaagtgctgggattacaggcgtgagccactgcgcctggccagttttagtttcttgattagttcaaacttcatcttttaaagttttaccttctgtatttagctgtagttctatacaattacaagatacattcagcctcgactaggtcaaactcactgtggatttcattaaccaggcccaatttaatttagtgctgcctttctgttccttttaaaaattgtcctggatgtcaggcctttgctgggttttgccttaacgcctc

SEQ ID NO: 2866 - DNA, 601 bp, Human
acctctgcctcccaaagtgctgggattacaggcgtgagccactgcgcctggccagttttagtttcttgattagttcaaacttcatcttttaaagttttaccttctgtatttagctgtagttctatacaattacaagatacattcagcctcgactaggtcaaactcactgtggatttcattaaccaggcccaatttaatttagtgctgcctttctgttccttttaaaaattgtcctggatgtcaggcctttgctgggttttgccttaacgcctcctttgctcgcccttgaattttagcaaaygagtcaggagagactccgctggacattgccaagcgcctcaagcacgagcactgtgaggagctggtgagtctcccaccacaaggacggggtggggcacctgtcacgggacagggagccaagcctgtcctccttgggcagggtttgctgtgaaccagtgtcctgagcagagctcagtgtttctgatgggatgagccgagaatcagcctgccttggagaaggtatgctagggagtctacagggaaacctagggggacccacccctcgcagtgagacttggggtgtgagtcagtgtttgctggt

SEQ ID NO: 2867 - DNA, 601 bp, Human
cttttaaagttttaccttctgtatttagctgtagttctatacaattacaagatacattcagcctcgactaggtcaaactcactgtggatttcattaaccaggcccaatttaatttagtgctgcctttctgttccttttaaaaattgtcctggatgtcaggcctttgctgggttttgccttaacgcctcctttgctcgcccttgaattttagcaaacgagtcaggagagactccgctggacattgccaagcgcctcaagcacgagcactgtgaggagctggtgagtctcccaccacaaggayggggtggggcacctgtcacgggacagggagccaagcctgtcctccttgggcagggtttgctgtgaaccagtgtcctgagcagagctcagtgtttctgatgggatgagccgagaatcagcctgccttggagaaggtatgctagggagtctacagggaaacctagggggacccacccctcgcagtgagacttggggtgtgagtcagtgtttgctggttggccgtgttggtaacatcactgctgtggtgggacaactggaacagaggcccgaggccaccacaagggcctgctctctggcctcc

SEQ ID NO: 2868 - DNA, 601 bp, Human
agaaaatagccacacagatcattttctacagcgtttaattctctcatcctggttgaaaaggctgggtttacagtgaatgagcacattcattctcctggggttgagctttctcccatatggagtatggatacttgcaggctgatcagcatcctttagatctcaaatatcctttgcctgttgttttggggaaaactctagccctgttttttctgtacggttacactgttgtcacaacaagcaatacagaagcagactgctgtgaccaaaggtgtggggttctcccccgaccccatacaccaaktgtagtcgcctgacaggttcttcttgcctgctgcatagattaaacccaattcatgagacagtgtgattgcagcagagaaagagtttaattatggcaagctggctgagcggtgggaggacaggaattattactcaactgtgtccccacaaaggctcagaggttagggtttttcaaggatggttggatgggcaagagggctaggaaatgggtgctgctgattggttgggagtgaaatcataagagtatgagaaacagcccttgtccactgcatatcatctcgggggggccacgggactgttt

SEQ ID NO: 2869 - DNA, 601 bp, Human
gaagcagactgctgtgaccaaaggtgtggggttctcccccgaccccatacaccaattgtagtcgcctgacaggttcttcttgcctgctgcatagattaaacccaattcatgagacagtgtgattgcagcagagaaagagtttaattatggcaagctggctgagcggtgggaggacaggaattattactcaactgtgtccccacaaaggctcagaggttagggtttttcaaggatggttggatgggcaagagggctaggaaatgggtgctgctgattggttgggagtgaaatcataagagtrtgagaaacagcccttgtccactgcatatcatctcgggggggccacgggactgtttgagtcatgagtcaggttcagtggagtcagttggtcaccaggatgcaaaagtctgaaaaaatatctcaaaagatcagtcttaggatatgttatctataggatcaattggggaagtcacaagtatcgtggcctctggtgcagtaaacaatttttttaaaaaaagacagtgtctctctgttgcccaggttggagtgcaatggcgtgcttgtggacagcctcaaactcctgagctcaagcgatcctctc

SEQ ID NO: 2870 - DNA, 601 bp, Human
atcttgaggcctttcattagtcttccaaaggcactttcaagttccctaacaagaacagagtcagttttcacatgcacacgtatgtttattgcggcactattcacaatagcagagagacttggaaccaacccaaatgtctgtcagtgatagactggattaagaaaatgtggcacatatacaccgtgcaatactgtgcagccataaaaaaggatgagttcatgtcctttgtagggacatgaatgaaactggaaaccatcattctgagcaaattattgcaaggacagaaaaccaaacaccgcaygttctcactcataggtgggaactgaacagtgagaacacttggacacagggcggggaacatcacaaaccggggcctgtcatggggtggggagacgggggagggatagcatcaggagatatacttaatgtaaatgatgagttaatgggtgcagcacaccaacatggcacatttgtacgtatgtaacaaatctgcacgttgtgcacatgtaccctagaacttaaagtataataaaaaaataaattaattaaaaagaaaagaacagagtcagttttagggagggactattaccatccttgattc

SEQ ID NO: 2871 - DNA, 601 bp, Human
tgggtgcagcacaccaacatggcacatttgtacgtatgtaacaaatctgcacgttgtgcacatgtaccctagaacttaaagtataataaaaaaataaattaattaaaaagaaaagaacagagtcagttttagggagggactattaccatccttgattcaaacttacaccacaaactaaattcttcccatggttagcttggcctgtgcccaggaataagggaggacagccagcctgtgaggccagaagcaagatggagtcagccatgctagacttttttcactaccatgttcttgtaaaggyggtttcacaagcagcagacaccagctggctgtcctccagttcaattagacactatctacttggaggtagtgttagatcccacaggctgggggctcagtccccaagactgtcttccaccccagacaccagtcacaaatcaacctccagaacttctgaccaaccggcttcaagttggggttcccacagccccctctttgggtttgaataatttgctggagtggctcatagaactcagggagacacttgtgtttactggtttattataaaggatattgcaaagcatacagatagagaggtgcg

SEQ ID NO: 2872 - DNA, 601 bp, Human
aaatcaacctccagaacttctgaccaaccggcttcaagttggggttcccacagccccctctttgggtttgaataatttgctggagtggctcatagaactcagggagacacttgtgtttactggtttattataaaggatattgcaaagcatacagatagagaggtgcgtagggcaaggtgtgggggaggggacatgggggttccatgccctccctgggtgccaccctccaggaccctctgtgtggtttgccatcctgaagctcgagaaccagtcctctttgatttttatggaagcttcttgrtgtcagcatctcttcccccagggtacagggtgagaccctctctggggagggccttaagacccacagtcagaaaagtgggggacgataagagtcctgccttggggcaggagaagttcagagagattctgtctcctgaggccttaacactccatgttataaccgaagactgtaacaagggatttgagagttacgagccgggaactgtggatgaaaactaatacagtttacaaagcctttgctgggacataccagctttgagtttcaaggttacgctgtgaagtaggcagaggggcgggggct

SEQ ID NO: 2873 - DNA, 601 bp, Human
accggcttcaagttggggttcccacagccccctctttgggtttgaataatttgctggagtggctcatagaactcagggagacacttgtgtttactggtttattataaaggatattgcaaagcatacagatagagaggtgcgtagggcaaggtgtgggggaggggacatgggggttccatgccctccctgggtgccaccctccaggaccctctgtgtggtttgccatcctgaagctcgagaaccagtcctctttgatttttatggaagcttcttggtgtcagcatctcttcccccagggtayagggtgagaccctctctggggagggccttaagacccacagtcagaaaagtgggggacgataagagtcctgccttggggcaggagaagttcagagagattctgtctcctgaggccttaacactccatgttataaccgaagactgtaacaagggatttgagagttacgagccgggaactgtggatgaaaactaatacagtttacaaagcctttgctgggacataccagctttgagtttcaaggttacgctgtgaagtaggcagaggggcgggggcttcacctgagacccagagatttccatg

SEQ ID NO: 2874 - DNA, 601 bp, Human
agtggctcatagaactcagggagacacttgtgtttactggtttattataaaggatattgcaaagcatacagatagagaggtgcgtagggcaaggtgtgggggaggggacatgggggttccatgccctccctgggtgccaccctccaggaccctctgtgtggtttgccatcctgaagctcgagaaccagtcctctttgatttttatggaagcttcttggtgtcagcatctcttcccccagggtacagggtgagaccctctctggggagggccttaagacccacagtcagaaaagtgggggamgataagagtcctgccttggggcaggagaagttcagagagattctgtctcctgaggccttaacactccatgttataaccgaagactgtaacaagggatttgagagttacgagccgggaactgtggatgaaaactaatacagtttacaaagcctttgctgggacataccagctttgagtttcaaggttacgctgtgaagtaggcagaggggcgggggcttcacctgagacccagagatttccatgcatttgccttggactagaaggcaggcctcctgcctgcacacttcagtgggtccagat

SEQ ID NO: 2875 - DNA, 601 bp, Human
gttcacgttgaatatgaatggcgactactccacgaagacctggatgaaagtgatgacgacatggatgagaaattgcaggtctgtgccaggttgctaaccattaagagttttgatcagcttcatccagaacagtgtgggtcctaatctgtaattaaggcagaaagctgttttatagaaatgaaaatgtagcttactttatgctttcattgatctcagtaggctcttggttttacccttcccactaccatctcctgtctcccagctcctgcacccattaatttaaaggaatggctaattatgyacttataggcagccttttgctacaaaggaaaggtgtgtgtggcgggggggttgattccagtggatttagaggaaggtctcttgctatggagtcatgtcataaagagccagatttcccccagtctaggtgatcacattctcctggttgatcttataaaaacatcaactgaaatcatcagacgacctttagagctcactgggtccaaccccttcctttatcagtttgggatattgaagcctcaagagaaaagttgacttggccaaagtgaagcagctatttagaggcaggcttgggactgca

SEQ ID NO: 2876 - DNA, 601 bp, Human
tgaaagtgatgacgacatggatgagaaattgcaggtctgtgccaggttgctaaccattaagagttttgatcagcttcatccagaacagtgtgggtcctaatctgtaattaaggcagaaagctgttttatagaaatgaaaatgtagcttactttatgctttcattgatctcagtaggctcttggttttacccttcccactaccatctcctgtctcccagctcctgcacccattaatttaaaggaatggctaattatgtacttataggcagccttttgctacaaaggaaaggtgtgtgtggcsggggggttgattccagtggatttagaggaaggtctcttgctatggagtcatgtcataaagagccagatttcccccagtctaggtgatcacattctcctggttgatcttataaaaacatcaactgaaatcatcagacgacctttagagctcactgggtccaaccccttcctttatcagtttgggatattgaagcctcaagagaaaagttgacttggccaaagtgaagcagctatttagaggcaggcttgggactgcacgaaggctcttgcctcctcctccagctcccttcttaccatcctc

SEQ ID NO: 2877 - DNA, 601 bp, Human
gtgtttactagtcagttcttacactgctgtaaagaaatacctgagactgggtagtttataaaagaaagaggtctaattcactcacacctccacatggctgggaaacatacaatcatggcagaaggggaagcaggcacctcttcacagggtggcaggagagagagcaagcgagagcagggaaaactgccttataaaaccattaggtcttgtgagaactcactatcccaagaacagcagaggggaaccgctgccatgatccagtcacctccttccctcgacaagtgaagattacaattcgagrtgagatttgggtggggacacaaagccaaaccatatcagtgtgtgtttccttcacgagacacaaggaggagtgaattttcactcttgcagctctcacgcaacttgtagctctcaggcaacagttgagagctcaaatggtaccaggcccagcagagttggtgtcagtgaggttttcacccctgtgttgaatgttatcaccaggagcagttcatatttgtctcacacgcctctgccccaatgttctcctgcagcccagtcccaaccggcgggaagaccggcccatcagcttctaccagctggg

SEQ ID NO: 2878 - DNA, 601 bp, Human
ggaggagtgaattttcactcttgcagctctcacgcaacttgtagctctcaggcaacagttgagagctcaaatggtaccaggcccagcagagttggtgtcagtgaggttttcacccctgtgttgaatgttatcaccaggagcagttcatatttgtctcacacgcctctgccccaatgttctcctgcagcccagtcccaaccggcgggaagaccggcccatcagcttctaccagctgggctccaaccagcttcagtctaacgctgtatctttggccagagatgctgcaaaccttgccaaggasaagcagagggctttcatgcccagcatcttgcagaatgagacttacggagccctcctgagtggcagcccacctcccgcccagcctgcagcccccagcaccaccagcgcccccccgcttcctccacggaatgttggcaaaggtatgaagctgtccgtcatccctgtgaatatatagagggtcttgttttgtggtttgggaagtttgcagctgccctgcctccaactcagtgacctttgggctcttttgttttgtagttattttctgtttgcttcctaaagggattccatcattcttatcagg

SEQ ID NO: 2879 - DNA, 601 bp, Human
tgggctttgtagatctggatggcggggggtgctctctggagccacacagctgccagcacagacacgtgccaagtgccccgtgttgtatggctccctgtggctcttgtgcagggctctcagctcccccagcctccttcgtcacagctgcaaacccctgcctgtccccacactgcaccaccaagtagcttcctcactcccttcctctgtcttccaaagcatttcagcaacatttcctcctttacacagtaccccagggtttctttttcctttggccatttggtgattttcaatattttggggrcagtcacttggattagaatctggctttttgtttttcttttctttttctttttttttttttttttgagacagagtctcactccatcgcccaggctggatgcaatggcacaatcttggcttgctgcaacctctgcctcccgggttcaagagatcgtcctgcctcagcctcccaggtagctgggattacaggagcctgccaccatgctcagctattttttttttttttttgtatttttagtagagatggggtttcaccatgttggccagcctggtctcgaactcctgacctcaggtgatccac

SEQ ID NO: 2880 - DNA, 601 bp, Human
gctgccagcacagacacgtgccaagtgccccgtgttgtatggctccctgtggctcttgtgcagggctctcagctcccccagcctccttcgtcacagctgcaaacccctgcctgtccccacactgcaccaccaagtagcttcctcactcccttcctctgtcttccaaagcatttcagcaacatttcctcctttacacagtaccccagggtttctttttcctttggccatttggtgattttcaatattttggggacagtcacttggattagaatctggctttttgtttttcttttctttttctttttttttttttttttgagacagagtctcactccatcgcccaggctggatgcaatggcacaatcttggcttgctgcaacctctgcctcccgggttcaagagatcgtcctgcctcagcctcccaggtagctgggattacaggagcctgccaccatgctcagctattttttttttttttttgtatttttagtagagatggggtttcaccatgttggccagcctggtctcgaactcctgacctcaggtgatccacctgcctcagcctcccagagttctgggattacaggcatgatccatggtg

SEQ ID NO: 2881 - DNA, 601 bp, Human
aaagcatttcagcaacatttcctcctttacacagtaccccagggtttctttttcctttggccatttggtgattttcaatattttggggacagtcacttggattagaatctggctttttgtttttcttttctttttctttttttttttttttttgagacagagtctcactccatcgcccaggctggatgcaatggcacaatcttggcttgctgcaacctctgcctcccgggttcaagagatcgtcctgcctcagcctcccaggtagctgggattacaggagcctgccaccatgctcagctattttttttttttttttgtatttttagtagagatggggtttcaccatgttggccagcctggtctcgaactcctgacctcaggtgatccacctgcctcagcctcccagagttctgggattacaggcatgatccatggtgcccagccttgtttttctttttaagacagggtctctctttgtcccccaggctggagtgcagtggcacaatcatggctcactgcagcctccaactcctgggttcaagggatcctcctgccttagcctcctgagtagctgggattattggtgcaagcgtattttttg

SEQ ID NO: 2882 - DNA, 601 bp, Human
tccatggacacccccttctgagcaggcctgattattccccagggtggcttcctcccctgttagggtgcagtttccacagcactcatgagggcctgaaatgacactccttcattttgaggtcttgagtttctaggtcatcaccccccattgctggattagtggaatcgggtgtctggagagagctgacctagagcgcagagccccaggcctgagtctggtcctgaaacaagctgtggccgcccaggcgtccagcagggtgtgggagcaagatgagtgccggccacctaagaattcagacttrgccactcaggggctggtggcttggggcaggttgcttttatctttaagcattagtgggatcatctgtgacagggaggtcacacacacacagtctggtgcaggtgatcttgtgagcacccactaagcggcagctgcagacagtgagggcggtggatgaaccggcttgaatggggcgcggacagaaagccccaggctgagcccaccacacagtagacgcaagtggcacagctccgcaactgagctcagagcagacagttcagctgggaactcacaggatttaggggaacttctttgtcgagtg

SEQ ID NO: 2883 - DNA, 601 bp, Human
ccactcaggggctggtggcttggggcaggttgcttttatctttaagcattagtgggatcatctgtgacagggaggtcacacacacacagtctggtgcaggtgatcttgtgagcacccactaagcggcagctgcagacagtgagggcggtggatgaaccggcttgaatggggcgcggacagaaagccccaggctgagcccaccacacagtagacgcaagtggcacagctccgcaactgagctcagagcagacagttcagctgggaactcacaggatttaggggaacttctttgtcgagtgcraggagtttggacactgtctttagtcactgtccctcccagaactcccactagtgtttaaactgcatgtcttcagcctccagaggcgctgtgagctctcagggccaggcagcactgccttcatttggcagagctgggttcaccggtctttcctgtggcctcgtttgcccttaatggattgaaagtgtctgtggcctgggcgcggtggctcacgcccataatcccagcactttgggaggccgaggcaggcggaacacttgaggtcaggagttcgagaccagcctggccaacatggttctctac

SEQ ID NO: 2884 - DNA, 601 bp, Human
agggaacataagtggatagagtgaagccttccacaagtacttaactcattgaaatggggccaacttatacctttgccactttaggtgacgttgcagctcacaaacttgtgacactcagttcattcattcattcattcattgaaaaatggcaagtgggaagtagtggtcagacagctgacctgtgtgcctcccaagaacaggtgggggtggccatccccacgagcgaacatctgggacatggctgggaagagctccttacacgggagaggcctgcactatttgaaatgtggtgaggaaaaamggacaaaaatcatttggatgttttacctaagtaattccttgtcggaagagtcttctgaaccaatcttgcttttcttcaccaaacgctctatgtaatgctcttcaaagtttccaccaacatttggaattttaataacaacctacacttttctccatttcagattggccacattgatggagatcctggtcgcaaaggcgcattcccggtgtcatttgtgcactttatcgctgactgaattgctactgaacaaaagcattaacagttatgttcctgtttcgttattggtaccaaaactcttgc

SEQ ID NO: 2885 - DNA, 601 bp, Human
tgatatattccgaagatgtagccttgggaattttcatagatctttcctcccccagaggtcacacacacacaaaagcatcacgtcttgttttacaaacataagttgaggctggatcttctgaaaacaaaatggaaacattggtgtcgagttggagtgcttgcagtggaccgtgatgcgctctgattccttcttcacagttattggagggtggtgaagagaggatggagacaccccaggaagaccacctcaggggacagcactatcatcagaaggggcaaaatggttctttcgacgcccccartgaaaggccctattccctgaagatccgaaacactaccagctgcaactcggggacatacaggtgcactctgcaggacccggatgggcagagaaacctaagtggcaaggtgatcttgagagtgacaggtgaggtgacctgctgcacttgttttcttcttgaacaatgcatgtgtacttcctttaggtcctaaaatcgttcctctcttttggagtgtagctctagagctttggatcacatctgtggctgaaagtggaaatccgctgcaagcatgtcaccattttctctttctgtggcttaaat

SEQ ID NO: 2886 - DNA, 601 bp, Human
tttggcaatatcagggcagctcccctgcttcctttcatagtccctgaaacctcctgaggtgaggacacaccacagtctacccaacagtgatgaagttaagataatttctggattaacaagtggtggttcatctggtaggaggacaaaataagccaggaaaggcttgacatccgaagtgcaggcagacaggccgcaggataagcctggaccagctgtctggctcagccgccttggtccttggtccttgaccctctctgagcctcggctctttcatctgtaaaatgggactactcaggcctgytctgaagattcggaaagatgccatgtgagagtcgcatgcagccagacacagagcgacagtgcgcgccggctgctgctgtcaccttcactgtcactgttactgtcgttcatcctgatggtgggaagaggagacaagcaggactccaggaccaaggaacaaagcattcttagctttttttcatggtagaaaaatcctgttaaaatggcttcacatgtcgcttacttttttaaaggatgccctgcacagcgtaaagaagagacttttaagaaatacagagcggagattgtcctgctgctggct

SEQ ID NO: 2887 - DNA, 601 bp, Human
gtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgyccacttgtcccactatctgggtgcatgatcttgagcaagttccttctggtgtctgctttctccattgtaaaccacaaggctgttgcatgggctaatgaagatcatatacgtgaaaattctttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaa

SEQ ID NO: 2888 - DNA, 601 bp, Human
cttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattmtttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagc

SEQ ID NO: 2889 - DNA, 601 bp, Human
cacatacctgtggccctagctacttgggaggctgaggtgggagaatcgcttgaacctgggaggtggaggttgcagtgagccaagattgagccactgcactccagcctgggtgacagagtgagattccatctaaaaaaacaaacaaacaaacaaaactcttgctttagagagactggatggagccagtgcagggacccgaatggctgggatgattggggaactaaaccaagctgcatttggtgtgaccaggactatggctgaagaattaaaagaaaagaatacagcattcagcacaaagagsttgcttaataaacattgattgagttgaattgtgctcatgtctctaggtacatatgatagtgtgaggttaagagtcagacctagggcctgcaggggaagttactgggaccacttgctgggtgacggatgcctgccagactggcttggcgggtgttgatggataggtgcactggtgggatcctttgggggctggtgtgtttttgttgtttggttaagttgtctgagtgtgattctcaagtgtatgtgctttgtgtatttgaattctatgtttgctatgtatataggaggaaactgggtttac

SEQ ID NO: 2890 - DNA, 601 bp, Human
tgatatttttaaagaaagtcaataccatcgaggaatttttggtgttttgaaagcatgattctaatgttagtatgtcagtgccaagctttgtactcatcagccaacaagaatatgagctactattcaaaagtagctaaccctctacccattaaaagagagagcaagagggcagtcctcacaggtgtttttcggagggtggatgatatgtacttgaaaaaacccagagagaatatatttatagtaagatgcttaagcttatggccccagtgcatagccatttgagttgatctctgccagtcaygccttctacctgaaaaatacctttgaaatctccacactatttctttcacttttctcagaaagtagtatgtcttagactgtttggcgtgttgtagcaaaagtaccataaactggggcgggtgggggaggggggcttataaacaacagaaatttagttttggaggctgggaagtctaagatcaaggcactggcagtttggtgtcagtgagggcctgttcctcatagcaccttctaactgtgtcctcacgtggcagaaggggctagcgagcttcctggactcttttacaagggcattaatccc

SEQ ID NO: 2891 - DNA, 601 bp, Human
aaagaaagtcaataccatcgaggaatttttggtgttttgaaagcatgattctaatgttagtatgtcagtgccaagctttgtactcatcagccaacaagaatatgagctactattcaaaagtagctaaccctctacccattaaaagagagagcaagagggcagtcctcacaggtgtttttcggagggtggatgatatgtacttgaaaaaacccagagagaatatatttatagtaagatgcttaagcttatggccccagtgcatagccatttgagttgatctctgccagtcatgccttctacstgaaaaatacctttgaaatctccacactatttctttcacttttctcagaaagtagtatgtcttagactgtttggcgtgttgtagcaaaagtaccataaactggggcgggtgggggaggggggcttataaacaacagaaatttagttttggaggctgggaagtctaagatcaaggcactggcagtttggtgtcagtgagggcctgttcctcatagcaccttctaactgtgtcctcacgtggcagaaggggctagcgagcttcctggactcttttacaagggcattaatcccattcatgaga

SEQ ID NO: 2892 - DNA, 601 bp, Human
tgagggcctgttcctcatagcaccttctaactgtgtcctcacgtggcagaaggggctagcgagcttcctggactcttttacaagggcattaatcccattcatgagagcacagccctcatgacctaattgcttcctaaatgccccatctcctaataccatcaccttggaaattaggtttctgcgtgtgagttttaggaagacacagacgttgagactataacacagcaccctccctgtcatccctctactaggacattacttcattcatcctccttgctggcttcacccattctccatcccwccccttcctaccgctcctcacctagctactctttctagctgccatcctaatcttcatttttccttctccatgaaactcctggaagtaggttccacttcctgcagtcacttcttaccctgaaaactgctgcttccactctattgaaatcccttttacaaagatcttcatggacatcctcctcatcgagctaacaggagtctcctctgccttcagagtccccaacctcttggcagcctttggcagtgctgacaagccctttcctcttagaatgttcttcccttgatttccagccgctgtgtc

SEQ ID NO: 2893 - DNA, 601 bp, Human
tgaaatcccttttacaaagatcttcatggacatcctcctcatcgagctaacaggagtctcctctgccttcagagtccccaacctcttggcagcctttggcagtgctgacaagccctttcctcttagaatgttcttcccttgatttccagccgctgtgtcctagttgccctccatctaactcttccctctgtaagttttgttccttatcccatcccctaaagagagaaattccctagtaatctctccttagtcctcttccttctgttccccaatacttcccaacacttgtatgtaactgacstaatctacatctaacagttcagaactctccctagttacaaacagacatttacaggagccaacaagaaacaatggggacagccatggatttggcatttgcagatctattaatatgttcaagtctggctcaaatcctaggagtttttacataactaaatatgggaatatcacagggtttttgaaaggattcgattacaaatattttcaaagggttaaagtctatttaaccctttgaaaatatgtataatttatatgtaaatataaatatctatatttaaatatttcaaaatgtttgctggat

SEQ ID NO: 2894 - DNA, 601 bp, Human
cagcccgcagtgtgccccatcagatcacaaacaccatgcaatcactttcctgactttcatgataaccacttcctagtttgcttttttttttttctttttgagatggagttgcccgggctggagtacagtgacgcaatctcggctcactgcaacctctacctcctgagttcaagcgattttcttgcctcagcctctggaatagctaggattacaggcaccttgccaccatgcctggctaattttgtatttttagtagagacagggtttcaccatgttggccaggctggtcttaaactcctgscctcaagtgatctgcccaccttggcctcccaaagtgctaggattacaggcatgagccacctcgcctggtcatttcctgcctttttgctaatgatttcagccctttatgtgtgcatcactaaataatacagtgtggtttcacctgtttttaaactttataaacagtacgatcattctgtatatagtcacaaggattcagaagtgtttttgtatcttgctttgaacatagtcattcatgttattgcaaatagttgtaattgttgatttttgtttctatataacattccactttatgactgta

SEQ ID NO: 2895 - DNA, 601 bp, Human
tgacgcaatctcggctcactgcaacctctacctcctgagttcaagcgattttcttgcctcagcctctggaatagctaggattacaggcaccttgccaccatgcctggctaattttgtatttttagtagagacagggtttcaccatgttggccaggctggtcttaaactcctgccctcaagtgatctgcccaccttggcctcccaaagtgctaggattacaggcatgagccacctcgcctggtcatttcctgcctttttgctaatgatttcagccctttatgtgtgcatcactaaataatayagtgtggtttcacctgtttttaaactttataaacagtacgatcattctgtatatagtcacaaggattcagaagtgtttttgtatcttgctttgaacatagtcattcatgttattgcaaatagttgtaattgttgatttttgtttctatataacattccactttatgactgtaccacagtttatccagcctactgttgatggacatatgggttgtctcttgtttgaagctttaatgagcagtgtagctgtgcatattctttcacacatagcttggtgcacacatttctctaagacggcatt

SEQ ID NO: 2896 - DNA, 601 bp, Human
caagcagatcacttgaggtcaggagttcgagaccagcctggccaacatggtgaaaccccgtctctactaaaaatataaaacttatccaggcgtggtggcccatgcctgtaatcctagctactcaggaggctgaggcaagagaatcacttgaacctgggaggcagaggttgcagtgagccaagattgcaccacaacactccagcctgggtgacagagcaagaccgtgtcaaaaaaaaaaaaattattactagaaatgtgtgtggttggctgactagttggttgggcattggttggtttcccrgttttagactgaacatacatatatgaaatatatgcacttgactgcatcaggtgaccacttaccttttctgtgcttttgcccttttttgtagttccctcctatcccttagaattattttcatttcatcccagattcctatactcagccttatcatgttctctgtaatgtcctttttcctttccctcactttttttttccactctggtctccttactctttgtccctgtggagtcacaaaatgcagcagaggctctgcttcttactcatcttcgtatgaactctgttcggttaactccataa

SEQ ID NO: 2897 - DNA, 601 bp, Human
cactggacaagcactgggccagtcacattattatcattcctttgtttccagttattccagataccctctctgccaccatgagttctcagactctcggtaaggaggaaggtgagccattagccctcacctgtgaggcatccaaagccacagcccaacatactcacctctctgtcacctggtacctaacacaggatggaggaggaagccaagccactgagattatttctctctccaaagattttatattggtccctgggcccttgtatacagagcggtttgcagccagtgacgtacagctcarcaaactgggacccactacattcaggctgtccatagagaggctccagtcctcagatcagggtcagctgttctgtgaggcaacggaatggattcaggatccagatgaaacttggatgttcatcaccaaaaagcagaccgatcaaaccactctgaggatccagccagcaggtaattatcttcctacgaaattcattaatacactagtattaggtagtgggtatttatgaggtatgttttaatttttgttctaatcttttgttggctctaaaaaattggctagaaagtttgatttaattttgta

SEQ ID NO: 2898 - DNA, 601 bp, Human
tgtgtgtgtgtgtgagatatgaataggttaagagtaaaaagctacactttgtcctccttcctgaggaatgaacacccgtgttatcctaccttgagaccctgccggcatttttcagttgccttctgttagtctcctactatgttgacctggtgtgggaaatagtacttagtcataattctgactcacagtaagaaatgaagaggtaattgatagtgggcagactccatcctctgcattttgctgtgatgtggtgagacgccggtccaaatggttctgaatgtctgcatgcacggaactgagraagccactcagctcacctttactttatgaaggttgggtgaccttaaacatgtttgaataatcagtgccttttgtgaagaaaaacagacatatctacaactaatataaggattcactaggctgggtttaaattcaaagtccagaaagattaattgcccaaaaaaaattttttttaatgttttaaatttttaaaaactgagctaaaaataaaggtgtccttgttgcactggctcattggagacatctccaaagatagataaattttcctttcatgttctccaatatgccatttactaggaat

SEQ ID NO: 2899 - DNA, 601 bp, Human
accctgccggcatttttcagttgccttctgttagtctcctactatgttgacctggtgtgggaaatagtacttagtcataattctgactcacagtaagaaatgaagaggtaattgatagtgggcagactccatcctctgcattttgctgtgatgtggtgagacgccggtccaaatggttctgaatgtctgcatgcacggaactgaggaagccactcagctcacctttactttatgaaggttgggtgaccttaaacatgtttgaataatcagtgccttttgtgaagaaaaacagacatatctrcaactaatataaggattcactaggctgggtttaaattcaaagtccagaaagattaattgcccaaaaaaaattttttttaatgttttaaatttttaaaaactgagctaaaaataaaggtgtccttgttgcactggctcattggagacatctccaaagatagataaattttcctttcatgttctccaatatgccatttactaggaatgaagatgcaccgatttggccttgagtggcaggccaggaagtgtgttggtgttcgttttcacactaaacatttggtctgactttctagaattaagg

SEQ ID NO: 2900 - DNA, 601 bp, Human
tgggaatcaatttctactctataaaataggaaactccaaatgtacaaatgcatggtcctagtcaaagaggtggcaactagaaaaacttgaaagtgctatattttaatctggtaaatatattagaaattctgtttcatttttctgtctagagtcaagtttacaagttagtctgatgagccgtcagccgcaggtgatgttaaccaacacctttgacctgtcctgtgtcgtgagggccggttactctgacctcaaggtgccactcactgtgacgtggcagttccagccagctagctctcacatmttccaccagcttattcgaatcacccacaatggcactattgaatgggggaatttcctatcccggttccaaaagaagacgaaagtgtcgcagtctttatttcgttcacaactcctagtccatgatgccactgaggaagagacaggagtgtatcagtgtgaagtagaagtttatgacagaaattccctatacaacaaccgccccccgagggcttctgccatctctcacccactgaggatagccgtcactttaccaggtaagtgtgacttgaaattaatccctgttttaaaaacaaacaaatag

SEQ ID NO: 2901 - DNA, 601 bp, Human
ctgaggatagccgtcactttaccaggtaagtgtgacttgaaattaatccctgttttaaaaacaaacaaatagcaatcctcccattttgggtaagttataacaataaaacataaaatactttctcccatatttgttctatctaagtaagcaccacatgatgaatgatacccaggttaacattgagttagtatgcatgggttggccatactggttgttaaaacattgaaataccttccatgctggctaattgctgctctctacccattccccattttcccctaagttcccaccacccagcaactaaagggtaccacgtggcacagcagggggcctctaggacctggctagaggggagaagaaatgttttggattagtcactgtccaggccttaccagttagtaaacatttgcagtgtctctgctagtggtagggataaggtaaattccactggaatacatccacctacttctttgtaaggtgttaatgtataagagtcagagaatttattattacaatcaaatataatccatctcatcaactgataatagagcataggagttaaaagtgagatactacctaggcaaagttctgctgtgtcatg

SEQ ID NO: 2902 - DNA, 601 bp, Human
ggacctggctagaggggagaagaaatgttttggattagtcactgtccaggccttaccagttagtaaacatttgcagtgtctctgctagtggtagggataaggtaaattccactggaatacatccacctacttctttgtaaggtgttaatgtataagagtcagagaatttattattacaatcaaatataatccatctcatcaactgataatagagcataggagttaaaagtgagatactacctaggcaaagttctgctgtgtcatgtatcttctctcttatagtttgcattctcttaggaakagtgatggagagacgttggagtcatttagatctgacagtcactggatagcagaacagctttggatgagccacttaatctgctgaagccttagttacctgatctgtaaattgttaatgtgcaatttaaatatggtgacatatataacatgccgagtacctgacacaccaagatgacgctcaaacgtggtcactgtcattattctctctgctgctgtgcaacatttttggtaatagtaatgatccccttgttcatgaattcatgcttaattaatttgtcctctctgtggtatttgcaattgc

SEQ ID NO: 2903 - DNA, 601 bp, Human
tagaatggctctttgtctacaaatggcacttggcaccatctctaagcctctgtccctgcacttgtctccctctagagtgtgagccactgagggaagatatccacagggcctggaattgtctggcacataatatagtgtgtgcttcataaatatttgttgaaggaagagtaaagggacctatgggcaacatcaataagcagttaaaaaagtagagtgggtgatgtcagcaagatgctagaagaagatttgggaacaaggattgtcactcatctttctgacaaagcagaaaagctgctggggycaaagattagttggctccatatctatacaatgttcccacagttaagtgactgcaaagacacacacagttttaatcactcatgtacaacttccttttgtttacccacgtttgaaggcagatacaactagagtttggaaattgtgaatccagaagtactctgcatagtaaacacacaaacacagcattaatagggccactttctcccaatctgatacatgaaatatgacagaagagatgcttgtgcttaaataccgaagcagtatcatgtggaagagagatactgggcttgtctgtgtgaca

SEQ ID NO: 2904 - DNA, 601 bp, Human
tttcaggttccctaaagaagatgactttgctgtctctctcaatagtaactcatttgaacaaacaaggtccacatgagattttggcatagacacttaaatatcgggagcatctgacaggtccatgtctttctgctggggttcagggagaaggtgggaggtgagcaataagctaagcttactgagggaaagggccattggagaagtaggggtgtggtcttggtgccagacaccaggaagcacaaagggaaaatcatcaataaaggtaacaatcctaagagaccagctagctttagtgacactscttaggagggacagaatgctgttgagaacatatgggaacatctaagaagtagggataggtgcatcccagcgcagcagggcttccagaggggaagtcgaagctatccgatttgttccttgaggtggtccatcattgtttttccctgttcattcctcagcagaagttttctcctgagtgccaggccaaaatgttttttctatcagcctttttcttctttccaacaattacaggaagtcccatactcatgagcacattccgtacatgttttcccagtggaattaataggctctgtagaatcgg

SEQ ID NO: 2905 - DNA, 601 bp, Human
ctgttcattcctcagcagaagttttctcctgagtgccaggccaaaatgttttttctatcagcctttttcttctttccaacaattacaggaagtcccatactcatgagcacattccgtacatgttttcccagtggaattaataggctctgtagaatcggcagtttttgcagtagaataaatagataagaactgtaaaaagtatacagtctgtgatgaaaagcgtatcttctctgaggcagatgggatccttcatagcatacatattgttaatctttgtgagatccttgtaaaacaggtatayggtttttaaaagataaacctggaaagaaaacattaaaaattgagtggccttcgtattcttcagaaaacctttgtcatgacaaactgagggttttgagggtaattaatgttgaggatttccaaggaaatccctgtaatgtaccttctgggctcctccacctggctgttccttcctggtagtcagggaggcagtgtggggtgataaaaaatcccaggggctggaatcagaccagcctaggctcaaatcacagctctactaccaataccagctatgaaatcatacgctggttacttgctgtga

SEQ ID NO: 2906 - DNA, 601 bp, Human
ggaaatccctgtaatgtaccttctgggctcctccacctggctgttccttcctggtagtcagggaggcagtgtggggtgataaaaaatcccaggggctggaatcagaccagcctaggctcaaatcacagctctactaccaataccagctatgaaatcatacgctggttacttgctgtgagcctcagctttctataaaatgaagatcacaatataaatatgtataaagtatccagtacagtgcttggcacattgtcagtgctcagcaaatgtaatctccttttccccttatgcctccaaaccygctgcacatacatatacacacaggtacacacatacctacatgtgtacatctatgtgacaaaataatgacacttgtttaataaataactatatcaggttctgaggccacaaaagtgtacatgacagagtctgttcccaccgagcttggaatccagtgggagaaatcaagtccaacataacaggtgtcatcaaagaagtatttccagtagactaggggaacaacagaggcagggctggggtgaagtgctaggtagggagatgatctgggaaggttccccagagtctggggctcatgaaaagg

SEQ ID NO: 2907 - DNA, 601 bp, Human
tcctggtcattgagaatggcaggaactgcagtctctatggtacagtggcaagagatgagaccagtgaggagggaaaggaacagatgatagatcccaaatgtgtctagagtatgaagctaagaaggaagaactttatcatgacagtgatggagtgtcattgaaaaagtttaagcaggggagtgacatgatcagattttccttttagaaagttcccacattaaaatgaattggaggtcgggcacagtggctcgtgcctgtaatcccagcactttaggaggccaaggcgggcgggtcacctgaygttgggagtttgagaccagcctgaccaacatggagaaaccctgtgtgtactaaaaatcctaaaaattagccgggcatggtggcccatgcctgtaatcccagctactcgggaggctgaggcaggagaatcgcttgaacccaggaggggaaggttgcggtgagccgagatcacgccattgcactccagcctgggcaacaagagcaaaactctgtctcaaaataaataaataaataaataaaataaaataaaataaatgaattggaggggaggtccacagtacagtgcaggtagtatatgaaa

SEQ ID NO: 2908 - DNA, 601 bp, Human
gcacgcctgtagtacttgctactcaaaaggctgagatgggaggattgcttgagtttggaggtcaaggctgcagtaagccatgatcatgccactttgctccagtctggatgacagagcaagacactgtcaaaacaaacaaacaaacaaacaaacaaagagagagagagagaaagagacagagaaagaaagaaagagaaagaaagaaaagaaagaaaaaaagagagagagaaagagaaagagagaaagggaaaggggagaagggaagataaggaagtggattcttgaaggagctgtgtgtctytaccacactgaagtatttggagatgccaagctacttacctgtgcttcccagtacctccagcaaggcctagcacatggcattcaacaaatgcttaatgaaagaatgagcaggcacgtcttcagttgggttgaaacaggatgctgtcagtgattcacttattctgggatgcacttgttatcaggttaccttaccctacttttatttcttggcaagagccaactcccacatggctgcatgtttggggttgggtagtggggaagagttggcagccccctctttatctcacacctcttttcttct

SEQ ID NO: 2909 - DNA, 601 bp, Human
tgctctcattacatttttggctttgttttgaagaccttgtactttgagcattgggcacttacttagattgatcaaaatgccaaaccttaatggtttgaatgtcactaattctaatccagatatgggtgagaggcagatggtgggaaatggtgactgtgggatgcagagcaaacactggcctcccaggagaggtgatttaacagcacaggcactaacagttgctagctgttggccacttcagcatggtaaggggcacaccttgccatcctttgatggcagattgcactaagctgggcagccgcttccccaccaagatagccaagccctctggctgttccttcatgctgaaaagcagagtagcagatttatttccacctcctgtgtagtggccccatctcgccatcattaccccaccattctagcaactgtaatacctggtgctgtggactctaacctcacaattctctgcctcccatgagtagaaaaggaagccagggcctcctaagtaatcatttcagtctttgctgaatgtcacccaggtctgaggacagggggactagagatgtaagggagagagagcctgtggaggaagatggccaag

SEQ ID NO: 2910 - DNA, 601 bp, Human
tggcagattgcactaagctgggcagcctcttccccaccaagatagccaagccctctggctgttccttcatgctgaaaagcagagtagcagatttatttccacctcctgtgtagtggccccatctcgccatcattaccccaccattctagcaactgtaatacctggtgctgtggactctaacctcacaattctctgcctcccatgagtagaaaaggaagccagggcctcctaagtaatcatttcagtctttgctgaatgtcacccaggtctgaggacagggggactagagatgtaagggagwgagagcctgtggaggaagatggccaagcctggggtccctgtgggagagatatctgtaggctccagccctgttctctgtctgttctcttgggagaaggtttcctgtgattttcttagctttctcagtagcattctagctaatatttattgcttgctgactccacaaatgctttaggcacttcgttagatgctttattatacattatctcatcacaactctagaaattgttatccctatttggttgatgaggaaactaatgattaagagaggataagtaacttatccaatgtcaataacagc

SEQ ID NO: 2911 - DNA, 601 bp, Human
tgtctgttctcttgggagaaggtttcctgtgattttcttagctttctcagtagcattctagctaatatttattgcttgctgactccacaaatgctttaggcacttcgttagatgctttattatacattatctcatcacaactctagaaattgttatccctatttggttgatgaggaaactaatgattaagagaggataagtaacttatccaatgtcaataacagcacattgaagattgaggatttgaactcagctctctttgaaacacagtaggtgctcattcactactctgcacaaatgstcacagccagtgcttataatacctggactccatggctccattcacttgcatcattgcagtctatgcttccttctagccacgggccttcaaatgtactcagataagaccgggggagaataactgtagtcaagcagggtcattggaagaggggtcagataggatgtggagcagagggatggtaaagaattcaaaacctaactttatcattgctcaccatttcaaaaaacaaaactaaatttaggatgaaggatacaaatgagatcagagaaaatccaggccatgaacctctgctgctctttg

SEQ ID NO: 2912 - DNA, 601 bp, Human
gctgactccacaaatgctttaggcacttcgttagatgctttattatacattatctcatcacaactctagaaattgttatccctatttggttgatgaggaaactaatgattaagagaggataagtaacttatccaatgtcaataacagcacattgaagattgaggatttgaactcagctctctttgaaacacagtaggtgctcattcactactctgcacaaatgctcacagccagtgcttataatacctggactccatggctccattcacttgcatcattgcagtctatgcttccttctagycacgggccttcaaatgtactcagataagaccgggggagaataactgtagtcaagcagggtcattggaagaggggtcagataggatgtggagcagagggatggtaaagaattcaaaacctaactttatcattgctcaccatttcaaaaaacaaaactaaatttaggatgaaggatacaaatgagatcagagaaaatccaggccatgaacctctgctgctctttgccagccccattcagagctgccagcctaatgttcagtgatgatctgtactttgtatagcatgatggcagccatccctg

SEQ ID NO: 2913 - DNA, 601 bp, Human
tctcatcacaactctagaaattgttatccctatttggttgatgaggaaactaatgattaagagaggataagtaacttatccaatgtcaataacagcacattgaagattgaggatttgaactcagctctctttgaaacacagtaggtgctcattcactactctgcacaaatgctcacagccagtgcttataatacctggactccatggctccattcacttgcatcattgcagtctatgcttccttctagccacgggccttcaaatgtactcagataagaccgggggagaataactgtagtcragcagggtcattggaagaggggtcagataggatgtggagcagagggatggtaaagaattcaaaacctaactttatcattgctcaccatttcaaaaaacaaaactaaatttaggatgaaggatacaaatgagatcagagaaaatccaggccatgaacctctgctgctctttgccagccccattcagagctgccagcctaatgttcagtgatgatctgtactttgtatagcatgatggcagccatccctgggttcccatgtgtggaatgtactcatgcaattgattcattcatcaggctcca

SEQ ID NO: 2914 - DNA, 601 bp, Human
agttttaagtaggtcattggaacctccagtggttggaaatcgcagggcaaggggctgttgcattagaagagcctgttccaggagctctcttcccccagtgctctgtcctgtgctcctcatgatttcaggggcccactgctatttggccccattatttttacatatacttgcctataacaataaatcccaggagtgtttgtaattgactagtacaaataagttggagatgaattactctcttgtttctcccttcgttgcagagcccacgcttccttccaggatctgctcctcggcccctttwctctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaaggtgggggctttttaattgggctaaccagggtgtgaatgaatcctggttctgtcctcaactatgtct

SEQ ID NO: 2915 - DNA, 601 bp, Human
acagtactccagtcagccccccaaggcctcgtacccctgcttccccctacacctccatatccccaccaaaaggtccatctggctcctggtgctcagccagtgccttattttctttgacctgacagcactgggtggtagggaaggtattgtctggaggagcagggttgacagtgccaccgttccctcatacgcctgcagggctggggtttggggcagcagtaggtcaagtctggttcctcaaggtctcctattctcagtagcaaaaagcagccggtgggggtggggtgtaatggcttaaagmtttcaacagctgtccccactgggcctacagtcccctcatctttgtttcaaaagccgctcaggccctgttgtagccagaattggaaatcaatcagtgccacctaaagacttgagaaaacacatctatttattatctatgtgaccaaccgagttgctttaacactcgttaatttgcatttccaaggagagcaatttagttttaattatttgatcaggcacacacgtcctctccaaacataattagttccttcctaaggggattattggtggctatgagcactcctactatggacctaccagt

SEQ ID NO: 2916 - DNA, 601 bp, Human
ttattttctttgacctgacagcactgggtggtagggaaggtattgtctggaggagcagggttgacagtgccaccgttccctcatacgcctgcagggctggggtttggggcagcagtaggtcaagtctggttcctcaaggtctcctattctcagtagcaaaaagcagccggtgggggtggggtgtaatggcttaaagctttcaacagctgtccccactgggcctacagtcccctcatctttgtttcaaaagccgctcaggccctgttgtagccagaattggaaatcaatcagtgccacctacagacttgagaaaacacatctatttattatctatgtgaccaaccgagttgctttaacactcgttaatttgcatttccaaggagagcaatttagttttaattatttgatcaggcacacacgtcctctccaaacataattagttccttcctaaggggattattggtggctatgagcactcctactatggacctaccagttccttaaactcatgtcccttcatagcctgatttaaaatactccaaatctttccttaaacatgtcagcacatttgtttcttgtcatccaggtaagggagcatatt

SEQ ID NO: 2917 - DNA, 601 bp, Human
tttccaaggagagcaatttagttttaattatttgatcaggcacacacgtcctctccaaacataattagttccttcctaaggggattattggtggctatgagcactcctactatggacctaccagttccttaaactcatgtcccttcatagcctgatttaaaatactccaaatctttccttaaacatgtcagcacatttgtttcttgtcatccaggtaagggagcatatttttacaaacaacaaagctgaaatgaagactttttttttttttttttgagatgaagtctcgctctgtcgcccrggctggagtgcagtggtgtgacctgggctcactgcaagctccgcctcccgggttcacgccatcctcctgcctcagcctcccaagtagctgggactacaggcacccgccaccatgcctggctaatttttttttgtatttttagtagagacggggtttcaccgtgttagccaggatggtctcgatctcctgacttcatgatccacccgcctcggcctcccaaagtgctgggattacaggcgtgagccaccacgcccggcagaagactcttagaaagtgtgatgaccccctgcccctattttt

SEQ ID NO: 2918 - DNA, 601 bp, Human
agactttttttttttttttttgagatgaagtctcgctctgtcgcccgggctggagtgcagtggtgtgacctgggctcactgcaagctccgcctcccgggttcacgccatcctcctgcctcagcctcccaagtagctgggactacaggcacccgccaccatgcctggctaatttttttttgtatttttagtagagacggggtttcaccgtgttagccaggatggtctcgatctcctgacttcatgatccacccgcctcggcctcccaaagtgctgggattacaggcgtgagccaccacgccyggcagaagactcttagaaagtgtgatgaccccctgcccctattttttagaaacctgtattttaattcaaagggaaagagagcagaagtgagcctgggcagagaatcttggatggactctgctgcagccctctgtgggagcactcttcaccccatccctcctctctgctcacatggacacctccttcaagcttctagctcaaacacctcttccccttttgaatccagcacagagatagcacagaggagatgtaagcagacagggagggtctcctgggaaagcagacatttaaccaacttga

SEQ ID NO: 2919 - DNA, 601 bp, Human
cacgcccggcagaagactcttagaaagtgtgatgaccccctgcccctattttttagaaacctgtattttaattcaaagggaaagagagcagaagtgagcctgggcagagaatcttggatggactctgctgcagccctctgtgggagcactcttcaccccatccctcctctctgctcacatggacacctccttcaagcttctagctcaaacacctcttccccttttgaatccagcacagagatagcacagaggagatgtaagcagacagggagggtctcctgggaaagcagacatttaaccwacttgagcaatcagcttgttttacagcttcctgccttgctgcctgtttcttcccaagccccgtgtggaatgtggtgacctagtcacctggaaccagctcctgacagaccccggcaacttctagatgaacccaagtgaactttcctcattaccatcctgaagtcactaccccagggggagctatagcttcatgaccgtaacatgtgacctgtgtgctggcaggacgactcactgcggctgcgccactgggacccctcccctacatgcaccaatgcactctctcccctctccatcaccccat

SEQ ID NO: 2920 - DNA, 601 bp, Human
tttcaccatgttggccaggctgacctcaaactcctgacctcaagtaatccgcccactctggccttgcaaagtgctgggagtacaggtgtgagccaccgcacccggcctcaatgcattttaaaagcatggtatgctgttgctaaaaccaatattaaagggtaaccatagtgataaagtatacaagtatcagtcatgattttatagtttaaattcttccacatgctaaccaaaattaaaaccaattcccaaaggcaatgagtacttacatgacgattgcccattttcctttttctgagatggwttttctgtatttcattaagagatcagtcctcctacaggcaaagtttacaacagttttcccccggacataatatctcttgtgtttaataagtaacttttggcactgaatttgaatacattgttggggatgggtagggagtggctctagctacagataaacttagactgcccaggtttccttggtacccatgtttttaaaataatatacttcttaataaataaagtttaggcttttaaagttgaatagcttcttcccacctaaaagactaaacctgcctcacttctgaattgttgagttatt

SEQ ID NO: 2921 - DNA, 601 bp, Human
gccaataccctcagctaatttttgtatttttagtggagatggggtttcaccatgttggccaggatggtttccatctcttgacctcgtgatccgcctgcttcggcctcccaaagtattgggattacaggcgtgagccactgtgcccggccgatctacttctacatgctgcttccaggtccctaatccggctctcatcagactcaattccccaccatctcctagggaagggatcagaggggtttagatcataccaggtttggctggtttggctgtgtcctcacccaaatctcatcttgaatcrtagctcccataattcccacatgttgtgggagggacttggtgggagataattgactcacaggggcagtttcccccataccgttctcacggtagtgaatgagtctcacgagatcagatgattttataaggggaaactcctttcacttggttctcattctctctttcctgctgccatataagaagtccctctgctcttcctttgtcttctgccatgcttgtgaggcctcctcagccatgtggaactgtgagtccattaaactctttttctttataaattaccccacctcgggtatgtctttat

SEQ ID NO: 2922 - DNA, 601 bp, Human
ctcaagccccatactccattgtcaaacccttctctttagcagacaacctcacctaccactcactgagcaatgtcaggttaccaggcatggatgccttcaatttctgccccaacaacacctatgaaggcatctactccagctgtcagtctcagtaccttccctccctgtcctgttcaagggaaatccttccatctgtgctttggatgtcaccctcttccaggcttctgggactagaccttgtgtcatgagtggcttccttggatcccagggcctctcttcatggccctagacctagatgctktctccctcatcccaccctggtccctggtctacctttgttttgacttcctgcagagtcccccactcttggccatgcactgacccttaggatgtaaacagcttctccattttcaacccttgatggttgatcttggccagttactcacttgatttagttcttttttcttttttttttttttgagatggagtctctctctgtcacccaggctggagtgtagtggcgcaatctcggctcactgcaacctccgactccctggttcaagcgattctcctgcttcagcctcctgagtagctaggatta

SEQ ID NO: 2923 - DNA, 601 bp, Human
tctgaactgcatgctgcaaaagggtgaattttatggtatgcaaattatatctcgataagcaaaaaattagtttaataaaacattctgtggactgacatggctcctacctattgttaatgacactgagcaatgtcttctcagtctgtccccaccccctccaggactgcagccatgtggctgaggtgccctagctaggatgtctctaaattggtggcatttggagtgagtgacaagaatatgttcaatcacagtgttccccacttactggcttggtgactttggctgtcttacttaaaatgtsaggtcatcagtttcctcagctggaaaatggatttttgtaagaacttgatgagattttgtatataaagtgcttagtccaatgcctgaaagtttaaccgtttctcaataaatgtaaaaaagaaaatctaggaaattaatccactttgccccttgacccctctgtctccttcaatgatttcacttgcttgttgttctggaactcctgatcagcaagcccagagtcaatcaatttttcccgtcctacctccaaggatacaggggaaaatcacacaaccatgtgggctggagccatgagaaacca

SEQ ID NO: 2924 - DNA, 601 bp, Human
agctctggagggtggaagtctgaaatcctggtgtcggcaggcccacagtccctccagcagccccggggcagtgtctgttccttgcccctcctggcttctgccgggaacccttagcattcttgggtttctggccatatctctctagtctctgtctccatctgcccatggccttctctgtgtgtctctgtctctcctaaggacacttgtcattagatatagggctcacccaggtaatccaggataatcacatctcaggatctttaacttaattatatctgcaaagacgctttttccaaacagycatgttcacgggttctggggggatatatttttggggagcccccattcaacccagttcaccctgagtgatggagaacaagggcgcgcctactcaatgctcataccgatctcactggctttgtgcagattttggatcccagcacattgttccaaaggaggcgatccacatgcaacgagggccaatgaggtgctgggctctgcgttgcctgctttatccctctccatgtgaggagacattgttatcctcattttgtagatgagaacacaggttgcacattcactctccctccctccctctctt

SEQ ID NO: 2925 - DNA, 601 bp, Human
atattgaaaataatagtgatctttagatgttctttttgggaatgctttaaaaaaaaagagaccaacccaaatgcccatcaatgatagactggataaagaaaatgtggcacatatacaccatggaatactatgcagccataaaaaagaatgagttcatgtcctttgcagggacatggatgaagctggaaatcattattctcagcaaactaacacaggaacagaaaagcaaacactgcatgttctcactcataagtgagagttgaacaatgagaacacatggacacagggaggggaacatcayacaccagggcctgtcagggggtcaggggcaaggggagggatagcattaggagaaatacctaatgtagataacgggttgatgggtgtagcaaaccaccatggcatatgtatacctatgtagcaaacctgaaccttctacacatgtatcccagaacttaaagtataataataataataaaaaacctaataaaaatctatgaaattttaaagctaaaaaagaaaaaaaagggcgagaaaccagattgcaaaacagtcctgagacggcccagcaacaacctggacgtcgggggaggctatgaaa

SEQ ID NO: 2926 - DNA, 601 bp, Human
gtcagtatttatcagatgacttgctgaatgaacggatgcttaaacatgtgcacagatgaatgaatgaattgatgggtgaatgaatgaatgaatggatgaatgaggaagtttgcatgtcatcacgacagaaccttgtctctgaagtggtttaagttgtatgtgatattcagatgggtctgtgtagcaaggaccaatagaaatcctccatactctgatgccacatggagtccacaactggataatcaggaaaatgaaattaatattgaaaataatagtgatctttagatgttctttttgggartgctttaaaaaaaaagagaccaacccaaatgcccatcaatgatagactggataaagaaaatgtggcacatatacaccatggaatactatgcagccataaaaaagaatgagttcatgtcctttgcagggacatggatgaagctggaaatcattattctcagcaaactaacacaggaacagaaaagcaaacactgcatgttctcactcataagtgagagttgaacaatgagaacacatggacacagggaggggaacatcacacaccagggcctgtcagggggtcaggggcaaggggagggat

SEQ ID NO: 2927 - DNA, 601 bp, Human
gaaaatccaaagtcacctttgagggcccaccagtcttttttactctcaaatactaccaagtcctgcctgtctcacctatgagacaactcttttacctgttcctcttcttcattccttctgtcactgcctaacaggtcctaagtgtttttagccttcaccccgataccaggctctgatctctgcagtccaccctgggaagctcgcatgtgttcacttcacaccatactttaaatacctttagtgattcctcttgactcctagaattacatcagaatcccttatggtggcatcgagacttccygcagtttggtgtcatgctactcttctagatccatctctgcacagagcagcccaaggcttactcacctaatctcagccacacttgttaagtttctgcttcctctgttttggcacagcacactatttacatgtatgtttctaggatcactgcagtgattatccaagactgcagtagtgacattctgagcccgacacctgggctctagggagtggccactacatggcagtgtgtgctgttacagtgtcacttactgctgtcttgctctggttggtgtgtggacctagatgatggctgccaccc

SEQ ID NO: 2928 - DNA, 601 bp, Human
actcgattttcagttctcctctctattggagtcactcctttcccaggcgactttcgccctttgactgatgactccaggatcagcgcctctagccctaatctctcctctgagttcagatcttatttccagctgcctgtagtcaacttcccacggatctcccaaggcatttcaacttccattgtagcttaaaccaaactcattttgtctatccttaaatccactcctcatcctgttcctttgtctcagtgcatggcatcacacggattagagaaaatccaaagtcacctttgagggcccaccwgtcttttttactctcaaatactaccaagtcctgcctgtctcacctatgagacaactcttttacctgttcctcttcttcattccttctgtcactgcctaacaggtcctaagtgtttttagccttcaccccgataccaggctctgatctctgcagtccaccctgggaagctcgcatgtgttcacttcacaccatactttaaatacctttagtgattcctcttgactcctagaattacatcagaatcccttatggtggcatcgagacttcccgcagtttggtgtcatgctactcttctagatc

SEQ ID NO: 2929 - DNA, 601 bp, Human
aaactcgattttcagttctcctctctattggagtcactcctttcccaggcgactttcgccctttgactgatgactccaggatcagcgcctctagccctaatctctcctctgagttcagatcttatttccagctgcctgtagtcaacttcccacggatctcccaaggcatttcaacttccattgtagcttaaaccaaactcattttgtctatccttaaatccactcctcatcctgttcctttgtctcagtgcatggcatcacacggattagagaaaatccaaagtcacctttgagggcccaycagtcttttttactctcaaatactaccaagtcctgcctgtctcacctatgagacaactcttttacctgttcctcttcttcattccttctgtcactgcctaacaggtcctaagtgtttttagccttcaccccgataccaggctctgatctctgcagtccaccctgggaagctcgcatgtgttcacttcacaccatactttaaatacctttagtgattcctcttgactcctagaattacatcagaatcccttatggtggcatcgagacttcccgcagtttggtgtcatgctactcttctaga

SEQ ID NO: 2930 - DNA, 601 bp, Human
aactatagtgaataagaaagaaggggagaatgtccttgtttgaaccaggaaccaggatcggaaagatgacacaggtatttccagtgtgcgaataagaaagacggttttaccatcaaaccccacattagatttattcaggttggactcaaatcacagctccaccctgtaccgactgcatgacattgggcaagtgatttttcttgccaagtctcagttttcccacctctaagatgagggtaatagtatacaaggctattgtgagaatgaaatgcgagaatccaagtgtgggtccagtccgcgstggtcctaagcacgcacgtgggaaacccgggacaccaggggatgtaaatgaccacgcgcctggcactgcctcacatccatgcagggtgtgcacagggaccaccctccatgaactgctcaccccagtgatcgagctcggtgggatcaaggcacagcagtcagcaatctctggagctggaggaaatgttagagactatctagtccaagctcttctttacagaagaggaagctgaggcacaatgcagcacctcttctcggttcctgcatgtacctgactgttctgcagcatttgaattctgca

SEQ ID NO: 2931 - DNA, 601 bp, Human
agtcttgattgaaaccatgaagggaggttgccccttttaactcctattacctttagattatgttatttttagaagcttttttacccctgatgctcaaagtaatacaagctcatggcagcaatttgatcagtactgaaaactatagtgaataagaaagaaggggagaatgtccttgtttgaaccaggaaccaggatcggaaagatgacacaggtatttccagtgtgcgaataagaaagacggttttaccatcaaaccccacattagatttattcaggttggactcaaatcacagctccaccytgtaccgactgcatgacattgggcaagtgatttttcttgccaagtctcagttttcccacctctaagatgagggtaatagtatacaaggctattgtgagaatgaaatgcgagaatccaagtgtgggtccagtccgcgctggtcctaagcacgcacgtgggaaacccgggacaccaggggatgtaaatgaccacgcgcctggcactgcctcacatccatgcagggtgtgcacagggaccaccctccatgaactgctcaccccagtgatcgagctcggtgggatcaaggcacagcagtcagca

SEQ ID NO: 2932 - DNA, 601 bp, Human
caatggaatgttatttggccagaaaaaggaataaattactgatagatgttataacatggatgaaccttgagaacattatgctaagtgaaagaagtcaatcatagcagatcacatgttatataattccattcgtatgaaagtccggaacaggagaatatacagaggctggaagtatactagtggctgggggtgggtgggctgcctagggggatggtagctggagtccagggctgctttttgaagtgatgaaaatgttctaaaattgactgtggtggtggttgcatgcatctgtgagtataayaaaaactgttgaattgaacactttaaatgggtgaattatatggtgcatgaattatatctcaattaaaatgttttaaaaaacaaaaaggaaaaagatggcctgttccttggcctctgggtgcttacaattgcatgaacaagattaggatataggctgaaactgttacaatattaaccccacccatacatttgttaatctcaggagagaagtcttgattgaaaccatgaagggaggttgccccttttaactcctattacctttagattatgttatttttagaagcttttttacccctgatgc

SEQ ID NO: 2933 - DNA, 601 bp, Human
acaataaaaagaatgaaagaaaagaaagaaaatgtaaagaaaaataggtgttgatagcttaataaaatggagggttttttttggtagttttctgtaacaatcgcttatgaaaaattcctgtataaagacccacttgtggaaactgattttcaaattactgatctagctacatatgtacagttagtcccaattaagtgaaaaaaagactagggtcttcatagaaaaatgaagtcaatttaagaaatgagtttaagagtattgattttacaggctattgagttaacaaagcaatttcagtttytctgaactccattaatgcttttaagtggttatttcacttttcctcctgggctgactcaataaagctataaagatattctgcgtggcctggggacatgaggaagccgagacggctgaggccatggctgggtgcaagcttgctgaccacccctggaatcaccttgccgtacgttgccttgtacttttgcttgatttgttgcctctcatctgatgtcctgcccgataagatttcaatgatggctgcttcattggtccctaaaatacaggagaaacaaacaaagccacagtgaataagaaacaa

SEQ ID NO: 2934 - DNA, 601 bp, Human
aaacccatcttcatctttctatatatctatttatacctacagtgattgaaatggtaaaagtttgaaaaatataaatgagaatacagcataataattgatattcattttgcataatgataattctaatgacattaagaaaagtttaagttgtgttcattacatattaataaagaaataagaaagcctaatgcatacttgaagacttctctctataaaattattttcaacaataaaaagaatgaaagaaaagaaagaaaatgtaaagaaaaataggtgttgatagcttaataaaatggagggttttttttggtagttttctgtaacaatcgcttatgaaaaattcctgtataaagacccacttgtggaaactgattttcaaattactgatctagctacatatgtacagttagtcccaattaagtgaaaaaaagactagggtcttcatagaaaaatgaagtcaatttaagaaatgagtttaagagtattgattttacaggctattgagttaacaaagcaatttcagtttttctgaactccattaatgcttttaagtggttatttcacttttcctcctgggctgactcaataaagctataaagat

SEQ ID NO: 2935 - DNA, 601 bp, Human
attatctctttggcagtctcagttctctgaaacacagccgagaaccagaaagtaagcaaatgattggcaaatgaagtatcacaaagttttgtgccagaacatgcccatttaagttttaacagggcccctaggctttcagtttgaatccatttactcttctttagactaaagactaaagattaagaagcattgtatccgatttttctttctttctttccttcttcctctctttctttctctctctctttcattctttcgttctttctttttctttccttccttcccttctctcccttcctcyccacctccctttctctctttttcttttcttttctttctttcctttccacagggtctctctctgtcacccaggctggagtgcagtggtgcaactacggctcactgaggcctcaacttcttgggcttaagcaaccctccagcctcagcctcctgagtagcagggactacaggcacacaccaccatgcccagctaattttttatttttggtagagatgaaggtctcaactggtctcaaactcctgggctcaagtgatcctcctgccttggcctcccaaagtgttgggattacaggtgtgagcc

SEQ ID NO: 2936 - DNA, 601 bp, Human
taatgccctaacttaaaccaaagaccttcacatagagcgacagcctgggatggctcagattggaggcccatagacaagctggcatttcaaggacacaaactatagcatagggtgggcagctccccagcagtgtggcatggtggcaaagaacacagccacagtacctttgtgaccttggaaatgtacttaatctcaccaactgtcagttttcagctctagaaaatggagacagtgctagactgacctcacagggtttttgggagaattaaatgtgacaatccttgtcaatactgagcattastgcctgacatattttaaacggtcaataaatgcttatcattaatctcccatgctgaaaaaaattttctaagaggaggcacatcaactatttttcaaatgaagctctgagctcttggcctgggagaaaaacccggaatatttttgtccaaagccctgggatctgcagtcctacaagggggctgttatattatgcctccgccccacagtggctgctccagccaacactgcatcttgtgaaggcaggtctgtggtcagtactctatggtgtggagtcatctaaaaattggaaatatattttcag

SEQ ID NO: 2937 - DNA, 601 bp, Human
tgttaagtggcagcaacaccaagactgacctctggaagactggaagagatgtcctcccacatggaccaagcacacatatgtctccccagacacctgctcagtccatggatagaatgctgggaagtagggtcccttctggggggctgcaaccatctctattgggtgtgtgatgctcccttgcgggctcagctgggactgaccttattggtcctcgtgcacaggacctcaatgaggacggactcatctgtgcccagacccttcatagccttctgcagctgccgggcggcgtactcgctgggayggtccagaagggccaacgctgtcttctcgaagtttccactcagctcactcttgagtacttcctccagctcctaccagaagacagtgagagacgtgctgggaatggcccaggaggagaggggcaggtgtctgcttgcactattgcaagtgctcatagttgacaagaaaggtgctgtggacatgaattctgccaacctgcaacctgctgagaacatgcaacctgctctcagctgcccatccacgtttccccagggctggcagagaggcagagaggagctccctgctcagggctggagacctc

SEQ ID NO: 2938 - DNA, 601 bp, Human
tgaattatttgtggaccctcttgacttgatgagtcccttggttctcctggcttctggagccagagacaaatagttctccatggggcctcaacaaatgctctcttcagcccctgcaaaggtggcatgtgccgagggacatccctctgtctgatgacagaaggacacacaacccttcagggtagtactggcagccactggggtgttcactggcatcccccagcaccactcacctctcttcctcattatagtctcttttgtaccctatgctagctgaccgccatagcccaggcagtggcacagrcatgcttgggctgcttgttgatttttcatgtcagaagagccgcaaagtcaggctgggtgggggaaagtagaattgtgcctcctgcttataaaagcatcagtttagaaaagcagaagctcgctggacacagctcttctgaaaagatcgattctgttaagtggcagcaacaccaagactgacctctggaagactggaagagatgtcctcccacatggaccaagcacacatatgtctccccagacacctgctcagtccatggatagaatgctgggaagtagggtcccttctggggggctgcaa

SEQ ID NO: 2939 - DNA, 601 bp, Human
ttttgtgtcagggcactgtttgcattttgcctgctgtctgctccaacctctgcttctatttcctgctgagaggcctcaagaatgttgggctcttctggcattttccttgctgggctgccccattctgctgtcatgtgtggttgctgaagagggaggggtctctcctgtgaattatttgtggaccctcttgacttgatgagtcccttggttctcctggcttctggagccagagacaaatagttctccatggggcctcaacaaatgctctcttcagcccctgcaaaggtggcatgtgccgagkgacatccctctgtctgatgacagaaggacacacaacccttcagggtagtactggcagccactggggtgttcactggcatcccccagcaccactcacctctcttcctcattatagtctcttttgtaccctatgctagctgaccgccatagcccaggcagtggcacagacatgcttgggctgcttgttgatttttcatgtcagaagagccgcaaagtcaggctgggtgggggaaagtagaattgtgcctcctgcttataaaagcatcagtttagaaaagcagaagctcgctggacacagctc

SEQ ID NO: 2940 - DNA, 601 bp, Human
gtgcagtggcacaatcttggctcactgcaacctccgcctcccgggttcaagcgatcctcctgcctcagcctctcaagtagctgggattacagatgcatggcgccacacctggctaatttttgtatttttagtagagacggggtttcatcatgttagccaggctggtctcaaactccgtctgacctcaagtgatcctcctgctttggtctcccaaagtgctaagattacaggcgtgaaccactgtacctggcctgaaaaatatgattaaaattaaccttttcacaaaggcaggtgctgaccrccctggcgttggctgcctccctgctgggaccttggtgcttctgagaagggtggatgctgagtgggggaagttgtgtgcctcttggcctcaactcacactcccggggggcctgtgctaaccctcctccgaagcatcatcccaacctgagactccttgaaatggaggatttttattatcttgtggggagaaaagaagtccggggatgctccagaaaaggtttgcacctgtagcctggaccctggcggcacttcaggaaaagaggctgagcagcgtgaacgtggcccagcacccaggccttct

SEQ ID NO: 2941 - DNA, 601 bp, Human
caccaccaagctggctaaaatgaaagtcagtaggtggtgattgggagaaggtggtgatggggagaaagcagtggggagcctcactgctcctgggtgggagggaagggcaggctaggtgctgggggaggctgatcacttgtgtttgtgcagctccctcccttttctccttccaacccgcaaccaggatctgcctgaacctggcacccactctctgcaggtttttcttctcatcccatcagatctatttgattgatagagaggccttgcttattggttgaagccaggaacttaaagaaactasgctgagggagaaaaagctatgatcacatgagattagaaaaatatatatgaatatattttttgagacgaagtctcgctctgtcgctcaggctggagtgcagtggcacaatcttggctcactgcaacctccgcctcccgggttcaagcgatcctcctgcctcagcctctcaagtagctgggattacagatgcatggcgccacacctggctaatttttgtatttttagtagagacggggtttcatcatgttagccaggctggtctcaaactccgtctgacctcaagtgatcctcctgctttgg

SEQ ID NO: 2942 - DNA, 601 bp, Human
ctcaataataatatcccggagatccagctatgcttgtacatggatagtcacctagagttttttaaagggacacaaaatattccatactacaataagctacggtttacttagccaacctcctattgatggaggcttaggtcgtttccaagttttctctccttcaaacaaggcttcgttcagtaacagactggctgcgtgcaggagtgctagtttctcttgagggtgtgttcttggagaaactgctttatatttcaatgtctggtgccaaggggtgcacctcaggagctgcctcagtttacayttgaaccagcagcttgtaagagcaggcttcctgctccccccgcccccccaccaccaagctggctaaaatgaaagtcagtaggtggtgattgggagaaggtggtgatggggagaaagcagtggggagcctcactgctcctgggtgggagggaagggcaggctaggtgctgggggaggctgatcacttgtgtttgtgcagctccctcccttttctccttccaacccgcaaccaggatctgcctgaacctggcacccactctctgcaggtttttcttctcatcccatcagatctatttgattg

SEQ ID NO: 2943 - DNA, 601 bp, Human
cctctgcaaacatctctaacacacaagtgacaaatgcatgcattctctttctttaaatgtgagaagtttacagctaggctaacaccttctttcaccacctcctcgcctggtctcactctctcttccccactcaggtaacccatgttagaagttcagtgcgtatcagaaagatacacagatttttttttttgcgtttgtatatatatgtgctactgaaaacagaattgtataggtgtcatgtgtttagcaggtggaatactgtacctatcattccttgacttagtttttctctcaataatartatcccggagatccagctatgcttgtacatggatagtcacctagagttttttaaagggacacaaaatattccatactacaataagctacggtttacttagccaacctcctattgatggaggcttaggtcgtttccaagttttctctccttcaaacaaggcttcgttcagtaacagactggctgcgtgcaggagtgctagtttctcttgagggtgtgttcttggagaaactgctttatatttcaatgtctggtgccaaggggtgcacctcaggagctgcctcagtttacacttgaaccagc

SEQ ID NO: 2944 - DNA, 601 bp, Human
ttgacatctgattcgaggctcctatcaaatacttcgaaggaagtaaacaaggagggaagaaagcagatgatttagtttcccagaggtattttgaaagaaacatactttatccaaagccagaatgaaaagtcacttacgcctttggtaggcctctttaatggcgatgatttcctagggaaggtaatttacaaaaaaatcaatattccaaggagggattaatcaataagagatacagagagaagaggcgggagaccatgtctggacacaaagtgccttcaagacttcctcttaagatggtcayccctataggtccagggcacacgcctggagcgagtccctggagatgtgacggcccgccccccccccactccgcccacctctgcaaacatctctaacacacaagtgacaaatgcatgcattctctttctttaaatgtgagaagtttacagctaggctaacaccttctttcaccacctcctcgcctggtctcactctctcttccccactcaggtaacccatgttagaagttcagtgcgtatcagaaagatacacagatttttttttttgcgtttgtatatatatgtgctactgaaaacagaat

SEQ ID NO: 2945 - DNA, 601 bp, Human
cttcgtttcaaaatatcagatttcaccactcaaggtcccagtcctaaaaaaccctgagagctggtcatggaagtctaacttgagccctttgtggtgggcagaattctaagatgacccaatggtccacatccttgtataatccccttcccttgagtgtgggtgagagctatgaatgtgaggagatgccactcctgtgattgtgttatattcaatggcaaaggggaattttgcagatataattcaggtctccaatcagctgagtccaccaaaagggagattatccttggccggcctgacccaratgaatgagctcttcttaaaaggtcagagatggaagaagtcagagagatgagctgctgctggactggaagaaaccaaacagccatgtggtgcactgccttgggggactgtgtggaagggagctgctggcggtctctaggagctgatagtagcttctggtcaacagcaagaaaatggggacatcaaacacagacataaggaaatgaattctgccaacaattaatgagcttggaagaagactctgagcctcagatgagatggcagccctggccgacaccttgatttcagcctgttgataacc

SEQ ID NO: 2946 - DNA, 601 bp, Human
ctgtttcaggatcaactttgagatattagcctggagagtgtactttcaggtagtcagttcatacacacacacacacgtacccagaaactccatctgtgggctccgtagtgtgggaggaggatctcagtcatagagaagtcctccagctcagaggctacgcagctccaggaacaagagaccaggggagtgcagggtcagctgtctttgatcatgactctgggcacgatttgaaaggagcaggccctaaaggcttatatacagtcatgataaaattccaaagctttattgtctttttatctgytggcaacacataggaaatgctatttggagtgaggagtggccagcttcagctgaggtaggagctcaggccggggagtcttggagttctcatccactctctgctaccaacttgctgtgtggtcctgataagttacagatggttcctcactcaacagactttccttgtccagcagttgtgggtcacaatagttgttcggcctacattatagttaccctgttgttgtgaaactgaatgagacacagaacatagaagtgctttgagcaggtaaaagcactctacacatataaaataggatgccaa

SEQ ID NO: 2947 - DNA, 601 bp, Human
ccaagctcagggcaggcacataaagagaaaggagaatgctttgctgggtttggagaaatgcaattaagcattagaaacactgaaatttctttcttagaaattatcttttgaggatatgacacaattgattctataaataattggggactttgagtatgcaccagtggagtttatgtggtttattttgaaaacacaggtaaacaaaatgttctttgtgatgtaagcacaatatatgtcaggggaggaactgtgtccagatttaatgaagccctgttgcttgatctcctagtcattgtttgcrtatctggaggccttggtgtgtggcaatagaaaccagattagaagagtgggggaactgtcccttccttagctgcccccagtcttttttgggtttgatgtgggagtcattattttggaagggattggtatccctttcccagaaacaaggttcttgttctgtagactgagatcatacttcaagagaacattttgttcacacaggtcttgtttactttaaaaaatcctcacattaaaccgttttccatttctattgttaataccaggctagagcagggattttaaattttctgtagaatctcag

SEQ ID NO: 2948 - DNA, 601 bp, Human
aagctgaagttcagagtaaattgtgactatccttaacacaaatactgcccgggccaagctcagggcaggcacataaagagaaaggagaatgctttgctgggtttggagaaatgcaattaagcattagaaacactgaaatttctttcttagaaattatcttttgaggatatgacacaattgattctataaataattggggactttgagtatgcaccagtggagtttatgtggtttattttgaaaacacaggtaaacaaaatgttctttgtgatgtaagcacaatatatgtcaggggaggaaytgtgtccagatttaatgaagccctgttgcttgatctcctagtcattgtttgcgtatctggaggccttggtgtgtggcaatagaaaccagattagaagagtgggggaactgtcccttccttagctgcccccagtcttttttgggtttgatgtgggagtcattattttggaagggattggtatccctttcccagaaacaaggttcttgttctgtagactgagatcatacttcaagagaacattttgttcacacaggtcttgtttactttaaaaaatcctcacattaaaccgttttccatttc

SEQ ID NO: 2949 - DNA, 601 bp, Human
atatttacagaagctgaagttcagagtaaattgtgactatccttaacacaaatactgcccgggccaagctcagggcaggcacataaagagaaaggagaatgctttgctgggtttggagaaatgcaattaagcattagaaacactgaaatttctttcttagaaattatcttttgaggatatgacacaattgattctataaataattggggactttgagtatgcaccagtggagtttatgtggtttattttgaaaacacaggtaaacaaaatgttctttgtgatgtaagcacaatatatgtcrggggaggaactgtgtccagatttaatgaagccctgttgcttgatctcctagtcattgtttgcgtatctggaggccttggtgtgtggcaatagaaaccagattagaagagtgggggaactgtcccttccttagctgcccccagtcttttttgggtttgatgtgggagtcattattttggaagggattggtatccctttcccagaaacaaggttcttgttctgtagactgagatcatacttcaagagaacattttgttcacacaggtcttgtttactttaaaaaatcctcacattaaaccgt

SEQ ID NO: 2950 - DNA, 601 bp, Human
gaaatgctgctccagaggctggatgtggtgggagccatttgacctcaccccctgctcctagatgttagtcataaactggcatcgctgtaagttaggtgggagcggggtgggaagtgtctagaaaatagtcatgaagccgtattctgttatttgtgtggcttattctcaaggtcttttctaatcactttttttcgctaccactggagtacagctctctcttggactgtgtggtcctcaaccccagggacttggcttttctgtcatctgtaccatctttgctctttgtttttttatctttatmtttagccttatctgttgatttgtacccaccagcttaaaatccaccatgagctttaggctccttaagagcaagaactggccttatttacctcttattcccaacccagcacaaaccctgggcccaggcaggtgctgagtaaatgttaaatcattgaatagttttaataccatcttctgactgcactctggtgttttcccgattctcacaatgcaggtatagcaagcaaggacgtacagcctcagaaccaggctgtgagtagatcctattatctactcaagactcttcttaattatgcctagt

SEQ ID NO: 2951 - DNA, 601 bp, Human
ataaaattattcactgcagccaggcatggtggctcacacctgtaatcccagcgctttgggaggccgaggtgggtggatcatttgaggtcaggagttcgagaccagcctggccaacatggtgaaactccgtctctactaataacataaaaattagccaggcttggtaatcccagttacttgagaagctgaggcatgagaaccacttgaacccgggaggcagaggttgcagtaagccaagattgcaccactgcactctaacctgggtgacagagtgaaactgtgtcttaaaaaaaaaaaaaaaaaagaaagaaagaaagaaaaaaacctcttcacagcaaatggcaggaaaggcagccagcccggtgctctatatcttgctcccctttgccttcagagtgagttcctgaacttcagtgagtataacacagtcacttggacagtttgtagaagtgtggcttcccaggctcccttcctggaggttctcaatgggaacctggagtggggcccaggaacctgcattgtaacaggtgattccaaggtagggggtccatagacctcactttgagaaatgctgctccagaggctggatgtggtgggagcc

SEQ ID NO: 2952 - DNA, 601 bp, Human
gttcaagcaattctcatgcctcagcctcctgagtagctgggactacaagtgtgtgccaccatgcccagctaatttttgtatttttagtagtgacggggtttcaccatgttggccaggccggtctcaaactcctgacctcaggcgatccacccacctcggcctcccaaagtgctgggattacaggcatgagccattgcacccgaccagctgtgatcttgacggctgctcccaagccgttggctcttcctctcccttttctttcttatacatacacattctccgagagcaagcacaaattggyttttagggggtgaaaaagcccttaatttttttatgtataaagcactgatatccacatggtatataaacagatttgtagtattatctctggtgttaacatttcttgtggggaagggatggcaatgaagaaacacgtgtctaaaaaggttccttagaacagcaatagtttttaaaaagattgagaaccattgccttatgctgatgtgcttgcttctgcagtgtgttcagttaaggaaaggcctcactcaggaattcagaaatcattctctttttgttcctgctgctggttgacctctttcaa

SEQ ID NO: 2953 - DNA, 601 bp, Human
agtgtagtggcaccatcttggctcactgcaacctccaccttctgggttcaagcaattctcatgcctcagcctcctgagtagctgggactacaagtgtgtgccaccatgcccagctaatttttgtatttttagtagtgacggggtttcaccatgttggccaggccggtctcaaactcctgacctcaggcgatccacccacctcggcctcccaaagtgctgggattacaggcatgagccattgcacccgaccagctgtgatcttgacggctgctcccaagccgttggctcttcctctcccttytctttcttatacatacacattctccgagagcaagcacaaattggtttttagggggtgaaaaagcccttaatttttttatgtataaagcactgatatccacatggtatataaacagatttgtagtattatctctggtgttaacatttcttgtggggaagggatggcaatgaagaaacacgtgtctaaaaaggttccttagaacagcaatagtttttaaaaagattgagaaccattgccttatgctgatgtgcttgcttctgcagtgtgttcagttaaggaaaggcctcactcaggaattca

SEQ ID NO: 2954 - DNA, 601 bp, Human
tcgctctgttactcagactggagtgtagtggcaccatcttggctcactgcaacctccaccttctgggttcaagcaattctcatgcctcagcctcctgagtagctgggactacaagtgtgtgccaccatgcccagctaatttttgtatttttagtagtgacggggtttcaccatgttggccaggccggtctcaaactcctgacctcaggcgatccacccacctcggcctcccaaagtgctgggattacaggcatgagccattgcacccgaccagctgtgatcttgacggctgctcccaagcygttggctcttcctctcccttttctttcttatacatacacattctccgagagcaagcacaaattggtttttagggggtgaaaaagcccttaatttttttatgtataaagcactgatatccacatggtatataaacagatttgtagtattatctctggtgttaacatttcttgtggggaagggatggcaatgaagaaacacgtgtctaaaaaggttccttagaacagcaatagtttttaaaaagattgagaaccattgccttatgctgatgtgcttgcttctgcagtgtgttcagttaagga

SEQ ID NO: 2955 - DNA, 601 bp, Human
tgcatatccttctaaatgtgccattacaaatgcatagttttttcatcaactgctgatttcattagtgtttagaaaacatccagttaccatgctaaaagaaagtgaagaggcagcctagatgcttgctaagccagagttcaaggtgccctgcccacgcatcttaacgttactgcccttaacttacacagcttggcctggctgcgccacttaagctgccaagaaagtaatccgggactcttaagggttttcgtgcgggagtctcatttgcaagtttgatttggaatgtgctcttgacaaaggyggttccaccctgtgttcctattgccctggcttggctcagtgcaagagggctactagcagtttccggaagtccccggaggtatctgagcgaaccatgtcagagagagacttctgatacttctcttggaactttgctttgatcccctgaaggtccacctgtagaaaaaataacagcaatggagataagaacgtttatggtgtgttcacaaacagtgggcactgttctacacatgttatactcatttgctcattcatgccttaaaacagcccttgagatagggctttatttcctatcattatt

SEQ ID NO: 2956 - DNA, 601 bp, Human
attggaaatttgatcccgtcccataaaagacaaggtggtctctaacaggatgatgacatgtttactgaaaatgagagtttagaaatgaaactgtaggtagatcacagataacactgcatgggccttggagttgaatatattctggaaaatttaacatatttatcgtgttagatgcaaccttacgttttacactggtgatcttttggtccatattgagaagtgtttgggtaaacatttgatgagccacgcgattctttcgcaaagagtctaccaagatcagggccttgtcttcaattttggyatcataatattttttcttttcctcttccttcaatgtcagaacatcgtgttttgccaaataattaaaaacaccatgaagaacatctttgcccaggtattccaacatcttaactgttttttttttgtggttgtcttctgtcagaaatagaaagactcctttaactatgggcacagcttaaagagttctgccttcacctaagacataactctgtaatatgaaactcctctaaaaatacattctattttaccatgtctccagcgaataacacacatctttttttgcaactgcagaattctctca

SEQ ID NO: 2957 - DNA, 601 bp, Human
agtcttgtgagaaagtgctggaattgcccacatttcacaggtggtaagactgatgactagggagaatggaaggtcaagaaacttgcatgaagctgcatagttcacatgtgacagaatctaagtttgggtttaggtatctcctactaaaaaatctcccttattaactatttctgtgcacagtctaaacacaaggacacagctttttggctaattggaaatttgatcccgtcccataaaagacaaggtggtctctaacaggatgatgacatgtttactgaaaatgagagtttagaaatgaaastgtaggtagatcacagataacactgcatgggccttggagttgaatatattctggaaaatttaacatatttatcgtgttagatgcaaccttacgttttacactggtgatcttttggtccatattgagaagtgtttgggtaaacatttgatgagccacgcgattctttcgcaaagagtctaccaagatcagggccttgtcttcaattttggcatcataatattttttcttttcctcttccttcaatgtcagaacatcgtgttttgccaaataattaaaaacaccatgaagaacatctttgcc

SEQ ID NO: 2958 - DNA, 601 bp, Human
ctcctgtgttctctccccacagaggcttttctggaccaacccaaaaacatcgcaccccatccaacattctctctcatgtttcctttttgcttactttggattctcttgttattcttatatagacacatacacacactcattatctgaaattgtccggtttcgtttatattgtgagattttacctccactctaacctagatccttgcaatttgaaacttctggtatcatttacagacttatccacagtatcaggaaaagctcttggccccaaagtttggatttaatatttgttttaagagtrcattcctgggccgggtgcggtggctcacgcctgtaattccagcactttgggaggccaaggcgggcagatcacgaggtcaggagatcgagaccatcctggctaacaaggtgaaacctcatctctgttaaaaatagagaaaattagccgggcgtggtggcacgctcctgtagccccagctactcggtagggcaggagaatcgcttgtggaaggtgaatgttgcagtgagccaagatcacgccactacactccagcctgggcgacagagtgagacttggtctcaaaaaataaataaaaataaa

SEQ ID NO: 2959 - DNA, 601 bp, Human
ctcaatcttttctctcctttcctaacaagagtcatgtgttataaacgcatcacaccactgtccttgtaaaacccaacatacgttgcttagaataaaatcaatcttctggcctgaccatactcatccttatactatgtctgttctgcttcaatctctagtcacactgatctgttgtgcctcacatgtgccagtttcattttcagctcagctctttcacaggtagcgccccctactgggaaggcgctgcattctcatcttcccagagccattccattccttccggtagtgccgtccaactccygtgttctctccccacagaggcttttctggaccaacccaaaaacatcgcaccccatccaacattctctctcatgtttcctttttgcttactttggattctcttgttattcttatatagacacatacacacactcattatctgaaattgtccggtttcgtttatattgtgagattttacctccactctaacctagatccttgcaatttgaaacttctggtatcatttacagacttatccacagtatcaggaaaagctcttggccccaaagtttggatttaatatttgttttaagagtgcatt

SEQ ID NO: 2960 - DNA, 601 bp, Human
cataatgtcaacatgtctgtaaatcatttacaaatcaagctatcatgtaaatgattccatttcaaagtttgaatatttctgtttaactttgatttagggattctgatgatctccttcaccacttccttcaccactatcaccgtggataaaattgtacagaaatttctccactgatgagacaatttctcattatatcagccccttaggtagagtttcttcataattcaatgtactttatttgcactggatggggtctaacattgtttcccctaaatataaaccaaacatcacaatcctctgyatacaccttcaaaactgttagatgttcagcctcagcactcaccacctctgcaggcctggacaatgatgaccttgggtttgtcctttagactgaggcagttgcggttgttgaatatctggaagatggtgtcataaagcagcacatccggttttttctttttatgcgcagttccgcagattccctctaggatgccatgagacatgagtaccaagaacgtgctgtcagaggacttgtgctctggtctggcagcaaatgccctcagcactgactccatatcctataaaagagcaatgtctaact

SEQ ID NO: 2961 - DNA, 601 bp, Human
ataaaagtacagttttttaaaatgtgtgtgtgggagggggaaggaatctattctcacagcacacataagatcatgcaaaatatatagagagcacacaccattctctcagctcattgttgcatagggcctatcttgatttcatagaatcattcaaaggtggcctcagcacccccaaatttttgactgttactaaaagacacatacgtggtgttgaagaacagaaagcaatgaagtccttctcctcgtggatcttgcaaacagaatctgcctccaggttctcagatgactgtgaagagatgastgccaaggatgctggagagtctctgacccagagttccccatgtttttctgtagagacatcaactttcttttttttttatgttactttaagttccagaatagaaatgcagaacgtgtaggtttgttacatagttacgcatgtaccattgtggtttgctgcacctatcatataggttttaagcccacatgcattaagtatttgtcttaaggctctccttccccttgtcgcccaccccccgactggccccggtgtgtgatattcccctccctgtgtccatgtattctcattgttcaaccctca

SEQ ID NO: 2962 - DNA, 601 bp, Human
agttttcatatgtcagctatgcctccataaagtggtttaaaaataagacttgaaaatttacaacttggaaagagtaaaatagaaagccctttaggatgattacctagaggtgaaatacaaacgactgtttcctgtaattagacctaattagctccaccctaacatttcttaccttttttaaagctcattcacatttttatctggacacttaataacattgctctttgtaggatcaagtgggatatatgtagaagagggcttgaagttgatcatttggaaagacagccagtactgggatccrtaaaacttctattcaaaatgttaaatggatttattaaaaaaacagcatccatcatctatgtttacatggtgtgtggcgaatggggttccttgtattgtattgctttaatatttggtatgcctttgactgtaaagtgtaacacttataataaaagtacagttttttaaaatgtgtgtgtgggagggggaaggaatctattctcacagcacacataagatcatgcaaaatatatagagagcacacaccattctctcagctcattgttgcatagggcctatcttgatttcatagaatcattca

SEQ ID NO: 2963 - DNA, 601 bp, Human
ttattgagttgcatacattaaatatgtacagttttcatatgtcagctatgcctccataaagtggtttaaaaataagacttgaaaatttacaacttggaaagagtaaaatagaaagccctttaggatgattacctagaggtgaaatacaaacgactgtttcctgtaattagacctaattagctccaccctaacatttcttaccttttttaaagctcattcacatttttatctggacacttaataacattgctctttgtaggatcaagtgggatatatgtagaagagggcttgaagttgatcrtttggaaagacagccagtactgggatccataaaacttctattcaaaatgttaaatggatttattaaaaaaacagcatccatcatctatgtttacatggtgtgtggcgaatggggttccttgtattgtattgctttaatatttggtatgcctttgactgtaaagtgtaacacttataataaaagtacagttttttaaaatgtgtgtgtgggagggggaaggaatctattctcacagcacacataagatcatgcaaaatatatagagagcacacaccattctctcagctcattgttgcatag

SEQ ID NO: 2964 - DNA, 601 bp, Human
aggggacttgagaaataactggaattctttcactttacaaaggaaagaatagaagctcagaaggatgaataaacttttaggttcagtgaggaagcaacaaaaaactaccgtcgggctccaagattgtttacagattgcaccatgatgtctttcaccatataataaacaaaatagatgaacacatccaaagtttcagttatagaagattaaaatatagaaaaatactgtataatatggtgccaatagtaaataatactgtcttatatacttaaaaatttgcagagagtagatcttatgtaarttatccttatcacacccttgcagaatgatgataataataaatagagagctggaggaatcttttggaggagagatgtttacagcatagatttgggtgatgattttaggggtgtgtactaatctccaaacttattgagttgcatacattaaatatgtacagttttcatatgtcagctatgcctccataaagtggtttaaaaataagacttgaaaatttacaacttggaaagagtaaaatagaaagccctttaggatgattacctagaggtgaaatacaaacgactgtttcctgtaattagac

SEQ ID NO: 2965 - DNA, 601 bp, Human
cagaggaaacagaaaagctggcaaaggttgaacaaaaaagacagcttgtaagtattgcaagagattgcatagtgattgtattttgattcttggaactaactttttattatggacctcatgttcattcactttgcttagaaaaggggacttgagaaataactggaattctttcactttacaaaggaaagaatagaagctcagaaggatgaataaacttttaggttcagtgaggaagcaacaaaaaactaccgtcgggctccaagattgtttacagattgcaccatgatgtctttcaccatawaataaacaaaatagatgaacacatccaaagtttcagttatagaagattaaaatatagaaaaatactgtataatatggtgccaatagtaaataatactgtcttatatacttaaaaatttgcagagagtagatcttatgtaaattatccttatcacacccttgcagaatgatgataataataaatagagagctggaggaatcttttggaggagagatgtttacagcatagatttgggtgatgattttaggggtgtgtactaatctccaaacttattgagttgcatacattaaatatgtacag

SEQ ID NO: 2966 - DNA, 601 bp, Human
ccatctcaatttatggtacaatcttctttaaacaccagtggtatatcttccttttcccacaagagttttactgttctctataatttttaatttagaaacaaccacactttcctgtgttaataccaatcctattttcccttaaaaagagaaggaacatttatctattcattcatgcatctatttattcaatatatattaattgaatgtctgctatatgtcaggcatattgaggtgctgagcaaatccccgccatcctgaagtttgcatattagtgagtaaatacaggtaaaaaacagacacrtaaataaactattaatatatgcttaatgggaggaggtaagaactgtggagaaaataaagtaggaaggatggggaataaggaatgtcccaagttgggcaaggagtagcaaaccttcccttctgccctttcccatggaaagagtgatttcttttttattccctgttacatgcctttatgaattctaccacaatctgtaattgcacatttttttgttaacccatattttcagtatccatatctctcacaaaagtgtgagtcctagatagtcttaagccatgcaagcctcatttacccctttgt

SEQ ID NO: 2967 - DNA, 601 bp, Human
ccaaatattgactatgcaagctatactggtaaatgtgctctttgatgttgacagaggagggctgggctgcctgtggtttcctgcagaagagagaaaggacagaaggtcaagatggttacccctcactgccttcatcccatccttcattatgattcttcttccatcttctgccatatgcttttgccatttccctcgacttccatctgtgacctctgtgtctatttagtgaaaagtactcaggaatatctttgtaaaacctaagttaaattatgtcacttctcttttccaaagcactggaagkgtttcctatctactcagataatatttttttaaagatttaccatgtgatgttcaagcacattgtgatgaggctcctcactgtttctcctaatttgtctctgtcagttccctcacttgcattctcttttggtcacactatctcattgtagttctttttaaacctgttcagcatatttctgccccagggcatttgcacttgtattctgtgctggaacacctctcctgcataagaaccacatgattcactctccaactctgtgcattctttattccaatttcattatttcaaggcaggttttcc

SEQ ID NO: 2968 - DNA, 601 bp, Human
attttcttccagcaaaggtttcttatttaacccctgtgggcttatcttgcagccaaacccatccaccagcatgaagaccgctgcttgaggttgaaggtgactgtcagtggcaaaatcagtgagtgtcggagccctgtgggcctccttcctccatctctatgctgggtgcggtctagtgatctaggatggtatagaagtcttgcagcccagcccactcatacttacagccctctgcctctttgatacagtacctgatctactaccactcttgtctttcagctcacagtcctcaggcccatgwcaatccacaggagaagagacttgcagcaggtgggtagctggagcaaactgggcctggggcacaggaaggggtctgcttgaagaggttgggtacaggaggtggctcctttaccaggctgaggctgagggaatcctgttgggctgagagccagtacaaatagtggagccactcacactggtggcctttgccctctcaccttgcagatgacccagaggtgcgggttctacatagcatcggtcacagtgctgccccacgcctcttcccacttgcctggactgtgctgctccttccacttctgct

SEQ ID NO: 2969 - DNA, 601 bp, Human
tcacactggtggcctttgccctctcaccttgcagatgacccagaggtgcgggttctacatagcatcggtcacagtgctgccccacgcctcttcccacttgcctggactgtgctgctccttccacttctgctgctgcaaaccccgtgaaggtgtatgccacacctggccttaaagagggacaggctgaagagagggacaggcactccaaacctgtcttggggccactttcagagcccccagccctgggaaccactcccaccacaggcataagctatcacctagcagcctcaaaacgggtcartattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacagga

SEQ ID NO: 2970 - DNA, 601 bp, Human
catgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgtatatattatagattatatatacattatataaggtawataaatattgcttagcattagatttagtaaaaaataaagggctaatgaaatttttttgacaggcctctgtctcttgatgtcctgaaatgttcatctcattaccattaagataatccaataatcaaaaaggcaccccctagtctggtagcatataaacaataaagcatttcaaaatgtaattatacatatttagaaagtcattatattactttgattagctttagaataattcctgagaatatcttaagttctctaaaattttccattttcctcatttgtaattctaacataccttatttg

SEQ ID NO: 2971 - DNA, 601 bp, Human
tttttgacttctgaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctrcgcacactgtatatatatgtatatgtatgtacgtaacattattatacataattatgtatatattatagattatatatacattatataaggtatataaatattgcttagcattagatttagtaaaaaataaagggctaatgaaatttttttgacaggcctctgtctcttgatgtcctgaaatgttcatctcattaccattaagataatccaataatcaaaaaggcaccccctagtctggtagcatataaacaataaagcatttcaaaatgtaattatacatatttagaaagtcattatatt

SEQ ID NO: 2972 - DNA, 601 bp, Human
cataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcatatagtccattttatttttaattttttatactgaaactgtaaacctatcatttacgtcaaactcccatgcaattcattcaaaatgtaaagraaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgtatatattatagattatatatacattatataaggtatataaatattgcttagcattagattt

SEQ ID NO: 2973 - DNA, 601 bp, Human
aacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcatatagtccattttatttttaattttttatastgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgta

SEQ ID NO: 2974 - DNA, 601 bp, Human
aggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttcygaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgta

SEQ ID NO: 2975 - DNA, 601 bp, Human
aaaggaaggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttkacttctgaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcac

SEQ ID NO: 2976 - DNA, 601 bp, Human
tgttatcaaatggctgttctttggtggactatattattttacataattttaatgctataaattctaattccttccccactatatttaaaaaaaatttaattaattacgctgcattaaatttaaagatgaagacattaaatttgtaaatgaaaagttctaaaaataatatataatttttaaaaacaattacaaaacagaagtacattagtagcatgcaaacatttcaaaactggtatgttttaagcaagcattgtaaaaggatatataaaagaaataaaaaggaaggaaaaagttattgaaygaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcat

SEQ ID NO: 2977 - DNA, 601 bp, Human
atttattgcacaattagttgtatttcttttataatatttttgccttaggcagtatcaaaacttttaattattataaaattaaaattgttatcaaatggctgttctttggtggactatattattttacataattttaatgctataaattctaattccttccccactatatttaaaaaaaatttaattaattacgctgcattaaatttaaagatgaagacattaaatttgtaaatgaaaagttctaaaaataatatataatttttaaaaacaattacaaaacagaagtacattagtagcatgyaaacatttcaaaactggtatgttttaagcaagcattgtaaaaggatatataaaagaaataaaaaggaaggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttaca

SEQ ID NO: 2978 - DNA, 601 bp, Human
aagaaatgctaagcattaagaaacttgctttgaaattctggtctccatcattcattatagtaaaccattatttcttctgcacatctggcttacagtaaagttgtatcaaattattctgttcatttattgcacaattagttgtatttcttttataatatttttgccttaggcagtatcaaaacttttaattattataaaattaaaattgttatcaaatggctgttctttggtggactatattattttacataattttaatgctataaattctaattccttccccactatatttaaaaaaaawttaattaattacgctgcattaaatttaaagatgaagacattaaatttgtaaatgaaaagttctaaaaataatatataatttttaaaaacaattacaaaacagaagtacattagtagcatgcaaacatttcaaaactggtatgttttaagcaagcattgtaaaaggatatataaaagaaataaaaaggaaggaaaaagttattgaacgaagtatgtttaataagttagcattcacaaacgctataggactataatgcttaggactataacctaagtcagtgagttaaaaatgtacccataa

SEQ ID NO: 2979 - DNA, 601 bp, Human
acaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatgtatgaacataacattattatacataatatgtatatattatagattatattatatatacattatataaggtatataaatattgcttagcattagatttagtaaaaaataaagggctaatgaaatttttttsacaggcctctgtctcttgatgtcctgaaatgtttatctcactaccattaagataatccaataatcaaaaaggcaccccctagtctggtagcatataaacaataaagcatttcaaaatgtaattatttacatttagaaagtcattatattactttgattagctttagaataattcctgagaatatcttaagttctctaaaattttccattttcctcctttgcaattctaaccaacattctctgtaatattgaagaaatgctaagcattaagaaacttgctttgaaattctggtctccatca

SEQ ID NO: 2980 - DNA, 601 bp, Human
ttgaacctgggagacagaggttgcagtgagccaagatcacaccactgcactccagcctgggtgacagagtgagactccatctcaaaaaacaaacaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatgtatgaacataacattattatacataatatgtatatatkatagattatattatatatacattatataaggtatataaatattgcttagcattagatttagtaaaaaataaagggctaatgaaatttttttgacaggcctctgtctcttgatgtcctgaaatgtttatctcactaccattaagataatccaataatcaaaaaggcaccccctagtctggtagcatataaacaataaagcatttcaaaatgtaattatttacatttagaaagtcattatattactttgattagctttagaataattcctgagaatatcttaagttctctaaaattttccat

SEQ ID NO: 2981 - DNA, 601 bp, Human
aatgtctgtatcttctagactttgctttaatgttatttgttgaaaaatttttttatttgattaaagttttcttatgcatttgtgggatcaagtactttatttcagaagtgaataaattagcttaaaaagttagagcttagccaggcgtggtggctcatgcctgtaatcccagcacgttgagaggctgaggcaggcagatcacttgggtcaggagtttgagaccagcatggccaacatggcaaaaccccgtccctactaaaaatacaaagaaattagccaggtgtggtggcacacacctttwatcccagctactgtgttggttgaggcatgagaattgcttgaacctgggagacagaggttgcagtgagccaagatcacaccactgcactccagcctgggtgacagagtgagactccatctcaaaaaacaaacaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatg

SEQ ID NO: 2982 - DNA, 601 bp, Human
agcaacaacaaaaataactactcttaatgaattatgcttttcataaacttttttgtgatttgcaaatatgtcatgtcaatatgtaacagcttattttggttttaaaagagacatttggatttataaaatcccaaaagaaaatatatacctgaaaacataatacctaagatatttgaaagttggctctctcactgggccaaggtcattaccatagctatctcataataagtttttagtttgactcgtgttttcagttggcaataaatatgttttttgagcaaaattataatagctatgttgytttttaaatttgtacccttgtgtctttaactatctaattttaaaatttatcacaaaactcaagtagcataaaggaaaaaaataaatgcccttatgcaaatggcaatttcttaaacataaacaattgcatagtcacagacatacagtcataaagtatttttcatgttacagaaaataagaaacaaaaacattttattataaggaagcaaaagaaaataaagatggaaaacaaaatatttaaaaaatataaagagattttagaaatagccttgttccccgagactagaacatgcagagaaaa

SEQ ID NO: 2983 - DNA, 601 bp, Human
tccagtatgacctcatcttaactcagttacatgtacaaagaccctatttgcaaatgagatcacattcacaggtaataaaagttaggaatgtacatgttttgggggcacagctgaacctagcacaggtactcgacaaaatatctactgaatagatgagaagaaaacttgtaaacctgaattagaattgtagaacttcccaggatctgttattgtaatttcacagttgcttatgggagatcaaattcttttgtgtctgttgaatttataagatgtctttatcagattccctccatcttcaccsttccagcaacaacaaaaataactactcttaatgaattatgcttttcataaacttttttgtgatttgcaaatatgtcatgtcaatatgtaacagcttattttggttttaaaagagacatttggatttataaaatcccaaaagaaaatatatacctgaaaacataatacctaagatatttgaaagttggctctctcactgggccaaggtcattaccatagctatctcataataagtttttagtttgactcgtgttttcagttggcaataaatatgttttttgagcaaaattataatagctat

SEQ ID NO: 2984 - DNA, 601 bp, Human
gtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttckggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactgggtaatttataaaggaaaaaggtttaattgactca

SEQ ID NO: 2985 - DNA, 601 bp, Human
gaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcarcacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactggg

SEQ ID NO: 2986 - DNA, 601 bp, Human
ggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattwcaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagaga

SEQ ID NO: 2987 - DNA, 601 bp, Human
aaaaataggttcaaaatatactgtttgcagcttacttgatcagagagagaacaaattggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctrttgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctc

SEQ ID NO: 2988 - DNA, 601 bp, Human
gcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcatggtggcttacgcctgtaatctcagcactttgggaggacgaagtgggaggatcgccagaggccaggagttcaasaccagcctggccaacatgataaaactccatcgctactaaaaatacaaaaattagccaggtgtggtggtgcacacctgtaatcccagctactcgggaggctgaagcatgagaatcacttgaacctgggaggcggaggttgcagtgagctgagattgtctcactgtagttaagcctgggtgacagagcgacactccacctcaaacaacaacaacactatcaaaacactatcaaattttaattggccattttattttatttcattagcctcacagtgaaaataagaaaacaagcacaaggatg

SEQ ID NO: 2989 - DNA, 601 bp, Human
tgtatcagatataaatcaatagtcaataattttattaagaagtaaaaaccatccatttaaactgaattacagtgggaaaatatatttgtaaagaaggcttagaaaataaacaataacaataaactagaatgagattatttcaagcatatattttctaactattcgtaggtaaagttttaaaaattgaatggattctagtcctctaatccctgtcactagaaaatgactgacctacagcatgctttagtatcttttcttcacaataagagaataatattttaataatgacacacaataattsctaaacaggcttgatgggacagtaagcgtagttccacaaagatgccaagcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcatggtggcttacgcctgtaatctcag

SEQ ID NO: 2990 - DNA, 601 bp, Human
atcctcatctaaaccctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattggrggattctccatcaaaggaggcttttccttgactgatcgctctccaaagaatcccaccagttgggaagcctccttcatgcacctgggagaggtataaaaggtataggcacactattctgcttatttctttcaacgtaagtcttctttctgaagagaggcatattttacatttcattctctgtccacatcaaatggtctaaagagaaacaccaaatttctgtattacaacactgggcagaaattcatatgatagcaattagtcatgacttaaccctttcacccaacactgtgaacaaaataa

SEQ ID NO: 2991 - DNA, 601 bp, Human
gcaggagaattgcttgaacccgggagatggaggttgcagtgagccgagatcgtgccaatgcactccagcctgggtgacagagtgagtccctgtctagaaagaaacgaaatgagaggagaagagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaascctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattgggggattctccatca

SEQ ID NO: 2992 - DNA, 601 bp, Human
gggcctggtgcggtggctcacgcctgtaatcccagcactttgggaggtcgaggtgggcagatcactcgaggtcaggagctcgagaccagcctggtcaacatggcgaaaccctgtctctactaaaaatacaaaaattagccaggcgtggtggtgggcgcctgtactcccagccactcgggaggctgaggcaggagaattgcttgaacccgggagatggaggttgcagtgagccgagatcgtgccaatgcactccagcctgggtgacagagtgagtccctgtctagaaagaaacgaaatgagaggagaagagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaaccctgtgcagccaggtgaatgctgcttctcgtaccctttcagaatatggaagatttactttctattaagattgcccagagatgctccaggtgacatgacagcagaagtgctgga

SEQ ID NO: 2993 - DNA, 601 bp, Human
atgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgctatcctaatgtgctgtttgtrttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcctagagtaagatttttgaaagcaaaggtcacaccttgctaattttggtatccctagcatttaattcttgtggtgaccccaataactg

SEQ ID NO: 2994 - DNA, 601 bp, Human
aagcaggcattataaatatgacaatagttttcccaagaagcttaccgaaatttccctgcccattatcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactsagtgttaactagaattgaatctgtttcatcacaaaaacagaggaaggactctggttcttttcgctatcctaatgtgctgtttgtgttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcct

SEQ ID NO: 2995 - DNA, 601 bp, Human
tttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttaatgcaaaatgaaagaaaattcagataaaagcaggcattataaatatgacaatagttttcccaagaagcttaccgaaatttccctgcccattrtcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgc

SEQ ID NO: 2996 - DNA, 601 bp, Human
ctccatttgtggtaccaaagcgaccaccacccaccccctgctaccaccacctccaatattttcttgattagttaattcattttcagtattcttctttagagagattgaaattctgtctaattaataggcttcaggatatgatcaaaatatttgacttataaatctcacatttgctgctacatataaagtcttacatcataattagcacacctgttaaagttttcactgccatcagatcgtctctgaattacagtccatcctcctccatcggacatgtcacaataaacagaaaattctgctrggctctggagaggtttgattttgtaaaatccactgagcttatacccatcattgaaaatctctgaacaatctgtttttaaaacaaggtaatgtaacattcattatgtgtctttttctcccccccacttagggagcctctgaatgagactactcagtatcactggagacagataacacatggtatagaaatcagcgttttaaaattgcatcttgtacatcttccagtggatattaggaaagttttatttcctttgctaaaatttgccacctgaatccttgatataatcatggaggaaaaaag

SEQ ID NO: 2997 - DNA, 601 bp, Human
ttgattttaagccactaagctttggaagaggattgttacacgttattattgtgacattaggtaactgatacagcatatataatctccaggaactcaaggcatcaaaaaggaataattatgacattatatatccttttcagaagtagaatatatatatattctatatatatctatagatacatatagcgacatattctatatatctatatatagctacatatatactatgtatagaatgtatatatatctataaatatatttagatatttctcataaatatatatgtgaaaacaattccccrcaacccaattctagcttttttttctgtttctaattttaggcagccacattttacatttgggattattgcccaaaagttatcactaccatctgcaaatcatagcaattattgaattagttccattgcctataatttggttaaaaaaaaattttagtgttgtttttattatatttcaaataaatctgacatcattcaaaccttaccttgagtggtcaagaagtgaagatttttattgcccagccaatattcaccatgtttttggacaaaatttccaaagccattttcatagtctttccatcc

SEQ ID NO: 2998 - DNA, 601 bp, Human
ctggccccaaggggtccacccgcctcagcatcccaaagtgctgggattacaggcatgagccaccatgcccagctgtttatttttaatgcaattgcagtgtaacttagcatgcttttttgggcattacagttgccttttatgaaggattcaggatcagacttgagtgggactgatgataatctcagactacaacagaggtagggaagacaatggattggagcaaaagaacatgggagatagaagctgggaaaagtcgttatcaaaacaatgatattttagacaaatattaaactctaaagayaagaatttaaaagtatatagggagacatccagatgtctgctatttactttgaaatatatatacagaaaagatggattgatggacggattgagtaatgggcaaacggatagatacgtaacaaaaacaagcaaagtaaaatgttaatgtaggatacaggtggtaggttgaaacttctttcaaattggttgcagctttgaaaaaatttcagcattaaagatgagatgtatgtggaaacatggacatttcatatattatagtgttttattggaaaaatagcaccaattccccaattgttcacct

SEQ ID NO: 2999 - DNA, 601 bp, Human
tactactataaatatagaaacaccaatagctttccagaacttggatggaacaaaggaacttttgttttatcttaattactttattattattattattatttattattattattatttgagacagagtcttgctctgtcacccaggctggagtggattggcgcaatcttggctcactgcaacctccgcctcttgggttcaagcaattctcctgcctcagcctcccaagtggctgggattacagtgctgtgccaccatgcctggctaatttttgtatttttagtagagatggggtttcaccaygttggccaggctggtctcgaaatcctggccccaaggggtccacccgcctcagcatcccaaagtgctgggattacaggcatgagccaccatgcccagctgtttatttttaatgcaattgcagtgtaacttagcatgcttttttgggcattacagttgccttttatgaaggattcaggatcagacttgagtgggactgatgataatctcagactacaacagaggtagggaagacaatggattggagcaaaagaacatgggagatagaagctgggaaaagtcgttatcaaaacaatgatattt

SEQ ID NO: 3000 - DNA, 601 bp, Human
tttagagcctcactttccttggagtttcaagccagaccatggaggcactgggaaagagagtccctgaatagtcctatcacctaggccccatctctggttggcctcttctctctttccatccccatctccatcacttatagcaaggggctttggatccacttgtggacatcccaggctgcatatccaagttctattcacacccaagttgggtggattacaaggtcaggagatcgagaccatcctggccaacatggtgaaaccctgtctctattaaaaatacaaaaattagctgggcatggtrgcacgtgcctgtaatcccagctactcaggaggctgaggcaggagaattgcttgaatccgggaggcagaggttgcagtgagccgagatcgcgccactgcactccagcctggctacagagtgagactctgtctcaaaaaaaaaaagccattttttagcctcccctcaagcttaagggtgcacacaccagcagcagaagaggacagacgagaacatcctgaaggagtcctataaacaaactcaaggctgttggggcagggaatgctggattcctcaagactggagtccctttaagaggtgatg

SEQ ID NO: 3001 - DNA, 601 bp, Human
taggcgatataagagcattatgtttttaaaatgattaaaataattgctaccttcaagtaatcttttttttcccattgtttggaaataacaaagactattcctttttcagaaacagaactcttgtcaggggcaccaaatgttataaatcaaattattagatcacatgtgttctatcctcctactttgataaataagatataacaatgacctgtaaggtcgggttagaatttagagcctcactttccttggagtttcaagccagaccatggaggcactgggaaagagagtccctgaatagtcstatcacctaggccccatctctggttggcctcttctctctttccatccccatctccatcacttatagcaaggggctttggatccacttgtggacatcccaggctgcatatccaagttctattcacacccaagttgggtggattacaaggtcaggagatcgagaccatcctggccaacatggtgaaaccctgtctctattaaaaatacaaaaattagctgggcatggtagcacgtgcctgtaatcccagctactcaggaggctgaggcaggagaattgcttgaatccgggaggcagaggttg

SEQ ID NO: 3002 - DNA, 601 bp, Human
cttttatatatgctaaagaatgatatatgatgacaaaaaatctctaaacattaaagatatactttaatgactgtaaaaattctaggcgatataagagcattatgtttttaaaatgattaaaataattgctaccttcaagtaatcttttttttcccattgtttggaaataacaaagactattcctttttcagaaacagaactcttgtcaggggcaccaaatgttataaatcaaattattagatcacatgtgttctatcctcctactttgataaataagatataacaatgacctgtaaggtcrggttagaatttagagcctcactttccttggagtttcaagccagaccatggaggcactgggaaagagagtccctgaatagtcctatcacctaggccccatctctggttggcctcttctctctttccatccccatctccatcacttatagcaaggggctttggatccacttgtggacatcccaggctgcatatccaagttctattcacacccaagttgggtggattacaaggtcaggagatcgagaccatcctggccaacatggtgaaaccctgtctctattaaaaatacaaaaattagctg

SEQ ID NO: 3003 - DNA, 601 bp, Human
tgactctgagtaaaaaggtatttctgaagagctgatatctacatgtgaaagcattttaagaatgcaatggggccggggcggtggctcacgcctgtaatcccagcactttgggaggccgaggcgggcggatcacgaggtcaggagatagagaccatcctggctaacactgtgaaaccccgtctctactaaaaaatacaaaaaattagccgggcatggtggcgggcacctgtagtcccagctacttgggaggctgaggcaggagaatggcgtgaacccagaaggcagagcttgcagtgagccragattgctccactgcactccagcctgggcgacagagcgagactccgtcgcaaaaaacaacaaaaaaacaaaaaaaagaatacaatgtattgggtacatattatcttttatatatgctaaagaatgatatatgatgacaaaaaatctctaaacattaaagatatactttaatgactgtaaaaattctaggcgatataagagcattatgtttttaaaatgattaaaataattgctaccttcaagtaatcttttttttcccattgtttggaaataacaaagactattcctttttcagaaacag

SEQ ID NO: 3004 - DNA, 601 bp, Human
ttggttattttcctgatagcataaaagatcagccaggaaaccctttaagaataatttgaggaagaaatatgaatcctaattgttatccgaaaaccttcgtttgatactggctcataagatcaagagactcttagcatcaaagtatgtagagtggatgtcattggaagagaatttcagaggcaataaggaaacattctggagaaatgctgtaccaccaacattctcaatggcagagatgatgataattactggaaaatatactaacatcaatgactctgagtaaaaaggtatttctgaagarctgatatctacatgtgaaagcattttaagaatgcaatggggccggggcggtggctcacgcctgtaatcccagcactttgggaggccgaggcgggcggatcacgaggtcaggagatagagaccatcctggctaacactgtgaaaccccgtctctactaaaaaatacaaaaaattagccgggcatggtggcgggcacctgtagtcccagctacttgggaggctgaggcaggagaatggcgtgaacccagaaggcagagcttgcagtgagccgagattgctccactgcactccagcctgggcg

SEQ ID NO: 3005 - DNA, 601 bp, Human
ttatttgaaaaaaaatgatggatacaatattaaatttaaaaaatgtctactagatctcttagaggtaaaacctagtgcaattcactgaataatgaacaacagaaaaaataagtgattacttaaagcaatctaacaatgaaaggatcgacgttttacctttaatagtttgacctctttttcttgatttcagtaagaatgttgatcttgaatataaatggtggctattaatgacattgtgtaatctctagtagctgagccactaggtttgtaaaatgtagttgccattgcctgcatatgcctsaacttggttattttcctgatagcataaaagatcagccaggaaaccctttaagaataatttgaggaagaaatatgaatcctaattgttatccgaaaaccttcgtttgatactggctcataagatcaagagactcttagcatcaaagtatgtagagtggatgtcattggaagagaatttcagaggcaataaggaaacattctggagaaatgctgtaccaccaacattctcaatggcagagatgatgataattactggaaaatatactaacatcaatgactctgagtaaaaaggtatttctga

SEQ ID NO: 3006 - DNA, 601 bp, Human
tttctggattattgtaaaggaaatttctgtattgggagaggcttagactcaatgaattaatgaaagccatagtgattgaaaagtagtaccatacagaagcattacagcaataacggtggctcttttgtgtgatatggtcaggtgaagaactagttggttattaggatgccaaatagtctccatatatatacatgctctctctttctttgtgtgaatttgtggccttctatttataactcatccataattcagtttgcaaatgatctttgtaaaagtaataatttatttctatgacatttamactttactaatgtacacaatgaacaaatcctcaaaacgacttcattgctgaagaattctaatgagaatgattacttaataatactaatattataaataaagactaacattaccatacatattatattgataattaatgtctatcagtgagatatcatcaactccattacaactatgctcataagacatcaaacctgttaaaccaccagccagactgatcttcttctgcgcagttcccttcatagttgtcatgatctctgtcccacgtgctgaatttcattctttggtgactagcccacca

SEQ ID NO: 3007 - DNA, 601 bp, Human
gtggatcacatgaggccaggagttcgagacctgcctgggcaacatggcaaaaccccatctctaccaaaaatacaaaaattagcccatgtaccccagaaatatataaaatattttgtatcagtaaaaaaagaagcaactatatacaatcaaaaacggaatgaatttgctgataaagtaacatgaatgtattcagtcagagggtagaattaggtttctggattattgtaaaggaaatttctgtattgggagaggcttagactcaatgaattaatgaaagccatagtgattgaaaagtagtacyatacagaagcattacagcaataacggtggctcttttgtgtgatatggtcaggtgaagaactagttggttattaggatgccaaatagtctccatatatatacatgctctctctttctttgtgtgaatttgtggccttctatttataactcatccataattcagtttgcaaatgatctttgtaaaagtaataatttatttctatgacatttaaactttactaatgtacacaatgaacaaatcctcaaaacgacttcattgctgaagaattctaatgagaatgattacttaataatactaata

SEQ ID NO: 3008 - DNA, 601 bp, Human
acgagcactatgaaactccaacactggatctgataactcagacttctactaagtgtcttggggcagggagggctttcagcgtggatacgctagacagaggggtgacccacctcctgggcagaaagaatccaatggtgcgaatctctgctcagaatgacatgcaatttaaaacttatgaattcggcagggtgcggtggctcacgcccaacactttgggaggctggggtaggtggatcacatgaggccaggagttcgagacctgcctgggcaacatggcaaaaccccatctctaccaaaaatrcaaaaattagcccatgtaccccagaaatatataaaatattttgtatcagtaaaaaaagaagcaactatatacaatcaaaaacggaatgaatttgctgataaagtaacatgaatgtattcagtcagagggtagaattaggtttctggattattgtaaaggaaatttctgtattgggagaggcttagactcaatgaattaatgaaagccatagtgattgaaaagtagtaccatacagaagcattacagcaataacggtggctcttttgtgtgatatggtcaggtgaagaactagttggttat

SEQ ID NO: 3009 - DNA, 601 bp, Human
atgattatataacaatatgtcagcattacagctcttgtgctttgggaccattattaaatcaaataagcatgattcgaacacgagcactatgaaactccaacactggatctgataactcagacttctactaagtgtcttggggcagggagggctttcagcgtggatacgctagacagaggggtgacccacctcctgggcagaaagaatccaatggtgcgaatctctgctcagaatgacatgcaatttaaaacttatgaattcggcagggtgcggtggctcacgcccaacactttgggaggcyggggtaggtggatcacatgaggccaggagttcgagacctgcctgggcaacatggcaaaaccccatctctaccaaaaatacaaaaattagcccatgtaccccagaaatatataaaatattttgtatcagtaaaaaaagaagcaactatatacaatcaaaaacggaatgaatttgctgataaagtaacatgaatgtattcagtcagagggtagaattaggtttctggattattgtaaaggaaatttctgtattgggagaggcttagactcaatgaattaatgaaagccatagtgattgaaaa

SEQ ID NO: 3010 - DNA, 601 bp, Human
accaagtttctaaaacaatctactttctctcccttaatgcctactgattttccaattgcacagccttatcaacccctttgattccaaggataatgtgggctctgtggcaggctccacctaatgaatggcctttctttgtgctccctgaacccatttctttaaagtcaggtaaatcgttcctttgcccacattaatatacatggtagttttcattcagatgccttagaagccagtcagctggataaagtacatggttttgatctcaggatactattagtaattatttctgtatatggaattsttttcaaaatcaaacattggtgatgcttgcagatgacttcatgaattacacgttaagttttatgtcatgctgacttagaagaacaagggggaaagaaaggagtaggaacaggtgaagaagacggtttttaaaataacaggaaaaccactaaggaaaacaccatcatcaccttcaatttgcaaagcaggagagtgaaatttgtttctctccttcacactgctggaaatactccagttcctttataaatgatcaaatcttaaatggactcaaatgtttttttaaaaaagcaaaatatagaaa

SEQ ID NO: 3011 - DNA, 601 bp, Human
ttctttcctcctttggagtctgtaaattttgtccttgatatgtataatttacatgtaacagtatgcaataagtttatgtgtgttgttatgaaattaattgccatatacttctttattgataaaattaatgaaaagatgtcagaattaggatagaaggagaacattcacaagaggtagttctgaacatctatggaaaaacccaaattattgaatcaaaaaagcatataatctacccgtaaaggctgagtggctggcttgaatcacttatcagcttaatgattcactcctactgagcgttctygaagtcctcctaacttaaatggacgtaattaattgaaaatatgtatgtcaagtctgcaaatgtcaaagcctactgtgtttttaaaacagcatggaaagtaatgttaaaaaaagaaaatactgtaaattgagtctccagaatatatattttggcatatatttgtctatctagagacatctgctaactatatttttatatttggtctatcatttgaatcccattaggaaactgactctgtgatgaacataagaaaccttcactattctgagaccagttttctagcatcgtttagtttttaga

SEQ ID NO: 3012 - DNA, 601 bp, Human
ttttctttaaacaaaaaattaaaacaagcaaacaaaaacgcatccttgtaacctccagccttacaacctcctgactcagaacagtgttaatttcatacttaacaagagctaaggtgagtgtcagcaaagcaagtcgtgggcaaggtgctctactactggctttcctggataatttgcactcacacgttcattcctctgctgctaagacttagctttcataattcaaactccgtatgtccccttctttaaattgctagcctatcagttatttcaatctcaagggtaagcaaacaaacctaartcaccatttaaagttttgccacccatcaaccaataatcattttttcctagttgctgagttaattttttacatatattgcaccaatctagataagctggttaggttatcgacaatataaaaatgtttctttcctcctttggagtctgtaaattttgtccttgatatgtataatttacatgtaacagtatgcaataagtttatgtgtgttgttatgaaattaattgccatatacttctttattgataaaattaatgaaaagatgtcagaattaggatagaaggagaacattcacaagaggta

SEQ ID NO: 3013 - DNA, 601 bp, Human
taacaggtgtgagccactgcgcctggcctcagagatgggtattttaaactggtgagttttactgccattacaaatctgaaaatacaacccaggccactcacagtgcattgaaaaataagcatttcaatttttgattttctttaaacaaaaaattaaaacaagcaaacaaaaacgcatccttgtaacctccagccttacaacctcctgactcagaacagtgttaatttcatacttaacaagagctaaggtgagtgtcagcaaagcaagtcgtgggcaaggtgctctactactggctttcctsgataatttgcactcacacgttcattcctctgctgctaagacttagctttcataattcaaactccgtatgtccccttctttaaattgctagcctatcagttatttcaatctcaagggtaagcaaacaaacctaaatcaccatttaaagttttgccacccatcaaccaataatcattttttcctagttgctgagttaattttttacatatattgcaccaatctagataagctggttaggttatcgacaatataaaaatgtttctttcctcctttggagtctgtaaattttgtccttgatatg

SEQ ID NO: 3014 - DNA, 601 bp, Human
gtctcccaaactcaagagagtagtggtgactctaataacagaaatgaaaacagcagacactggggagtagtcatgtaaatccacatggcaaagccaaggtgaactgcaccctgagaacacttcttccaacaaccactgtcacatcaacagatccgtgctctgtcttcatgtccctcttttctgtacgtctccctccttctactattgactttacatatctatctgaccctgtactgctccaagaggccctcctacattgagctattcaaatagcagattccatcattagccttacctttcratctggactttcgggcacatttagttcttgccttttggaccctcatcatgacctctgagttccaggttgagtcgtctttcctttgagtcaccttatccaccacttggagcttctcttggatgccatgcccaggtgaggctgcccctggaccaaatagacttgtgaatagtttagtgagctcccttctcatgttcccagcccctaccctttcaggagttatcttgccatttctctataattctctcttttcttgtgtgtatctttcttccccccagactcataatacttccttctatttct

SEQ ID NO: 3015 - DNA, 601 bp, Human
ggttaacaatcttcaagcattttttcctgtttttctaccagtttggagagacaagttacatatgagtccttatgaaaggacttccttgtagcattgactaaggaaatacagcaagctcatgttaataggcagaaaagctaaaaatactacagaagccaaatttccactaattaatatatgtcaatacatttactacaaatactagaataaagggatgtacaggagtccccccttatccacacggcatatgtttcaagccctccagtggatgcctgaaaccatgggtagtgcccacccctgyagatactatgtttcttcaatctgataaccaagacagctactaagtgactgatgggtgggctgcgtatacagcaggacacactggaccaagggatgattcgcatccccgagtgggatacagcaggatggtgcaagactttgtcacgctactcagaacagcgcatcatttttaacttataaattgtttatttctggaactttccatttaatattttcaaactgcagttgacttcaggtaactgaaatcatggatcaaaaaactgcttataaaggggggctactgtatggccttataaatatc

SEQ ID NO: 3016 - DNA, 601 bp, Human
acagaattaataatcacttatagctacaaacatagatttataagcctcataggttaacaatcttcaagcattttttcctgtttttctaccagtttggagagacaagttacatatgagtccttatgaaaggacttccttgtagcattgactaaggaaatacagcaagctcatgttaataggcagaaaagctaaaaatactacagaagccaaatttccactaattaatatatgtcaatacatttactacaaatactagaataaagggatgtacaggagtccccccttatccacacggcatatrtttcaagccctccagtggatgcctgaaaccatgggtagtgcccacccctgtagatactatgtttcttcaatctgataaccaagacagctactaagtgactgatgggtgggctgcgtatacagcaggacacactggaccaagggatgattcgcatccccgagtgggatacagcaggatggtgcaagactttgtcacgctactcagaacagcgcatcatttttaacttataaattgtttatttctggaactttccatttaatattttcaaactgcagttgacttcaggtaactgaaatcatg

SEQ ID NO: 3017 - DNA, 601 bp, Human
acacagaattaataatcacttatagctacaaacatagatttataagcctcataggttaacaatcttcaagcattttttcctgtttttctaccagtttggagagacaagttacatatgagtccttatgaaaggacttccttgtagcattgactaaggaaatacagcaagctcatgttaataggcagaaaagctaaaaatactacagaagccaaatttccactaattaatatatgtcaatacatttactacaaatactagaataaagggatgtacaggagtccccccttatccacacggcatrtgtttcaagccctccagtggatgcctgaaaccatgggtagtgcccacccctgtagatactatgtttcttcaatctgataaccaagacagctactaagtgactgatgggtgggctgcgtatacagcaggacacactggaccaagggatgattcgcatccccgagtgggatacagcaggatggtgcaagactttgtcacgctactcagaacagcgcatcatttttaacttataaattgtttatttctggaactttccatttaatattttcaaactgcagttgacttcaggtaactgaaatca

SEQ ID NO: 3018 - DNA, 601 bp, Human
ggagcaggagggagagcaccaggataaatagctaatgcatgttgggcttaatacctaggggatgggttgataggtgcagcaaaccaccatggcacacatttacctatgtaacaagcctgcacatcctgcacatgtatcctggaacttaaaataaatatttttaaaaaaggtgaggtctgagggtgtatagcaaagaaagggaggaagatagggggattcactttggggttgggtgggtgagctgggaggcccatgtgaggaggccctgagcaggaacaaggtgggagcattcggtatctgrtgacctatgctgtgaggaatcaggctggtgtgaccctagagacacgggtaggggtggtttatgggtgttggtgacatcctgtgtcttgagctgcgtgctgggtgtgcgggtgcattttctgtgtgtgtgaatccatcaagctgtactcttaggatacatgccattttctgcaagcacatacaccagtgctactcagtgctccagcctacgatgcgacaggggcttgatcagaatcaatgcactgctgtctccactgaggaatcttgctatgaaaacagtgtgcttagcgtcacagttggt

SEQ ID NO: 3019 - DNA, 601 bp, Human
agcacacactggggcctatcaggggagcaggagggagagcaccaggataaatagctaatgcatgttgggcttaatacctaggggatgggttgataggtgcagcaaaccaccatggcacacatttacctatgtaacaagcctgcacatcctgcacatgtatcctggaacttaaaataaatatttttaaaaaaggtgaggtctgagggtgtatagcaaagaaagggaggaagatagggggattcactttggggttgggtgggtgagctgggaggcccatgtgaggaggccctgagcaggaacraggtgggagcattcggtatctgatgacctatgctgtgaggaatcaggctggtgtgaccctagagacacgggtaggggtggtttatgggtgttggtgacatcctgtgtcttgagctgcgtgctgggtgtgcgggtgcattttctgtgtgtgtgaatccatcaagctgtactcttaggatacatgccattttctgcaagcacatacaccagtgctactcagtgctccagcctacgatgcgacaggggcttgatcagaatcaatgcactgctgtctccactgaggaatcttgctatgaaaaca

SEQ ID NO: 3020 - DNA, 601 bp, Human
gttctcacttataagtgggggttaaacaatgagaacacatggacacagggaggagaacagcacacactggggcctatcaggggagcaggagggagagcaccaggataaatagctaatgcatgttgggcttaatacctaggggatgggttgataggtgcagcaaaccaccatggcacacatttacctatgtaacaagcctgcacatcctgcacatgtatcctggaacttaaaataaatatttttaaaaaaggtgaggtctgagggtgtatagcaaagaaagggaggaagatagggggattcrctttggggttgggtgggtgagctgggaggcccatgtgaggaggccctgagcaggaacaaggtgggagcattcggtatctgatgacctatgctgtgaggaatcaggctggtgtgaccctagagacacgggtaggggtggtttatgggtgttggtgacatcctgtgtcttgagctgcgtgctgggtgtgcgggtgcattttctgtgtgtgtgaatccatcaagctgtactcttaggatacatgccattttctgcaagcacatacaccagtgctactcagtgctccagcctacgatgcgacag

SEQ ID NO: 3021 - DNA, 601 bp, Human
actaaacaccacatgttctcacttataagtgggggttaaacaatgagaacacatggacacagggaggagaacagcacacactggggcctatcaggggagcaggagggagagcaccaggataaatagctaatgcatgttgggcttaatacctaggggatgggttgataggtgcagcaaaccaccatggcacacatttacctatgtaacaagcctgcacatcctgcacatgtatcctggaacttaaaataaatatttttaaaaaaggtgaggtctgagggtgtatagcaaagaaagggaggargatagggggattcactttggggttgggtgggtgagctgggaggcccatgtgaggaggccctgagcaggaacaaggtgggagcattcggtatctgatgacctatgctgtgaggaatcaggctggtgtgaccctagagacacgggtaggggtggtttatgggtgttggtgacatcctgtgtcttgagctgcgtgctgggtgtgcgggtgcattttctgtgtgtgtgaatccatcaagctgtactcttaggatacatgccattttctgcaagcacatacaccagtgctactcagtgctccagc

SEQ ID NO: 3022 - DNA, 601 bp, Human
atatacctgcatgtgtatgttcaccgcagcactattcacaatagcaaagacatgggctcaacctaaatatccatcaattatagactggataaagaatatgtggtacatatacaccacggaatactatgcagccataaaaaggaacaaggtcatgtcctttgcaggggcatgattagagctggaagccattatcctcagcaaactaatgcaggaacggaaaactaaacaccacatgttctcacttataagtgggggttaaacaatgagaacacatggacacagggaggagaacagcacacaytggggcctatcaggggagcaggagggagagcaccaggataaatagctaatgcatgttgggcttaatacctaggggatgggttgataggtgcagcaaaccaccatggcacacatttacctatgtaacaagcctgcacatcctgcacatgtatcctggaacttaaaataaatatttttaaaaaaggtgaggtctgagggtgtatagcaaagaaagggaggaagatagggggattcactttggggttgggtgggtgagctgggaggcccatgtgaggaggccctgagcaggaacaaggtggga

SEQ ID NO: 3023 - DNA, 601 bp, Human
ccattactgggtatacacccaaaggaatataaatcattctattataaatatacctgcatgtgtatgttcaccgcagcactattcacaatagcaaagacatgggctcaacctaaatatccatcaattatagactggataaagaatatgtggtacatatacaccacggaatactatgcagccataaaaaggaacaaggtcatgtcctttgcaggggcatgattagagctggaagccattatcctcagcaaactaatgcaggaacggaaaactaaacaccacatgttctcacttataagtgggrgttaaacaatgagaacacatggacacagggaggagaacagcacacactggggcctatcaggggagcaggagggagagcaccaggataaatagctaatgcatgttgggcttaatacctaggggatgggttgataggtgcagcaaaccaccatggcacacatttacctatgtaacaagcctgcacatcctgcacatgtatcctggaacttaaaataaatatttttaaaaaaggtgaggtctgagggtgtatagcaaagaaagggaggaagatagggggattcactttggggttgggtgggtg

SEQ ID NO: 3024 - DNA, 601 bp, Human
ttcatcacagttaagataagtgccatgaagacaaaatgcaggtctccacaagggcatgtcagggagacccacccctacctgctgggagagagaatgcttccctgtggaagtgacatttaaggtgaggtctgagggcaaaggtctaatatccagaatttacaaggaacttaaacaaatttacaagaaaaaaacaaacaacacctttaaaaagtgggcaaaggacatgaacagacacttctcaaaagaagacatttatgcggccaataaagatatgaaaaaaagctccacatcactgagcatkagagagctgcaaatcaaaaccacaatgagataccatctcatgccagtcagaatggcgattattaaaaagttaagaaacaacagatgctggcaaggctgtggagaaataggaacacttttatactattggtgggaatgtaaattagtttaaccattgtgaaagacctcgaagcaattcctcaaagacctagaaccagaaataccatttgactcagcaagcaatcccattactgggtatacacccaaaggaatataaatcattctattataaatatacctgcatgtgtatgttcaccgcagc

SEQ ID NO: 3025 - DNA, 601 bp, Human
agtaccagctgtgtgaggcatggggagctggacatacagcaacacacaagacccatccacttactgacctcacgtgactttcacgcagtgaacaggctgtgcacagatcattcatcacagttaagataagtgccatgaagacaaaatgcaggtctccacaagggcatgtcagggagacccacccctacctgctgggagagagaatgcttccctgtggaagtgacatttaaggtgaggtctgagggcaaaggtctaatatccagaatttacaaggaacttaaacaaatttacaagaaaaaarcaaacaacacctttaaaaagtgggcaaaggacatgaacagacacttctcaaaagaagacatttatgcggccaataaagatatgaaaaaaagctccacatcactgagcattagagagctgcaaatcaaaaccacaatgagataccatctcatgccagtcagaatggcgattattaaaaagttaagaaacaacagatgctggcaaggctgtggagaaataggaacacttttatactattggtgggaatgtaaattagtttaaccattgtgaaagacctcgaagcaattcctcaaagacctag

SEQ ID NO: 3026 - DNA, 601 bp, Human
cagcagatgagagcgtggccttgggagccagactggggggcagggaggggtgggggtgggaggggcttgtaatcctggctctgcaacttactagaaggattacctaagcgtgcattactgttatcaaatttgagtgggaaatttgctgccgcaggttcctaatgtgagggaaaggcagagctccaggtgactctggaccactattgcaaaccttgagggagattagcacagctctggggaccttcccttctacagttctctgtctccacagaaatgtcttctctaattccctgtggtgaayatagctttagggaacacaaatgtcccaaacacattcacaagcagatgagggagcagggggtggctttgggggccacgggtagcaagctgatgtgcagagttgtgaggacaaacatcagtcccttccttacccagtggaggcaggccatcaagtgaggtggggcctttagacccgaggacttccaaagccaactgtcctatgcctgagggcagcctgttcctaatagtgctaagtctggctcagcctcacctactcatcttaccaaccaggccttgaaggatggaaccctgcagccccagg

SEQ ID NO: 3027 - DNA, 601 bp, Human
cttacggtgggaaaaactttgtttcaacagccagccctcttgcatggagtggccagctccaccatttgtctctagactcaactcagtaaatatggaacagcagatgagagcgtggccttgggagccagactggggggcagggaggggtgggggtgggaggggcttgtaatcctggctctgcaacttactagaaggattacctaagcgtgcattactgttatcaaatttgagtgggaaatttgctgccgcaggttcctaatgtgagggaaaggcagagctccaggtgactctggaccactaytgcaaaccttgagggagattagcacagctctggggaccttcccttctacagttctctgtctccacagaaatgtcttctctaattccctgtggtgaatatagctttagggaacacaaatgtcccaaacacattcacaagcagatgagggagcagggggtggctttgggggccacgggtagcaagctgatgtgcagagttgtgaggacaaacatcagtcccttccttacccagtggaggcaggccatcaagtgaggtggggcctttagacccgaggacttccaaagccaactgtcctatgcc

SEQ ID NO: 3028 - DNA, 601 bp, Human
acacaaggcagatagagtgagactgagagaggagggaccctgagaagtgaggatgtgatccccccgacagaaccctacaggatgcctggcctcacaggagcaggggctggcagcaaggctaggcatgggggtggagggtagtgggggtgtgggaacttacggtgggaaaaactttgtttcaacagccagccctcttgcatggagtggccagctccaccatttgtctctagactcaactcagtaaatatggaacagcagatgagagcgtggccttgggagccagactggggggcagggaggrgtgggggtgggaggggcttgtaatcctggctctgcaacttactagaaggattacctaagcgtgcattactgttatcaaatttgagtgggaaatttgctgccgcaggttcctaatgtgagggaaaggcagagctccaggtgactctggaccactattgcaaaccttgagggagattagcacagctctggggaccttcccttctacagttctctgtctccacagaaatgtcttctctaattccctgtggtgaatatagctttagggaacacaaatgtcccaaacacattcacaagcagatga

SEQ ID NO: 3029 - DNA, 601 bp, Human
agaaatccagagtttagattcaggggaagcagttgcaagagggtttaaaataaatctcagcaattcctgctgccttcccctccaacctcactatgggtgaattcattaaagagagacagcaggggctgtttctctggggagaaatgaaggggctgtccatgtcttatgttgagttacagaggatgttacacctaaaatgaatctaggagaacacctggtccaactctctcccttgcctcaaacagttattgaaagagctaaaggaaaacaaatggcaaaacaagagcattgacggaaaggkgaaggaacagtatcagcggcgaagaagccattcatttctctggaaagacacaaggcagatagagtgagactgagagaggagggaccctgagaagtgaggatgtgatccccccgacagaaccctacaggatgcctggcctcacaggagcaggggctggcagcaaggctaggcatgggggtggagggtagtgggggtgtgggaacttacggtgggaaaaactttgtttcaacagccagccctcttgcatggagtggccagctccaccatttgtctctagactcaactcagtaaatatggaac

SEQ ID NO: 3030 - DNA, 601 bp, Human
agtggaacatatagggcatcttcagtgaatgtgtcttaatttgcaagtgaattggctgtcactgaatagtcttctattctataagcatcctgctgatctctctgtgctgatggaaatgtttctttgcattcatgttgccagaggaaaaaaaaatcttcatttataatcttatttcctgactcaaatgaagacttgggtgagtgaggtggctggcactgaggggatggtgtcagtcttaattatttgctgtttcttttcattttattgcttccctgcttcttcctcgatgaataaaagaaarccctggagagctttgaactaatttcccagttgctcatggagcagtctggcaactcagaacccctgggtagaaatccagagtttagattcaggggaagcagttgcaagagggtttaaaataaatctcagcaattcctgctgccttcccctccaacctcactatgggtgaattcattaaagagagacagcaggggctgtttctctggggagaaatgaaggggctgtccatgtcttatgttgagttacagaggatgttacacctaaaatgaatctaggagaacacctggtccaactctctccc

SEQ ID NO: 3031 - DNA, 601 bp, Human
aaaaaaaaaacattttagtggaacatatagggcatcttcagtgaatgtgtcttaatttgcaagtgaattggctgtcactgaatagtcttctattctataagcatcctgctgatctctctgtgctgatggaaatgtttctttgcattcatgttgccagaggaaaaaaaaatcttcatttataatcttatttcctgactcaaatgaagacttgggtgagtgaggtggctggcactgaggggatggtgtcagtcttaattatttgctgtttcttttcattttattgcttccctgcttcttcctsgatgaataaaagaaaaccctggagagctttgaactaatttcccagttgctcatggagcagtctggcaactcagaacccctgggtagaaatccagagtttagattcaggggaagcagttgcaagagggtttaaaataaatctcagcaattcctgctgccttcccctccaacctcactatgggtgaattcattaaagagagacagcaggggctgtttctctggggagaaatgaaggggctgtccatgtcttatgttgagttacagaggatgttacacctaaaatgaatctaggagaacacct

SEQ ID NO: 3032 - DNA, 601 bp, Human
ccttaaagtagaagagaacagttttgtgttattcagtcttcactccatcttccttttgaattctcccctccatgaattccaataatgtacagggtattggggaacgttctctggttagtttgcaggaactctttcatctcgagtgacagataagctatgtgtacacagtggcctgcaacaaaccaccactgccaccaacactatatcaaaaaaaaaaaacattttagtggaacatatagggcatcttcagtgaatgtgtcttaatttgcaagtgaattggctgtcactgaatagtcttctmttctataagcatcctgctgatctctctgtgctgatggaaatgtttctttgcattcatgttgccagaggaaaaaaaaatcttcatttataatcttatttcctgactcaaatgaagacttgggtgagtgaggtggctggcactgaggggatggtgtcagtcttaattatttgctgtttcttttcattttattgcttccctgcttcttcctcgatgaataaaagaaaaccctggagagctttgaactaatttcccagttgctcatggagcagtctggcaactcagaacccctgggtagaaatc

SEQ ID NO: 3033 - DNA, 601 bp, Human
cttatataaaatccctttcgcctcaccacaggtcacggggagcttagaacagtgaaaatccacagtgtcacttttgggttttccttaaagtagaagagaacagttttgtgttattcagtcttcactccatcttccttttgaattctcccctccatgaattccaataatgtacagggtattggggaacgttctctggttagtttgcaggaactctttcatctcgagtgacagataagctatgtgtacacagtggcctgcaacaaaccaccactgccaccaacactatatcaaaaaaaaaaaacattttagtggaacatatagggcatcttcagtgaatgtgtcttaatttgcaagtgaattggctgtcactgaatagtcttctattctataagcatcctgctgatctctctgtgctgatggaaatgtttctttgcattcatgttgccagaggaaaaaaaaatcttcatttataatcttatttcctgactcaaatgaagacttgggtgagtgaggtggctggcactgaggggatggtgtcagtcttaattatttgctgtttcttttcattttattgcttccctgcttcttcctcgatgaataa

SEQ ID NO: 3034 - DNA, 601 bp, Human
ttcctctgtgaggtggaaggagtagcaggggagtctgcgggcctcttctcttggactgaagccagccctaaagcctgactgagtggtgaggggtgggacagaatgtgcattcgtgtagtgcctacatgcagcaaggacatggctgtcagtacagcagggcccatgggtgacttccaggtgggagtggagggtctgattgccagaaataccatgatgtggaagagtttggaaattccttcctaagaagcgtttcttctgcagtctagctagcagggtccatttcctgatcaattacacacaygggtattttcctcccttctagtgagtccttcatctagggattccaaagagcagaagaccaaggaactcaccgtgtttcattttcttcttatataaaatccctttcgcctcaccacaggtcacggggagcttagaacagtgaaaatccacagtgtcacttttgggttttccttaaagtagaagagaacagttttgtgttattcagtcttcactccatcttccttttgaattctcccctccatgaattccaataatgtacagggtattggggaacgttctctggttagtttgcaggaactct

SEQ ID NO: 3035 - DNA, 601 bp, Human
tagtttctttttaggttcttacatctctcttcacctcaaagccctttgccggcatttaaagttcctgtactcctttacttgcatttaaagttctccaccatcaggaacaatatgtgctcctaactttgtcacccacagttttttttctatgaacatttaactccttataaatcatgctgttgaatcctaacgggagctcttcacatttctgctcttaaagctccacttctccttcaaggatttaaacctgtcacctatctgtcccgtcattataataccttcagcagctctcctagggtcrttccttcacaacgtatattccgtttccagttctttgcgttccttccttttccttcgacttcaaattcatttggtgttaaccaagttccatcctcattccgaatgcacttcactgaggatcctgtaagaaaaagcccattcttggatctacccccatcctctgtgaattcaccctgaacctcttcatcctaattgtggccttctacctttccaggtcaagagagacttcctctgtgaggtggaaggagtagcaggggagtctgcgggcctcttctcttggactgaagccagccctaaagcc

SEQ ID NO: 3036 - DNA, 601 bp, Human
aggtttttcttttgtagatactggccttcccacttcctagtgaatgtctgtacccagacatcacactggatctcaaacccaagaagtcaaaaagaaaaattagctccctcccccagtcagtttttcttctggacctcacttagtgataaaatcactttttcccctgtcactcaaacccacgaccctagttcttctttcttaacctttcccatccattcctttctccttccatttctccctctctagattaaaatctttaggatttcatcctagtgataatttcttgagtgttgctgagagrggccttgtgttgggtcctgtcatcatagacactagttgttctcaggacaggaatagtgtgctgtggacatgcagcggagagacagaccacggactgggcagcctggaaatgctgcaggggggccagatgagctgggccttgagtagatgtcaggtagaggatgcaggggagtggttgcaggcatctgtcttcagctagtttctttttaggttcttacatctctcttcacctcaaagccctttgccggcatttaaagttcctgtactcctttacttgcatttaaagttctccaccatcagg

SEQ ID NO: 3037 - DNA, 601 bp, Human
accttgcacagtgctagtgaggaggctgggcatctcttctgagtcttcttccgcattcattttggatgttaacttgtcattggtcactgaaggaggaaaggaaattattacagattgcagggactggatgtcagggagaagagtgaatgttaaaagtgcctggggcagatagagcatcaaggcacaagggcagagggttggaatgtcccgggagtgggaagcaggtgttctggactctaggtcttacccaccccccggcagtgctcataatccctcttgaaaagggttgtgtttgggtagrtgggtgcaagagaagaactaggacaataaaagtcaagatgctgggattggcggcaacatggcacaggcaccttaggctgaggatatacaggtgttggatgggatctgtttctcacctgaagtgcttcttccttcctggatgagtgcagggagaggcaggacagggtcagatgggctgggcgactcactcaggatctcatcgctttgctgggaggatgttccaggctcactgactcttggcgcacagggtgaacagcttggttgagggggttgtggtgggggcagcgccagtggggtatgg

SEQ ID NO: 3038 - DNA, 601 bp, Human
gaggagaaaagagaatgctctattccaacaagtaaaaatgacggggtaacagcaaccaaggcctgggaaaggatggcatagagtgggaaagtaagcaaccattcactctcaattagccacttgttcttccattgctgttagcttcctgattatgttaacctttttggatggtaggtattagaggagtggatgcaatattatttggatcgaagaggacccctcttctcagtactggagagctcagaatccatggtatcatttttgacaatgcccaatatcataccattcttacgtttaatgyaatcaaactccattatgatgatggtttggggaggacaagtgatacaatttgagaagctaaatattaggtctagcagacctttaaacattttatcatcttttctagtaattttgataacattgttcttagaatccaaaccatataaaaatgaagaatgttgaaactctaaggcccccataatcaggtgggggtgaggaatcagctaagggtcactagtgtgagtgttacgcaggttacttgtcaattcagaatggtgttttggttgttggtttgttttgcattgctgcgttggtgaattgg

SEQ ID NO: 3039 - DNA, 601 bp, Human
accagaatgaggagaaaagagaatgctctattccaacaagtaaaaatgacggggtaacagcaaccaaggcctgggaaaggatggcatagagtgggaaagtaagcaaccattcactctcaattagccacttgttcttccattgctgttagcttcctgattatgttaacctttttggatggtaggtattagaggagtggatgcaatattatttggatcgaagaggacccctcttctcagtactggagagctcagaatccatggtatcatttttgacaatgcccaatatcataccattcttacrtttaatgtaatcaaactccattatgatgatggtttggggaggacaagtgatacaatttgagaagctaaatattaggtctagcagacctttaaacattttatcatcttttctagtaattttgataacattgttcttagaatccaaaccatataaaaatgaagaatgttgaaactctaaggcccccataatcaggtgggggtgaggaatcagctaagggtcactagtgtgagtgttacgcaggttacttgtcaattcagaatggtgttttggttgttggtttgttttgcattgctgcgttgg

SEQ ID NO: 3040 - DNA, 601 bp, Human
ccccagggactctgtatccattcagaggtcgggtctcctgcctgttcaagctcccaagtgctgggtgaactggaagctgggccaagattgctgagaggcaggaggagagccccctctctagaagatccgaatggcttttcctcttagtaaacacagaaacaaaggcaagcttttaggttgaccaaaccaagattacctggcatagagcccaagggagagtggggcatctcttgagggtcttctttatctcttatttgggggatcaggttgtcactggccactgaatggaggaagaaaaagktttagatctcaggaacagcaagcagggaccagaatgaggagaaaagagaatgctctattccaacaagtaaaaatgacggggtaacagcaaccaaggcctgggaaaggatggcatagagtgggaaagtaagcaaccattcactctcaattagccacttgttcttccattgctgttagcttcctgattatgttaacctttttggatggtaggtattagaggagtggatgcaatattatttggatcgaagaggacccctcttctcagtactggagagctcagaatccatggtatcatttttga

SEQ ID NO: 3041 - DNA, 601 bp, Human
aactgatcttgaattggcactcttctctgcatctccactgtcagatctgaatccaagccaccaagaactctcatggcatctgccccaaaatggctgccctgcctccattctttcccagctccaactcattctttacaccgtagcaaaattgagcttacattgtgtcacttcactgactaaatctcttcaatggcttcccattgcatttagaataaaattcaaccctccacagcttgacctacaagccctgcatgagctgtttccagcctccagcttcctcttgtactctcatcttacctcytgggaggctttttttcttatgtctcctttttggagttgaccagatacatctttttcttttctttcctaaaaagaaaggataatgttttatagttacaaacattgatctcccaatcttgtatgtcaatgatattcagcttttacttttggtcttcaaaccacattgctagaagttcattggtgaccttaggtgatggtacttcagggagtaataggggaagaaggactctaaaatgacagaggaaaaggagaaacgaagaaatagagacagggagtttaggtagctcatttctagaagttt

SEQ ID NO: 3042 - DNA, 601 bp, Human; identical to SEQ ID NO: 3014

SEQ ID NO: 3043 - DNA, 601 bp, Human; identical to SEQ ID NO: 3015

SEQ ID NO: 3044 - DNA, 601 bp, Human; identical to SEQ ID NO: 3016

SEQ ID NO: 3045 - DNA, 601 bp, Human; identical to SEQ ID NO: 3017

SEQ ID NO: 3046 - DNA, 601 bp, Human; identical to SEQ ID NO: 3018

SEQ ID NO: 3047 - DNA, 601 bp, Human; identical to SEQ ID NO: 3019

SEQ ID NO: 3048 - DNA, 601 bp, Human; identical to SEQ ID NO: 3020

SEQ ID NO: 3049 - DNA, 601 bp, Human; identical to SEQ ID NO: 3021

SEQ ID NO: 3050 - DNA, 601 bp, Human; identical to SEQ ID NO: 3022

SEQ ID NO: 3051 - DNA, 601 bp, Human; identical to SEQ ID NO: 3023

SEQ ID NO: 3052 - DNA, 601 bp, Human; identical to SEQ ID NO: 3024

SEQ ID NO: 3053 - DNA, 601 bp, Human; identical to SEQ ID NO: 3025

SEQ ID NO: 3054 - DNA, 601 bp, Human; identical to SEQ ID NO: 3026

SEQ ID NO: 3055 - DNA, 601 bp, Human; identical to SEQ ID NO: 3027

SEQ ID NO: 3056 - DNA, 601 bp, Human; identical to SEQ ID NO: 3028

SEQ ID NO: 3057 - DNA, 601 bp, Human; identical to SEQ ID NO: 3029

SEQ ID NO: 3058 - DNA, 601 bp, Human; identical to SEQ ID NO: 3030

SEQ ID NO: 3059 - DNA, 601 bp, Human; identical to SEQ ID NO: 3031

SEQ ID NO: 3060 - DNA, 601 bp, Human; identical to SEQ ID NO: 3032

SEQ ID NO: 3061 - DNA, 601 bp, Human; identical to SEQ ID NO: 3033

SEQ ID NO: 3062 - DNA, 601 bp, Human; identical to SEQ ID NO: 3034

SEQ ID NO: 3063 - DNA, 601 bp, Human; identical to SEQ ID NO: 3035

SEQ ID NO: 3064 - DNA, 601 bp, Human; identical to SEQ ID NO: 3036

SEQ ID NO: 3065 - DNA, 601 bp, Human
acacatctaagcaagtagaggaggttgaggagggggagttagtgcagccaatagatgactgccatttccagctgtagggatgccctgtagagacaaagctcagttcaaaggcgtcattccatcctggtgctaccaataagaagcatggaggattcagcaatactcagtatgcaatcatggatgatcctcttgtcctttcatatactgttcctgtctatttcaatgccttttcttttgcttttcatgctgcagcattcttttttttttttttctgagacagggtcttgctctgttgccccakctggagtgcagtggcatgatctcgcctcactgcaacctctgcctccagagctcaagtgatcctcccacctcagcctcctgagtagctgggactacaggtgcatgccaccatgcctggctaatttttgtatgttttgtaaagaaggggttttgtcctgttgcccaggctggtctcaaactcctgggctcaagggatccacccaccttggtctcccaaagtgctgggattacatcgctctgtatagcaatacagagtctcactatatcactcaggctggtcttgaactcctgggctcaagca

SEQ ID NO: 3066 - DNA, 601 bp, Human
aaataagtgcagttgattcttttggctattttttcactcatagacctacctacacgttcacataagcaacaatgggttccttccccacacgtcacaactagcattaagtgtcctgaagctctcctgaccacaaaaccatttggtggctttccattgattgaaggataactccatacttatgaatccatgtatttaaacaaatacctatatcaaaggtctaatattctataagaaaagtttaaaaaaaaaccattctgtagctgtatcagtttattctgcaatactgatagaacttgtgttygtccctaattttttgctattatgatgttacactgagcacccctgattctcagggtatttcagaccagcatgggaaagatgatttatataatagatggcattgggagaccagtgccttaaactttgaatgaatccagcctggtcaggccagcctccagggcaagatgggggaggcaccattgtctctgctggaagttcacaactaacgggaagctcatgagtggagctgatgtgtctggagaacacatctaagcaagtagaggaggttgaggagggggagttagtgcagccaatagatgac

SEQ ID NO: 3067 - DNA, 601 bp, Human
ttttctggttgcaaaagtaacaaatggtcattatagtaattccaattgtacataaaggtataatacagaaggcatatgtccctgtgatctcatctcaaaataagtgcagttgattcttttggctattttttcactcatagacctacctacacgttcacataagcaacaatgggttccttccccacacgtcacaactagcattaagtgtcctgaagctctcctgaccacaaaaccatttggtggctttccattgattgaaggataactccatacttatgaatccatgtatttaaacaaatayctatatcaaaggtctaatattctataagaaaagtttaaaaaaaaaccattctgtagctgtatcagtttattctgcaatactgatagaacttgtgttcgtccctaattttttgctattatgatgttacactgagcacccctgattctcagggtatttcagaccagcatgggaaagatgatttatataatagatggcattgggagaccagtgccttaaactttgaatgaatccagcctggtcaggccagcctccagggcaagatgggggaggcaccattgtctctgctggaagttcacaact

SEQ ID NO: 3068 - DNA, 601 bp, Human
gcctcacactatatgctgatagagtggcaactgctggctgcatccaagcccttctggagacggaggctctcacaggccaagtctgtggctctttacaccagctgcccatcatgtgtgggtcatggaggcagcacgctgcagggcaaccacaaaacacattttgggagtaccagcatcggtctctttgttgtacacatacataagtgagactgcagtggagacagacggacgtgctgccgagcagcagtgacactggatgatggggctgagggcaaggcccacactggctcattctcagtcrggtaaaccttcatcttattctcccaacctggccctggaaggtgggactgagaggctgggtcaagcatgcccctggctattatgagctgacatgtggcattaggagagttagagggtattaccatgttggggctattaattaatgatctggattttaaagatttttttttttctggttgcaaaagtaacaaatggtcattatagtaattccaattgtacataaaggtataatacagaaggcatatgtccctgtgatctcatctcaaaataagtgcagttgattcttttggctattttttca

SEQ ID NO: 3069 - DNA, 601 bp, Human
cccaaaagctgttctcctcagcctcacactatatgctgatagagtggcaactgctggctgcatccaagcccttctggagacggaggctctcacaggccaagtctgtggctctttacaccagctgcccatcatgtgtgggtcatggaggcagcacgctgcagggcaaccacaaaacacattttgggagtaccagcatcggtctctttgttgtacacatacataagtgagactgcagtggagacagacggacgtgctgccgagcagcagtgacactggatgatggggctgagggcaaggcccrcactggctcattctcagtcaggtaaaccttcatcttattctcccaacctggccctggaaggtgggactgagaggctgggtcaagcatgcccctggctattatgagctgacatgtggcattaggagagttagagggtattaccatgttggggctattaattaatgatctggattttaaagatttttttttttctggttgcaaaagtaacaaatggtcattatagtaattccaattgtacataaaggtataatacagaaggcatatgtccctgtgatctcatctcaaaataagtgcagttga

SEQ ID NO: 3070 - DNA, 601 bp, Human
gtagattttaggtaagcccatttacgctgttacttgcaaaataagcccactttgaatggggccccttctaacaaaaggttctagaatctgtcaaattgcaatacagcagacattagtgccctcctgagtctcattcactgtggaagctttggcaacctcctctcatgcctcctggcatctctggaccacccatgatggccatgggcttctgatacaaaaaaaaaccaaaaccccaaaagctgttctcctcagcctcacactatatgctgatagagtggcaactgctggctgcatccaagcmcttctggagacggaggctctcacaggccaagtctgtggctctttacaccagctgcccatcatgtgtgggtcatggaggcagcacgctgcagggcaaccacaaaacacattttgggagtaccagcatcggtctctttgttgtacacatacataagtgagactgcagtggagacagacggacgtgctgccgagcagcagtgacactggatgatggggctgagggcaaggcccacactggctcattctcagtcaggtaaaccttcatcttattctcccaacctggccctggaaggtgggactg

SEQ ID NO: 3071 - DNA, 601 bp, Human
gagtactcacagtgttctaataaacctcccagcatccttcaggcctcttgagttcaaggaaacacatccttcatttgtagattttaggtaagcccatttacgctgttacttgcaaaataagcccactttgaatggggccccttctaacaaaaggttctagaatctgtcaaattgcaatacagcagacattagtgccctcctgagtctcattcactgtggaagctttggcaacctcctctcatgcctcctggcatctctggaccacccatgatggccatgggcttctgatacaaaaaaaaamcaaaaccccaaaagctgttctcctcagcctcacactatatgctgatagagtggcaactgctggctgcatccaagcccttctggagacggaggctctcacaggccaagtctgtggctctttacaccagctgcccatcatgtgtgggtcatggaggcagcacgctgcagggcaaccacaaaacacattttgggagtaccagcatcggtctctttgttgtacacatacataagtgagactgcagtggagacagacggacgtgctgccgagcagcagtgacactggatgatggggctgagggca

SEQ ID NO: 3072 - DNA, 601 bp, Human
ggacacaatagaccgttatctggctaccacggggtacctcgacagttctgccaccatacacaatctttgcaggcaggatttgaactgcatctgacattctctaggagtacaggtgtaacatcaccctgaagacacccttctttcagcaaattcatttgacacactcaggacattactcacaaagaactcatagaaaaggatggggtttgtgtttccacatggtgggattaaactaaaacaaaaaagtatgggccactgccccaggcatagtacagggatccacaccaatttctggccattrtctggtcagttgagggatgctccatccctgacactgtcaaaaaataattattgaccctctgagtactcacagtgttctaataaacctcccagcatccttcaggcctcttgagttcaaggaaacacatccttcatttgtagattttaggtaagcccatttacgctgttacttgcaaaataagcccactttgaatggggccccttctaacaaaaggttctagaatctgtcaaattgcaatacagcagacattagtgccctcctgagtctcattcactgtggaagctttggcaacctcctctc

SEQ ID NO: 3073 - DNA, 601 bp, Human
ttagagaaagggtgattatccccactgtttctccatttaacagcccaatttggtctgttcttaggcttggaaagaatgaatggtgcctctcggtgaattactacaacctgaatcctgtgaccccacctgtgatggcccaatgttattgaaattactgactccatccacttagcaagtggtaaatactctgcaggcatagatttgactaatgtgttctgttcagcgcctatttcaacagatctcagctgcaggttgctttcacccccgaagggacacaatagaccgttatctggctaccacrgggtacctcgacagttctgccaccatacacaatctttgcaggcaggatttgaactgcatctgacattctctaggagtacaggtgtaacatcaccctgaagacacccttctttcagcaaattcatttgacacactcaggacattactcacaaagaactcatagaaaaggatggggtttgtgtttccacatggtgggattaaactaaaacaaaaaagtatgggccactgccccaggcatagtacagggatccacaccaatttctggccattgtctggtcagttgagggatgctccatccctg

SEQ ID NO: 3074 - DNA, 601 bp, Human
tgcctaactgccccatggtcgtaacataacatggccctaaaatgttccacagtgggcgtggatgctgtgacccagtaaataacacattaaaataattaaaattaagttacctttggcacttacaattggctttacaaaatggaactctatggaccttctctgttaaaatatttaatactgatcaatatgaattaaaacacggctttcaaggattgaaactcattatggaagatctatttagagaaagggtgattatccccactgtttctccatttaacagcccaatttggtctgttcttargcttggaaagaatgaatggtgcctctcggtgaattactacaacctgaatcctgtgaccccacctgtgatggcccaatgttattgaaattactgactccatccacttagcaagtggtaaatactctgcaggcatagatttgactaatgtgttctgttcagcgcctatttcaacagatctcagctgcaggttgctttcacccccgaagggacacaatagaccgttatctggctaccacggggtacctcgacagttctgccaccatacacaatctttgcaggcaggatttgaactgcatctga

SEQ ID NO: 3075 - DNA, 601 bp, Human
cccgaggcggggctgcatcccactcacctcttggcttccacaggggggatgtgacagtcctcatggaagactcgtggacaagtaccgcagcagagaagttgtcccccttgacagcacacctcgcattcatccgagtttttccgctgcaagggcagataacgtgggcaccgctaggaccatggagacccacgaatgctgaccctgtggggttctagaacacatcatttttgtgtgtgccagagtggatatccaaacccaatttttgatggggggagctgatgccacctccctgggggaaatygcaagacaaatggcacaacaagcagagagtctgggtggtgaccgccgccaccaggacttttcttctctggctgtggcttgccaacaggttctgctgcgttttgagctgtgctgctgcctgctggcaagcttgtgctttgagctgggccactctgggcgcatttgctgagcccaccaggcctctattaatagatctaactgaccaaagtaagaaatgatgataactggcatttgggtgcaggagtatgggaactgttgttcctggtgccttgcctaactgccccatggtcgtaacataaca

SEQ ID NO: 3076 - DNA, 601 bp, Human
ggaggaactcacatttctgtaaaatgtgaagagggcttgaaagtgaaatgcagcttagaaacagtgaagccaggcgagtgtctagacatgcacacggatggggcagccaagcccagtcagcattccagccatgcttcccaaggcgcacagggtgtgtgggattttgtttagactctgagtttgggcattaaatcgtcatcctttaaagggagacattgaaggctccctttggtacattgccctgaccctgtgcctgtttgtgcttctcgtgtgagaagggaaaagtataggtttggggttygcatccaactcaccagctggtcctgaggctgcatctgcctctccagggtcttagatacatgatggcactgttggcttcctgaagacctcttcatcctacagaaggtgcaactccacagcatcctgagaggttggacacaaggtgagcagagggcaaagcccctggaaatggccaccattcctgtggctgccactgtcttccctcaggaaggatgggctcagccatgagggtgggacacctcccagagtgtccaagatccccacatggggtctccagcattggcccttccctcgcatcagt

SEQ ID NO: 3077 - DNA, 601 bp, Human
gtaggccttcaagaggaggaactcacatttctgtaaaatgtgaagagggcttgaaagtgaaatgcagcttagaaacagtgaagccaggcgagtgtctagacatgcacacggatggggcagccaagcccagtcagcattccagccatgcttcccaaggcgcacagggtgtgtgggattttgtttagactctgagtttgggcattaaatcgtcatcctttaaagggagacattgaaggctccctttggtacattgccctgaccctgtgcctgtttgtgcttctcgtgtgagaagggaaaagtrtaggtttggggtttgcatccaactcaccagctggtcctgaggctgcatctgcctctccagggtcttagatacatgatggcactgttggcttcctgaagacctcttcatcctacagaaggtgcaactccacagcatcctgagaggttggacacaaggtgagcagagggcaaagcccctggaaatggccaccattcctgtggctgccactgtcttccctcaggaaggatgggctcagccatgagggtgggacacctcccagagtgtccaagatccccacatggggtctccagcattggccct

SEQ ID NO: 3078 - DNA, 601 bp, Human
ttggccaagctggtctcaaactcctgacttcaagtgatctgcccgccttggcctcccaaagtgctgggattacaggcgtgagccgctgagcccagctggcatctgtgactcttaatctctagtaggaaagacattcttcctaaagagaagatgaaacagatacacaggaggagaagcaacttgcccggtatcccagagcccgtgagcagtggggtggagtttgaaccaggtagtccctctccagagtgtgcagcaaaatccctgctgccccgctccactgctgccacgctgcccttctctyctgttctccagcttcctgagcaaactgcagcacctgccagatcagcccccaaatttctccaaatgcattttatgcaagagaaccgtaaaatgtgacttacattaaatgggatgcccgtaaaaaaggagctttgtggatgacagtaggccttcaagaggaggaactcacatttctgtaaaatgtgaagagggcttgaaagtgaaatgcagcttagaaacagtgaagccaggcgagtgtctagacatgcacacggatggggcagccaagcccagtcagcattccagccatgcttcccaaggc

SEQ ID NO: 3079 - DNA, 601 bp, Human
ggggttttgccatgttggccaagctggtctcaaactcctgacttcaagtgatctgcccgccttggcctcccaaagtgctgggattacaggcgtgagccgctgagcccagctggcatctgtgactcttaatctctagtaggaaagacattcttcctaaagagaagatgaaacagatacacaggaggagaagcaacttgcccggtatcccagagcccgtgagcagtggggtggagtttgaaccaggtagtccctctccagagtgtgcagcaaaatccctgctgccccgctccactgctgccaygctgcccttctctcctgttctccagcttcctgagcaaactgcagcacctgccagatcagcccccaaatttctccaaatgcattttatgcaagagaaccgtaaaatgtgacttacattaaatgggatgcccgtaaaaaaggagctttgtggatgacagtaggccttcaagaggaggaactcacatttctgtaaaatgtgaagagggcttgaaagtgaaatgcagcttagaaacagtgaagccaggcgagtgtctagacatgcacacggatggggcagccaagcccagtcagcattccagcc

SEQ ID NO: 3080 - DNA, 601 bp, Human
atttcatagatgaggaaaccgagggatggagaggtcaaggaacctacccaagatgtctcagcaagaaagtggtagagctgagatgggaacccacacagtttggcatctatgactcttttttttcttttgagatggagtcttgctttgtcacccaggctggagtgcagtggtgcgatcttggctcaccgcaacctctgcctcctgggttcaagcgattctcctgcctcagcctcctgagtagctgggattagaggtgcctgccaccatgcctggctaattttgtatttttagtagagatggsgttttgccatgttggccaagctggtctcaaactcctgacttcaagtgatctgcccgccttggcctcccaaagtgctgggattacaggcgtgagccgctgagcccagctggcatctgtgactcttaatctctagtaggaaagacattcttcctaaagagaagatgaaacagatacacaggaggagaagcaacttgcccggtatcccagagcccgtgagcagtggggtggagtttgaaccaggtagtccctctccagagtgtgcagcaaaatccctgctgccccgctccactgctgccacgc

SEQ ID NO: 3081 - DNA, 601 bp, Human
atgtaatctccacatttatgggtaccataaataataatgcccatttcatagatgaggaaaccgagggatggagaggtcaaggaacctacccaagatgtctcagcaagaaagtggtagagctgagatgggaacccacacagtttggcatctatgactcttttttttcttttgagatggagtcttgctttgtcacccaggctggagtgcagtggtgcgatcttggctcaccgcaacctctgcctcctgggttcaagcgattctcctgcctcagcctcctgagtagctgggattagaggtgccygccaccatgcctggctaattttgtatttttagtagagatggggttttgccatgttggccaagctggtctcaaactcctgacttcaagtgatctgcccgccttggcctcccaaagtgctgggattacaggcgtgagccgctgagcccagctggcatctgtgactcttaatctctagtaggaaagacattcttcctaaagagaagatgaaacagatacacaggaggagaagcaacttgcccggtatcccagagcccgtgagcagtggggtggagtttgaaccaggtagtccctctccagagt

SEQ ID NO: 3082 - DNA, 601 bp, Human
tttaagccagctattgttctaggcactagataaactaaattctaagccaagtatatgaatatgtaatctccacatttatgggtaccataaataataatgcccatttcatagatgaggaaaccgagggatggagaggtcaaggaacctacccaagatgtctcagcaagaaagtggtagagctgagatgggaacccacacagtttggcatctatgactcttttttttcttttgagatggagtcttgctttgtcacccaggctggagtgcagtggtgcgatcttggctcaccgcaacctctgcytcctgggttcaagcgattctcctgcctcagcctcctgagtagctgggattagaggtgcctgccaccatgcctggctaattttgtatttttagtagagatggggttttgccatgttggccaagctggtctcaaactcctgacttcaagtgatctgcccgccttggcctcccaaagtgctgggattacaggcgtgagccgctgagcccagctggcatctgtgactcttaatctctagtaggaaagacattcttcctaaagagaagatgaaacagatacacaggaggagaagcaacttgcccg

SEQ ID NO: 3083 - DNA, 601 bp, Human
tgcttcctgaaagggctcaccgtaatctcgaatcttggggacaaagccaccagaggtgacgttagcacagctgtcatcactggaatggatccaacttaaatacaatccaagccttcatttccagggtcataatgataataccatttgacctctttaagccagctattgttctaggcactagataaactaaattctaagccaagtatatgaatatgtaatctccacatttatgggtaccataaataataatgcccatttcatagatgaggaaaccgagggatggagaggtcaaggaacctayccaagatgtctcagcaagaaagtggtagagctgagatgggaacccacacagtttggcatctatgactcttttttttcttttgagatggagtcttgctttgtcacccaggctggagtgcagtggtgcgatcttggctcaccgcaacctctgcctcctgggttcaagcgattctcctgcctcagcctcctgagtagctgggattagaggtgcctgccaccatgcctggctaattttgtatttttagtagagatggggttttgccatgttggccaagctggtctcaaactcctgacttcaagt

SEQ ID NO: 3084 - DNA, 601 bp, Human
tctcaagcatatcctggcctacaacatcaatatcattcacatcgacttctagacagggaatcttgtactgctttggagaaagtttccaatagccagtactaaggtctggtgatgccctgcgctgcatatccatatagctctttacattatcctctttttcagctaaatttcgctcccattcattcataggttcaaaggcagaagcatagtcctgatctatagttggcacctgtgatttgtcaaaacatgtttccagaactgaaaaatgtgctctgggtgatgtcttatttcctcgtattgrgaagtggatgctcctcaacaatgacaagctttctgggtggtcgaaaaagtactgtaagttaagcgcacccaaagtcagtgttctcccttgaaggaattgcaaaacaaatggagaacacgcagcaacagtgttgctttgataagcagttttcagggcaagaaccagtaaatgttctgaaaccattgaaaagtaagcttgtggacaaatttgccacaatcccctaagtaactgcatctgcagtgaaatttctggctggtgctttaagtagtcatcattttcagatatattctccaatgactc

SEQ ID NO: 3085 - DNA, 601 bp, Human
ttgaccaccaaacttcgttgtgtcagacaggatcaatgtctgctggtctgctgcaactctgtactcatttatctctggggaggcctgaagccttggtgctgttccttggccaaacctaaatgaaatgtactagccagtgattaatagagtcctgtgctggggtgggagacagaccagggagcagcctgtttcttgcttctttctttctttttggagatgaaatctcattggctttgaacttctgggctcaagtgatcctcccacttcagcctcccaagtagctgggattacaggtgcatgycactgccccagcttgactataccagcttgtttctggttttgagccctggtatgcaagctagtgttggctacctgatcagaggagtataaaagagcctcagatgaggttacagttctcttgagaccaaggtgtcttgcatgtatcatctagctggttcattgcttaaagatgaagcacatcttccacatcctctgtggctgcaaaaggaccctaggaactgggtgtggtgtttcacttgccttttggtttgttgggttttttttttttttgtatctatcctttacctttattaaagcctta

SEQ ID NO: 3086 - DNA, 601 bp, Human
cttttaaaaaaattattttgtagagctggagtcttaccatgttgcccaggctggtctcgaactcctgggctcaagtgatttgcctgccttggcctcccaaagtggtgggattacaggtgtgagcaactgcgcctggccccaggtttttttttttctttttttttttcgagacagggtctcacactgttgcccaggctgtagtgcagtggcactgaagcctgaaacctctgcctcctgggttcaaacagttcttgtgcctcagccacccgagtagctgggattacaggcatgcaccaccacrcccggctaatttgtttgtatttttagtagagatggggtttcgccatgttggccaggctggtcttgaactcctgaactcaagtgatccgcccgtcccagcctcccgaagttctgggattacaggtgtgagccactgcgcctggccccccagttttttactttataatttaaatgatagctaaggctttgtttgggagaaagatgaaaagtggggaaagatttagagccactggtgccaggctagttgctggggaatccctgtttgaatttgctgaagtgctacaactctcaatgggaagaa

SEQ ID NO: 3087 - DNA, 601 bp, Human
catgttgcccaggctggtctcgaactcctgggctcaagtgatttgcctgccttggcctcccaaagtggtgggattacaggtgtgagcaactgcgcctggccccaggtttttttttttctttttttttttcgagacagggtctcacactgttgcccaggctgtagtgcagtggcactgaagcctgaaacctctgcctcctgggttcaaacagttcttgtgcctcagccacccgagtagctgggattacaggcatgcaccaccacgcccggctaatttgtttgtatttttagtagagatgggktttcgccatgttggccaggctggtcttgaactcctgaactcaagtgatccgcccgtcccagcctcccgaagttctgggattacaggtgtgagccactgcgcctggccccccagttttttactttataatttaaatgatagctaaggctttgtttgggagaaagatgaaaagtggggaaagatttagagccactggtgccaggctagttgctggggaatccctgtttgaatttgctgaagtgctacaactctcaatgggaagaaagggatgacaatggaacttgaaggtggttgatgcaga

SEQ ID NO: 3088 - DNA, 601 bp, Human
aagttaagagggaatggggagctaatttacatggggctttgaaaaatgaacaaatgggagactttttgggaacttcgaagagattactttggggccatagcacctcagtgttcaaatgatgttagcaatgtcagcaaccgactcacgctgatggagcttcttaccaaagcccgtgactgcccctcagggatggtcatggggatttgacactagaaagttacccgaggcttctggcaggtatatgtcctttgaaaaacagtcattggcctgttactgagcttctttttttttttttttttttaagacggagtcttgctctgtcacccaggctggagtaccgtggcgcgatctcggctcgctgcaagctccacctcctgggttcacgccattctcctgcctcagcctcccgagtagctgggactacaggcgcccgccaccacgcccggctaattttttttgtagttttagtagagatggggtttcaccttgttagccaggatgttctccatctcctgacctcgtgatccacctgcctcggcctcccaaagtgctgggattacaggcgtgagccaccgcgcccggccagagcaccgagacttaa

SEQ ID NO: 3089 - DNA, 601 bp, Human
tactttatgctaggcatagagtgagtactaattcttatccaatgaatttacccctttctctcccatttcacagctgagttcatggaggctcagagactttaagaaacatgcctatgtttctaccgaaatgtcatggcaaggctaaaacgtaggttttctaattgcacgttacttcagctggtcctggtgttagtcggcttccctatcactttgaccctgagagctcaaagagcaacataccagctctggggggcagctggggcaggatattgagttacacagcttagggttctgtacctaragcacggctgtggtggaggggcccattttgggtggtgggattgaggatggagactcaggccaatgagatcgggagtgcacagccacgctggagcttgtcttgctcctgaacaaaacaatcaactctgtgtacataccccctggtgccactgccaggcaatctaaatattttccttcatatataggtaaacaggacacggtacagtgtttttcctgtggtggatgtttaggaaattgggaagaaggagatgatccttggaaggaacatgccaaatggttccccaagtaagtagataatttt

SEQ ID NO: 3090 - DNA, 601 bp, Human
ggagatgatccttggaaggaacatgccaaatggttccccaagtaagtagataatttttgcttaaatgtttctttcttttttttttgagacagtcttgctctgccacccaggctggagtatagtggcatgacttcagctcggtgcaaattctccctccctggttcaggtgattctcctgcctcagccttctgagtagctgggattataggtgtgcaccaccaagatgggctaatgtttgtatttttagcagagatggggttttgccatgttgcccaggctggtcttgagctcctgagctcargcagtccacccacctaggcctcccgaagtgctaggattacaggcgtgagccactgtgcctggctaaatttttcagttctttaaaagacaaaatgaaagacaaaagagccacctttctggagtagcaccttcagttttgatctttccctattcaaaattggaccactccaggatttattcaagcaggaaaggcctaattacattgtgaaaagtttgaattatagaattttaaacagtttttaagtatttcattatcccaaattctaagataggttttgcccagtagaagtttcatgatctg

SEQ ID NO: 3091 - DNA, 601 bp, Human
tattttctttaacaaatatttgtcacacacctactacatgcaaagttgttggttggatactaaattaactacaaaactggacacagttatttacatttataagtcatcttgcacatggacagccatgcccacaaaagtgaatggaggcccggcatggtggctcatgcctgtaatcccagcactttgggaggctaaggtaggcggatcatttgatgtcagtagttcaagaccagcctggctaacatggtaaaaccctgtctctattaaaaatacaaaaattggccaggcgtggtggcaggcrcctgtaatcccagctacttgggaggctgaggcaggagaattgcttgagcccgggaggcagaggttgcagtgagctgagatcgcaccactgcactccagcctggtcaacacagcgagactccatctcaaaaaaaaaaaaaaaaaaaaaggctgggcacagtggctcacacctgtgatcccagcactttgggaggccaaggcgggcaaatcacttgaggccaggagttcattcaagtgatgaactctcctctcccctcttccctctctcctctctcctctcctatctcccctcttccctggc

SEQ ID NO: 3092 - DNA, 601 bp, Human
ttaacaaatatttgtcacacacctactacatgcaaagttgttggttggatactaaattaactacaaaactggacacagttatttacatttataagtcatcttgcacatggacagccatgcccacaaaagtgaatggaggcccggcatggtggctcatgcctgtaatcccagcactttgggaggctaaggtaggcggatcatttgatgtcagtagttcaagaccagcctggctaacatggtaaaaccctgtctctattaaaaatacaaaaattggccaggcgtggtggcaggcgcctgtaaycccagctacttgggaggctgaggcaggagaattgcttgagcccgggaggcagaggttgcagtgagctgagatcgcaccactgcactccagcctggtcaacacagcgagactccatctcaaaaaaaaaaaaaaaaaaaaaggctgggcacagtggctcacacctgtgatcccagcactttgggaggccaaggcgggcaaatcacttgaggccaggagttcattcaagtgatgaactctcctctcccctcttccctctctcctctctcctctcctatctcccctcttccctggccaacatgg

SEQ ID NO: 3093 - DNA, 601 bp, Human
caggagttcattcaagtgatgaactctcctctcccctcttccctctctcctctctcctctcctatctcccctcttccctggccaacatggtgaaaccccatctctactaaaaatacaaaaatgagccgagcgtggtggtgcgtgcctatggttccagctactcgggaggctgaggcaagaaattgcttgaacctgggaggcggaggttgcagtgagccaagatcactccactgcacagcagcctgggcaacagagtgagactccatctcaaaagaaaaaaaaagtgaatggatatctttgrtatgttttgatacgttgtgtgggaaagcaatatgcacaataagtgcagtgtgagactttgaaaatgtttaaaaccactcaaactatatatggagttgcttgaaaatatatagaaaaccttatgaaaatatgtaaaccaaactgtagatacttctggatctggatttgtcagggggtgaagtagtgatggattttcacatttattttgttcattgctgtcttgtttaaatttttggaaacaagtatatattactttcatagttgaaaagaaagtgaggagattaggagggaggaagtaaac

SEQ ID NO: 3094 - DNA, 601 bp, Human
ggagttgcttgaaaatatatagaaaaccttatgaaaatatgtaaaccaaactgtagatacttctggatctggatttgtcagggggtgaagtagtgatggattttcacatttattttgttcattgctgtcttgtttaaatttttggaaacaagtatatattactttcatagttgaaaagaaagtgaggagattaggagggaggaagtaaacaagggaggagaggagaaaggcaggaagaggagagagagaaagttagacaagtagatgagatggttatagggacgaatgaagctagaattgwgaaatcatttgacagtcactctggctccctgacgaatcaaaacagccacccaggcagtccttgtccatgctgacagtgcaccatatatgcatatgtaacagggaacagcagccccggctggagcacaagccgctgctcgtgggcacctgtctcagctctagcctcagctcaggcttcacttagcctcagggtcactgtgtttagtgtcgctgggttatacactggacaagtaccagtggcaccactcacacatgatcacattatcatgtgactagcacctactagagccgcacatcctgt

SEQ ID NO: 3095 - DNA, 601 bp, Human
atcatttgacagtcactctggctccctgacgaatcaaaacagccacccaggcagtccttgtccatgctgacagtgcaccatatatgcatatgtaacagggaacagcagccccggctggagcacaagccgctgctcgtgggcacctgtctcagctctagcctcagctcaggcttcacttagcctcagggtcactgtgtttagtgtcgctgggttatacactggacaagtaccagtggcaccactcacacatgatcacattatcatgtgactagcacctactagagccgcacatcctgtctgsaggggccttcatatgccttctctaacatagtcagagggtaaggtaataagcacagggaggggagacagcagtccagcaaccactcctagagaggaaggagttcaggccagcaaacaagggcagggggtagtgcagaggcttaggagatagagccaggcttgaatctgctgctacctgactaccagaccctaggcaggtgactgaccttgtctgaatctcatatgtaaaatgcagtgtcaacaacaacaaaaaaattagagacagatatccccaaatatgtcaaatttattcaggaataag

SEQ ID NO: 3096 - DNA, 601 bp, Human
ggaagagtaaagggaatttttcttggcaaaagggagaagttcacataagctgcttagaaacagagttcatagctgggcatggtagctcatacgtgtaatcacagctatgtgggaggctgaggcgggagggtctttggaggccaggagtttgagaccagcctgggcaatgtgatgaggctccagtttctttagagagagaggagagaggggagaggggagaggagagagaagacaggggacgggggagaggggagaggagagagggcagaagagaattccttggttctgaaggctcaaagctagagttcttgtgtgttcattggtggagatgctgttcctgggcaggtgttcttttgacagcatctcatctcatgttatcttatctgaattgctgcagtccaaaagaatgtgcagtgataaaccttgccatagaaatatgtgcgtacatgcaagcaatgcaaagcaggagatgcgtgacaggcgtgaagggatttcttatgggattcttagaaagtctttggaaccgttcctgtcttggacatgaaagcctgaaccccactccttcgtgccttcccagccctattttgtgtgggtctgataa

SEQ ID NO: 3097 - DNA, 601 bp, Human
gaagagtaaagggaatttttcttggcaaaagggagaagttcacataagctgcttagaaacagagttcatagctgggcatggtagctcatacgtgtaatcacagctatgtgggaggctgaggcgggagggtctttggaggccaggagtttgagaccagcctgggcaatgtgatgaggctccagtttctttagagagagaggagagaggggagaggggagaggagagagaagacaggggacgggggagaggggagaggagagagggcagaagagaattccttggttctgaaggctcaaagccwgagttcttgtgtgttcattggtggagatgctgttcctgggcaggtgttcttttgacagcatctcatctcatgttatcttatctgaattgctgcagtccaaaagaatgtgcagtgataaaccttgccatagaaatatgtgcgtacatgcaagcaatgcaaagcaggagatgcgtgacaggcgtgaagggatttcttatgggattcttagaaagtctttggaaccgttcctgtcttggacatgaaagcctgaaccccactccttcgtgccttcccagccctattttgtgtgggtctgataaa

SEQ ID NO: 3098 - DNA, 601 bp, Human
agagtaaagggaatttttcttggcaaaagggagaagttcacataagctgcttagaaacagagttcatagctgggcatggtagctcatacgtgtaatcacagctatgtgggaggctgaggcgggagggtctttggaggccaggagtttgagaccagcctgggcaatgtgatgaggctccagtttctttagagagagaggagagaggggagaggggagaggagagagaagacaggggacgggggagaggggagaggagagagggcagaagagaattccttggttctgaaggctcaaagccagwgttcttgtgtgttcattggtggagatgctgttcctgggcaggtgttcttttgacagcatctcatctcatgttatcttatctgaattgctgcagtccaaaagaatgtgcagtgataaaccttgccatagaaatatgtgcgtacatgcaagcaatgcaaagcaggagatgcgtgacaggcgtgaagggatttcttatgggattcttagaaagtctttggaaccgttcctgtcttggacatgaaagcctgaaccccactccttcgtgccttcccagccctattttgtgtgggtctgataaaag

SEQ ID NO: 3099 - DNA, 601 bp, Human
gagtaaagggaatttttcttggcaaaagggagaagttcacataagctgcttagaaacagagttcatagctgggcatggtagctcatacgtgtaatcacagctatgtgggaggctgaggcgggagggtctttggaggccaggagtttgagaccagcctgggcaatgtgatgaggctccagtttctttagagagagaggagagaggggagaggggagaggagagagaagacaggggacgggggagaggggagaggagagagggcagaagagaattccttggttctgaaggctcaaagccagatttcttgtgtgttcattggtggagatgctgttcctgggcaggtgttcttttgacagcatctcatctcatgttatcttatctgaattgctgcagtccaaaagaatgtgcagtgataaaccttgccatagaaatatgtgcgtacatgcaagcaatgcaaagcaggagatgcgtgacaggcgtgaagggatttcttatgggattcttagaaagtctttggaaccgttcctgtcttggacatgaaagcctgaaccccactccttcgtgccttcccagccctattttgtgtgggtctgataaaagt

SEQ ID NO: 3100 - DNA, 601 bp, Human
ctggaattagagcaagaatccccaagtttcttgttgggttactctgtctttagctttctggacttcaatttgttgcttctttttatcaactgtcaacaaaatgagtatacccttacactttttaaaatgtggcactccataaatgtaagatgattttatggtaactttttaaggtactgagttcctcctcaatccatataaatcatgaggacagggaaccaccccgtgcattgtgtgccatgtaggttatgtgcagacttacggcaatccttggaaacatttatacacctgaaaactgggraccctggctgcctatcacatagaatcatggccctggggaaatatgcagatcatctgatggcatccatgttctcctgtgattataagagaacatggcaaggttggtcacatccccactggtggaagagcgggtactaatgctccagcctttgggttcccagcccattctttgctacagcaccatagaaagaaaacttaaatttgaattggagggatttttatttttatttttattttttttgagacagagtctctctctgttgcccaggctggagtgtagtggtacaatcatgactcactg

SEQ ID NO: 3101 - DNA, 601 bp, Human
tcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctcttkgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagt

SEQ ID NO: 3102 - DNA, 601 bp, Human
gtgactcacacctgtaatcccagcactttgggaggccgagaagggcagatcacctgaggtcaggagttcgagaccagcctgaccaacatggtgaaaccctgcctctactaaaaatgcaaaaatttgctggcatggtggcatatgcctgtaatcccagctacttgagaggctgaagcaggagaattacctgaacctgggaggcagagattgcaatgtgagccgagatcgcgccattgtactccagcctggggaacaagagtaaaactccatggggaacaagagcaaaactccatggggaacragagcaaaactccatctcagaaaaaaaaaaaaaaaaagaaagaaatccctaatataatgttgccactccaaaataatttgtagggttattttattttgtttttggttaggctggtcttacattgcaacttacagatctggcagctcagcaggaaggaaatctgctaatccgtagtcattggaagtatttccctgtttctcaccagcctatcctaatagttcatggaaaatggtgcagccatctttcttaaatacatcatttagctaaatgacttaggcaccatcattccttaacttagta

SEQ ID NO: 3103 - DNA, 601 bp, Human
gagaagggcagatcacctgaggtcaggagttcgagaccagcctgaccaacatggtgaaaccctgcctctactaaaaatgcaaaaatttgctggcatggtggcatatgcctgtaatcccagctacttgagaggctgaagcaggagaattacctgaacctgggaggcagagattgcaatgtgagccgagatcgcgccattgtactccagcctggggaacaagagtaaaactccatggggaacaagagcaaaactccatggggaacaagagcaaaactccatctcagaaaaaaaaaaaaaaaaggaaagaaatccctaatataatgttgccactccaaaataatttgtagggttattttattttgtttttggttaggctggtcttacattgcaacttacagatctggcagctcagcaggaaggaaatctgctaatccgtagtcattggaagtatttccctgtttctcaccagcctatcctaatagttcatggaaaatggtgcagccatctttcttaaatacatcatttagctaaatgacttaggcaccatcattccttaacttagtaaacactgaacactaaagattgaagaaatatacaactc

SEQ ID NO: 3104 - DNA, 601 bp, Human
tgaagcaggagaattacctgaacctgggaggcagagattgcaatgtgagccgagatcgcgccattgtactccagcctggggaacaagagtaaaactccatggggaacaagagcaaaactccatggggaacaagagcaaaactccatctcagaaaaaaaaaaaaaaaaagaaagaaatccctaatataatgttgccactccaaaataatttgtagggttattttattttgtttttggttaggctggtcttacattgcaacttacagatctggcagctcagcaggaaggaaatctgctaatcygtagtcattggaagtatttccctgtttctcaccagcctatcctaatagttcatggaaaatggtgcagccatctttcttaaatacatcatttagctaaatgacttaggcaccatcattccttaacttagtaaacactgaacactaaagattgaagaaatatacaactctatggaattgacataaagacttgcatgcaaaagcttcattgttggccaggcacagtgactcacacctgtaatcttagcactttgggtggccgaggcgggaggatcgcctgagagcaggagttcagcaccaggc

SEQ ID NO: 3105 - DNA, 601 bp, Human
ttggccaggcacagtgactcacacctgtaatcttagcactttgggtggccgaggcgggaggatcgcctgagagcaggagttcagcaccaggctgggcaatatagcaagacatcgtctctactaaaaaaataaaaaattagccaagtatgatggtgtgcacctatagtccccagctactcaggaggctggtaggatcacttgagtccagaagttcaagcttgcaataagctatgatcatgccactgcactccagcctaggtgatagagcaagaccctgtctcaaaaaaaaaaaaaaaaatawatatatatatatatgtgtgtgtgtgtgtgtgtgcatacatatatacaccgaagctggaggtggtagttatatttgtcagcaaattttgcaacaaatttaggttttgcttcagagttgtcattccttttatgtttcttttttttttttgagacagagtctcaatctgtcacccaggctggagtgcagtggcaccgttgtcagctcactgcaacctccgtctcctgggttcaagcaattctcctgcctcagcctcccaagtagctgggattacaggcgcccatcaccatgcccggctaattt

SEQ ID NO: 3106 - DNA, 601 bp, Human
cagagtctcaatctgtcacccaggctggagtgcagtggcaccgttgtcagctcactgcaacctccgtctcctgggttcaagcaattctcctgcctcagcctcccaagtagctgggattacaggcgcccatcaccatgcccggctaattttttaatatttttagtagagacggggtttcaccatgttggccaggccagtctcaaactcctgacctcaggtgatccgcccacctcagcctcccaaagtactaggattacaggcgtgagccactatgcccagctgtttctttgtatagtattcyttttttttttttttttttttttttggagatgcagtcttgctctgttgcccaggctggagtttggtggcgcaatatccactcactgcaacctctgcctcctgggttcaagcgattctcctgcctcggcctcccgagtagctgggattacagctgcctgccacccacgcctggcaaatgtttgtatttttagtagagacagggtttcaccatgttggccaggctggtctcgagctcctgagctcagatgatccacctgcctcggcctcccaaagtgctgggattacaggcatgagccacagc

SEQ ID NO: 3107 - DNA, 601 bp, Human
agtgtcagcagcttcattgtctccgagtcctctcatttttcaagactttgaatgatgacagcgtggtggaaattggtgagctagtgtttcagcttgcatggaagccagtggtatagccaagctttctgctgcaacatgtctatgtaaacatttgcccctctagaaattttcaacccgcttcctcattttcactatcatactgttccttctagtgtccttctgtggatttaggcgcattctggtcagatttggaagtacaaaaaggtctcccatttgtggatatacaagccctcaaatctgygttcttgccacctggtgttttagacacctggccacatactctcctaagtactcctttttaaaactgaagatgaatatacacacagaaaagtacaaaaatcatgtgtactgctcactgaattttattttcttattttcttcttttttttttttttgagacagagtttcgctcgtgttgcccaggctggagtacaatggcacgatctcgggtcactgcaaactctgcctcctgggttcaagcgattctcctgcctcagcctcccaagtagctaggattacaggtgaacgccaccacacctgg

SEQ ID NO: 3108 - DNA, 601 bp, Human
tgtaatcccagcactttgggaggccgaggcggatggatcacgaggtcaggagatcgagaccatcctggctaacatggtgaaaccccgtctctactaaaaatacaaaaaattagccaggcgtgatggcgggcacctgtagtcccagctactcgggaggctgaggcaggagaatggtgtgaacccgggaggtggagcttgaagtgagccaagatcatgccactgcactccagcctgggcaacagaacgagactccgtctcaaaaaaaaaaacaaaaaacaaaaaacaatgacaacttacaacstttttcttaaaggccttgtttcttcctccttatgaggaagaatttaataacattaaattttgtggtctctctcatcctcatttactataaattatttgtgttttattcttctcactacattaggtcaaagccttccttagaacttcaatctcacacacagatttgagccagtaacccctgtcgctctccctcctgagagcaggtgttttctcttcccggcgcccagcagagtatgcctggcctatagtgggaactcagtaaatatttgttgactgaataaagaaaacttacttttctgta

SEQ ID NO: 3109 - DNA, 601 bp, Human
aataacattaaattttgtggtctctctcatcctcatttactataaattatttgtgttttattcttctcactacattaggtcaaagccttccttagaacttcaatctcacacacagatttgagccagtaacccctgtcgctctccctcctgagagcaggtgttttctcttcccggcgcccagcagagtatgcctggcctatagtgggaactcagtaaatatttgttgactgaataaagaaaacttacttttctgtagcttcttctgatggacagctgagaggccattgtttgcctatagtcrgtaatgcttaaactttacctgtaggagacagcattcagacacatcacagaaccggctaatcacacaatatgaagtgggagttatgctgaaacaggggaaagaagggaatggatgtgaaagacctgagtctttcttcaagtccctccagaagtgtctttcatgtgggggaatgagaaatatctcttgaatgttactgaagatacctattcaggacatagctgaagacattttctcagtacctctgttgtttaacctcagtcaagctacagccatggattctagattgaaaccaaacttaac

SEQ ID NO: 3110 - DNA, 601 bp, Human
taaaaacaaggctgggcatggtggctcatgcctgtaatcccaacacgttgggaggccaagatagaaggactgcttgaggccaggagtttgagacaagattgggcaacatagcaagaccttgtctccataaaaaattgaaaaattagccaagcacggtggctagtcctgagtagctaggactcaggaggctgaggcgggaggattgcttgagcccagaaattctaggctgcagtgagttataactgaaccattgcactccagcctaggcaaccaagtgacaccctgtctcaaaaaaaaaaawttttttttttttaaaaacccctaaaccaaacaacaagaactctgcttggtacccattccaaagtctagtcagcctgtgttcattgagaacacagggtgtgcccggcttccatttccttcagagcccttagtctcaaaaacaggagggtcccttctgggcaacagaaatagggcatagcagtggacagtcggatgacatggctttaggaatgtcacacccccttctctataaaaggggaagacataattgctacactctttgaagtcccttgtaatttagtctggatttttttttttttgt

SEQ ID NO: 3111 - DNA, 601 bp, Human
aatttttttttttttaaaaacccctaaaccaaacaacaagaactctgcttggtacccattccaaagtctagtcagcctgtgttcattgagaacacagggtgtgcccggcttccatttccttcagagcccttagtctcaaaaacaggagggtcccttctgggcaacagaaatagggcatagcagtggacagtcggatgacatggctttaggaatgtcacacccccttctctataaaaggggaagacataattgctacactctttgaagtcccttgtaatttagtctggatttttttttttttgttttctctttttgttttttagacggagtcttgctctgtcacccaggctggagtgcagtggtgggattttggctcactgcaacctctacctcccaggttcaagctgattctcctgcctcagcctcccgagtagctgggattacaggcatgtaccaccatatccggctgattcttgtatttttagtagagatggggtttcaccatgttggccagcctggtctcgaactcctgacttcaagtgatctacccacctcggcctcccaaaatgctgggattacaagcgtgagccactgtgacttg

SEQ ID NO: 3112 - DNA, 601 bp, Human
tgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaaggtgtctgggggaaaggagggaacatggcatttgagctatgagggagctaagtagatcatggttgcttragaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagt

SEQ ID NO: 3113 - DNA, 601 bp, Human
tcgctcaacctgtttgatacgtataagggcaagtccttagagatccagaaacccgctggtgagagtcctgcaaagatgcttctgatggttgaaagctaggcatgcatggggcatacgttttagagctctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacacgtaagaattggaggaaaataaakgtggatttgggaaactttgaggccagcttgcttcttgcaggctcatgatcaaccaatctcacataaaagtattgaatgttacatatctcagccttcttgatagggatttcatagatttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtattttt

SEQ ID NO: 3114 - DNA, 601 bp, Human
ataaatgtggatttgggaaactttgaggccagcttgcttcttgcaggctcatgatcaaccaatctcacataaaagtattgaatgttacatatctcagccttcttgatagggatttcatagatttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtrtttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcattttcgaccctctctccgtcttgttctccagttgcccctcg

SEQ ID NO: 3115 - DNA, 601 bp, Human
caatgtctcactagtgccaaaagacggaacaggatgggcaagcaaacaggagcagtccgaccccaagaggtagacagaggcttgggggacctagagtgatgggtattttaacttgaacttcagggagcattggggcttggtttagtccagccacgtctgagccagagacgaagaggtccctttcttacctattgcaggttccttgttaaatgactaaggaatggtactaaactttagctttttgtcttggagagagagcatgaaaaaatagacaacagcctacaaaggatgacaaaattawtttgtccttatatttgtaaatggtagcaatgggcatgatttcagtcctgagtctccaccagttggagaagtcagggaggcatctcaggtgtgaataaccttcccattctgtcccctcagttccgatgcctcaaccgctcagccgccggaatcgcagccactgccggcttcacagacgcctgcctccaaccagccgaaacgacccccagcagcccccgaggtacctggagaactggaggggtggggaggaagaatggttcatagctgccccacccacatcatttatcatctttctgaacac

SEQ ID NO: 3116 - DNA, 601 bp, Human
cagaacactcctttggttccaagcggggtaaagtcctgggcacaagccagcgtcacccatggagcacatggagatggtgagtgcagcacttaattggggagctgtgtctgggcaccatgggatgcatgaaccctgcactgtattttcagccaagtgaccttggtcctctttggctaaatcaaggaccacccatattcagtttcatggaggcacatgagcaagtttaagtctcagtcttatatgatggagtgtagtggtgccagaactgacctccttggggaataagcagttattctgtagsggggtgagtttgaaggcgggaaacctgatggtctggtacctgtcagagccttccactttttttttttttgagacggagtctcattctgtcacccaggctggagtgcagtggcgcaatctcggctcactgcaacctctgcctcctgggttcaagcgattttcctgcctcagcctccagagtagcgggactacaggcacacgccaacacacccagctaattttttgtgtgtttttagtagagatggggtttcacatgttggccaggatggtctcgatctcttgacctcgtgatccgcccgcc

SEQ ID NO: 3117 - DNA, 601 bp, Human
caccatgggatgcatgaaccctgcactgtattttcagccaagtgaccttggtcctctttggctaaatcaaggaccacccatattcagtttcatggaggcacatgagcaagtttaagtctcagtcttatatgatggagtgtagtggtgccagaactgacctccttggggaataagcagttattctgtaggggggtgagtttgaaggcgggaaacctgatggtctggtacctgtcagagccttccactttttttttttttgagacggagtctcattctgtcacccaggctggagtgcagtggygcaatctcggctcactgcaacctctgcctcctgggttcaagcgattttcctgcctcagcctccagagtagcgggactacaggcacacgccaacacacccagctaattttttgtgtgtttttagtagagatggggtttcacatgttggccaggatggtctcgatctcttgacctcgtgatccgcccgcctcagcctcccagagtgctgggattacaggcgtgagccaccgcgcccagccagagtcttccacttttatagcatgtcctcaggaaatgtcttctgtctcctgttctgcatccc

SEQ ID NO: 3118 - DNA, 601 bp, Human
gtaggggggtgagtttgaaggcgggaaacctgatggtctggtacctgtcagagccttccactttttttttttttgagacggagtctcattctgtcacccaggctggagtgcagtggcgcaatctcggctcactgcaacctctgcctcctgggttcaagcgattttcctgcctcagcctccagagtagcgggactacaggcacacgccaacacacccagctaattttttgtgtgtttttagtagagatggggtttcacatgttggccaggatggtctcgatctcttgacctcgtgatccgcycgcctcagcctcccagagtgctgggattacaggcgtgagccaccgcgcccagccagagtcttccacttttatagcatgtcctcaggaaatgtcttctgtctcctgttctgcatccccatcctaataggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaagtgagtggctgccttttggccaagacatt

SEQ ID NO: 3119 - DNA, 601 bp, Human
cagctactgttggacccttttacagatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaa

SEQ ID NO: 3120 - DNA, 601 bp, Human
gaccaggcccaatggctcacatctgtaatcccagtgctttgggagtgttaggtgagaggatcgcttgaagccaggagttcaagaccagcctgggcaacacagcaagaccccccacctctacaaaaaaaaaaaaattttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaaragtaggggaggatggatggggaataccaagtccttgcaaagtggtgagaggagtaagaatgacaagacttcattggtggatctagacttcggagggaaggatattggcattggtagtccatcttgttacatagttccagactacctcccaagattggagggcagaatgcttgggttactaatactcatatttcccctcaggggcccatgaagaggttgactacactgaaaagctcaagttcagcgatgaggaagatgggcgagactctgatgaggagggagctgagggccagtgagttag

SEQ ID NO: 3121 - DNA, 601 bp, Human
ttaaaaggaaaaaaaaaaaagagtaggggaggatggatggggaataccaagtccttgcaaagtggtgagaggagtaagaatgacaagacttcattggtggatctagacttcggagggaaggatattggcattggtagtccatcttgttacatagttccagactacctcccaagattggagggcagaatgcttgggttactaatactcatatttcccctcaggggcccatgaagaggttgactacactgaaaagctcaagttcagcgatgaggaagatgggcgagactctgatgaggagggwgctgagggccagtgagttagggccatcaggggagaagaggagggggtcttggtttgtattttggtaatatactcttagaggagtatattagttgcagctgattttaatttcactgttgatctgctcacagcagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccac

SEQ ID NO: 3122 - DNA, 601 bp, Human
gaagaaaaaggagccctgggtgtttgggtttcggaaggagagagggaacagaaaaataaaaagactagggtggctagatagctggatctgttagtatgcatcagtagtccaagctactcagcaggctgaagcagaaggatcacttgagcccaagttcaagaccagcctgggcaacatagcaagacgtggtctcaaagaagaccaggataatgagtttgtcaccacccagagagatcaaccccaaagcctgggtcgttgcatcctgcaagtagcgacagttgatttgttgtaaaagagatgrtagaaagcatagtaactgattcccctggccctgctgggtcttgccaattgacaggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacct

SEQ ID NO: 3123 - DNA, 601 bp, Human
gtctggaatcttaggttgtagtctaataccatttcttggcagagtactgtagctcacgcctataatcccaacacttagggaggcttggggtggaggatcgcttgagcctagggagtttgagaccagcctgggcaacaaagcaagaccctgtcggccaggcatggtggctcacacttgtaatcccagcactctgggaggccgaggcgggcagaacatgaggtcaggagttcaagatcagcctggccaacatagtgaaacccgtctctactaaaaatacaaaaattagccaagtgtggtggcwtgtgcttgtagtcccagctgcttgggaggctgaggtagtagaatcgctttaacccgggaggcagagatttctgtgagccaagaccatgccattgcactccagcctgggtgacagagcaagactctgtctcaaaaaaaaatcctgtctcacaagaaatacataaataaaaatgaaaactatttcctataggccaagactgaagaaagtactgttgttctaatggtttcatagaaagttaatgccaccaccataggctcatgagaggccatgaagtgctttaatgggtcttaaatgggaggg

SEQ ID NO: 3124 - DNA, 601 bp, Human
gggaggccgaggcgggcagaacatgaggtcaggagttcaagatcagcctggccaacatagtgaaacccgtctctactaaaaatacaaaaattagccaagtgtggtggcatgtgcttgtagtcccagctgcttgggaggctgaggtagtagaatcgctttaacccgggaggcagagatttctgtgagccaagaccatgccattgcactccagcctgggtgacagagcaagactctgtctcaaaaaaaaatcctgtctcacaagaaatacataaataaaaatgaaaactatttcctataggcyaagactgaagaaagtactgttgttctaatggtttcatagaaagttaatgccaccaccataggctcatgagaggccatgaagtgctttaatgggtcttaaatgggaggggcttcaatagaatagatgttgaatagaatattttagtcttaagggagctagagatgagacgtgagattcctggggtgttcatggagtgtctattgttggactagatcactctgttgtgttttttccgatgcagtggaaccacaactgccctcaaaagagggtcctgaaccaccagaagaggttcctcctcct

SEQ ID NO: 3125 - DNA, 601 bp, Human
tccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggtaagggggcatgggaggagtgagaaacaggaaagtcccctcagtcttaggcattggatattagggtcttactgtgactctggtacgataggttttgcccatcatagtgatgagggaagggcatatgcttrgcactgctgagatagctctgttgcaaaaatgggcttagttaagaaataagcagtggttggccaggcattgtggctcacgcctgtaatcccagcacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgagattgtgcc

SEQ ID NO: 3126 - DNA, 601 bp, Human
agggtcgtccccctctagacttctaccctcctggtgtgcatccctctggtaagggggcatgggaggagtgagaaacaggaaagtcccctcagtcttaggcattggatattagggtcttactgtgactctggtacgataggttttgcccatcatagtgatgagggaagggcatatgcttggcactgctgagatagctctgttgcaaaaatgggcttagttaagaaataagcagtggttggccaggcattgtggctcacgcctgtaatcccagcacttagggaggccgaggtgggcagatcarctgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccagga

SEQ ID NO: 3127 - DNA, 601 bp, Human
gagtgagaaacaggaaagtcccctcagtcttaggcattggatattagggtcttactgtgactctggtacgataggttttgcccatcatagtgatgagggaagggcatatgcttggcactgctgagatagctctgttgcaaaaatgggcttagttaagaaataagcagtggttggccaggcattgtggctcacgcctgtaatcccagcacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttgtagggaatctgagtggataaccttgttatataagagca

SEQ ID NO: 3128 - DNA, 601 bp, Human
ggaagggcatatgcttggcactgctgagatagctctgttgcaaaaatgggcttagttaagaaataagcagtggttggccaggcattgtggctcacgcctgtaatcccagcacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagwgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttgtagggaatctgagtggataaccttgttatataagagcaggcaaggcccggacctactgggaacaagagatggaagagctgacttgaccgcgaggggagatgctttttgggctggagggcttgtgacatgaatagg

SEQ ID NO: 3129 - DNA, 601 bp, Human
agcagtggttggccaggcattgtggctcacgcctgtaatcccagcacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttgtagggaatctgagtggataaccttgttatataagagcaggcaaggcccggacctactgggaacaagagatggaagagctgacttgaccgcgaggggagatgctttttgggctggagggcttgtgacatgaataggattatttttctttttctttggtttcttcaggcctagttccccgagagcgttcagacagtgggggc

SEQ ID NO: 3130 - DNA, 601 bp, Human
ttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatscctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggt

SEQ ID NO: 3131 - DNA, 601 bp, Human
gtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaaggtgggtaggaacaaacaaatttattgtggtttaaaaattggaggagggggraaaagcctgagggaaagataagtttgggtggagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtatgcataggaacccttagaaggactcaaaaacacctggactttaatagggaagagaataggttgtaagcagaagttgggaaacataacttgtgggaaaaagtaacgattt

SEQ ID NO: 3132 - DNA, 601 bp, Human
catgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaaggtgggtaggaacaaacaaatttattgtggtttaaaaattggaggagggggaaaaagcctgagggaaagataagtttgggtgkagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtatgcataggaacccttagaaggactcaaaaacacctggactttaatagggaagagaataggttgtaagcagaagttgggaaacataacttgtgggaaaaagtaacgatttagtggatactggagctaatgctctgttttct

SEQ ID NO: 3133 - DNA, 601 bp, Human
gaaggaccgggccaggacgaggcgacaagaggagctggccctctcccaagaaccgaaggtgggtaggaacaaacaaatttattgtggtttaaaaattggaggagggggaaaaagcctgagggaaagataagtttgggtggagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtaygcataggaacccttagaaggactcaaaaacacctggactttaatagggaagagaataggttgtaagcagaagttgggaaacataacttgtgggaaaaagtaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgca

SEQ ID NO: 3134 - DNA, 601 bp, Human
gccaggacgaggcgacaagaggagctggccctctcccaagaaccgaaggtgggtaggaacaaacaaatttattgtggtttaaaaattggaggagggggaaaaagcctgagggaaagataagtttgggtggagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtatgcataggaayccttagaaggactcaaaaacacctggactttaatagggaagagaataggttgtaagcagaagttgggaaacataacttgtgggaaaaagtaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtc

SEQ ID NO: 3135 - DNA, 601 bp, Human
acccctgaatgctgttccttgtgagggtccacctggctctgaacctcctaggagaccaccacctgccccccacgatggggacagaaaggtaaaagaccaaaaaaggataaggggaatgtttccaggaatctgactttggccctacctttttctgctttttctctctgcgtgtgtgttctgggcattccaatttggatttccctttccctcccccaatgcactttactgtgtgcccaatccaggagctgccccgggagcagcctctgccccctggccccattggcacagaacgatcacagcrtacagaccgaggcacagagcctggccccattcggccatcccatcgacctggtcccccagtccagtttggcactagtgacaaggtctgtgtgggctggatctgggtatcctgagttgggtggagagaagggaaggactaaaggtgggacatagaggacacatgtctgtcacgggacaatgtctcctgccttcttgtgatcacaggactcagacttacgcctagtggtaggagacagcttgaaagcagagaaggagctaacagcatcagtcactgaggtaagtgggagtaagagtttggtgg

SEQ ID NO: 3136 - DNA, 601 bp, Human
gattgctgggagtgaccagggcgtccaggatgccagacatccctctccacgaggcctctccttcccaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcaggtaggccccgcttcccattgcatgaccccttcagtgaataataatttttttctgcctggtatgtrtttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcaattacatccaaacagtggaggcttccgccctgggacaccctcactgcacccttacaggtaagactcgatgcctgtggatcacagaagtacttggagatgtgtttcggggagagggaagggga

SEQ ID NO: 3137 - DNA, 601 bp, Human
gccaggatctgccatccccttcggatttttattctactcctctgcagcctggtggccaaagtggctttctcccttcaggggctcctgcccagcaggtatattgtatcttcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcat

SEQ ID NO: 3138 - DNA, 601 bp, Human
tcccccaactggaaggtgaaacggaatagggatgtggactttccaagtgcttccttactttggaaccagggtctggatcctaggcttgccttagacgcccttcttcccttaggtccttctctggcctcaattcccgtctcaaggccacgccttccacctacagtggagtcttccgcacccagcgcgtcgacctttaccagcaggtgaaggagaaacccttgtggccccaactctaaattcgagttgccacctgatttcctgtccttccgtctcatcgctgacctctcactgtgactcactstttaacacatgcctgtcccctaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtcc

SEQ ID NO: 3139 - DNA, 601 bp, Human
actgcactccagcctggaagacagggcgtgactccatctcaaaaaaaagaaaaaaaaagaaaatctggtgaccagaaaatcaagctcatctctcaggctaaggggcctaaacgaggaaaagctaaaggtgtcttccagaactagtgaggtgtctcacctgggcccccacaataaaggtacgagtttgagagtccaaggtcttcaccaacacctccaagctgtcaggctcctccacagcggtactggtactatcattaggctccatggccgacaggtctctaaagaagaacgaaggaaggarggcccgctgttgcccagaccagagtgtacccgaaagactccctagcattaatccctgccccaatacctaaaaagtttctcctgcacacacacacattcacacctgtccccatcccccttctgattccggggcacagggagagaaacacaaagggcaggagatcgacggcttagggagctggaggacgagaggtgggaggggctccacgacgccaatcacaataagcagggagccagtcagattaggaaggaagcacgagaccagagactagtgtcatcaccggtcacggcaggacaagcg

SEQ ID NO: 3140 - DNA, 601 bp, Human
tgagccgagatcgcatcactacactctagcctgggtgacagagagggactccatctcaaaaaattaaataaataaacttaatgaagctcaggttatagatccaggaaaaataacacggatgaaaaacaaaaaaaaaacacatggacattatattatctgtctggcatccaagggagtatgtgtctagagacatcagtgacccctttccaaacacaagatgataccagtttatttaccagactctcctgtgatttccaagattaaaaaatggcaaagaagatggggtctggtatcaggttamtgaagaaagactaagaagataagaaagcaaaaaaggtcccagcacagtggctcacacctgtaatcccagcactttgggaggccgaggcaggtggatcacctgaggtcaggagttcaagaccagcctggccaacacggtaaaaccctgtctctactaaaaatacaaaaattagccgggcgtggtagtaggcgtcgtctgtaatcccagatactcaggaggctgaggcaggaaaattgcttgaacccaggaggcagaggttgcagtgagctgagattgcgccccagccctccatcctgggca

SEQ ID NO: 3141 - DNA, 601 bp, Human
tcacattaggtcaggagttcgagaccagcctggccaacatggtaaaaccccttttttaccaaaaatacaaaaaaataagccaggcatggtggtcgcctgtaatcccagctactagggaggctgaagcaagagaatcacttgaattcgggaggcggaggttgcagtgagccgagatcgcatcactacactctagcctgggtgacagagagggactccatctcaaaaaattaaataaataaacttaatgaagctcaggttatagatccaggaaaaataacacggatgaaaaacaaaaaaaaamcacatggacattatattatctgtctggcatccaagggagtatgtgtctagagacatcagtgacccctttccaaacacaagatgataccagtttatttaccagactctcctgtgatttccaagattaaaaaatggcaaagaagatggggtctggtatcaggttaatgaagaaagactaagaagataagaaagcaaaaaaggtcccagcacagtggctcacacctgtaatcccagcactttgggaggccgaggcaggtggatcacctgaggtcaggagttcaagaccagcctggccaacacg

SEQ ID NO: 3142 - DNA, 601 bp, Human
tcactttcaactggttctgatgtttgagagctcaaggctactggctccggggtcacagccggtggctgcgggggcggctgactgtgctgcggttggggccctcctcgacactgaaggtaggggagagtcaggataccaaaggcagggtaagactgctgcagaggattactctacaggagactgaacagagaaagtatcctaactagactccctgaaggcatggctctgcaattttatctccgactcgctagcaactagcataagactgacacaaattagatgcataataagcatctgtaatttttttttttttttttgagacagagtctcgctctgttgcccaggctggagtgcagtggcatgatctcagctcactgtaacctccgcctcccaggttcaagaaattctcttgcctcagccttctaagtagccaggcctacaggcgcgtgccaccacacccaactaatttttgtacttgtagtagagacagggtttcaccatgttggccaggctggattggaactcctgaccacacgttatccccctgccatggcgacccaaagtgctgggattacaggcaggagccaccacacccggccac

SEQ ID NO: 3143 - DNA, 601 bp, Human
acagggtttcaccatgttggccaggctggtctcgaactcctgacctcaggtgatctgcccgcctctgcctcccaaagtgctgagattacaggcatgagccactgcacccagccaaagcttctattctttactcccacccatgagaggatagggagaagaaaatgaactgctcccaccctccccaccacaatcctgcacctacaatggtgaaagactaattctaagaaagagagcaggccttcgtgaactcagaggagaattccgatcaggctcaggagataccatttggatttccttgccrtagggagagcagcagttcttctcagctgcctgtcctagcgtcatttacctataccgagagagcccctcctcgcccctcaatgctaacccttcaactaagacctccaagtaatcctttccctcccttgccatggttcatttccttctccccatacttcacttaggattccccacccactaaagattccctccatctctcacttgggtgcatttgtttccggggcaggtgttgggcccgctggggctgggccaggagtgagctccgggttctgggctggggcacgctcctccacttcttctg

SEQ ID NO: 3144 - DNA, 601 bp, Human
acccaggctagagtgcagtagtgcaatctcggctcactgcaaccccctcctcccgagttctagcgattctcctgcctcagcctcctgagtagctgggattacaggtgtgcaccactacatccagctaatgtttatattttcagtagagatggggttgcaccatgttggccaggctggtctcaaactcccgatctcagatgatccgcccaccttggcctcccaaagtgctgggattacaggcgtgagccactgcacctggccctgttgcaatgtttttccagggagggaaagagttatctgyatttcagcctgttctgttttgggagtactggggctgaggagaaagggcagggccatcaaagggctcacattgttattgtagtccgtggtggcagcagcacccagaacctcgtagtagcgctgcaagaagggctggaggcgactctccagccgctgtagctcctggagcacctcgacatactccgcaggggaaggatggctgtggacaaacccaaggggcaatgagccaaagccttcctcagattcccaccctcacagtcaacagggaccacatgtgccctctttctccctggtctcccag

SEQ ID NO: 3145 - DNA, 601 bp, Human
actaataaaagcaataatgcctactgagaataccatgtcctccaaaactttcagttatatccttggaagtttacatgtagaccaaatctttgcaaataaattatatcttattcacataaggaacatcctattaaaacactactatgaatcagtaagtcatcatatactgatctcctgtactttacattttctaaattcattcaggggcacaaggggtacgatacgaggacagtgcttacagcaaagattatcaccttctctgtaagggaggacaaaatcacttacaggtttagagagaaaytgttttgttgcaatgtgtgtttttttgttttgttttgttttttgagacagtctcgctctgtcacccaggctagagtgcagtagtgcaatctcggctcactgcaaccccctcctcccgagttctagcgattctcctgcctcagcctcctgagtagctgggattacaggtgtgcaccactacatccagctaatgtttatattttcagtagagatggggttgcaccatgttggccaggctggtctcaaactcccgatctcagatgatccgcccaccttggcctcccaaagtgctgggattaca

SEQ ID NO: 3146 - DNA, 601 bp, Human
ctgttgggaagcctggcacctgctgtcctgtgggtggcagaagagacagaccgaagagggctgagggccaggcccttgccagccagctgccaccatggactgtgccctacctcccaagcctccccttccaggtcattacctgcggccgcggaggcaacagctgccaccatggcctgatgagtgatctggtgggcgacggcgtgcatgaactcagggggcagggagggcagctggatgagggtggagcctggggggcgggtctgatgtaaccttgaacctggaccccttcaacccacccacwcagcccttccctttctctacccagagctcagcctgccctgatgccctcactcttacccagggtttggccatgaccagggggtcccagggggccagtgggagcactcggaacaccaccaggctgtgtgccagaatctgggcagggagacagagacagtggccctgaggtaggtagggccaaggcctaactatatccttctgagatcaggcatacttcaggcccataatcccccaatcagaaagcctgcctttccctccatctaaacagggagaggtactcccttcaccacacaaacacacc

SEQ ID NO: 3147 - DNA, 601 bp, Human
acaagacactacagcagccccattccaggaaagcaggaaccaagaaaatatggaaagaactggaaagtgccagtgagcagactaggaaaggagtttaaactctgagtggggaagaatgaaaactcacccacaaggactggctgcataagaagctgccccacaaggccgctcaccatctgggccaacgaggcattggtacccagaccggcgccctgctggatagagagcaagggagaacttcagacctgcccttccatgcaccaccacaggagtctctccctagactgttacgcactagaamtccccgacccttgctcaccagtgtcccagagactgggggccctccaggatgggaaggccgagcctgtggaggagtgggccgggcaatcaccacccgggttggagctgttgggaagcctggcacctgctgtcctgtgggtggcagaagagacagaccgaagagggctgagggccaggcccttgccagccagctgccaccatggactgtgccctacctcccaagcctccccttccaggtcattacctgcggccgcggaggcaacagctgccaccatggcctgatgagtgatctggtgggcga

SEQ ID NO: 3148 - DNA, 601 bp, Human
caagattgtacactgcactccagcctagcaacagagtgagactccatctcaaaaaaaaaaaaaaaaaaaaaaaaaaaagctgaaacctgaagacacaagacactacagcagccccattccaggaaagcaggaaccaagaaaatatggaaagaactggaaagtgccagtgagcagactaggaaaggagtttaaactctgagtggggaagaatgaaaactcacccacaaggactggctgcataagaagctgccccacaaggccgctcaccatctgggccaacgaggcattggtacccagaccrgcgccctgctggatagagagcaagggagaacttcagacctgcccttccatgcaccaccacaggagtctctccctagactgttacgcactagaactccccgacccttgctcaccagtgtcccagagactgggggccctccaggatgggaaggccgagcctgtggaggagtgggccgggcaatcaccacccgggttggagctgttgggaagcctggcacctgctgtcctgtgggtggcagaagagacagaccgaagagggctgagggccaggcccttgccagccagctgccaccatggactg

SEQ ID NO: 3149 - DNA, 601 bp, Human
actttgggaggccaaggcatgagaactgcttgagcccaggagtctaggccacatagcaagaccccatctctaccagaaaaaaaaaaagacaattactagccaggagctagtactgctagctactcaggaggctgaggtgggagaactgtttgagcccaggagttcaaggttacagtgagctttaactcactggattgcaccactgcactccagtctgggtgacagagcaagactctgtaacttaaaaaaaaaagaaaaaagctggccgggcacgatggctcaagcctgtaatcccagcacyttgggaggccaaggtgggtggatcacaaggtcaagagttcgagaccatcctggccaacatggtgaaacccccttctctactaaaaacataaaaaattagctgggcgtggtggcgtgcacctgtagtcccagctactcaggaggctgaggcaggagaatcacttgaacccgggaggcagaggttgcagtgagccaagattgtacactgcactccagcctagcaacagagtgagactccatctcaaaaaaaaaaaaaaaaaaaaaaaaaaaagctgaaacctgaagacacaagacactacag

SEQ ID NO: 3150 - DNA, 601 bp, Human
gaaaccaaaaaaagaaagctgggctgagcatggtggctcttggctgtaatcctagcaactttgggaggccaaggcatgagaactgcttgagcccaggagtctaggccacatagcaagaccccatctctaccagaaaaaaaaaaagacaattactagccaggagctagtactgctagctactcaggaggctgaggtgggagaactgtttgagcccaggagttcaaggttacagtgagctttaactcactggattgcaccactgcactccagtctgggtgacagagcaagactctgtaacttaaaaaaaaaagaaaaaagctggccgggcacgatggctcaagcctgtaatcccagcactttgggaggccaaggtgggtggatcacaaggtcaagagttcgagaccatcctggccaacatggtgaaacccccttctctactaaaaacataaaaaattagctgggcgtggtggcgtgcacctgtagtcccagctactcaggaggctgaggcaggagaatcacttgaacccgggaggcagaggttgcagtgagccaagattgtacactgcactccagcctagcaacagagtgagactccatctca

SEQ ID NO: 3151 - DNA, 601 bp, Human
ggctggcggtggagccatacctggggtcccctgagctgtaagaaaccaaaaaaagaaagctgggctgagcatggtggctcttggctgtaatcctagcaactttgggaggccaaggcatgagaactgcttgagcccaggagtctaggccacatagcaagaccccatctctaccagaaaaaaaaaaagacaattactagccaggagctagtactgctagctactcaggaggctgaggtgggagaactgtttgagcccaggagttcaaggttacagtgagctttaactcactggattgcaccaytgcactccagtctgggtgacagagcaagactctgtaacttaaaaaaaaaagaaaaaagctggccgggcacgatggctcaagcctgtaatcccagcactttgggaggccaaggtgggtggatcacaaggtcaagagttcgagaccatcctggccaacatggtgaaacccccttctctactaaaaacataaaaaattagctgggcgtggtggcgtgcacctgtagtcccagctactcaggaggctgaggcaggagaatcacttgaacccgggaggcagaggttgcagtgagccaagattgta

SEQ ID NO: 3152 - DNA, 601 bp, Human
gtcagaaagcagtgacactaattactatactttctttttctaaacctcattttcttcatctttaaaatgaaaggttcagagtcaatgaattcccagggccccttcccctaacatgtcactaggggctcttacccagtggttatataatggcaagaaggtaccactgcctggctgggccgggggacaggaagatgaggtgaatggcaagccagccactcacctgcaagaagtcagtcatgccttggagaaaggcagggacaccaggcatcgccacagtgatggtgggagaagccacaccagrccctccagcccctggccctgcaggccctagcaggttccccagaagctgagagaactgaagatcagccatggagggttgaggggtgggtggaggctgggcaggccccccaggagcggggccagctgtggtagctgtgttggtggtgccagcactggcagaagcagtggcaggggctggcggtggagccatacctggggtcccctgagctgtaagaaaccaaaaaaagaaagctgggctgagcatggtggctcttggctgtaatcctagcaactttgggaggccaaggcatgagaactgctt

SEQ ID NO: 3153 - DNA, 601 bp, Human
gacacacggaaataatacggcatcaagagggcacaaaccaacgggtctgggaagatggggagttacattctgatcttcactgcttaaagcagaagtatggtaggtatttaacagagtcaggcagcacaacttacctacctcttcctctgaacaggctgtcagaaagcagtgacactaattactatactttctttttctaaacctcattttcttcatctttaaaatgaaaggttcagagtcaatgaattcccagggccccttcccctaacatgtcactaggggctcttacccagtggttatrtaatggcaagaaggtaccactgcctggctgggccgggggacaggaagatgaggtgaatggcaagccagccactcacctgcaagaagtcagtcatgccttggagaaaggcagggacaccaggcatcgccacagtgatggtgggagaagccacaccaggccctccagcccctggccctgcaggccctagcaggttccccagaagctgagagaactgaagatcagccatggagggttgaggggtgggtggaggctgggcaggccccccaggagcggggccagctgtggtagctgtgttggtgg

SEQ ID NO: 3154 - DNA, 601 bp, Human
tcaaaacgaaaggcagaaggggtcaagccatccgggattcagagctaggtaatccacaagaggaaacccaccttaaaggaaaatgggatctaagcacatggggattaggcagctgagcaactaatacaggactgctagcaaacagactaaggtcaagtcctgtatggttatgcaacaaccaagagcaagtctgaatcccagaaaaagtttcctcattaaacgaggggaggggagactgaataacaagagctcccaccatctctacatagtttgattccaggcatgacggggaaacctggayagagagagaggcttagggaagaggaaaaccaaccttgcgtctcttggcaggcataccactgaggtaggcatcactcagagggggctgcggtttcaccttccgctggctctgaatgtcctgctggataatagggacccattcctggggaggaaaagagaaaatagtaatgtccttgactttcagctgccatgacccactggattacttcctgacacttactggggggactgcagctgcccaaggttctgtctcagctgaagctccatcctgttcatcccgggagcccccctcaggagcagg

SEQ ID NO: 3155 - DNA, 601 bp, Human
gtagtgagccgagctcgagatcgggccactgcactccagcctgggagacagcaatactctgtctcaaaaaaaaaaaaaaacaaacatcaaaactggcttgtacaatttagcgtgctgagtagaacacaacagtgttccaaggaagtattaatttaaaaaagttcacacaagattaagggacacactacctaatggagacaatgtagagagaaagcagccagaaaaatccgacttttatttcttaaatactgtgaaggaagaggggggaaacggtcccctgatgaggaagggccatagagcaaagagctaaggatcatcagcaaaggcccgctgggcattggggaagcgctggggactgtagttggggtcttcctgcagtcgtttttgtatatcagaccggagctaaagagaaaaagtaagcaggttggagaaacgctggccaagtccctatgatcccagcaagcacacaaggccatccctcagaagctaacatttccccccccaagcacactgtcaaatagcccggggtggcactgtcaagccttcccagatgccaaaggggaaaacaaatggtagcaccaggctgaccagttcatcgctg

SEQ ID NO: 3156 - DNA, 601 bp, Human
gacctgtgtccgggggcaggtcacccattacacattttgggccctggtcatttctctggtgggtgatacctgtttgcttgggaaaatacagcccttccaggcagcgcttggaccccagagagatgtgggcctcaggcgtcctgttcttggggttgtacgtctgcacctggaggggacactggggaggaaacgtgggttcggagcagggggcggcgtccgcgtctgacccggcctgccggttgcttgtcgcccgcgcaggagctggccgggcgccgcctgcaggctgtcccgggccgagtcsgagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggtaagagggcggcgctgtctcctccctcgggaggtcgaaactcctcttctgggatttctgccactccctagaagagtgaagggtggggacacgcctcccttcacataagcaccaattaagttact

SEQ ID NO: 3157 - DNA, 601 bp, Human
tatataatagcattacccctcagccactgcgatatacatgagtttcaatttattatagctcagtcccaaatcaatgtcactgttaagagtatgtgttacagtagtggttatctttggaaaacaatttgagtctgactagatgttgttcaatccccaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatkcaggtaagaagtataccctgtgaaaattgttaagtggaataatcaaattttgtttttaatggaaatatgtgggcgtggagaaatgttgaatctcagagtgagtctgcttttgagtatgttttttagaagtgaaattcagataaatcaatagaaaaaaaatgccatcttgctgagactggcaagtttgatgctttccagctgttccaaatgcctccttctagcaggatattcactggaaacaacaccccaaccacattttatgtaaattgtgagccatgatattgaataccggattacatc

SEQ ID NO: 3158 - DNA, 601 bp, Human
tatggggatgcttgccagtacccaactaactgtgacttgacaaagaagaaaagtaaccaaatgtgcaagaattcacaagacatcatctgctctaatgcaggtaagaagtataccctgtgaaaattgttaagtggaataatcaaattttgtttttaatggaaatatgtgggcgtggagaaatgttgaatctcagagtgagtctgcttttgagtatgttttttagaagtgaaattcagataaatcaatagaaaaaaaatgccatcttgctgagactggcaagtttgatgctttccagctgttycaaatgcctccttctagcaggatattcactggaaacaacaccccaaccacattttatgtaaattgtgagccatgatattgaataccggattacatctgttaaaaaggatttatataaactgacttaattattttctgttacagatcacgggtgctttgaatttttaccttcgcaaaatagaaccaaatactttaaatttgatagaagtttcagatatactggttataaagctctttgaaggatacagtcacagaaagattttttgtttgatcaaaatattttttatttcatagaagttat

SEQ ID NO: 3159 - DNA, 601 bp, Human
atggggatgcttgccagtacccaactaactgtgacttgacaaagaagaaaagtaaccaaatgtgcaagaattcacaagacatcatctgctctaatgcaggtaagaagtataccctgtgaaaattgttaagtggaataatcaaattttgtttttaatggaaatatgtgggcgtggagaaatgttgaatctcagagtgagtctgcttttgagtatgttttttagaagtgaaattcagataaatcaatagaaaaaaaatgccatcttgctgagactggcaagtttgatgctttccagctgttccaaatgcctccttctagcaggatattcactggaaacaacaccccaaccacattttatgtaaattgtgagccatgatattgaataccggattacatctgttaaaaaggatttatataaactgacttaattattttctgttacagatcacgggtgctttgaatttttaccttcgcaaaatagaaccaaatactttaaatttgatagaagtttcagatatactggttataaagctctttgaaggatacagtcacagaaagattttttgtttgatcaaaatattttttatttcatagaagttatt

SEQ ID NO: 3160 - DNA, 601 bp, Human
catgccccatagcgtctttcatcttgaaaaaattattcttttcaaacttgtttcagtaacaagacttgaattctgttttgggtttgaaatctattttgggatttatttatttattgtttgcaaatcaaatttagggtttttttttagagaacattataatcaaatgtggtagtctaggattctaaagatgtttaatattaaggaatctaaacatgtaattcaccacattaacatatcttaaaggagaaaacatacagaagtgtttcagtagatgataaaacatatttgatacaatgtaaaygcatttctaggacatctgtactctctcattttttaagcatggatgcaatacctttgttcataacctgctttagtcaagggacccagtaatgtcctgtatagcgttttcctctccttacaggattcagactattgaaaatgttatgtttatatctctctttagtcttctttaatctgggtcatttccacagactttggctttagagcattgaaacttgtgaagaaagttgtccccattttattaaaagaaaagtgtacttatcttggatttgtctgatgtctcccccgccatgattagatt

SEQ ID NO: 3161 - DNA, 601 bp, Human
attccttttagtgaaaatggtatttgaataaaaattgtgggcacagggatacttatttccactggagggtatttgcttcttggccctttctgcaaataggcttgtgtcaaaaaagtagattgaagcataatacaatttttattttatctgagcaaacaatgattcatgaatcaggcagctccaaatcagaagtgattcaggtgcttcattgagggaatgcaagtgggaggcttttatagggtgaacagaaaaagaaagcaaagaaaaatagttggttggctaatgttatatggttgccttrtttagtctatcctgttggaaagtccctagttatataattataagtttgttggttgcttctgattggttaaacttaagttctgttcttctttaatgtagacatttataagaaataacttaagctaagtttcacttatttttgcctgtcaggcaaggttaggatcatttatgaggcctaactggcttagtctgctcaggggttctttaggccttgtctccattttaatttatcttgacactagtaaatatatgcctgtgcatatacacacaaatacatatacacatacttgcacacagatat

SEQ ID NO: 3162 - DNA, 601 bp, Human
gagcagaaggggaagaggagttaaatggattggggaatgagactgaagggcagaatgaggcagagctggggatcaaagtgttccagaggctaactttgtgggaaaagtagaagggaggtccagtgtgcagagcagggtgaggccccggcaccactgtacaggagtgtgggctggtgtacatgtctggtcagtcatcctagagagagtcagttctattgggcactatgaaaaatgagagctaaaaatcatcaagtgtaaggcagaagaccagtcctagaggctgagttaactggcaaccacragagagaagctgtgtgtgtcatagcatgagcacaggagtctggagcttttgcctgggcgtccatatgccatgtcttggaggctccgttgtgaattctgctttatgggtgagacaggaagtctctgagctgttgtaaacttcccacatcagccgggaatgtttccgatgtgtggatgagagggagctgcctatgggggacttcagtgaggagtcatagaatttggaggcagaggctgttccttcccatctttcctgaaaaaacttcctcatacacagtcctaaccaagtgacttcctgctc

SEQ ID NO: 3163 - DNA, 601 bp, Human
tactatgtactaggtgcagcagtgcttctagaaacatgactgggtacatattcatcacttggtattggcagcagttctatgaagcagagattatttgcagatatggaatctgggaattagaaatgaaagcaatgcctttaaaaatgcatagctcatgaggattaaaactcggaattcagctacagctctaccttactcacaagttcattctctttctaatagatcacatatagatttgctaatatctagtaattcaaaccaaattagcaacagcttccttggttccttcccatccttcacyctttacactcagtcaccaaatgccctctactctttctcctaaaaatatccccagatgtatttgttccattctaaactcatcgcatcatgtgtctagccactgtcttctttcctgcagacaaatataacagccttttaactcatttctttgcatccacttttgcctcatttcagttcattcactcttatgctattgcttcatctagtttttgttacatgacaaccagagtaatctggtaaaaattcatacatgatcacaggactcccttgcttctatgtcttccaattatttttggattaa

SEQ ID NO: 3164 - DNA, 601 bp, Human
cattcatgcattggttggatggctatatgtggagtagctctgcacttggagaggtcaaatttacattcattaaaccattagaggtcaataataatagttgtgtgatctaaaatataattgccatgctaaaataacctcaagaaagagtagcatgtgctttacctcaccatgcccacagaaatatctaattgaaatattaaattgatttggattatctactctcttgagagagatggtataaaaattcattaattataattttatgtgcatgtaacaaacagtcttttttgttttcatggtmtaggtacatgtcactgtggcaggtgtaagtgtgataattcagatggaagtggacttgtgtatggtaaattttgtgagtgtgacgatagagaatgcatagacgatgaaacagaagaaatatgtggaggtatgtatattggctctgtagaaattaataaaagtacctgtttttttcacctatttcattgttcttttatctctacataagtttctgctctaggtgtgctaatgtagtttaaacctatgtttatctggaaaacatttcacataaggagagtgagactatggcattaagagtaga

SEQ ID NO: 3165 - DNA, 601 bp, Human
gcaccttctgtataaattttctgaaattacagagaaaataaattccgtagtctaaaaaggtgattgggtcgtacaaacctgactcctaagaaaagcaattaatatacactattgcttttttttcagtgtaatccttgagttcttgaggcctgtgatatatcactaggatgtgatttgtgtgtgcaagtagacaccattttaagttcataaataagatatatagatgatatattctgtactgattaaatcacttgacagcctttgcatttgcttaagtaaacaaatttaaaattcaaattcrttgtggaaatggtcattgatttttaggttaacaagtgattttctttgaatatcccaattataacttatttagacagagaacatggcattgggtccctgtctctttctctgtgtctcactatagcactctttctgttcatctctctggctctgtctctcagatgtgtatcttcttgatggaagtctcatctgctggacatgaatagcgtaggataccagaatattctgttgtacttcttgcttcttatgtgagttttacaggtcctattaatgttcttgccattggccagaaataccatag

SEQ ID NO: 3166 - DNA, 601 bp, Human
aaataccatagtgttagaatgataaatatgcttataagacaatgaaaagtagtctcataatcagttttgcattgtcttttggggagtttggctgtaagagaagagagatggaaagaacaaagactttagccatagactgataaaacacaaactcctataatacagaaagaatagactaaaaacaaaacaagaacaaggacatacatttatacttaggtgatataactacaaagatgagagtataagaagtaaaatttgggataaatgccatctttggggaatttgcagaaggattgctagrtgtggatgaggaaagcaatggtgcgataattcactacagatggcttggaggcaagtgcagatgagcaggtaacaggttacagagaggtgggagctgaaagagggcatctggacacaaaatggtgagtgcccttacctgtcatttgtatccccttgacaagtagaaagggaatttgattgcgtggccaagggcccatggtattttgtttgtctaaatgaggattaaacatggactaggctgaaaacctctctttcacatggtggaacacaacagcttgtggggcacagttgagtgaaaaga

SEQ ID NO: 3167 - DNA, 601 bp, Human
cattaggtatatctcctaatgcttcccctccccactacccccacatcacaacaggccccagtgtgtgatgttctccttcctgtgtccaatgtgttttctgcataagtccttttatgcagtaggggtcacagtcaccatttttaagtatatgaagcttgaactctggtactgtggaaaatgactatttggctgtcaaaaagagagaggtggaaaatggaattggttgggctgtggattaaggtcaggttctgcagcagagttacattggctgtgagagacgatgtccttcagaaacataagstaagccacctgcatcccacttcgctgtgcttggagcattctgacctggagctatggcagaggcagaatgggaagcagcttgcctgagcgaggctcacagcttctgagattcaggggtacttgaagacagggcagaagtgggcgctgagatgagtcatttttttttctcaaaagataatactcctgactaccctgaaagcatttctgcatcattgcatccataggtaatagaaacacactggtccctgcacatacctatcttgtcttcctttttccccatcttcaggggccaaaaaaccaa

SEQ ID NO: 3168 - DNA, 601 bp, Human
taccattactgcgctaattccccattgaacaatatttcggtcactagtaatttttcaaaaacataaatacaactatattttatatttctgaacatacacttgtgtgtactttttctttctgttgggtacattaattaaagtgagctataagtctgaataataacacagatataaaaagtacatattgcaaaatcgctacccagaaagttgtaccatttcgtactccccttcagggcaagaaagtacccattgtcccacacctttaccgagtctggatccaacaatattttccacctctgaygatctgacttctaaaataattgccaatcacgattattttgaagatctgccactgctacccacttagtagtggttgattgagtgataaacatttttcatctttatctgtcattatttctgtatgaaatttccttttgttctttccttttgtctatttcactttgggcatattaatcctttatatattcaattctatgatttatttatatgtttttgaaattgttctttgtcttttacagacatattaactacttgtttcagctttgtcagtcttttttttacagtgttttgtttccaacca

SEQ ID NO: 3169 - DNA, 601 bp, Human
tgactttctcttagttctacctccaatgtctcctagaacatttcctctaatccctatatatccaatccatccactgctaattactccaacactcattgatcctctttctccaaattcttagagcattcatgtcttagtttacaaaatatttgcacattgtttttagtgtttgttaatttttctttctaattagctttctatttgccaaatagattgcaagcttcttgggggaaaggattatatcttatataaattgttttagtgttatctttgaaggaaactaacataatactaatgacayattccaccaactcacataattatagaatagataataacttttgtttattaaggaatctctattatcaatattagatggtgtttttcctttttagaatatttttgtctgaatatatgtgtttttttcaaacacaaagtaaacagaaaataataagcgatatgtgaaatgctttctttcatggtttttcttgactggattcttataaaattcttcttcccacctagggacttgtgtatgtggtgaatgtacctgtcacgatgttgatccgactggggactggggagatattcatggggacac

SEQ ID NO: 3170 - DNA, 601 bp, Human
gccgggtcttccctaagcttagctacctttgcaaagtacatgatataattcattgtgggttgttttgttcatttggggatttatttggcttcaagactacacaattatatctttgccttgactacttcaagctagatccagataatcacgtccaatcttcttacagatgctgttgtgtgacaatggctgtaaacacatgtcattaactgtctccttaaactctcacagtgatacttcttgggtcccacatcttccaaagaagtccagcatacacacacactcacccacccacaacctgtcmcacatccccagaaaagagaaagagtgaaagatgcttcacaaaatcggcctcagcctggtgttcaagttgcctcgctcaatatgcctgtgcagtcagacctgcaggaagaaacagctcatttttaaactactgtatatgaaagtttttgcctggagatacatcacagataggcagatcactaaaaagaagagtggattgaatcagagtgaagtcttcagttaactgtttgtttattgcctgtgaggtccaggacagtttcctttattctctcttccattctcatctttgaaggtaaaattt

SEQ ID NO: 3171 - DNA, 601 bp, Human
gcaaagtacatgatataattcattgtgggttgttttgttcatttggggatttatttggcttcaagactacacaattatatctttgccttgactacttcaagctagatccagataatcacgtccaatcttcttacagatgctgttgtgtgacaatggctgtaaacacatgtcattaactgtctccttaaactctcacagtgatacttcttgggtcccacatcttccaaagaagtccagcatacacacacactcacccacccacaacctgtcacacatccccagaaaagagaaagagtgaaakatgcttcacaaaatcggcctcagcctggtgttcaagttgcctcgctcaatatgcctgtgcagtcagacctgcaggaagaaacagctcatttttaaactactgtatatgaaagtttttgcctggagatacatcacagataggcagatcactaaaaagaagagtggattgaatcagagtgaagtcttcagttaactgtttgtttattgcctgtgaggtccaggacagtttcctttattctctcttccattctcatctttgaaggtaaaatttcatttctttccccttcctatgtcctaagat

SEQ ID NO: 3172 - DNA, 601 bp, Human
ggttgttttgttcatttggggatttatttggcttcaagactacacaattatatctttgccttgactacttcaagctagatccagataatcacgtccaatcttcttacagatgctgttgtgtgacaatggctgtaaacacatgtcattaactgtctccttaaactctcacagtgatacttcttgggtcccacatcttccaaagaagtccagcatacacacacactcacccacccacaacctgtcacacatccccagaaaagagaaagagtgaaagatgcttcacaaaatcggcctcagcctkgtgttcaagttgcctcgctcaatatgcctgtgcagtcagacctgcaggaagaaacagctcatttttaaactactgtatatgaaagtttttgcctggagatacatcacagataggcagatcactaaaaagaagagtggattgaatcagagtgaagtcttcagttaactgtttgtttattgcctgtgaggtccaggacagtttcctttattctctcttccattctcatctttgaaggtaaaatttcatttctttccccttcctatgtcctaagatgccctgaagacacatgagaaaatgtgg

SEQ ID NO: 3173 - DNA, 601 bp, Human
gttgttttgttcatttggggatttatttggcttcaagactacacaattatatctttgccttgactacttcaagctagatccagataatcacgtccaatcttcttacagatgctgttgtgtgacaatggctgtaaacacatgtcattaactgtctccttaaactctcacagtgatacttcttgggtcccacatcttccaaagaagtccagcatacacacacactcacccacccacaacctgtcacacatccccagaaaagagaaagagtgaaagatgcttcacaaaatcggcctcagcctgktgttcaagttgcctcgctcaatatgcctgtgcagtcagacctgcaggaagaaacagctcatttttaaactactgtatatgaaagtttttgcctggagatacatcacagataggcagatcactaaaaagaagagtggattgaatcagagtgaagtcttcagttaactgtttgtttattgcctgtgaggtccaggacagtttcctttattctctcttccattctcatctttgaaggtaaaatttcatttctttccccttcctatgtcctaagatgccctgaagacacatgagaaaatgtggc

SEQ ID NO: 3174 - DNA, 601 bp, Human
gaatagttccagggccagaggataagtttgaagatgaaatataagatatttcatgaattgtgacatatataaaatgatatcctgggtgtatatatgaatattatgggcatataaaatcagcactactttagaaacaactaaagacagccaaatacttcaaataactaattttccttcactcatggaaataaaacactaagtatggtgcctttcgaggaaacttctctgatagtcaatgaaatactccatgtggtctttgttggcagatatatcactatccatttgttaaacaagcagtagrgtgctgtacatttttttatgcctagaaatgtgaaagaaagtcttcaaaattaggataaagaaatctctaaaatcaggaaattcctcaccttgatgagaccacaagggaaccagcatcctttgcagactgacctgggagcagcagctcactgggtcctgagaaaccacagggctgtcagtcaattattaaaactgagaagacgtgtatatttcctcaagagcatgcaaatcaacctggaccctcaggaaaacaagtcaagactaaatacaattatgccatagctacgcaagaagttaaaaa

SEQ ID NO: 3175 - DNA, 601 bp, Human
atgaattgtgacatatataaaatgatatcctgggtgtatatatgaatattatgggcatataaaatcagcactactttagaaacaactaaagacagccaaatacttcaaataactaattttccttcactcatggaaataaaacactaagtatggtgcctttcgaggaaacttctctgatagtcaatgaaatactccatgtggtctttgttggcagatatatcactatccatttgttaaacaagcagtagagtgctgtacatttttttatgcctagaaatgtgaaagaaagtcttcaaaattmggataaagaaatctctaaaatcaggaaattcctcaccttgatgagaccacaagggaaccagcatcctttgcagactgacctgggagcagcagctcactgggtcctgagaaaccacagggctgtcagtcaattattaaaactgagaagacgtgtatatttcctcaagagcatgcaaatcaacctggaccctcaggaaaacaagtcaagactaaatacaattatgccatagctacgcaagaagttaaaaaacacaattgtcacaatctaaataattctgactgcactcttactttgagaagt

SEQ ID NO: 3176 - DNA, 601 bp, Human
gtacatttttttatgcctagaaatgtgaaagaaagtcttcaaaattaggataaagaaatctctaaaatcaggaaattcctcaccttgatgagaccacaagggaaccagcatcctttgcagactgacctgggagcagcagctcactgggtcctgagaaaccacagggctgtcagtcaattattaaaactgagaagacgtgtatatttcctcaagagcatgcaaatcaacctggaccctcaggaaaacaagtcaagactaaatacaattatgccatagctacgcaagaagttaaaaaacacarttgtcacaatctaaataattctgactgcactcttactttgagaagtgtgtcaagaaatggcaaacatttaatttggactttggggatttttgcagctgaaatgcatataccagtttccctgatatgaaatatcacatagttgagacacatgaacctgaatcctttcatgatatctgtgatgaccacaactcctttttcctgatcactttaatcacccaggctgttaactcatttttaatcactgtgttttaaaagaagcactaatgattgattcttgccccttttcaatatattttgaac

SEQ ID NO: 3177 - DNA, 601 bp, Human
tagctacgcaagaagttaaaaaacacaattgtcacaatctaaataattctgactgcactcttactttgagaagtgtgtcaagaaatggcaaacatttaatttggactttggggatttttgcagctgaaatgcatataccagtttccctgatatgaaatatcacatagttgagacacatgaacctgaatcctttcatgatatctgtgatgaccacaactcctttttcctgatcactttaatcacccaggctgttaactcatttttaatcactgtgttttaaaagaagcactaatgattgatycttgccccttttcaatatattttgaacttaccaattctgcagttttgttaaatatgtcaaaatactcttttcaactgcacattttttcaacgtgattttgactcaaaaagaatacagccatcttttagtaaatggaagtcatgtttggaaagaacaaccaacccaaggaaacagaaggaaaagaaagtcctttttatttgtttctttttcattgtaaagtctttcctgctgtcgttgaggcagtttttccatgtaagggtttttagtctgtcatggaaagctgtttagactgagagaact

SEQ ID NO: 3178 - DNA, 601 bp, Human
tgattcaatttaggaggaaaaaatctatttttgaatacttttttggaagaccatctataagaatcaaccccatcctgctctcattgacatttcaaccagactgggccatgggacatttgttcaaggctaattgcaactgtctagatccataatgaaggctttcctgggtgacctttatgaattacagtaagtaaagctcccctctgagaaaccagccattcaatacacttttacctttggatgatgggttattagaagcctgttgtcagtgtgtcaacgatattctattcgagatggaaayctttagttataaggtgatggtgagtaatagcctttgtaatttcaggttcttgtcattgtgggaagtgcatttgttctgctgaagagtggtatatttctggggagttctgtgactgtgatgacagagactgcgacaaacatgatggtctcatttgtacaggtgcagtattaaccttttctaattgctctatgccacagtttgttatagagccaagagacactcgtcatgcaatgctttaggtggctggaccaacagggccaaccgtgaatatgaaatatctaccaaaggcgaagtgggcat

SEQ ID NO: 3179 - DNA, 601 bp, Human
aagaatacaagagaatgaagctaaattttgtgattatttgggatccttccacaaagtaacctccccaccctcaaactcacatgtatgcagttgtatattgaacacagaaaagaattttgttggcaaccattttactttgaacatggtatagggaatgaaatattcttttaaacagaatctgggtaccactagttgatgtgttggttgcttttagggaactggatgtgtgtatgggggagaggtataaagagggctcagccgtgtcatagccactgctatcctaatttattgagtcctcataattggttataaattcatttgtttagccaagttacgaggaaacagagacatgtatacttctcctcagctctagctgaaggtaaaagatgactctttgtgtgtcattaagttagacctttgctttctgcccatccttactacgtaagactctcttcacggattacttggcctgcctcatgttatgtcaaagagccttatgtttttctgtatttattcataagtcagatataacttgctctttaagggaaaacaaaattgtcacctaaaagcctagctggagtgatacaggatggtgactatc

SEQ ID NO: 3180 - DNA, 601 bp, Human
atgaagctaaattttgtgattatttgggatccttccacaaagtaacctccccaccctcaaactcacatgtatgcagttgtatattgaacacagaaaagaattttgttggcaaccattttactttgaacatggtatagggaatgaaatattcttttaaacagaatctgggtaccactagttgatgtgttggttgcttttagggaactggatgtgtgtatgggggagaggtataaagagggctcagccgtgtcatagccactgctatcctaatttattgagtcctcataattggttataaatycatttgtttagccaagttacgaggaaacagagacatgtatacttctcctcagctctagctgaaggtaaaagatgactctttgtgtgtcattaagttagacctttgctttctgcccatccttactacgtaagactctcttcacggattacttggcctgcctcatgttatgtcaaagagccttatgtttttctgtatttattcataagtcagatataacttgctctttaagggaaaacaaaattgtcacctaaaagcctagctggagtgatacaggatggtgactatctgatcggtaaaggg

SEQ ID NO: 3181 - DNA, 601 bp, Human
gaacacagaaaagaattttgttggcaaccattttactttgaacatggtatagggaatgaaatattcttttaaacagaatctgggtaccactagttgatgtgttggttgcttttagggaactggatgtgtgtatgggggagaggtataaagagggctcagccgtgtcatagccactgctatcctaatttattgagtcctcataattggttataaattcatttgtttagccaagttacgaggaaacagagacatgtatacttctcctcagctctagctgaaggtaaaagatgactctttgtgygtcattaagttagacctttgctttctgcccatccttactacgtaagactctcttcacggattacttggcctgcctcatgttatgtcaaagagccttatgtttttctgtatttattcataagtcagatataacttgctctttaagggaaaacaaaattgtcacctaaaagcctagctggagtgatacaggatggtgactatctgatcggtaaagggtggcaccaaataaatgccactaattgtttgaaagattagatgtctcgcagctgcttaataagatgtaataataacatcattgcac

SEQ ID NO: 3182 - DNA, 601 bp, Human
tctatgttccattagaattgagttccagacaggccagacccttcctaaggggctcagggtgggagatgactcttcggagaggccgcaggaacggctcaagggagcccgtgggggaggcagctgtggccgccctgcgtgacgcacggactcactttcacctcctccgtgacctggaagtcctcgtggacaacgttctctacctccaccatgagcacctcagccgggagctcaggggtgggctccatcgccagctccgccgggtgcctggcgctcagctcgtcctccgcctccttcttgcccygctttgacttcctgcggggcttgtgcttgttctccgcctccggctcctcgggctccacctccagctgtctgctgatatggactctgacacgggagcaaggcaggtgtgaatcagccgctgaggctgggagctggacccggctgaggcctccctggtggcacaggtggtccaagggtcccgctgagcccagacctctggagccacagggtggctacagggtcctcaagctggagacgtgagccgctttctcggggcctcccaaccagtgtcccctccaccccttagactccagccagattc

SEQ ID NO: 3183 - DNA, 601 bp, Human
ggacgacagagcagatgatggcacgaagccctcaaaacccagacaggccttcttggcttgccctggccgatgccaccggtccctccgtgtgctccagagcctgactgatgtcacgtggcccgaggggaaggcccccaagagtggctgcgcctcagccgcgggctcacctcccgccccaggcgctgctgcagcttgctcagttcaaattccttcttcagcagggagagggccttgtacagccgcttaggaatctgccgagacagggaggacagaaaggatgagcagaagtcggcatctgtgygtgtagggccgaggttgggggaaaatgcgcaccctgagagatgctgccgggaggacctggccatgctgtacccagcacagaggcatgtgtgccctctgccccaacaaatcccgtgctggaaacgcatcctacggatacttcacaggccctccagctgcgtgcatggggacgcgctcaggagtgctgctcacaacagcaaaagactggcaacgccccgggtacacggcccagaggatcccactgaacccgcaacggtgactcccaaccgaaggctatgaagccaccgaaaggcggatggat

SEQ ID NO: 3184 - DNA, 601 bp, Human
ccatttaacaatttaacaccaaaggacaactaggtgctaggagaccgcggccacccggcagtgccaggcccgttcagcagttcccgggaccctgaagaccgcaaatgctccactctctccggtccaacccagagaagcagtccaccaatgcctctggctcctgttttttttttttttttttttgagatggagtcttgctctgtggcccaggctagagtgtactggtgcgatctcatctcactgcaacctcagcctcctgggttcaagcaattctcctgcctcagcctcctgagtagctggrattacaggtgtgagtcaccatgcctggctactttttttgtatttttagtagaggcgaggtttcaccatgttggtcaggctggtctcgaactcctgaccttgtgatccacccgcctcggcctccccaagtgctgggattacaggtgtgagccaccatgcccaggctctgactcctgttttttaacctttgactcccacctgcctgcctggtttccaatgtctcaggagtgatattttaaaaattaatttaaaattaattaattttcagacaaggtctcgctctgtcacccaggctggagtg

SEQ ID NO: 3185 - DNA, 601 bp, Human
acctgcacactgcctttcagacgtctgagggctgcgagaagggaccaggattgtccgggaggctgagcacatcagagctgccactggccacggggaggggcagcctgtgacaagggctccatttaacaatttaacaccaaaggacaactaggtgctaggagaccgcggccacccggcagtgccaggcccgttcagcagttcccgggaccctgaagaccgcaaatgctccactctctccggtccaacccagagaagcagtccaccaatgcctctggctcctgttttttttttttttttttttgagatggagtcttgctctgtggcccaggctagagtgtactggtgcgatctcatctcactgcaacctcagcctcctgggttcaagcaattctcctgcctcagcctcctgagtagctggaattacaggtgtgagtcaccatgcctggctactttttttgtatttttagtagaggcgaggtttcaccatgttggtcaggctggtctcgaactcctgaccttgtgatccacccgcctcggcctccccaagtgctgggattacaggtgtgagccaccatgcccaggctctgactcctgtttttta

SEQ ID NO: 3186 - DNA, 601 bp, Human
gccgcaggtcccacctgtctctcccgggcccaggagctcccagaggcacggcctctgcaggctctggggggcgccccctgctctgggaaggggacagcagtggggaggggctgggcttacctccgcaatggccagcttctcctgggccacgtagcccgacacgttgatcatctccatacggtctcgcagcggctcggggatggtgtccgtgacgttggccgtgcagatgaacagcacctgggggcggcggcaaggtgctgggggactggccgcttaccctccccagcaagcccaggccccrgacaggccccccaccttggacaagtccacgggcacgtccaggtagtggtccaggaagttggcattctgctctgggtccagcagctccagcagtgccgacgacgggtccccctggtagcctcggccgatcttgtccacctggggcagcagacagcaggtggtgcccctcgccgtgcccctggccagcccgcccagtggggagaccccagggtcagggctggggagaccccgagtgagagcggcacccacaccctgccttggacgggcagcctgctgggcgtggctgtgggtgggagggacc

SEQ ID NO: 3187 - DNA, 601 bp, Human
cctccctcaggggtaggtcatggtggggaggggcagctgggcacaggggagagcaggcatcttctacagaggcctgggaagctgtgtgccagacagcgccgagcccaccagacccagactcacctacagctggagatccccacttccctgtgcccacagaatctgccctttgcagtctcccatctccccaacccaggcctcagcctgtctcatttttctatcagacgtgctggaagagcagcagaatcaggcccagctcccaattccctctccccagtcttctccaggtgtcccctcccaygagcgcacaggaaaaggaccacatggcctggcgagccctacacccactgctactgctgctgctgctgttcccaggtgagggggaggaggagcccagggagcagaggagatgggtgtggtggggactgtcaggacagcagggtcagggagcaggtggctctgtggccagaggcctgctgtgaggcaggttgtgcgcgtggccttgacctatgcgttacttcatcattctccaggctctcaggcacaatccaaggctcaggtacttcaaagtgtggcagggcagacgctaaccgtgagatgc

SEQ ID NO: 3188 - DNA, 601 bp, Human
aaagaaaaacaatattttgtgacatacaggaaattcaaatttcagtgcctataagtggagttattttttggaacacagccatgcccactcaattacctattgtctgtggcccttttcatgctgtgacagcaaaattgagcagctgtgacagagaccacatggctcatccctgaccctttacagaaagtgtgccaaactcctgctcagagcagagctacccacagttcctgtggaagaggaccttctaaaaaaaaatctgcaattcacatgagtaattttttttgtaaaatacagtaaaaamaaattactagaaaaataagaaaaagatatataaagtacaagcccaacatttattaaatttgacaaacataaaattacattttaatgaatacaatcagaacaaatatcacatagggaaaaatttataaaaactgtatacattgttcatttgaaagtgtgcctaaaggtgattgatgtagtggcttaacggtatacccataacgttttgtcattcctcagttaaaactaagtacaaagctagaagggaaattgcagttctccatattaaatgccaatatgcacccttcaaacaaacaccctg

SEQ ID NO: 3189 - DNA, 601 bp, Human
ttaaaactaagtacaaagctagaagggaaattgcagttctccatattaaatgccaatatgcacccttcaaacaaacaccctgtctttccgtttttaaggattataatgtgacaaatgagcacttttcttacttggtaactttcctaatctgagaactatttatgacaccacatcacttaggagataatgtataaagaaattgtgttgattttttttaaaataatactcacagtagaagcccagaaaactggtctcacggaggtataatgtcagaaatagaagaaattttaaagcaattcckacaagctcaacagttttatatttaacttttacaaaaggaagcaagcgatgctgtaatttcaaaatgcatcttcaatcctttatcagtagccagttccaaaactttatcctaaaacttatagtttaaattatctttcgatgggaaaatatggattctagatctatgaatttcctctgcatatatcttcttctgacaaaaaaacgaaattcaaaacatgctatcaaattattaatgttttcccatgagcacttgtgaagatatgcaatatcaatattatcacttattttgttgataaatgtt

SEQ ID NO: 3190 - DNA, 601 bp, Human
attcaaaacatgctatcaaattattaatgttttcccatgagcacttgtgaagatatgcaatatcaatattatcacttattttgttgataaatgttattaaattaagaacatgtcataacaattcatagaaatggttcttctgacttttatgtttgcacttagactttacttgccattgaaaaacatgtcgctttacttccttgcatggaaatattaacttcagaactacagtataaacaagtctgatggtacaattcacatttgtactaaactggcttcttgtcttaattaggaattcttyctatagatgaaacatgctcaacaaaactttaaatttggcatgcaacagtagctgtttatgatctgtttccatattaccacataataaagagaatgatttcaaatttaatatattcaccttataaaattcacaattctgtccatgttggtcagcacaacgttcagttaagctgcttttttttcatagtaaaactctctcaatgaaggaagcagtgcattaatttaaaatctagcccaagacttcttaacctggatgacattttcctgtcattgcaactgcagccatcagaacatactctta

SEQ ID NO: 3191 - DNA, 601 bp, Human
caaattattaatgttttcccatgagcacttgtgaagatatgcaatatcaatattatcacttattttgttgataaatgttattaaattaagaacatgtcataacaattcatagaaatggttcttctgacttttatgtttgcacttagactttacttgccattgaaaaacatgtcgctttacttccttgcatggaaatattaacttcagaactacagtataaacaagtctgatggtacaattcacatttgtactaaactggcttcttgtcttaattaggaattcttcctatagatgaaacatrctcaacaaaactttaaatttggcatgcaacagtagctgtttatgatctgtttccatattaccacataataaagagaatgatttcaaatttaatatattcaccttataaaattcacaattctgtccatgttggtcagcacaacgttcagttaagctgcttttttttcatagtaaaactctctcaatgaaggaagcagtgcattaatttaaaatctagcccaagacttcttaacctggatgacattttcctgtcattgcaactgcagccatcagaacatactcttacataaaacttaacccc

SEQ ID NO: 3192 - DNA, 601 bp, Human
tggattgttggtctttgcagtacaaaatgttactttacaagaagccacaaagtctagagcttatatgtgaagtatggattcctttcaagagcttttcaatccaatactcttttttctcctaaaaacagtttgttgtgaacttgtgtttttccgttttatatgtatatgccacttgtttttttgttttgttttatttcgttttgaggcggagtctcgctctgtctggagtgcagtggtgcaatctcggctcactgcaacctccacctccagggttcaagcgattctcctgcctcagcctccrgtgtagctgggactacaggcgcctgccaccacacccggctaatttttgtatttttagtagagatggggtttcaccatattggtcagcctggtcttgaactcgtgacctcaggtgatccgcctgactcggcctcccaaagtgctgggattacaggcttgagccaccatgcccagactatgccacttgtttttgttgttgttgttattgttgttgttttgagacagagtctcactcagtcacccaggctgcagtgcagtggtgtgatctcggctcactgcaagctccgcctcctgggttcac

SEQ ID NO: 3193 - DNA, 601 bp, Human
caagaagccacaaagtctagagcttatatgtgaagtatggattcctttcaagagcttttcaatccaatactcttttttctcctaaaaacagtttgttgtgaacttgtgtttttccgttttatatgtatatgccacttgtttttttgttttgttttatttcgttttgaggcggagtctcgctctgtctggagtgcagtggtgcaatctcggctcactgcaacctccacctccagggttcaagcgattctcctgcctcagcctccggtgtagctgggactacaggcgcctgccaccacaccckgctaatttttgtatttttagtagagatggggtttcaccatattggtcagcctggtcttgaactcgtgacctcaggtgatccgcctgactcggcctcccaaagtgctgggattacaggcttgagccaccatgcccagactatgccacttgtttttgttgttgttgttattgttgttgttttgagacagagtctcactcagtcacccaggctgcagtgcagtggtgtgatctcggctcactgcaagctccgcctcctgggttcacaccttctcctgcctcagcctcccaagtagctgggact

SEQ ID NO: 3194 - DNA, 601 bp, Human
tttatatttttactagagatggggtttcaccatgttagccaggatggtctcgatctcctgacctcatgatccgccctcctcggcctcccaaagtgctgggattacaggcgtgagccactgcacctgacccaactcaaggtcttcaaccttaatcacatctgcaaatttccctttgccatggaaggcaatgtcctcacaggtacctgggattagggagtagacattttggggtacccgtattctgcctaccacaatgagagattctactttcaaacaaaaccagcacaaactctttggaatractgcagaaggaaaaaatttatttagaatcagttctaccatcttcatctggcttactgtcactgccacattcaggaaagatgttttttttcagtgatttttgttttgctatctgttcattagaatgctaattaggtaatcactattctactctaacttagctaatcatgttacactctaaattttgtttaaaaaaagtttgattaaaaattaaaatgattgtaaaaataataaatcataaaattatacatctttcgagatgtttatacacttttgggctatagctaacaactttatttat

SEQ ID NO: 3195 - DNA, 601 bp, Human
atttagaatcagttctaccatcttcatctggcttactgtcactgccacattcaggaaagatgttttttttcagtgatttttgttttgctatctgttcattagaatgctaattaggtaatcactattctactctaacttagctaatcatgttacactctaaattttgtttaaaaaaagtttgattaaaaattaaaatgattgtaaaaataataaatcataaaattatacatctttcgagatgtttatacacttttgggctatagctaacaactttatttatttatttatttatttatttattgtgagacagagtctcactctgtcacccaggctggagtgcggtggcgcgatctcggctcactgcaacctccacctcccaggttcaacccattcccatgcctcagcctcccaagtagctgggattacaggcgcctgctaccacgcctggctaattttttgtattttagtagagacatggtctcaccatgttggccaggctggtctcaaactcctgacctcaagtgatccacctgcctcggcctccaaaactgccgggattacaggcgtgagccaccacgcctggccgctaacaagtaatttt

SEQ ID NO: 3196 - DNA, 601 bp, Human
aagtttgattaaaaattaaaatgattgtaaaaataataaatcataaaattatacatctttcgagatgtttatacacttttgggctatagctaacaactttatttatttatttatttatttatttattgtgagacagagtctcactctgtcacccaggctggagtgcggtggcgcgatctcggctcactgcaacctccacctcccaggttcaacccattcccatgcctcagcctcccaagtagctgggattacaggcgcctgctaccacgcctggctaattttttgtattttagtagagacrtggtctcaccatgttggccaggctggtctcaaactcctgacctcaagtgatccacctgcctcggcctccaaaactgccgggattacaggcgtgagccaccacgcctggccgctaacaagtaattttaaagtatcacacattgtaacatggctctggcataggttactagcacacagctcactccatattcgaccctccatgctaatttgacaacacccaagctggtctatatcctgttcaatgagatgagacgagttaactaatcacgggcttggatcttgaggcagtatcaaattgata

SEQ ID NO: 3197 - DNA, 601 bp, Human
tgctggaggaggggcaggcttggggaaagggacagggtgtgagaacggattcaagtcacttcatgtatttctcccctcatctcaagggttttaaggaatcggcacatgcagcatcaagggaggtctctgctgcacccagctcagcccaggccccaggcccatagacacttcccactgagccacagggcaccaggtgggcggccagtctccaacaaggctgggctcccagcagctcctccctgacttctgacctctgctgttatccgcaaagaaaaggccaggacttgatccaaggcctttrgccacgctctccctgcagagctgcagaacccaggccctctacttgctcaccctcagtttgcactgcggccagcaccccgttgtgggagcaaagcccagcgcctgcagcatctttctaccaaacctgagtcactgatgacattccctcttccctgcctcctcctcctatctatagcccctgataaaagaaaaacgtgaggcctggaacgctggtggctgacacctgtaataccaccactgtgggaggccaaggctaaaggatggcttgaagccaagagttcccagttgcagtgagccatga

SEQ ID NO: 3198 - DNA, 601 bp, Human
tttggtttgggctgttgggcctagtgcaggagctcagtctaaatcaatggcctcttattactctgatttaacaccccaaatccagacgcctgggtcaccccaacgtttccctctccctctgcccttgctcagccacactctgccaaggcctctcctattgtgcctcctccccctttccaagccccttcacctcacactggcactcggaccactgtgtcagccacctaacagggggtcctgtcttcagtccccgcctcctagattgttcccctgatatgtcccttcccaacaatacctctgygcatttctgccacccaggaattgaagtccagtgtcgttactggggtcccaataatgctttgcctagatcagccacccctgtagcacagcaccccactgtgctgtccttaccaccaccaacatggctgcagcctccacaaggaagtgaacctttcttttttcctgcacaagctggtcaagaggcgcctcaactcgccacattcaagatcactccgtgccttgccccaggcctgtcacccccacagtgctgttgtctctttctgacgcttacaatcccgatgttggacctaccagactgaga

SEQ ID NO: 3199 - DNA, 601 bp, Human
tccatattttctatgtcctccaagtgcccatcatatcttttattttctcctttcattgacctctgtctttcttcagagctttctggaaacctttgccgcttctcggccacccacttgcttagaagccccatgcgggccgcggggtgctgtgggctccaggcggattgggcgggagtatggctccattttttctctttcacagctctgtttctctagaaaggactcttagctgtccttcctgggagtgtaagtctagacccagggttctaggcaccaactggaacagagcaaaggggtctcrctgcccaatgtctgttcccacccaggcccccactgcacactctctctctgtggcgccctgtgccctgagcagagcatctctgtgtcaccctcatcagagacttacctcaagctctctgcagctgttgagagagaggaaagacagaggatgtgggcagctaacctactctcagtctcacggaagccagagaatctaggagtctaagtgattcttaaagttccaacctgttctctggtttccagcacccacttcaaccctgccttaagagatacctgcacctcccatttctccaactttctg

SEQ ID NO: 3200 - DNA, 601 bp, Human
ccactcccaccagctctctctgatctgtgaagtcatctgattttacccaccttcaaaacatgtatggagctctctgtttatctttgaggatgggtttatgccatttttatccagttattgctgctttcaccttcttggcaagagtgaggagggaccccagattttccatcaaaacacccctccccagcacccgccaccaagggcaggagcaagtgagatcccaggtctccacttgctcctgtaaagactcctggccccctccccttcccccaaggtcagcactcagactccagtacagccycttggtgccttattatatccctgttcactctagttgccataagatgcccaggatgccctggtcctccctcatcacccagaatcccaactcagtaagaccttgaaaatccatgacattagccccaattcccactcgtcccaaatcccataacctttccaccctgcacctgaagtgcgcagtcatcagcacaagctcctgtatgctcagcttctctgaacgtcaccgcggtactctccctgacatctgcctgttctccgaggacaatgctttctccgcagttctcttgcggggggagggagg

SEQ ID NO: 3201 - DNA, 601 bp, Human
gcggtactctccctgacatctgcctgttctccgaggacaatgctttctccgcagttctcttgcggggggagggaggcggtttgttctcctttgcctcatgctcctgagcccgagggtggggtcagtgtcctctgtgcccctcacagccccttcctatcttctgatcctccctaaagcactccacaagtagctttctgccattaggctgtatcactgtgggtgaccacccatcatcactgcagattctgtacaatctggggcacggctctttattcctcatgggtctcaaccccaggctcarcgtcactctgactgctcccgccataattctttgtgatcttgggcccacgtagacaagatctacatgaatgattcttccaaatctctggcatcacagttccttggcctcctatccccagtggtctcgtcctcttccctatttcagccaccattgcagatggtcagtaagcgccaatagcccccctcttaatctcattcccaccaccccctacctcaatcctgctaacctgatcccagtattgcttcaacaccacagggacccatgatccattgatcctgccacccgcccctttccgccatc

SEQ ID NO: 3202 - DNA, 601 bp, Human
tgggtgaccacccatcatcactgcagattctgtacaatctggggcacggctctttattcctcatgggtctcaaccccaggctcaacgtcactctgactgctcccgccataattctttgtgatcttgggcccacgtagacaagatctacatgaatgattcttccaaatctctggcatcacagttccttggcctcctatccccagtggtctcgtcctcttccctatttcagccaccattgcagatggtcagtaagcgccaatagcccccctcttaatctcattcccaccaccccctacctcartcctgctaacctgatcccagtattgcttcaacaccacagggacccatgatccattgatcctgccacccgcccctttccgccatctcacccatgctttcctttcccttagattccatgatccaacctcaaatcagtctttggcacacagcctccccttctgtgctcctctccccttttattgaactcctctgggaaaactgtaaccctggttgaacctagcttcctgcttactctgtgcctgtgtccagccaagatgaatgtggctgtggctgacaaaatacaatctatcatcccgaaatg

SEQ ID NO: 3203 - DNA, 601 bp, Human
aagagggggaaagagagaaagagagggagggagggagggagggagggacagaatgagaggaagagaaaaagaggagggaagaaggaaagaaggaaaagggagggagggaaggaaggagaaaaaagaaagtccacttgatcccaccacacctaccaatcatctgcctctcttcttcctctcactctccctactcttatctcaagccaatcactttccttcagctccaaataccatcttctcttgtctacacaagaatattccagccgagcatggaggtgcgtacttgtggtcccagctactygggaggctgaggcaggaggattgcttgagcctgagaggtggaggctgcagtgaactatgatcgtgccactgcactccagcctaggtgacagagcaagaccctgtctaaaatagaaaaaggaatattcatccaggagccacccctctctcctgcatcatcttcccgggttgtatgtcatgaccatcagaatctaaatgggctctaatatattaaaccctccccacctacagccctccagctactgctccattatcttattgtcctctgcagcaagggcccatgaaaggactggctgcacca

SEQ ID NO: 3204 - DNA, 601 bp, Human
gagaaaaagaggagggaagaaggaaagaaggaaaagggagggagggaaggaaggagaaaaaagaaagtccacttgatcccaccacacctaccaatcatctgcctctcttcttcctctcactctccctactcttatctcaagccaatcactttccttcagctccaaataccatcttctcttgtctacacaagaatattccagccgagcatggaggtgcgtacttgtggtcccagctacttgggaggctgaggcaggaggattgcttgagcctgagaggtggaggctgcagtgaactatgatygtgccactgcactccagcctaggtgacagagcaagaccctgtctaaaatagaaaaaggaatattcatccaggagccacccctctctcctgcatcatcttcccgggttgtatgtcatgaccatcagaatctaaatgggctctaatatattaaaccctccccacctacagccctccagctactgctccattatcttattgtcctctgcagcaagggcccatgaaaggactggctgcaccatcagcctccaaaattctcttttcttctctcttgaagccactccagtcaggcctttgactatg

SEQ ID NO: 3205 - DNA, 601 bp, Human
aggagaaaaaagaaagtccacttgatcccaccacacctaccaatcatctgcctctcttcttcctctcactctccctactcttatctcaagccaatcactttccttcagctccaaataccatcttctcttgtctacacaagaatattccagccgagcatggaggtgcgtacttgtggtcccagctacttgggaggctgaggcaggaggattgcttgagcctgagaggtggaggctgcagtgaactatgatcgtgccactgcactccagcctaggtgacagagcaagaccctgtctaaaataraaaaaggaatattcatccaggagccacccctctctcctgcatcatcttcccgggttgtatgtcatgaccatcagaatctaaatgggctctaatatattaaaccctccccacctacagccctccagctactgctccattatcttattgtcctctgcagcaagggcccatgaaaggactggctgcaccatcagcctccaaaattctcttttcttctctcttgaagccactccagtcaggcctttgactatgccactccttgaaacacctccagtgagttctgcactgtgaaatccagcagcc

SEQ ID NO: 3206 - DNA, 601 bp, Human
cccaccacacctaccaatcatctgcctctcttcttcctctcactctccctactcttatctcaagccaatcactttccttcagctccaaataccatcttctcttgtctacacaagaatattccagccgagcatggaggtgcgtacttgtggtcccagctacttgggaggctgaggcaggaggattgcttgagcctgagaggtggaggctgcagtgaactatgatcgtgccactgcactccagcctaggtgacagagcaagaccctgtctaaaatagaaaaaggaatattcatccaggagccrcccctctctcctgcatcatcttcccgggttgtatgtcatgaccatcagaatctaaatgggctctaatatattaaaccctccccacctacagccctccagctactgctccattatcttattgtcctctgcagcaagggcccatgaaaggactggctgcaccatcagcctccaaaattctcttttcttctctcttgaagccactccagtcaggcctttgactatgccactccttgaaacacctccagtgagttctgcactgtgaaatccagcagccaatgctgaaatctcctcaccctggga

SEQ ID NO: 3207 - DNA, 601 bp, Human
gagcaagaccctgtctaaaatagaaaaaggaatattcatccaggagccacccctctctcctgcatcatcttcccgggttgtatgtcatgaccatcagaatctaaatgggctctaatatattaaaccctccccacctacagccctccagctactgctccattatcttattgtcctctgcagcaagggcccatgaaaggactggctgcaccatcagcctccaaaattctcttttcttctctcttgaagccactccagtcaggcctttgactatgccactccttgaaacacctccagtgagttstgcactgtgaaatccagcagccaatgctgaaatctcctcaccctgggaagaggagcaccctaggcatggcctcccacttctgccttcttgagatgctttcttccagggcttccaggaaaaaagaactcttgtgactttctcctgactcatttgatgttgcataataaattagccccaaaacgtagtagcttaaaacaacaaatgatacatattcattaggtcacaggttttttggggggatgggggtgtgatcagaaatttgggaacaacttagttgggtgttcctggctcagaacctct

SEQ ID NO: 3208 - DNA, 601 bp, Human
aaattatttacattcctcccacatgcaaaaatacactcagtcccaccaaaggtctcccaaagtctcatcccattatggcgtcaggatgaggtccaggaactcatcatttaaaccaggtccaggtgtggaggaaattcctcaggtgtaattcctcaaatacaattctcagtatgaagacctgtgagctagagacaagttatctgccacacacacaaccccaatgtccaatgcagtacagtcataggaaaaccactacagatatttttgttcaaaagaggtggaagggggagacaaaaaaaamaagtcactggtccttagaaaatcagaactttagctgggaaaatgttggaaattccttgattcagacactgctcaactcctacctagaaataattctcagtggtcgtggctccttcctctgtgctcgagtatgtcttctgagccacccttctctttccatgaaaggcagcccatatttacagcttcgtaacttcctcaggctgcttcctgccagtttaatttgggggatacaaagtgagatcccagattttatgctatttctgttcctttcagtccaatctggcagtgttttgtgactgtc

SEQ ID NO: 3209 - DNA, 601 bp, Human
tagagacaagttatctgccacacacacaaccccaatgtccaatgcagtacagtcataggaaaaccactacagatatttttgttcaaaagaggtggaagggggagacaaaaaaaaaaagtcactggtccttagaaaatcagaactttagctgggaaaatgttggaaattccttgattcagacactgctcaactcctacctagaaataattctcagtggtcgtggctccttcctctgtgctcgagtatgtcttctgagccacccttctctttccatgaaaggcagcccatatttacagcttcrtaacttcctcaggctgcttcctgccagtttaatttgggggatacaaagtgagatcccagattttatgctatttctgttcctttcagtccaatctggcagtgttttgtgactgtcattctcttaaaaaaaatgtggatctcctgtaaaacttattgtgactcactccattagacaaagaccatacccacaaatttctccaagagaagatctcttccacaccatgtgcttctgacaagaaagtgaggataatgtctttatacttcttagaagatctaatgttcgactgaaaaatctatgaag

SEQ ID NO: 3210 - DNA, 601 bp, Human
gctatttctgttcctttcagtccaatctggcagtgttttgtgactgtcattctcttaaaaaaaatgtggatctcctgtaaaacttattgtgactcactccattagacaaagaccatacccacaaatttctccaagagaagatctcttccacaccatgtgcttctgacaagaaagtgaggataatgtctttatacttcttagaagatctaatgttcgactgaaaaatctatgaagcacgcacccttaaattcatgaaagggccttttgcctgagacactatgtgaaataataattattatayattattgaaatcattataattttatataaattattatagtttattatatttttaatatattttataaattttttatatttttattttttatattttatttatatattttatattaatttttattaataattttaaataaattataattttatatattatgcatatattatcatgtatataattttcatatatatatatatttctttgaccctagttcctgacacagagctcctgagacccttataaatgggagtgctaagataatcttttgttctcatatttggtctttgacctctgctc

SEQ ID NO: 3211 - DNA, 601 bp, Human
gtgactcactccattagacaaagaccatacccacaaatttctccaagagaagatctcttccacaccatgtgcttctgacaagaaagtgaggataatgtctttatacttcttagaagatctaatgttcgactgaaaaatctatgaagcacgcacccttaaattcatgaaagggccttttgcctgagacactatgtgaaataataattattatacattattgaaatcattataattttatataaattattatagtttattatatttttaatatattttataaattttttatatttttattttytatattttatttatatattttatattaatttttattaataattttaaataaattataattttatatattatgcatatattatcatgtatataattttcatatatatatatatttctttgaccctagttcctgacacagagctcctgagacccttataaatgggagtgctaagataatcttttgttctcatatttggtctttgacctctgctcctgacacagagctcctaagacctttctaatctcctgagtgataggagtgtctaacacagaggtcctacctcccttggaatttcctggc

SEQ ID NO: 3212 - DNA, 601 bp, Human
aagtgaggataatgtctttatacttcttagaagatctaatgttcgactgaaaaatctatgaagcacgcacccttaaattcatgaaagggccttttgcctgagacactatgtgaaataataattattatacattattgaaatcattataattttatataaattattatagtttattatatttttaatatattttataaattttttatatttttattttttatattttatttatatattttatattaatttttattaataattttaaataaattataattttatatattatgcatatattatyatgtatataattttcatatatatatatatttctttgaccctagttcctgacacagagctcctgagacccttataaatgggagtgctaagataatcttttgttctcatatttggtctttgacctctgctcctgacacagagctcctaagacctttctaatctcctgagtgataggagtgtctaacacagaggtcctacctcccttggaatttcctggcatcttttcctctaaagaggtgactcttagtgtgctcttggatgggggctggtcaccagaaggatcaatccatgattgaaagct

SEQ ID NO: 3213 - DNA, 601 bp, Human
gtagggtgatgtattcaaaaagcaccagacaaaaggagaacacccaacaaaggctgagttttagagggagtgaggtgtagaagaaagcagactcaactgtgacacagcagagaccatctgcctttccagagcttactgcagctgaaaagacagataatagtgtgtgggcagagggtgaacctggagacttgaaggaaacaggcccctcttcttggtggacagtagaggaaaataaaggaaaaaatcagggtgaggaaactgaccaaactgggctcaaaatccatgcatgctcactgacacytttctggcagcagtggccaggagcagacttcatccttgtgaggtgggtatggcaaccaaccctgcgagtagtgggatggggaaggggttgcctctgcacctatgtgcaattatgtggcagtctctgaccaccttcctggtttcctgctctgattgcaggggggacatatggtggaaaaccgtgatggagctcaggagcctggatacccaaaaagccacctgccaccttcaacaggtcacggaccttccctggacctcagtttcctcacctgtagagagagaaatattatatcacactgtt

SEQ ID NO: 3214 - DNA, 601 bp, Human
tggagacttgaaggaaacaggcccctcttcttggtggacagtagaggaaaataaaggaaaaaatcagggtgaggaaactgaccaaactgggctcaaaatccatgcatgctcactgacacctttctggcagcagtggccaggagcagacttcatccttgtgaggtgggtatggcaaccaaccctgcgagtagtgggatggggaaggggttgcctctgcacctatgtgcaattatgtggcagtctctgaccaccttcctggtttcctgctctgattgcaggggggacatatggtggaaaaccrtgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacactttgtgaataataaaattatctgaatgttttattcctgttgtttcctaagtttccttcaaactctgtctgcatccgcacatttgatctctaggggaccagcttctctagtttgccctctttcctccatcataaccctttctta

SEQ ID NO: 3215 - DNA, 601 bp, Human
gagcaagaggctgctcctctccctcccagggcccctccccaggtacctctgaccccaggaccccctagggagaaggggatgcagccagatgctgaggacctccctggggaagggtccagcagggcccagagactgaagaagggaccgtcggggctggggtggctcctaggagcaggtctgcagccctgtgtcccttctgcctcccaggcgggagtcctccctcccaggcgggacacgtaccttcccgaaccagccacggccgatttccttcaggtacaggaggctgtgccggcccacgtcygtggacttgaggagctgcactgtaaccaagcagggggttcagggacccagtgtggcctccgcaccccccagcttcctcacccggcccctggaggggctgcccgcttggccttttctgggaaactgtcctgagtccctagcaccagctggcaaccttggggccaccatcaggagccagggtctcttgagagcaggggccgctgcttcccagaaaagccacggagctgcaggatccatccgggcatctttctgggtaggtctggagaaggtgcctgaagccactgggatagcccggccaggg

SEQ ID NO: 3216 - DNA, 601 bp, Human
cccgagggaagccagcaggggatccagcccagccacagacagcctcggctcagtgcaggagctgcatatgtggaagggggtggggggcaggtctcgggggagggggggacgggtccccggggcaggggggcgttgatgggcaggtctcagggggagggggggacaggtccccggggcggggggcgttgatgggcaggcccagaactccaggcagcctggggaagtggccaggcccagccccccatggcaaaagcaagcctgagtgaggccgtggagcccaagtgggccagtgccccccccmagttggcccaggatgcctcctcctgaaccacagggcacacaagcaggtgaccaagcagctggcagctccccaggggtgcagggagccccagcccaggcctgttctgtgcccagcccccacagtccctccctggtgaggctaggtctccccatcgcctcctctggaaggtggtgggggcagggtccctgggtcttggctttagggaggatgtgaggcccccaaggagggggtggcaccagacactggcagggcaagggagggccccggctcagcaaagaccccagcatccccccgggcagc

SEQ ID NO: 3217 - DNA, 601 bp, Human
atggggaggggacggaaggaaggggcaggcggggtccggtagtgccctcagcctccgtggcaagcttgggctctgcctgcgggtggtcacccccactactggctgtctctgtccaggagggtgtaaccaggcagggagcaggtgccaggccctgggcagagcatagatgagggaggccggggcagcagcctggctcctgggcagaggctgcctggagcccaagcagaggctctccagggtaccccggctcgggggaggcccgtggggtctgctttggactggggcagccctcagcgtggcmgcccgcagagacggggtcccaggactctggacagcggctgccgctgttgttgttggctgacacgttggagcgccagtgcccgcgctgggcggccctccgcgctcccacctcctctagctcatcctcgccagtcagcggcagcgggggcgcccctgagctccccaaaggggacgtgcccagtgggtcctcgaagaaggcaggacagaaggcggccacgccccagtctgcatcctccgctcctccctccgccagactcaggggccccgccgagggcgagggagagcgtgaggggcagagcgg

SEQ ID NO: 3218 - DNA, 601 bp, Human
ttgcaaatacctgtgactcttcctggcatcttgtttctggccctgggagctggaaatgcaaaagaaaaatgtccacagaagcaactgtcagccatggaggatggagaaatggtggataaagaccccagctccctcctgctacaattggaataacactgagttctccttttcctctcccattcccccagttacccccacttgataggacacctcgtagcagcttccttctgtttcctgtatctcctttctctaccaagtgtttcctggtgtcccctcccacataacccacttgcatccgaaaccttgtctcaggcctgcttcagggagaacctagagcaagacatgtattttcctgctgttctcttccaaccaccctttcttccctactttttggccttttttttttttttggagagaagaactattctgccatcttgtcctcagcataacatatcatagctttttatttatctctctctttttttcaagcctgagaacataatgcttttggatagaaatgtccccaaacctcggatcaagatcattgactttgggttggcccataaaattgactttggaaatgaatttaaaaacatatttg

SEQ ID NO: 3219 - DNA, 601 bp, Human
atgtccccaaacctcggatcaagatcattgactttgggttggcccataaaattgactttggaaatgaatttaaaaacatatttgggactccagagtttgtcggtaagtttctttgctcctgtggtcatttacgtctcataaacattattctggcaaacctcccctgctagaagattctttccctgctacatgttcctggttgttgcatgaagatagaatcggttagtttgcttcctcccaagctaaatgagtgtttgtttcctcttagctcctgagatagtcaactatgaacctcttggtcttgaggcagatatgtggtaaggagtatgtccttggtgttgtttgctttctgatttatttgactattcttctgacatgtttttttgtttgttttgtgttgtttttaggagtatcggggtaataacctatatcctgtaagtatcagaattcacaactcatactctcttctcttctatgagaccataggtttaattaaccattaaatgtgctgtgttgatctcttcagcttatgcatgcttttgatgcaaacatattcattttacacccccaaaacatgtttagtttatactaattaaacatg

SEQ ID NO: 3220 - DNA, 601 bp, Human
ctctgagatccctctcagctctacattacttgatgatacccaagttcaaatgcctcataacatagcctcaccatgaatattgccattcccaaactatcagtgtggaaagtcgtgatttagtttgaccccaagctctacttctccccagtgtccatggatgatacgaaaccctgagatagaagagtgagcccgctaagactaggtgcctaggtattccatgttatcccaacttcttatgctaatttaataaggtgaatgtgtaagcatcctgaataaggagatgtttcaaaaaattgtcatrtaacacattttcataatttgagagctttaattttttttcttggatttttattttagcctaaagatacacaacaggcacttagtagaaaagcatcagcagtaaacatggagaaattcaagaagtttgcagcccggaaaaaatggaaagtaagattgtttgttgtggagggattaacaaattctgtttcctgtgtagagtagtgtgtggtcagggtgcatctcctctgatactggtaatatggaagatacatcctttcctctttttaatccaccctgtagtgttctgcaccattactctatt

SEQ ID NO: 3221 - DNA, 601 bp, Human
ttggttatcacattgtctaccatcactgcttatgtggcacaaaggacacagagcaaggcccctgcagtctgtgcttctctgagggtgatctgcaagggtcagatcaccttctccaaacagcagagaagaaaatatagagagagaaaggatgtggggtgtccagctctgtagttcaataatgaaacatggaaggagaatctctatatcctgttgtcttgatttataagacctttaaaattattctttaagcaaatacaacccattctgctgtaggattgcccaccctgggagagtgtgtgcygatagcaatgaacacgatctcgcaggctttgtcgtttgtactcatttgacaattgttacataagctgtctctcctcctctcaccctgcctttttcctccccgccctcccttttttttttttttttttttaaaaaaaagcaatccgttcgcttgatatcactgtgccaaagattatccaggtcattcctgtccagaagtaacatgagtgttgccagaagcgatgatactctggtaagcaaacccgtgagccctggtgctccccttagcactgggtactcagaatgaccaagctgttctatt

SEQ ID NO: 3222 - DNA, 601 bp, Human
gggtcagatcaccttctccaaacagcagagaagaaaatatagagagagaaaggatgtggggtgtccagctctgtagttcaataatgaaacatggaaggagaatctctatatcctgttgtcttgatttataagacctttaaaattattctttaagcaaatacaacccattctgctgtaggattgcccaccctgggagagtgtgtgctgatagcaatgaacacgatctcgcaggctttgtcgtttgtactcatttgacaattgttacataagctgtctctcctcctctcaccctgcctttttyctccccgccctcccttttttttttttttttttttaaaaaaaagcaatccgttcgcttgatatcactgtgccaaagattatccaggtcattcctgtccagaagtaacatgagtgttgccagaagcgatgatactctggtaagcaaacccgtgagccctggtgctccccttagcactgggtactcagaatgaccaagctgttctatttgttcaacctcccaggaacctgaagttgtggaaatggcaagcttattcttgatcccctcggaggggtttgggggtgctgattgatgcaccctctt

SEQ ID NO: 3223 - DNA, 601 bp, Human
aaaatatagagagagaaaggatgtggggtgtccagctctgtagttcaataatgaaacatggaaggagaatctctatatcctgttgtcttgatttataagacctttaaaattattctttaagcaaatacaacccattctgctgtaggattgcccaccctgggagagtgtgtgctgatagcaatgaacacgatctcgcaggctttgtcgtttgtactcatttgacaattgttacataagctgtctctcctcctctcaccctgcctttttcctccccgccctcccttttttttttttttttttttaaaaaaaagcaatccgttcgcttgatatcactgtgccaaagattatccaggtcattcctgtccagaagtaacatgagtgttgccagaagcgatgatactctggtaagcaaacccgtgagccctggtgctccccttagcactgggtactcagaatgaccaagctgttctatttgttcaacctcccaggaacctgaagttgtggaaatggcaagcttattcttgatcccctcggaggggtttgggggtgctgattgatgcaccctcttgcttctttcctctttttttctctttgatttgga

SEQ ID NO: 3224 - DNA, 601 bp, Human
ccctgcctttttcctccccgccctcccttttttttttttttttttttaaaaaaaagcaatccgttcgcttgatatcactgtgccaaagattatccaggtcattcctgtccagaagtaacatgagtgttgccagaagcgatgatactctggtaagcaaacccgtgagccctggtgctccccttagcactgggtactcagaatgaccaagctgttctatttgttcaacctcccaggaacctgaagttgtggaaatggcaagcttattcttgatcccctcggaggggtttgggggtgctgattratgcaccctcttgcttctttcctctttttttctctttgatttggatggtgctgtcccccctcatagccccatacctctaacactaccctccaccttgatgcaaacataagcacagaccacccccgcaacacacacacatacacacatgcacagcaaatgcacacacatagagacacacgcactgatattttggtaaaagagaggctagccagcagaagagaaaagagcttatcctaattttcatgaactgtagccactgacatagaagaatcttggttaacagtagcacagaaggggcag

SEQ ID NO: 3225 - DNA, 601 bp, Human
tcattgctgctggctgtgggaatattcaaatactacagttgctcattaaaagaggctcgagaatcgatgtccaggataaggtcataattgttttattgaaatgaattgaattttaaagtattttcaagtgtctcttaatcataggggtaacagaggaaaaaaatttatgtcctaacttgtttctcagtttcctgtaaaggaagatgagctgcttttaaacagcttggtacagcctgacacatgggttaaagaggcaaacatttatcatttatcctccccttggcgctgctgcttgacatcrgcatttctttgtacactacccagattttacttcttaccgatcacatttactcaacaatgttagatgtcacacatgaaaaagttttgttatctaattattctcatcagaaatttgtttgcctgcttctgcagacgtcagcagagctgtaagtggagtagatctggccctctgcagtaagggaatcctaaccagagaggggagatgagggtttacaaacataaaataattgtttataagcaattgtttattttgaaatcatttttgatttacaaaaaaaagttggaaaagtggtacagagag

SEQ ID NO: 3226 - DNA, 601 bp, Human
ctacccagattttacttcttaccgatcacatttactcaacaatgttagatgtcacacatgaaaaagttttgttatctaattattctcatcagaaatttgtttgcctgcttctgcagacgtcagcagagctgtaagtggagtagatctggccctctgcagtaagggaatcctaaccagagaggggagatgagggtttacaaacataaaataattgtttataagcaattgtttattttgaaatcatttttgatttacaaaaaaaagttggaaaagtggtacagagagttccatcattcgcttyacccaggtgcccctaatgctagcatcttgtgtaaccacggtacatttgtcaaaggtgtaaaatagaatgagggttttattcctctgggaagttgctcctctggggtttgtcatcacacaggaagggaaataacagtgagtctgaggaatgcatgcatctggtgctgtcagctccctagaaatgtgaccccaggttgattttcctgcagggcgggtccaatgccgtctactgggctgctcggcatggccacgtcgataccttgaaatttctcagtgagaacaaatgccctttggatgtgaa

SEQ ID NO: 3227 - DNA, 601 bp, Human
ggcacttattagaaagatgctgcaatgcacctgcacgaaggctctattgttcagacaagcagggccgatggtttcaacgggctcccgaaagtcaattgtcagtcatatgcttgagaaagccaaattcatcaaacacacaagtgttgaggaaggaaaactaatgaaagagagacatcagatctacctcttaatgctggtggctcacactcatgttgttattttattccagattaatatttcactccaatacctatgagctctttccctctgctgccttggttgcgtttctgccaaatttgayagggactctcaccttgctttatactttgtttctcattattgtgttctcctcctctctgtactcgtctccttggccaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggtgccttatgggggaagactcatat

SEQ ID NO: 3228 - DNA, 601 bp, Human
ctctttccctctgctgccttggttgcgtttctgccaaatttgacagggactctcaccttgctttatactttgtttctcattattgtgttctcctcctctctgtactcgtctccttggccaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaycttaatgcttgcgacaaggtgccttatgggggaagactcatatgcactgggaagtgatctaggggtctagagggaccacaagactcctcagtttgtttccctaagataacaaacttgaatgcagcaaactgtaattaccccgtctcttctctgttccaaagattctgtgaacttttctatattgtatttaatagttaatattaatttatggcatataacaaaattcatgagttgatcaattgactttggtctctaaataatttttagcttttttagctttagagcaggtacagtgatgtt

SEQ ID NO: 3229 - DNA, 601 bp, Human
tgtgaacttttctatattgtatttaatagttaatattaatttatggcatataacaaaattcatgagttgatcaattgactttggtctctaaataatttttagcttttttagctttagagcaggtacagtgatgttcactgaatccgagacaattctcattgaggactgacattggcaacacgctattaatttttagataaacaaagaaatagatgttttacttatttctatcatccgctgtgttgtaaaaagacaataaaccactcttgtctggcaatctcgatgctagaccaggtttaawtaaacaaattcagcctcatctgtttttattgtgatctgtacttaaaacaagcctgtgatgttgctatatacggttagatttgggattctgtagttaatttaatatctgccctttgtgaagttattttctttgtatagagcaatggttctgggtcgggggcgactttgcccccaggggtgtttgataatgtctggggatactttctggttgtcacagctagagatgggggttgctactggcatctcgtcgatcccagccagtggtgctactaaacatcctgcagctcacagagcagccccc

SEQ ID NO: 3230 - DNA, 601 bp, Human
tttacttatttctatcatccgctgtgttgtaaaaagacaataaaccactcttgtctggcaatctcgatgctagaccaggtttaaataaacaaattcagcctcatctgtttttattgtgatctgtacttaaaacaagcctgtgatgttgctatatacggttagatttgggattctgtagttaatttaatatctgccctttgtgaagttattttctttgtatagagcaatggttctgggtcgggggcgactttgcccccaggggtgtttgataatgtctggggatactttctggttgtcacarctagagatgggggttgctactggcatctcgtcgatcccagccagtggtgctactaaacatcctgcagctcacagagcagccccctcgacagagaatcacccagctccaaatgccaatagcgctgaggctgagaaaccctagcacagtaggttttagaaatgtttcagaactctccacccagctcctaaaactcaacacatctattcattagggattctgtaataggtagaatgaatgcccgggctggtttttcatgggatgcagaggttacacatgttaaatctgcttctcatttatatg

SEQ ID NO: 3231 - DNA, 601 bp, Human
cagcccttgagcaagttatttcacaatactttcacatttttcctggtgcaaggtaaaataataggctctctatttaggaaattggcagagattgctgggcaaatgtttttaaaagtgttttacaaatgctttgattaaagaggccattggagtatcaacaattacttatgttctatctgattgtactgctgaagcctaaatgaatcaagctagtgttcagcttaggctgtgattatttagagaggaatatgtaaagctccgcatcctcccagtccttacccctgctataggagtaaagttctcatttaaatcctccactagggcttttagtagtgatcttgttgccaattaaacctcactcgatggcggcagaaaaggtgaagagacggaggccacatgcccaagtgaaaagctctcatgatctctggggtttgtttccaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccc

SEQ ID NO: 3232 - DNA, 601 bp, Human
acctgatcccaggtcctgattctgtgtccatccccctgatcccaggtcctgattctgtgtccatccccccgatcccgggtcctgattctgtgtgctcccacctgatcccgggtcctgattctgtgttctctcacctgaacccgggtcctgattctgtgtcctcccacctgatcccaggtcctgattctgtgtccatccccccgatcccgggtcctgattctgtgtcctctcacctgatcccaggtcctgattctgtgtcctcccacctgatcccgggtcctgattctgtgtcctcccaccygatcccgggtcctgattctgtgtcctcccacctgatcccaggtcctgattctgtgtccatccccctgatcccaggtcctgattctgtgtccatccccccgatcccgggtcctgattctgtgttctgtcacctgaacccgggtcctgattctgtgtccatccccccaatcctgggtcctgattctgtgtgctcccacctgatcctggattttggccaagtttctatttgcatgtgtttgttgttgaaagtgaatattacttatatggacatgtacttttttatagcgttttgccatcttaa

SEQ ID NO: 3233 - DNA, 601 bp, Human
tgtccatccccctgatcccaggtcctgattctgtgtccatccccccgatcccgggtcctgattctgtgtgctcccacctgatcccgggtcctgattctgtgttctctcacctgaacccgggtcctgattctgtgtcctcccacctgatcccaggtcctgattctgtgtccatccccccgatcccgggtcctgattctgtgtcctctcacctgatcccaggtcctgattctgtgtcctcccacctgatcccgggtcctgattctgtgtcctcccacctgatcccgggtcctgattctgtgtyctcccacctgatcccaggtcctgattctgtgtccatccccctgatcccaggtcctgattctgtgtccatccccccgatcccgggtcctgattctgtgttctgtcacctgaacccgggtcctgattctgtgtccatccccccaatcctgggtcctgattctgtgtgctcccacctgatcctggattttggccaagtttctatttgcatgtgtttgttgttgaaagtgaatattacttatatggacatgtacttttttatagcgttttgccatcttaagttgcattttacatgtgacttttg

SEQ ID NO: 3234 - DNA, 601 bp, Human
cccacctgatcccaggtcctgattctgtgtccatccccctgatcccaggtcctgattctgtgtccatccccccgatcccgggtcctgattctgtgttctgtcacctgaacccgggtcctgattctgtgtccatccccccaatcctgggtcctgattctgtgtgctcccacctgatcctggattttggccaagtttctatttgcatgtgtttgttgttgaaagtgaatattacttatatggacatgtacttttttatagcgttttgccatcttaagttgcattttacatgtgacttttgaayaatttcatagataaacagaaaattattataataagtactttttgcataactcagtgtacactgatggaaatcccgtgtgtgtgtatgtatgtgtgtgtgtgtgtacatgcatgtgagcatgaggctctgtagaggaatcagagaagcatggtaaaattgtaacatctttctagagcactaagtcttcaggaaaatgtctagtgacattaagatttgatcccaggactgtatttctcttttttattttatttatttattttatttattatcattattattattttttttgagacagagtct

SEQ ID NO: 3235 - DNA, 601 bp, Human
tgattctgtgttctgtcacctgaacccgggtcctgattctgtgtccatccccccaatcctgggtcctgattctgtgtgctcccacctgatcctggattttggccaagtttctatttgcatgtgtttgttgttgaaagtgaatattacttatatggacatgtacttttttatagcgttttgccatcttaagttgcattttacatgtgacttttgaataatttcatagataaacagaaaattattataataagtactttttgcataactcagtgtacactgatggaaatcccgtgtgtgtgtrtgtatgtgtgtgtgtgtgtacatgcatgtgagcatgaggctctgtagaggaatcagagaagcatggtaaaattgtaacatctttctagagcactaagtcttcaggaaaatgtctagtgacattaagatttgatcccaggactgtatttctcttttttattttatttatttattttatttattatcattattattattttttttgagacagagtctcactcttgtcacctgggctggagtgcagtggcccaatcttggctcgctgcaacctctgcctcctgggctcaagcgattctcatgc

SEQ ID NO: 3236 - DNA, 601 bp, Human
gtatttctcttttttattttatttatttattttatttattatcattattattattttttttgagacagagtctcactcttgtcacctgggctggagtgcagtggcccaatcttggctcgctgcaacctctgcctcctgggctcaagcgattctcatgcctcagcctcctgagtagctgggattacaggctcatgccaccatgccctgctaatttttgtatttttagtagagacagggtttcaccatgttggccaggctggtctcgaactcctgacctcaagtgatctgcccgcttcagccycccaatgtgctgggtttacaggcatgagccatcacacctggccctatatttttctgcttagctttccgcattgagagttttatgggcaaaagttcctactaccgttttttgtgctaaataaatgtggtaagactaaagagatgctatcatttggtgaaaaatggagaaatgaaaataactgtgcttttaggttcataaaaaatgttgacttctagattttagccagcaccttcccttttctctgaattccatatagatgttcattaccaaacaacacagactattgcagattcctgtgat

SEQ ID NO: 3237 - DNA, 601 bp, Human
tagagacagggtttcaccatgttggccaggctggtctcgaactcctgacctcaagtgatctgcccgcttcagccccccaatgtgctgggtttacaggcatgagccatcacacctggccctatatttttctgcttagctttccgcattgagagttttatgggcaaaagttcctactaccgttttttgtgctaaataaatgtggtaagactaaagagatgctatcatttggtgaaaaatggagaaatgaaaataactgtgcttttaggttcataaaaaatgttgacttctagattttagccascaccttcccttttctctgaattccatatagatgttcattaccaaacaacacagactattgcagattcctgtgattttggccctgtagctgtattaaagacaagcattatgccattacgattatgctaaaaatgaagtccaagcacaattaattttttaatttcaggaaatgtttatcaatggcatatacaatgccagtaggattctagtatggtttgttggaggtaaaaggatatctgaaacagctggaaagttatacttttatgtacacttattccttttgcatgttatgtgattaact

SEQ ID NO: 3238 - DNA, 601 bp, Human
tttttctgcttagctttccgcattgagagttttatgggcaaaagttcctactaccgttttttgtgctaaataaatgtggtaagactaaagagatgctatcatttggtgaaaaatggagaaatgaaaataactgtgcttttaggttcataaaaaatgttgacttctagattttagccagcaccttcccttttctctgaattccatatagatgttcattaccaaacaacacagactattgcagattcctgtgattttggccctgtagctgtattaaagacaagcattatgccattacgattaygctaaaaatgaagtccaagcacaattaattttttaatttcaggaaatgtttatcaatggcatatacaatgccagtaggattctagtatggtttgttggaggtaaaaggatatctgaaacagctggaaagttatacttttatgtacacttattccttttgcatgttatgtgattaactcaagcagaaattgaaattggtaatttcacattctgagactgtgtggaagggcagtatcccaggttttagccattagctgctggttgctttcttagtttgtcccgttttaatcttgccaagtca

SEQ ID NO: 3239 - DNA, 601 bp, Human
gaatgaagctcagctgatgtgaaaatcatcagttccagtttcaaccccttggaattagcagcaaaattcagacccgtaattcagagcccatctggacagaagtgtgctggttccacacaagctctgcatctctgcccccgcagacaggctccccaggttggctttgatgctcccatcatcagcacaccctgactttggggatctcacagcttcttcagaagggttgctgtcaggcttgttttgctatttttttttttaaaggaaaggtgatgggggctttagaagggcttaaaagaagcayaggtacgtaacagaaggcatcgcttcctaccaaagcacatccagctttctagagactcactcaagtaactgattgtgagcgtggggtggcatccacattctacaaggaggctgttgctctttctccattgcgtggtcttgccttttccttatctgaattaagttcctccagaaataaaaatggccattcaaatcctaccctgtcaccagtatgtgacaggacctcatggctatgtttgacgctaatgcagtgaaacagacatttctgcattcttcctccttctcatatggaaatcaggag

SEQ ID NO: 3240 - DNA, 601 bp, Human
ttccagggcagcactgtgcccagcgcagagggaggaactcgtagatgccaaggtgaatggctttgccctcaggctacttttagacacactcaaattcagatgtagcagcatctcatgttgtcattgctgctgtgatgggcataaggtgctccagaaacacagaagcaacaattcagatattaaagaaatcagggaaggcttttcagagttgatcacttaagatgatcgaggctttgacagatggagaagagggaagcctgttttccaccaagggaagccagtgtgtctgccgtgggctgtygctgacacacggcgggtgttgggtaggtatttagggagggggttatggggaagggagaaaatgaagctggagacgttgggtccaggtgtggcagacctggaatttaaggctaaggggtttggtgtcattctgtcccaacctgggcccttcaacagtggccgtttcctctgcccttttcttcatcacactctcttcctcagctttcttcccttctagaaaactgtgcattctacaaccaaaattacatctcccttacattgcatcttctaaacatttcacccagtcttcaaaactttccct

SEQ ID NO: 3241 - DNA, 601 bp, Human
agataagagcttgggaggaaatggacaaaaatgttaaacagggacagctctgagctagggagcttgagagtaaggggggaggggagaaggaagatttttattttgtattatgtttttctaggttgcttggatttttaaaaagagcatgtgttaactttataacaaaaactgatatttaaaaatacatagcattaaaaaaaattcccaaactttctcagttcacaacatcctcagggtttcagtaattagttttttcatggttcccctagatcaaaagaaatccctaacagttctgttcatygagtggttcagtccaaacaacttagtaaccgcttatgtcctaacagcttagcagcagctaagaaagataatacacataaacggaaagaaaactaatattttcttttccttcttccatgaccacattacgtacaatctgatgagtgctcccgttgggcactgcacttctgaaaccttggactcagagtggacacggcctcatttcctgtccacagtgatttcctcaagactcttggttcctctcagggcagctaccaaccccccgctgtgagagacatgatgtcatggaaggcagggtggt

SEQ ID NO: 3242 - DNA, 601 bp, Human
tattttgtattatgtttttctaggttgcttggatttttaaaaagagcatgtgttaactttataacaaaaactgatatttaaaaatacatagcattaaaaaaaattcccaaactttctcagttcacaacatcctcagggtttcagtaattagttttttcatggttcccctagatcaaaagaaatccctaacagttctgttcattgagtggttcagtccaaacaacttagtaaccgcttatgtcctaacagcttagcagcagctaagaaagataatacacataaacggaaagaaaactaataytttcttttccttcttccatgaccacattacgtacaatctgatgagtgctcccgttgggcactgcacttctgaaaccttggactcagagtggacacggcctcatttcctgtccacagtgatttcctcaagactcttggttcctctcagggcagctaccaaccccccgctgtgagagacatgatgtcatggaaggcagggtggtgcagtctaatgatgacactctgcacctcttcaagcgagtagttcacctggtctcagaaccatgtttcttatcaaaaactttagatattcctgggcacc

SEQ ID NO: 3243 - DNA, 601 bp, Human
aagtgtgcgctggtggttgcccctgaagcctggtggctgagggatccctgggcaggaggcatagctcggcagctggacttggaggtggatgagacagacaagatgcccccatccctggactgggcgggtcaccaggcacttgctgccctcacagcttgtacatcagcatcagacagcgcccgggaaatgcagagcagggcacaagcacagggcaccgcgagggcggcctggggagattggactttggcagagggtatgtgtgttgggggccaacggagcagcgtggctttgttagacaccygaggaactgccgctcctgagcatgcctccagggactgggcctggttcctgaagcagcaacactgtcacctgccagggggcactgctcgtgcctggcaggccgtgctggggtctctttcaggccagggctctggacaccagtgacctctcctagaattgtcaggcccttttcccttcaatgagagagatgcctacatggcaacatttatatcatcagacagcaagaagtttgcttttagaattttggcccttttccactgccgttctcttgagaacgctggaggccaaggctgagctccca

SEQ ID NO: 3244 - DNA, 601 bp, Human
ggttgcccctgaagcctggtggctgagggatccctgggcaggaggcatagctcggcagctggacttggaggtggatgagacagacaagatgcccccatccctggactgggcgggtcaccaggcacttgctgccctcacagcttgtacatcagcatcagacagcgcccgggaaatgcagagcagggcacaagcacagggcaccgcgagggcggcctggggagattggactttggcagagggtatgtgtgttgggggccaacggagcagcgtggctttgttagacacccgaggaactgccgcycctgagcatgcctccagggactgggcctggttcctgaagcagcaacactgtcacctgccagggggcactgctcgtgcctggcaggccgtgctggggtctctttcaggccagggctctggacaccagtgacctctcctagaattgtcaggcccttttcccttcaatgagagagatgcctacatggcaacatttatatcatcagacagcaagaagtttgcttttagaattttggcccttttccactgccgttctcttgagaacgctggaggccaaggctgagctcccagccaggagaccgga

SEQ ID NO: 3245 - DNA, 601 bp, Human
gcaggccgtgctggggtctctttcaggccagggctctggacaccagtgacctctcctagaattgtcaggcccttttcccttcaatgagagagatgcctacatggcaacatttatatcatcagacagcaagaagtttgcttttagaattttggcccttttccactgccgttctcttgagaacgctggaggccaaggctgagctcccagccaggagaccggacggggtcccctcgaagttttctgttgcacacatcactcagctgtggggacactgagggttgtggctgttgagctgtgggaaggaaaacatccaaggtcataggaggcatgaatgtccaggaagagtatttgaagaagccattcctgttcccgcggagaggagcctgcgggaggaattcccggtgaccaggtaaagtgggtctcctgggagccgtcacgttacaccgccagggggcagtagctaacaaaaatgatttcctgggatttcggtgcttccccatgaaattattgttttcataacaccttgtacaaagcctgtcctaaccttttatcctcccaacgaaaactgtcaccgaggagcaggaatgactgccatttacca

SEQ ID NO: 3246 - DNA, 601 bp, Human
caatgagagagatgcctacatggcaacatttatatcatcagacagcaagaagtttgcttttagaattttggcccttttccactgccgttctcttgagaacgctggaggccaaggctgagctcccagccaggagaccggacggggtcccctcgaagttttctgttgcacacatcactcagctgtggggacactgagggttgtggctgttgagctgtgggaaggaaaacatccaaggtcataggaggcatgaatgtccaggaagagtatttgaagaagccattcctgttcccgcggagaggarcctgcgggaggaattcccggtgaccaggtaaagtgggtctcctgggagccgtcacgttacaccgccagggggcagtagctaacaaaaatgatttcctgggatttcggtgcttccccatgaaattattgttttcataacaccttgtacaaagcctgtcctaaccttttatcctcccaacgaaaactgtcaccgaggagcaggaatgactgccatttaccaacgtctgctctcattaagcacagggccacatgccactaaaagaaggcttgttcctgacaggcaggcacccagacacaaatt

SEQ ID NO: 3247 - DNA, 601 bp, Human
ggagcctgcgggaggaattcccggtgaccaggtaaagtgggtctcctgggagccgtcacgttacaccgccagggggcagtagctaacaaaaatgatttcctgggatttcggtgcttccccatgaaattattgttttcataacaccttgtacaaagcctgtcctaaccttttatcctcccaacgaaaactgtcaccgaggagcaggaatgactgccatttaccaacgtctgctctcattaagcacagggccacatgccactaaaagaaggcttgttcctgacaggcaggcacccagacacarattccaggtcacagggaagtggacagacccattcttgggcaacccagcagcttttgcaggctgggattaacaatatgcagagaaatacactaaaatggcagctatgttgacatcaagacttacatcattttgcttttgttttctatttacattcctatctgccaactttcctacagaaatagaatatgtgttggtgtttttaagaataaatcttgccctcctagtgccctttctcctttccctgtacctaatcctgcccttaggatccacttttcttctcctcatcccctccgttggata

SEQ ID NO: 3248 - DNA, 601 bp, Human
acagcaggcgtggggccttcatctctgtggcatgttgcacttgtacctggagagtcggcctgggcatgaggccaacacaccgccctcacctgggcaggagaggcagccaggtaggaggacccaccccctgaagcagttccctctctgcccccagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtgagggkcagccacttagtctccagctcacgggtagcctcctctccctgagaactgaagcagaggtgtgaaaagtacaaaggaagtctcatgaaccagagaaaggttttaaaggtctttctttcttggtcaactcttttcttgtacaggtcttgtatcccttattggaaatgatcggctttagaagtgtttctgatttcttatttgtttggattttaatatatgtacatatacatagcagttgaacatcctagttcaaaaattctaaatctgaaatgctctaataaccatttcctttgcatgtcttg

SEQ ID NO: 3249 - DNA, 601 bp, Human
aattcatttaggaagtcgtggccaattctttttaaaatgggatggaatggaatgggataggataggacaggaaaggacaggacaggataggatagatcagatgtcaagtattattttgtaaaacgtttgtttcactgatgagtatgggtatgtacaggattatgatgtaaaatatatgtttttactcagagtctatcaaaacagtttgaacctgcagctttctataatatgctagtatctctgatcttgcattatcaacttgagacatttatctattgtcttgagacactatatctgttgycagatataaaaatggggcttctattaatatttttaggtcagtgatgtagcttttgcattcacacctctattcttagtccctccactttccacagtatctcttgtcctcacttgtaaggtgcgagcattaggcctcacctttcctgcctcgggagaagctgacatctttccatgctgtgctcctgctgcttcatgcaaacctgaaggtcccgctcctatgactcagactatatgccagtttccccaagtctctgcacccactgtgatgaggcagagcccaccaacagcagggatggggagg

SEQ ID NO: 3250 - DNA, 601 bp, Human
aagtgctgagattacaggtgtgagccaccatgcctggccaattttgggaaaaaaccaaaaaattcaaaagtgacttattgtggaatatttagaaaattcagaaaagtagaaaaacagtcacaaacttttttgaaagacagaaaagaataaatgaacaaagggaatgagactgtattcttgggttgcaagatatgactattttatttttccctagttatataaatgtaatacaatttcagttagcatctgaatgggttgaggggattgggatttttatcttaaaatttccatggaaaaattmattaaacctattataaagcccctgataatcaatacagttaaataggaggaaaagcttagagggtatagaagtaaatcataatatctttagaaatataatggaaaataaatatgtcatttgaatttaatggggtaaagattatttaataaatgaacctggcacaactggctatttgtctggaaggaaataaagttggattcctacaccctacaaagtccaaaaataaatggattaaagcttttaagtaaaaacatgaaacaataaataccttgaatagaaattgtggagagtgtattttca

SEQ ID NO: 3251 - DNA, 601 bp, Human
ttgaaaatgtaaaaatttttaaaatttttttctagcaaacaaattaagtaaacaaagttgaaaggtgaaataggctgggaaaaagcattctcaatgctttggacagataaatggtcacaccgtaatgttcaaaaagctctccggaattggtaagaaaagggcgagcgtcccagtggagaagtggtggcattcactctggagtcttcctgctgccgaggcctgaggacaaatgcgggcagatgcctgtctccctctcttacctttgaagctgcctctgggtgtattttttttttttttttttaactgctttgctaataagaaaatgctgtgcttcccgcaccagattctggttctagatgtgcttccagaattctcgggaaaccctttcctgtctccagaaaaccctgcccttcacaccagatatcctcgttggggtcccactgtggcatcatcagaagatagggggtagtccggtgaggcctgggaggaatctgtcacagaaaccaggggcggtgatctgggaactaacagtggtctctgagggcccctgtgcttccccaccaggtctggattgaggctgcattcctgaggcaggagggag

SEQ ID NO: 3252 - DNA, 601 bp, Human
ctccccctgggcaccaggaacttaatctgctactcctggcagccttcaggatggcttctttgtatcagcgtggagtcatcagctccacacagatctcctgggtgggaaaacagttgagaaaaggcagtgaggtgtccttgtggaggcaatgtctggagatacaaagacagagaactctggtgcacagatacacagagtaatcataattaaagatgcacattaaaaaactctagcaagcaatgcccagcagaaatgattgagaatgggaggctttgctctggttctgtgacattgagcaccrgggcgcggtttggaaaccctgttctaatggcatcatatgcctgtcccaggaacgggggcagtgccttcgtgtttctccaccatgtgaaattgggagcctacatgaactagtgtgggccaagaagagcggttctgaatattgcaactaaaagcagctctgagattattaaaagccagatgcttacctccccaatctcaggtgccaggtctggccctatagccagtttgtatgagtcatacaaatttcttgaaactaaacctgaatccacaagccagtgaccttgaaaactggagtcgccgg

SEQ ID NO: 3253 - DNA, 601 bp, Human
tgaggtgtccttgtggaggcaatgtctggagatacaaagacagagaactctggtgcacagatacacagagtaatcataattaaagatgcacattaaaaaactctagcaagcaatgcccagcagaaatgattgagaatgggaggctttgctctggttctgtgacattgagcaccagggcgcggtttggaaaccctgttctaatggcatcatatgcctgtcccaggaacgggggcagtgccttcgtgtttctccaccatgtgaaattgggagcctacatgaactagtgtgggccaagaagagyggttctgaatattgcaactaaaagcagctctgagattattaaaagccagatgcttacctccccaatctcaggtgccaggtctggccctatagccagtttgtatgagtcatacaaatttcttgaaactaaacctgaatccacaagccagtgaccttgaaaactggagtcgccgggcagtaatttcatcagcctttaaactcccagttaaatggccagagaatctgccaactcatccaggaatactttaaagtgattgaatccaaggaagaacacaggtgaaggaccacatcttagatgaca

SEQ ID NO: 3254 - DNA, 601 bp, Human
tccaaggaagaacacaggtgaaggaccacatcttagatgacaagatactgctggatgtaaaaaatgtgtcaattctaattctaaactcctttggcacaggagtcccttgctttctagtagtagaccagcaactttctagatcatatcatatagtctcctttatttgtcattacatccctgcttgcccttgagagtttagtaagtaaatgaagatgtaaagaaggagggtaattaggcagcaggaactacattgtgtggcccgactttgattggccccgggcctcctccagacctgccttcygtatctaatttgcagatcttcagaactccccagtggcccttctgactctgttttctggcccagggtcccacactacgtttagctgactgtcttagctccctgttctcctccactatgggacagtttcgtctttcctgagcctgaggcgatgagcagtgtttaggaccaaactgcaaatggtattccagcaaatgctgtatcaggaactagatcaatattggctctgccctccaggaattttcaacctaggttcaattctgaatagactcttagacagggggcatctttcaggtttaagcc

SEQ ID NO: 3255 - DNA, 601 bp, Human
ccactatgggacagtttcgtctttcctgagcctgaggcgatgagcagtgtttaggaccaaactgcaaatggtattccagcaaatgctgtatcaggaactagatcaatattggctctgccctccaggaattttcaacctaggttcaattctgaatagactcttagacagggggcatctttcaggtttaagccagactgtgggcaggaaattactgtgtggtcaccggtggggtcagagcctccaagtgagggagtccagggcgatggccactctccaagaaaggaagcagaactcttccatwaagggaaagttccttctgttttttgtcacttttttttcctttctttttatttttttaagaaataaacacaaccaaaaagctaaagtccccttgggccatcatctctggtctcactcctctctccccttctcggaggccaactattatcatggcagcatatcctttcaggccttttctatgtgtgtgtgttaaacattcacataatggtataataatagaatgttctgactcttttttgaaaatgttctcaagcctttagagaagttgcaaggatagtaccatgaactctcatataggcta

SEQ ID NO: 3256 - DNA, 601 bp, Human
atgctgtatcaggaactagatcaatattggctctgccctccaggaattttcaacctaggttcaattctgaatagactcttagacagggggcatctttcaggtttaagccagactgtgggcaggaaattactgtgtggtcaccggtggggtcagagcctccaagtgagggagtccagggcgatggccactctccaagaaaggaagcagaactcttccataaagggaaagttccttctgttttttgtcacttttttttcctttctttttatttttttaagaaataaacacaaccaaaaagctraagtccccttgggccatcatctctggtctcactcctctctccccttctcggaggccaactattatcatggcagcatatcctttcaggccttttctatgtgtgtgtgttaaacattcacataatggtataataatagaatgttctgactcttttttgaaaatgttctcaagcctttagagaagttgcaaggatagtaccatgaactctcatataggctacatttatttatttttttaattaattaattaatttttttttttttttttttgagatagagtctcactctgttgccaaggctgg

SEQ ID NO: 3257 - DNA, 601 bp, Human
catggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgyggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggac

SEQ ID NO: 3258 - DNA, 601 bp, Human
atgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccartaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagc

SEQ ID NO: 3259 - DNA, 601 bp, Human
cttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttrtaattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttcttttt

SEQ ID NO: 3260 - DNA, 601 bp, Human
tccggagccgagaatggagagggccggggagctgggggcggggccgaccgagccacaggctcccgcgccccctccccctagtcacgtgagctgggctcctggctcccacctcccgtcacgtgcggagggtctctgccccttggggtcacgtggggagggtcttgcgaccccgcctcctgggggggtcacgtgcgtcggcctcctttgacagacctggggactgtgccttgcacaccggccgcgacctagccctctgccccccactcagtacttccatttagtcccgtggaacaggagagayctgttcccaatctggcccagaaactagggatggggggactgtattggagcgatgcattagagtatgaggtcgaggagtcccctaagccgggaatcgaacttggtgaggggggttgggacggccgatggccaaatatatgccccctggcctgtgtttcatttctttgcagaactgagcaaggatgttggtatttgctccgttctcaaggagcttcgggaacatctttctatatagctgtctctcgacctatctctgaaatgcttctgttgctgatctctctttcattcatgcattcattca

SEQ ID NO: 3261 - DNA, 601 bp, Human
ggaggtgtcgggcgcgctgattctcccccacccgacgcggcccagggaagccttgcgcccagacctgggctgtccagactgggacgggcggggcgccgaggcccagggcgcctgaggggcgcagaggtgtcagcgtgcaaccgccgccccccagcgttcccgccaccaccgccaccaccctcaaagcccgggcgcgcggaccccacgccgcgcacacgtggtccggcctcgcctgctggagcgggcggcgcgcagcctcgggggcgcgcgctagagggaagaggaacccgggtctacattmgtcctccacccctgtaactctgcagcccggcgtctaagaccggggctgggggtggaggatggcgaggatttgacaagttcagggccccctgggatcctttccctactccctggtcttgttggacaccctgtttacctgccctaattgccccgggctgggggagaagtttgctccttccccgctccgcccgcctgccccctccgcggacactccgggttaagtggagccaggcgcgggccggcagggcactgaaagcgagagagaggtgtcgggatgcgcctcagaggctgtgagagccag

SEQ ID NO: 3262 - DNA, 601 bp, Human
gtcccagcccacccccacccttccgcaggaggcgcggccctagaggcggggttagctgcggagcttcgcgtgggcccagcggcacctctctctccgcactgctagggagaaggagggaggatgacagattcaattaaagtgcccaagccaagcagacacgttgggtctccaaagagttgtggctgggaattcctggctctcaccccgtttgtccccgtgccctctgtgtaccaactgggcccagccaccccaccggcaggtctttctctcacatgcccagccttgggggggcatttcaggrgctgttcctgccacccagcgcaggagtacataacagatggcttcccttcacctgtggtcgccctgcaaccttttttataaggctagtcctgccctgttgaggaaatggaattacctgtaggaataccttgggtgttggcttcctccctgctggaatggggtgtgttgtagggggaactgggcggtacagcagggaggggctgcttcagagtgggactggaaacatgggtgaggctcaaagacagagatcccagtgtggctgtgcagctgctccagacctggcaccctcaccactggaggc

SEQ ID NO: 3263 - DNA, 601 bp, Human
cagggaaataagaggcgcagccatcttgtctaggccctgtgcccactgctctgcccagcatcattaaggggggccgttgtgccaggttgaggaaggaggtgcacaatgagacagaagtttgggctggttggcatgatgccatgtggagtcttggtactgagtcccttagcgccctcatgtgtttaaagttcctgggagcctaactgtccttggcctcagggtggggtctctgtcacgggactcaaggtacagaagccagtgatactgtagtatggggagggcagggggagacccccagatyggtggggtcaaccaatactggcatgcgggccagcacacatacagcccagcttttctgtgtgtctgctgcctatgagtgggcggtggacatatttgtgcgtgtgccatagaacttatgcatgtatatgcatgaagccgccatacatgcgtctgtaagggcaggtcctgttggactggcctccggggtggactggcagccgcagggaagcatggtgggagaagcgatggagggtgtgtgcgtccctcggaggggatccctcccacgttcacccttggcttccatccctcccatccctcctcc

SEQ ID NO: 3264 - DNA, 601 bp, Human
cgggcctgggtctgagagtcgctggggcctgcgccgtttctgtggcaaccaaagcgtacgttcccttcttccctccgcccctctccctcgcctccttttctttggaggcaggccgggcttccctgcgcctttgctaccctctggtggccaacaggagaaggacagaccaagaaggagggcacggaaggagacttaggggagcggcggcactagggccccgggggcagagacagggctgagccgcgaggaagctcggaggaaaagtcggaaggctacgcggaccctggggaggggctgcggrgcggtcagatggaaagcggctttgctctggggtttcttctctctgagccgcttcctcttccccacagcctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatca

SEQ ID NO: 3265 - DNA, 601 bp, Human
tcacaacctgcactggaagtgtctgaggatgaaggtgttcgtctgctgcgcctccagtgagtagaataggctccgagccgcgcccccatcctcagctccctgctttggggctcccctggcttcctgggggtgggggcggagggcacaggtgaggggggcttgctccccagccgtagcaaggggagggaatcctggccctgactctcccctcctctctccccacccgcaccccaccccgcagcatcgcactccggggagaagccggtccccactctcccccagttcaccatgggccccaatrtgaagatcaacgtgctgggtgagtctgcgcagcgccctctggtggccactgctggaaccgcagccccccgccccggtgcctgctcacctcgcatgccttccctgggggcactgatacttcctaccctgtgggtggtcacgtccctggctccattgctgctgccgcgtgcccctgccctggcgcgcaacccagccctcaccagtctgtctgttcctctgtccacagaagactttgagggagagaaccctcaggtgcccaagcttgagaagagcatcagcgggaccagccccaaacgggaac

SEQ ID NO: 3266 - DNA, 601 bp, Human
aagtttatgcatcacaaccctctgggatgagcaggaatttgcaaagctccagaaacaatctttttccaattaaggtctctcttagtgacattaaatgtagccgtctaaagatggctgtcccgttttggccactcctcctgggttagtctatgccttccacctctttctttccccacttaccacaaggcaagaaagaatgagtgatcacatccattctcatctggaactccctagcacctacttgtccctacttctctctattatcaggtaggaaagattgtttccttttggatcccaagamctgaaattgttatctcacatgactttccactattaaccaggagtatgcctgttgaacaagacacctgcttctttttcacctcatggaagcaggttttgaggctgtcttggagtggactccagaccagttgcattactatgcttgtgtgggcatgcgttagggcagtcagagagagaaggggtggcattaaggaggttctccgtggtgattgcaagctgagcgtccagtatatcttaaaatgtcccatcctggttctgtcctgcagtcctgatactgaagaacacaagtgcttcttcaatt

SEQ ID NO: 3267 - DNA, 601 bp, Human
aatgtctcttcttagttttcttcaactttattttaataggaggattggaacctatggcatgctattaattttattacatatttttggtggttttcatttgtcaaatattcctgatgttcagtcttgggtttggagatgaactgtatacatgctaggacaattacactcttatatggctttatgtcctccattagtaaagaggatatctctagcccattcctacaaaccttttaacctgcatagccatattttctgtgtattcatttagtaagaaattataaagaatcacctattattttartcttatttaataaactgtttctaatactttaaaccaatatatatgcattctttttttgtttgttttgagacagagtctcgctctgtagcccaggctggagtgcagtggtgcaatctcagcttactgcaacctccttcttctgggttcaagcaattctcctgcctcagtctcccaagtagctaggactacaggtgtgcaccaccacacccagctaattttatgtatttttttttttaatatagacggggtttcaccatgttggccaggctggtctcgaactcctgacctcaagtgatccac

SEQ ID NO: 3268 - DNA, 601 bp, Human
aggtagattcaaaccccagaaactttttttttaaactttacctgcaaggtgaactttcagggtctattttgaattacaaaaggctcttcttccattaaaagagtatctactgagccatgcttctggtgtaacagggagatgtgaagtcccaaggaggaggaccttaaggtagggacacctgcttcttcttctgtggtaagcagcctggtgctactgcaaccccacccctaggcaggcatggtgtgcctgtgcagggcttgctgcagggagacctctggctcacacaactcgctaaggagcyccagggccacagctgctgttggagacactacctctagaattggaggctcagttctggaggcatgggagggtttcacccaacacaagcctccgcttgtgagatctcaattccaaaggacaggggaacattttccaataagttaggagtgccctggttgtccaacacctgttctccctgggaagtttcctcactcagcattcaggagcattcaggtcaaggtgaggtctgcctgttccaggacacctgacctctgagaagacctcaggaatcatcaggctgatccaggttttggtataggtc

SEQ ID NO: 3269 - DNA, 601 bp, Human
gtcaagttcttagtacaaaacatgacacataaggggtagacaaataatgctgtttactccttccccagagtccatttactcttgctaggtaaatctgtgctgagtccttagggaagttttagcaggtctaacctctccccaggtagattcaaaccccagaaactttttttttaaactttacctgcaaggtgaactttcagggtctattttgaattacaaaaggctcttcttccattaaaagagtatctactgagccatgcttctggtgtaacagggagatgtgaagtcccaaggaggaggwccttaaggtagggacacctgcttcttcttctgtggtaagcagcctggtgctactgcaaccccacccctaggcaggcatggtgtgcctgtgcagggcttgctgcagggagacctctggctcacacaactcgctaaggagccccagggccacagctgctgttggagacactacctctagaattggaggctcagttctggaggcatgggagggtttcacccaacacaagcctccgcttgtgagatctcaattccaaaggacaggggaacattttccaataagttaggagtgccctggttgtcc

SEQ ID NO: 3270 - DNA, 601 bp, Human
actggcaccagctggagcttggaaatgcaggctcctggacttcaccacaattccactcaatcagaaaaggagtgcccattaaagtttaagagacactgggctgaagttccagaccacctgcctgacacacaggtcagcaatccatggtcaaatggtaggaggtagtttcaagaaaggcaaggggagaggggatggagatgaacaaaccctgtgaattggagggacatggttctatttcagatttcaggtgtacctcttacaagctataatcctctggcctagttgctcccctctctgatcyacattcgtaaaatgacataaaagcacttgaccagcccacagtacagttgtaaagatgaggtgagaatgtaggtcaagttcttagtacaaaacatgacacataaggggtagacaaataatgctgtttactccttccccagagtccatttactcttgctaggtaaatctgtgctgagtccttagggaagttttagcaggtctaacctctccccaggtagattcaaaccccagaaactttttttttaaactttacctgcaaggtgaactttcagggtctattttgaattacaaaaggctcttc

SEQ ID NO: 3271 - DNA, 601 bp, Human
atgcagatgcagtcataaagactgaatgtgatgattgctatggaagtgatttataaattattttgcaacataaatatgcagagttatgctattttcatgtctgttataagtggtttttaagaaaattaaaagccgatgtttaagatgaatcccaaaatttgtagatcgttttgaggggtaaatgtgaagacacagttaacatcagtccaacagtagtgtctagtcaaacagataaggaaggaaaagtctatattagcagaatgtagacagtaagtgaagaatacacatcagattgtcttakcgatgggggtaggtgatgggaatgagagtagagtctcttcatgtatgacaagaaaggcattagctttgactcctttgttttggatctggagagtttgatggcttctactttctttctctttttgtctaactttagcacagagcatgcgggatagtggccacaccaaataacctgctattctcaccacggtattgccttctccatggtatgtcagatgaaaactaaagagcagccacagaaagatgtcagagtcagtctgatactctcggccactcccatccaactcagaatggacaaaat

SEQ ID NO: 3272 - DNA, 601 bp, Human
atattcactgtcatctcccaaatttttgtatttgcctttgtttttactatgaactagatattccattaagggaattttactgctccaggaatctattgacagatcttttgggaatgggaaataggagagctaggagcataacttgccaggtgtaaaattaaattaacaaatgtcatccttttgtacatgcttttaggtcaccaaccacctctcctttcactgcaatgtacctgctcatttcgtatatgtgtctcctcctcttgtttcagggttctaaggtagagccaagacttgtcccctrtttctgcagcagattggtccttgaaatagtaagttgcagatgcagatctatctctataatacaagcaaaattattatttatgcatgctccttcccttcctcatctgacccatgtttctcagttccatccttgactcaacttcctctgatcttttgacttccctttcttcttccactctatattttctcttaaattaaagaagactgtaaaagagttccaggaaaaaaaccttattgtctatcatcaagttgcaggtaaactcaatccattctatcttcctaattctgggaggcaatgtta

SEQ ID NO: 3273 - DNA, 601 bp, Human
taatccctgcacttcacatgccacacacacttttgagtctttgttcatgctgcccactctgtctgatatttttccacccgctcccaaacttgtgtcaagttttcaagatcaagcttaaaaacatgcaggagctgtccatgaaataataatacttccacaggagttgagttgaaccatatgacattgctgtttttgtagatcaaaactgactaacttttggcaatttcatatctagtccaagataatgcattcttcattgctgcaatactttacctgtactgctttgtgtgtctgtgtgtgygcattggggagggggctggttgcagccctttatcatattgtaccttgcaatatagcagaaaattaaatgacaaaaaacaataaagaactgtaggacaagagaaaaattactttttatagcttaccttcagttgttccatatcaaactttaaatctaatgcattcttcactggctttccatgatcaatgtcaagaatcagactgagagcttgggaacattcttttgctctttgccgtacctaatataattattagaagaaggaaatgacaaagtaaaaagttataacacttattttaaagt

SEQ ID NO: 3274 - DNA, 601 bp, Human
aatacttacctgattgtaatcatctttctttctttatcaggtgagtagcattttttcatttttatgatattagcaggatattggaaatattcagagttgataaaaaagaggggctgaggaattctggaatatacttcatcacccagtggaaacatccatgcatccagggcaataccacatctgtagatatttgttgacaatgatgaaattaaactggttacatactagccaacattgaggacatcctaataatgctaggattggtggacacgcaccataccagtttattatgggttatctsattggaataaagaggtatcatacttcaatgtgggaaagggatatgattaactttgtaaagtagcagacctggaattttatataatcattttctttatatgcctttaggaattgcaaccatttgagtgatatatccttaaaactttttattcaaaataaattttagaatacataataatttcttcaacactgtggagtatctgaaaaagtataataaatacacctttgttttcagagcttttatgcaccttgtagtgtatttattatagctttattagagtaacaattgggcccattactt

SEQ ID NO: 3275 - DNA, 601 bp, Human
catggaagtccactctaggcttcatacaaagaatattacctttaacagttggatttgctttctatgatatagaggatgtaaagcagcaaaattgactttctcaaatttctgttttcaaattgatatactgctttgttccattgtaaaccaactggaaatagtttaaatagtactaaagctgtattaagatagacagctttgtcctgagattcatctggtttaggtcatgaaaaaaatagtttcttacctaaatgcttttgtaagaatgctaatgaagctttgttgctaagatcaatagctrcatttgaatctatgtctccctttaatttgagcatgtgtccaattattttgccagttgcaaaagtgaagtcagcaaaattctggtggactgaacccctaaaagagaacaagacatttaaaagtcacattgtttgataaaattattatttttttagttagagtgtaagaaaggtactggtcttgttggtctgtttactgaaaaccaaagaagaaataaaacttgtaatttgatctacttagatgtgtttcaagggtcacaggctgtttgtttagggatcccagagtatattcttcttccctc

SEQ ID NO: 3276 - DNA, 601 bp, Human
ctagtccttgtccccttccctggtgctaaataaaagtgaataaatactaaataaatacaactggggcccaggccctccctgccttccccctccctcctgtgacccgcagggcagagggggcagtttagatggagggctgtctgtcagccccttccatccactaacccatcactgcctcccagggcaggaaaccagggcagggccagcctgcgcattagggcagagaggaggggcaggtctcacgcccacagcccctccccactgagtcttagcatgaggcagcaacagaagctctctcttyctcccagctaagtccgaggccccggtgcccagaaagggcagccgggatagtgaggttatttcctgcccgcccaggggcgccgccgaaggatctccagaatctgtgctcttcggtgcagccagtcctggggagtggggcgtggcgttgaaggggtcggccggggcacgaagaagctgtatcggaggcgtgtgtcctgggggttgccagccactaggacttgcagtgtcaaaggctgggccagtggcccatggcctgacagtgtctctgaggctgcagtggccccgctgtagcgcaagctga

SEQ ID NO: 3277 - DNA, 601 bp, Human
gggcccaggccctccctgccttccccctccctcctgtgacccgcagggcagagggggcagtttagatggagggctgtctgtcagccccttccatccactaacccatcactgcctcccagggcaggaaaccagggcagggccagcctgcgcattagggcagagaggaggggcaggtctcacgcccacagcccctccccactgagtcttagcatgaggcagcaacagaagctctctctttctcccagctaagtccgaggccccggtgcccagaaagggcagccgggatagtgaggttatttcytgcccgcccaggggcgccgccgaaggatctccagaatctgtgctcttcggtgcagccagtcctggggagtggggcgtggcgttgaaggggtcggccggggcacgaagaagctgtatcggaggcgtgtgtcctgggggttgccagccactaggacttgcagtgtcaaaggctgggccagtggcccatggcctgacagtgtctctgaggctgcagtggccccgctgtagcgcaagctgactgccccaggcagtaccacatctgtgggggagggcatcagcgtgtattcaccattgagggcat

SEQ ID NO: 3278 - DNA, 601 bp, Human
cctgactgcttgctgcaaccagaaccgtcccctccgcacaccatgcacttgtcaaacttcttcttggagccaatgatgcgatcacagccagcatggatgcatcggccctggacacagaccgaggagctgtccggggaacagggggtcccatctaccacctgaggaaaagagaaagaacaatgctgaaggttcctcctaagtcaaaaggggttggtaaatcaaacgagacccatgtcccatcagggaagcaatgttgtcggaaaagttggatgaagtaggggatgtagatgggtgagtgccrgccaccatgtgggtgataatcataacaataataattattatcacatataacatctagccagcattttcagagcactgagtatgaatcaggcagcatgctaagtgttttataaacacaaatgtaaatctcaccaccactatttgaggtttttagggatggaacgttgaggtttagaaaagctaaagaacctgtccaaaagccacacaaatggcaagcagaggagccaagatgggaagtgcagtctgtctggtcccagcaccaagccctaaaccttgatggcactgtccctaaatggacgct

SEQ ID NO: 3279 - DNA, 601 bp, Human
aaagccacacaaatggcaagcagaggagccaagatgggaagtgcagtctgtctggtcccagcaccaagccctaaaccttgatggcactgtccctaaatggacgctagagggcagccagcctgtagaaattctcaggttggggcgaagggagcaaaatgctgctggggcttgtttttctttgtgcagccttcaacccaccaccctatcacagagagggagtgtagggacttcagtcatctccaggaggcctgtccattgagggactggctgtccaggagctgaatgaaaccaccactataakttgacagaggagcccatggaagaggggtgaaggacttgtcccaaaggccacacattcgattctcaccaaatgcagcattagaagatggggagtcagaggaaaagaaaccacgggaaataggataggctagagggacctattggccacatatctggagtctggggctcgttttcctgatacccatgtacagataagtctgagtggaatcctggactgggctggcgtggctgtaggaacagggttactttgggtgatctttgttatcagaaagcagagggagcactgcgggtgtgtgtgacc

SEQ ID NO: 3280 - DNA, 601 bp, Human
aaatgcagcattagaagatggggagtcagaggaaaagaaaccacgggaaataggataggctagagggacctattggccacatatctggagtctggggctcgttttcctgatacccatgtacagataagtctgagtggaatcctggactgggctggcgtggctgtaggaacagggttactttgggtgatctttgttatcagaaagcagagggagcactgcgggtgtgtgtgaccatagacagggcctgggggtgtcctgaccctcacccgtggctccagcacatagtagtagcccagtgccygggcctggcaggtgagtttgcactggtcctggggggccacgcctgtgtagcgaggaacccagtccatgggccctgggaagctcttgaagaggtcggtgcggtggttgtaggcagcacactgctcctcgcggaaggtcagggctggaggggtaaaacagtcagagcccctccttccttcctcacatcaccccacatccctccacccaacccctgagaactctagacagcacagctctgctcttccctgcagacggccaaggacaattcccagaggttaaaggcactccccacagcagcagg

SEQ ID NO: 3281 - DNA, 601 bp, Human
gcaggggaatcaacacccccttggtcttgcactcaagggacagtccttcctgctctactgtcccctcccaagggctcccatcccccctactcctcacctgagccagttgggcagtcctcagtgttgcaggagcggaagcgggtacggcggccctcacagtacttgccaccattccgggggacaggcctcgtgcagtctcgggaggagaactggacaccacccccacaggtccgagagcagtcaccccatggtccccaaggaccccagccaccagcctgtggaatctgcaaaggcacagaayggaagtggggcataagtgaactctctcctgggcttaaggccagtccccacacccccgggccctttaccccacccctgccctaggatctcacattgaagtcctggagctggtccatgtggaggcagcgaccacccatgcaggcctgtgcgggcccgcagggtgtgccatcggcccagggcgagtgtttggtctggcacatggcatggccattgaggtggccagagcaccagagggcagcacagggcggcggcagctgtggacaatggcgtgagtcgggcccgaaggtcagctggcactggc

SEQ ID NO: 3282 - DNA, 601 bp, Human
ggcagcacagggcggcggcagctgtggacaatggcgtgagtcgggcccgaaggtcagctggcactggcggtcagcatcatagtccttgccagggaaagtcacaggcagatgcaatggagcctctggtttgtctaagagacagtgccctgggaagggggttggggcacaaagtcagcaacgggctgaggggagcattcaggattgccagcagaaagcttaggctccctggggcctgatggagcctagaaaaacaatcctaggactataagaggatttaaatttttgttatttataatttttrttttaattacttacttttttttttttttcctgagacagagtcttgctctgtcgctcaggctgcagtacagtggcatgatcatggctcactacagcctcaaacttctgggctcaagcaaacttcctgccttgggctcctgagtagctgggattacaggcatgtgccatgtccagctaattttttggaattttttgtagtgataaggtcttgctatgttgtccaggctaatctcaaactcctggtctcaagcaatcctcccaccttagcctcccaaagcattgggattacaggtgtaagcca

SEQ ID NO: 3283 - DNA, 601 bp, Human
ctgagggtcccttccccatgccctgagggactccataataaatctggctgcagctgtggatgatcagatccattacccacctcaccctgcccccagtcctttcctttatggtactctcagggctcccagtatgtagccccgtctctttctctgtctcctcttccccaaaatatactcagggtccctccctacccacttttccttatagccaacattcccaactgtgaccccacccattgtctctgactccccctccaaatacacacacacagacacacacacacacacacacacacacaccgaggagttcacagtagtttcgaccaactaatttatttaatagaaaaatgtaaatgtatgtctacacctggagcagagaggagtaatagccctatacctaggcctgggggaagaataccttgggacccccattaacactgtggtgaacttgctaccccctcccccaccttctcctccctaatacctttctcatccacccctactttacccagttcatgagcagcagtgaaggctgactggagcccatcatcctccacaatggcacagctccgagccgggtcacagacggtgcccacatcag

SEQ ID NO: 3284 - DNA, 601 bp, Human
tttatgagattgtcactcaggaaacttaagaatactaaatttgcttttgaaaaagcaaatatatttacatggatgtgcattgcacaaccaaaaacttacctttttattatctgaaaattctaaataaatcctttggcatacttttagttatattcttatctaaggctgcttcaaaacctatttttatcataattctatcatataaaatgtgaaagataactgtccagcatgagggttattgcttttgattggaagtgaatctcagttgtcctatgtatgttggagaaatatttcattaatratttattgaaaacattttctttgtcatctttctgaatgaaagagtatgaatggcgcttccctgtctttaaaggagtatattactgacatacaaaactcaaatgttaaatttgtctgaaaaatatatttctacatgatctgataaagttcagataaggggcattctgttcctaagaatgtcctaaaaatggaaagctgataaaagattatgcttagaattatacaggtaaaagacctacaacagttgttctcttgttttgatcccataggttatttgttattactcttctttaacagagtg

SEQ ID NO: 3285 - DNA, 601 bp, Human
tgcttttgaaaaagcaaatatatttacatggatgtgcattgcacaaccaaaaacttacctttttattatctgaaaattctaaataaatcctttggcatacttttagttatattcttatctaaggctgcttcaaaacctatttttatcataattctatcatataaaatgtgaaagataactgtccagcatgagggttattgcttttgattggaagtgaatctcagttgtcctatgtatgttggagaaatatttcattaataatttattgaaaacattttctttgtcatctttctgaatgaawgagtatgaatggcgcttccctgtctttaaaggagtatattactgacatacaaaactcaaatgttaaatttgtctgaaaaatatatttctacatgatctgataaagttcagataaggggcattctgttcctaagaatgtcctaaaaatggaaagctgataaaagattatgcttagaattatacaggtaaaagacctacaacagttgttctcttgttttgatcccataggttatttgttattactcttctttaacagagtgattttctattcttaaccttcttaagagccaatacagagtag

SEQ ID NO: 3286 - DNA, 601 bp, Human
ttctcaagagttgcaggataaaatcaaattaactttcatgtttcagaactaaaacatatccttgcatttatgggaaggataggtaaaaatggagatggtggctgataaaataaaaatctttgaaactatgtttttacaagcccaaagccttttggagttgaaagtattaaaaaaaagtatgatatgctatcttcaggttatgtatatgatcacagataatagctctgatggtcacagagcttgctgatggcttccaaaggatggctcctgccttttaccttgttaccacagctcctcatakggcactttgagtggcagttctggaatctgaaaaagaaaggatagtgtaagaatggtggtaaaataaaaagaactgtctttatagttcctgctttataggctcaataaggatttttaatacatccttgcaaaattgtttttgtagtttttgttacaaatctgttactttgcaattcctaaggagtagatttggtgctgttagtatgggtatttgcaagacatccctcaaggattcttatgttttgtgcattaactactgtcttcattacttacacatctaaaaactcccccttccttaggc

SEQ ID NO: 3287 - DNA, 601 bp, Human
aagctcaaaattttattaaccactctgctctgaatttattttagttaaggattagaagcatcaaacattttgctggaaaacaaaatgacatttggggaaacattctttccccttttgctgttactgatagcttattaattctggctgtaatttttttgtctttatatacattaatcaaaaagacaaagatgttgtataaaatagtcatgaaaaagattgagtaaatagtttatagctttgtagtaacttctgggataggacactaatatagctgtcaggaaaccttgattttagtttcctrtgtaccttcagttcgtttttcttaaacattggtataaaaatatggatgtaaaaggaagaaggtattttgtagggtagttgtaagttcctgaatgtgtggaatgatttatgtgcaaacattgtcttgcctaatggaaatagtcataattgcctagttttcattagtctgaaaaatgtcttaaagaagtattgggctcatcttaaatcaagagcaacagaagtctcttcatcagctgctgttagaacatgagtctgcgcagccatagagtagggatctgcagaccctgcaagaacagttcct

SEQ ID NO: 3288 - DNA, 601 bp, Human
attgcctagttttcattagtctgaaaaatgtcttaaagaagtattgggctcatcttaaatcaagagcaacagaagtctcttcatcagctgctgttagaacatgagtctgcgcagccatagagtagggatctgcagaccctgcaagaacagttcctgtcactggccactgtcagtggtcattaataattataacaatgtaagaaaacaagataatatagaagagtcaaactttgaactttaaacaaaacatgtttgctacattttaacagtcataaatagggcaatgggggggcggggcatgagttttagaatatgttttatgtcatttaagaatctgacttgcaagtacctgaatgggagagaagtgctgattattacaaagtagtggagcaaggagagttgaggagtagttggttttaaggggtttgtaaagctgtgttgatgttttgggtaataaaactagattcggggtagaaatgctttttctacccacgtattcataaatttatgtaagaagaaatgctagtaagtgttaataacctgagaagctctagctttttccttcctttttttggggtaataccttcatatgttaatttca

SEQ ID NO: 3289 - DNA, 601 bp, Human
tggaagaaattttttatctagtaatgtttggtgtgtattatcttaacattagtgctgaattttagaaagcacttctattttggtgacttttggaacacatgggtagagcattgtcaagtggcttggttagtttccattacccttatacaagtgttgtcattctgtacaatttggtgcctcttccctgacagtgtgatagtttcaggagttgaagggaaagcattgcatgttaaaagctaaagtggacagaagttatctttatttccctcttctgtactactttacacctacagtcacttattttttttttttgcaacattcattgaaaactccacattatttcaaacattatgttcttttttgacttattcatgttgtcaatgcctttatgataattttaagcttatttttaaatatttcaagatttattacattcaaaactcttataaagcattttgttcatggtataatagtattttgatctgagtagtaatagatttatttgtttaaatatagataaaaattggtcagtgtgtgttctccaaaaaaaaatcttgataatggggaaaatcagagattagacaggaaaagaagatattgt

SEQ ID NO: 3290 - DNA, 601 bp, Human
gatttataaggcttaaataccttgcacacatgttttttaaagtagattcaggggtcgggaaaactgaaaaatcactgtctttaagtacaagagaaaaatggaaatgcataaatattgaaaggttttacaatttgaaatgttctttgtggttttttcttttttaggtatgttttcataagcatatataaatttaaacatttttgatagcctctggccttaacttactgagcatgtgtcaccattgcacagctctttaaacagccgcttttaagatcaatgcaatttttcttttaattgaagrttttgaaagattaagagttagtgagatgagctctctgcctcttttagtagaattgaatagtctggattgtggatattatttctctccgcccttttgtaaccctctttggctaatgtcctctgttcatccacgtattagccaagtgccagtaaccctgctttacattgggatttctactcctggaatgtaggttgagaaccccagagggcttctttttgttaaatacttttagtattcttaatatgtaatctaatccaattaaagtgcagacttatatttctgtatcttgagttgcagatg

SEQ ID NO: 3291 - DNA, 601 bp, Human
gcaggctttccccaatactgcaggatctgtgagtcatgggaggaacggatcaaagaaggagaaggaatgtatctaatcaggaaaccatacatcgtttttacttctaaatatttggggctgatcccttacactgtagaaaaatttacttttttaaaagcccttttggctgggtgtggtggctcatgcctataatcccagcactttgagaggctgaggcaggtggatcacctgaggtcaggagtttgagaccagcttggccaacatggtgaaaccccgtctctactaaaattacagaaattaratgggcctggtggcgcatgcctataatcccagctactcaggaggctgaggcaggagaatcacttgaatccgggaggcagaggttgcattgagccgagatcgtgccatcgcactctagcctgggcaacagagtgagactccatctcaaaataaacaaacaaataaaaataaaagcactctttacatctttcatataatagagtcactagcttctgtaccaatttcttgtctttagtgtactttggtaaagttttataattaaagcacatttctatcttgaagttaccatccaaggtggttt

SEQ ID NO: 3292 - DNA, 601 bp, Human
ttctaaatatttggggctgatcccttacactgtagaaaaatttacttttttaaaagcccttttggctgggtgtggtggctcatgcctataatcccagcactttgagaggctgaggcaggtggatcacctgaggtcaggagtttgagaccagcttggccaacatggtgaaaccccgtctctactaaaattacagaaattagatgggcctggtggcgcatgcctataatcccagctactcaggaggctgaggcaggagaatcacttgaatccgggaggcagaggttgcattgagccgagatcrtgccatcgcactctagcctgggcaacagagtgagactccatctcaaaataaacaaacaaataaaaataaaagcactctttacatctttcatataatagagtcactagcttctgtaccaatttcttgtctttagtgtactttggtaaagttttataattaaagcacatttctatcttgaagttaccatccaaggtggtttctggatgctagtttaatgatttaaacactagtggctcactaattcactagatagtttttgttctgttttctttttgctgcctgtttttatttttataatta

SEQ ID NO: 3293 - DNA, 601 bp, Human
aaaagctattccttaggatcacagaatatacttgttttgagaccccatggctctcatgtgactgaaggagtcaatctgtgctcatggatgggcttctcagcaatataattctttttattttttatttttctcttcagttttccaaaatgggtcggatagtaagcagtacaatatcatgtgtccctgtaaggaaggttcccaagtaccaagcgaaatctgaatgttaccagactctttaccctaaaatggttaagaaccattgttttaaaggcagaaaactgaggcccagtttgcataatcrtttccttttatgaagcagatttcaagttctcattccattctagttgcttcatacaacaaacagtttggttttattttcaggtctgtggacatgtcattgattacagttaattgtcttgattactgtttatagcttaattatcaaaccagttgtttcttgaatttgtattatgacagggtgcatgtagtctttggactggttatttctggttttgaagtaatcgaacaaattgaaaatctgaagaccgatgctgcaagcagaccatatgcagatgtgcgagttattgactgtggagtactt

SEQ ID NO: 3294 - DNA, 601 bp, Human
agtttgcattcatgtcacgcctgcacagaaccctccaaggactcccatcttcaatcatccaaagcagaagtctttatggtggtctctaaggccctggctggtctggctctctgctgtctctctaaactcttttcccttattcattgccttccaggcacattgaccttttttcagacatgccaaccactcagggattttgtgctgcctattctctttgtctggaacaccctttgttaagatatctgcatgacactgtcccttgctcttaagtctctgttcaaatgttatgttaaactacccytagtcttcctattccctttacactgctttgtttttctgtcttagcacttaatcatttgtcatattatgcaattctttttttttttttttttttttttttgagacaagagtcttgctctgtcacccaggctggagtgcagtggcactatctcggctcactgcaacctctgcctcctgggttcaggtgattctcctgcctcagcctctggagtagctgggattatagggatgcaccaccatgcctggctaatttttgttatttttagtagagacatggtttcaccatgttggccaggctggt

SEQ ID NO: 3295 - DNA, 601 bp, Human
ctgtcacccaggctggagtgcagtggcactatctcggctcactgcaacctctgcctcctgggttcaggtgattctcctgcctcagcctctggagtagctgggattatagggatgcaccaccatgcctggctaatttttgttatttttagtagagacatggtttcaccatgttggccaggctggtcttgtactcctgacctcaagtgatttgctcaccttggcctcccacagtgttaggattacagatatgagtcactgcaccgggcctatttcttgttacttgacccaacaagaatatagscttcataaagacaagggacttactaccttacaatcttgccagtaattttattataaacttgaaaaaaactgtctacatttcattttttgtttgctgtatgtaaagcatattttatgatattcagtaatcacattttttactctgaaaggtaggcactgaatttagtactaatgtttttattaatgtttcttaaaagtttttgagaaaaaaaggaagaaaccaactcattcagaaggctcggattcctcttccaattcctcctcttcttcagaatcatcttcagaaagtgaacttgaacat

SEQ ID NO: 3296 - DNA, 601 bp, Human
ctgatattgtcttgttttaaaaagctattgcaaaatggcatgtatctttgaattaatagcttaacataatgtgttttcattattaaaaattctagcttctttgcttatttttaattttcatcacaatcttcttttcctaggaagattcctgatgttgcacccattgtaagtgatcagaaaccatctgtatcaaagtctggacggaagattaaaggaaggggcacaattgtatgtgtgataagactttttttgatattatgtatctaataaaaaatttttacctattttcaaagtcctagckttaattttagatataatacaaaatctgttcaaggaactaattgtattttccatggttatgggaaggtattgctgttagatcaaagtatactgctgtgtttgaatgggtttaattgagtatgaaaggaggaacatgtgaaaccatcagtgagtatgctgagaaatcattaagactttaaaaaggaaaattttatgtggattacaggtgaatctcagccttgcccatctcttttaatgccttgtttgaaataacttcacctgaacctaaaataaaagttaaaaactaaaaaaaaaaaaaaaa

SEQ ID NO: 3297 - DNA, 601 bp, Human
tgagattgggtcttttacttaactctgtcacatagcagactgtcgtggagaggcattttttaaaatactattgtttttgtttttaaagcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagtaagaactttgagtataagcacaatcctgtgtctgttatattttaaatgttaaagggattggatamaattctggacttttcattaaagattcagtgaaagattcacagtcagactgtgaccaaaggaaatacatttgggactacttgatgaaagtagtactgttaactagttgggcttttaaatcaaaatcctgttttccttaacaaaaactataagcctgtgtcttttaatgacctcttagtcaattttagaaataattaggacttagaggccgggcgtggtggctcacacttgtcatcccagcactttgggaggccgaggcaggcggatcacgaggtcaggagattgggaccacagtgaaaccc

SEQ ID NO: 3298 - DNA, 601 bp, Human
aggagataagtaagaactttgagtataagcacaatcctgtgtctgttatattttaaatgttaaagggattggatacaattctggacttttcattaaagattcagtgaaagattcacagtcagactgtgaccaaaggaaatacatttgggactacttgatgaaagtagtactgttaactagttgggcttttaaatcaaaatcctgttttccttaacaaaaactataagcctgtgtcttttaatgacctcttagtcaattttagaaataattaggacttagaggccgggcgtggtggctcacrcttgtcatcccagcactttgggaggccgaggcaggcggatcacgaggtcaggagattgggaccacagtgaaaccccatctctactaaaaatacaaaaaattagccgggcgtggtggcgggtgcctgtagtcccagctacttagagaggctgaggcaggagaatggtgtgaacccgggaggtggagcttgcagtgagctgagatcgtgccactgcactccagcctgggtgacagagcgagactccgtctcaaaaaaaaaaaaaaataattaggacttagaaattatatagcagattctttc

SEQ ID NO: 3299 - DNA, 601 bp, Human
agaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagygtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgat

SEQ ID NO: 3300 - DNA, 601 bp, Human
tccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactktgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctg

SEQ ID NO: 3301 - DNA, 601 bp, Human
aagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcggtgagcaatattctctttcctttcttctcccaaggagagtctgttattgtttagcttggaagaatatcagaattagggacagaatcactatttccaaatatctgaaaggaataagaagtcttgttttgtgtgattcagagagtarattgaaaacttagggagagggaatttcaggaggagaaatttgggctgggtttacaaaactctattactatcagtttaaagctctctgtcactagaaatgagttcccatgataggtggtaaattctccatctttaaaggtgtgaggctgcttcttgccagtcaagtgatgccttagaagggaatcctgaattgacagaatatatagaatttgcagatcattaatctaaccttccattttacacatgtggaagttgagggccagagagacaaagttacctgcccaagacatgcatcttagtt

SEQ ID NO: 3302 - DNA, 601 bp, Human
tgtgatggtaataggaagttagtaagcagttgtgttgcattctttttcttgtaaatattttatggttttacctgtttcttaattattcatatcccttattttattgtgcttgatattcatcatttgaactgaaaataccataagaatctttgacgtttgtttcctttctagttattcatcagtctttcttcccttgcctacccagacttcctaaaaaaggaaccgccacgtgccatctatactcggtctcccattttctcctcggctgtgtgcttgctgccttctgtgccttcccctcccygcatctcttagtttactgactaagactttcaggtacttctgatggccagtaccatggcgtattttcagcctcacttctggagccctctgctagctctcctttctcccactcaggccatttcgtccctgtgttctaggcttctcttcttcctcatggccttttctctctgagttcctgttgatagatgcagttgcctattgagcgactccagcttcctgtctgcttatgatctgccttaaccatttacacagagacagctctgagctattcgtgatgctggccactcttctcatttacctt

SEQ ID NO: 3303 - DNA, 601 bp, Human
ctttgacgtttgtttcctttctagttattcatcagtctttcttcccttgcctacccagacttcctaaaaaaggaaccgccacgtgccatctatactcggtctcccattttctcctcggctgtgtgcttgctgccttctgtgccttcccctccccgcatctcttagtttactgactaagactttcaggtacttctgatggccagtaccatggcgtattttcagcctcacttctggagccctctgctagctctcctttctcccactcaggccatttcgtccctgtgttctaggcttctcttcytcctcatggccttttctctctgagttcctgttgatagatgcagttgcctattgagcgactccagcttcctgtctgcttatgatctgccttaaccatttacacagagacagctctgagctattcgtgatgctggccactcttctcatttaccttcccacctctgccttggagtgggtggtatttcagtttgtaatgaagacagcaaggcgtagaaaggctaagggacttgttctaggctatgcagctaacaggtagtagactgagatggataagcctgggtgctgccctgcctccctgttt

SEQ ID NO: 3304 - DNA, 601 bp, Human
ggcgtattttcagcctcacttctggagccctctgctagctctcctttctcccactcaggccatttcgtccctgtgttctaggcttctcttcttcctcatggccttttctctctgagttcctgttgatagatgcagttgcctattgagcgactccagcttcctgtctgcttatgatctgccttaaccatttacacagagacagctctgagctattcgtgatgctggccactcttctcatttaccttcccacctctgccttggagtgggtggtatttcagtttgtaatgaagacagcaaggcrtagaaaggctaagggacttgttctaggctatgcagctaacaggtagtagactgagatggataagcctgggtgctgccctgcctccctgttttggttacctgcctgggcctgacacccccattaggctgtgaactccttgaagtcaggaactgtgtgttactcatcgttcagtcacctcacagggtctggctttattatttttggttgaataaatgactacaatcttattagaacataacgtattcattttcttgcagatatactggaagcaggtcatgtcttccaaaacatagtgcatac

SEQ ID NO: 3305 - DNA, 601 bp, Human
gagccaagtgaatgcagaggggcagaattgtactgcttacatttttgcttgttttattaagtattagacataaaaaatgataaaagtataaaaagctatataatacatactcatgtacctgccatctagcttaaaaaatagatctttgggccgggtgtggtggctcacgcctgtaatcccagtactttgggaggccgaggtgggcagatcacaaggtcaggagttcaacaccagcctaaccaacatggtgaaaccctgtctctactaaaaatacaaaaattagccgggcgtggtagtgcgygtctgtaatcccagctactcaggaggctgaggcaggagaattgcttgaacctgggaagcagaggttgcagtgagccaagatcgcgccactgcactccagcctgggcgacagagcaagactcctcaaaaaaaaaaaaaaaatagagctttgatgtaccagtgccacccctaggtgcatgcctatgtcccaaagttaaccattattctaaactttggttataattttgttgtctttctttatagctttaccccaagtgtttctatctttatacaatgttatgtttgcactttttattaagta

SEQ ID NO: 3306 - DNA, 601 bp, Human
cccagtactttgggaggccgaggtgggcagatcacaaggtcaggagttcaacaccagcctaaccaacatggtgaaaccctgtctctactaaaaatacaaaaattagccgggcgtggtagtgcgtgtctgtaatcccagctactcaggaggctgaggcaggagaattgcttgaacctgggaagcagaggttgcagtgagccaagatcgcgccactgcactccagcctgggcgacagagcaagactcctcaaaaaaaaaaaaaaaatagagctttgatgtaccagtgccacccctaggtgcaygcctatgtcccaaagttaaccattattctaaactttggttataattttgttgtctttctttatagctttaccccaagtgtttctatctttatacaatgttatgtttgcactttttattaagtaaaatacttttatatatatagatgttctacatttgccttcttcattcaacattgtgttctagagatatatccttgctgaaacatgtagctgtagttcattttcttcagaatatttcgttatatatctctaccttaatgtttttttaacccattctaccattagtggagatttggttta

SEQ ID NO: 3307 - DNA, 601 bp, Human
tcccagctactcaggaggctgaggcaggagaattgcttgaacctgggaagcagaggttgcagtgagccaagatcgcgccactgcactccagcctgggcgacagagcaagactcctcaaaaaaaaaaaaaaaatagagctttgatgtaccagtgccacccctaggtgcatgcctatgtcccaaagttaaccattattctaaactttggttataattttgttgtctttctttatagctttaccccaagtgtttctatctttatacaatgttatgtttgcactttttattaagtaaaatacttytatatatatagatgttctacatttgccttcttcattcaacattgtgttctagagatatatccttgctgaaacatgtagctgtagttcattttcttcagaatatttcgttatatatctctaccttaatgtttttttaacccattctaccattagtggagatttggtttattttcttctcagtgttattggtgttataaatcaggcttctatgaacatacttgtgccaatcttttcttgtttttctttattttcttctgtttgattttaaccatggttgttttgagagttcctcattagctg

SEQ ID NO: 3308 - DNA, 601 bp, Human
gagagttcctcattagctgacactgtcatatccactgtgaggagtttgtgagaggcctttcttcttgttgtgttttcccctttctgccctaccagtaattaattttaatatcatgatgagtcaacataattatatattttttcaattgctttaattgtagatcaagaagctactctagaagtcggagcagaggatggtacagcagaggccgaaccagaagccggagcagttcctaccggagttacaaaagtcacaggtgagcttgtgatctcaccctgtgatgtggtctccatcatgtccrctttttaaggctacataggcagagggggtagttgttgagaagaatcatgtcattactgaatatactactggcctattttctcatgtagttttttctatgtaagagctgtggaattcttgactattcctctgttgggatcttatcagagtgaggcaagaggagcagtagaaatatttaagaagccttgacccctacctccacctcccccacatgcatcttccttaacctaagttttacatctgcattcacctcttgacatgggttagagattgggataggaagattgtagagaggggacca

SEQ ID NO: 3309 - DNA, 601 bp, Human
ctagcttctttccctcttttgcatctgaggtattttctactgctgtcacttcactttacttacaaaggtcctacctgtacagacctttcccctaactccacccagtttagagcctccctagtgactatatgcatctcagagaagaactgcataaaacttgatcttatgaaatccaataggctttttaaaaaatccaatatacttttgatatgaaaacaaaacaaatgtagctgtgggatttcactgtattttcaccttgatgggcaaataaatgtctagatatttggtatagcctgtcctrccctgatctataagatgatggtccttcatgtgattaatattaggacgtccagcaggagcagatccaggagcagctcatatgatccccacagtcgatccaggtatgaacagggattgggaaaccaccagtggggcagaactgaaagatcttgttttgtaaactgtttgttcaaagtggtattttattgagtaactaaatgcatatatttgtctcctgaaaccataccttttctaaatgaggtctgttcgacaagttttatctgttggcccattgtactccagtgtcaaaaatgacaatatc

SEQ ID NO: 3310 - DNA, 601 bp, Human
actctttctggcttccctcctttaaagtgttgggacttttccttctgcctggagacacacgtgtcctcttcaccatctccccttttgccacttgaaatggccagttcccatctaccctgcagatctccactgtccctgggcagccctccctgatgcctaatcctaggatacagtccctcccatgtgcctctaagacagccctttgctcctactgtggctccccttgctcctaaattacttgtcttgctgactattctattctgtccttgaaccccagagaactatacttggttttgtgtctttgtgtgtgtgtgtgtgtgtgttcccagcatcttgcaaaatgcctggctcacagtgaatgtttttcaaaataactgaatgggacccatgaccaggtcctcttgactcaatatcccagtggtcctgttcatgcccagggccacccccacccctcattggaccccattttggtttccattccttgagtgaaactatttgtgcaccttttccccattacttttctcaggtaatctattcaaatattgatactcattttgggtaatatggggaaactattctgctcattggttttttgtttttg

SEQ ID NO: 3311 - DNA, 601 bp, Human
ctttctggcttccctcctttaaagtgttgggacttttccttctgcctggagacacacgtgtcctcttcaccatctccccttttgccacttgaaatggccagttcccatctaccctgcagatctccactgtccctgggcagccctccctgatgcctaatcctaggatacagtccctcccatgtgcctctaagacagccctttgctcctactgtggctccccttgctcctaaattacttgtcttgctgactattctattctgtccttgaaccccagagaactatacttggttttgtgtctttgtgtgtgtgtgtgtgtgtgttcccagcatcttgcaaaatgcctggctcacagtgaatgtttttcaaaataactgaatgggacccatgaccaggtcctcttgactcaatatcccagtggtcctgttcatgcccagggccacccccacccctcattggaccccattttggtttccattccttgagtgaaactatttgtgcaccttttccccattacttttctcaggtaatctattcaaatattgatactcattttgggtaatatggggaaactattctgctcattggttttttgtttttgtgg

SEQ ID NO: 3312 - DNA, 601 bp, Human
gtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaatycagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagggggaggggcattttcaaattctgcctaccaca

SEQ ID NO: 3313 - DNA, 601 bp, Human
gcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagkgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacat

SEQ ID NO: 3314 - DNA, 601 bp, Human
tccaggtccaatgggctgggagggctggccttctgccagcacatgcttcttgggatctcagtgtgaatggtgttcaggaggctaggggaaggcaccctggacctcactacaggctcagagcctgcccagcaacaccatggatactctctctaaaagggggactcctggggagactatagacaaactcaggcctggctggaagaaagagcatcaggaacaagccttgagtaccccaacttggtctcgtagagttcaaggcccaagctacaagcagcttgctccagcatccaggaggtccggyggtgcacacggcttgagatgcctgacaacctttacacctttgtgctgaaggtgagtgacaaggcttttcacaccctggggcaatacaaatacatacacatacagcagacccaaccctgttcccttcctccctgccaggtgaaggaccggacagacatcatctttgaggtgggagacgagcagcagctgaattcatggatggctgagctctcggagtgcacaggccgagggtgaggtcctgggccctcgtccctggcaccacctttgctgctaccacccctgacctgcccagatccttaac

SEQ ID NO: 3315 - DNA, 601 bp, Human
aaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccragaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacct

SEQ ID NO: 3316 - DNA, 601 bp, Human
tctttgtagccaaaagtcgggggtgtggggccatgcccagggggacctggtaatgccatttctgcactttgacaaaaactgagttgtatgaatgacttagataatggacattgaaacatttttgtaattatttccctctctctcctcccttcctccctcttctttttctctgtccccctcaagaccctctttcccagctgcccgctcctcagcacccgaagattcgcctgtacaacgcagagcaggtcctgagttgggagccagtggccctgagcaatagcacgaggcctgttgtctaccragtgcagtttaaatagtaagccggtatttctgttggatccttgctgggagctgtgggggcatcgtgcggaaccctggggccacatactagtccctgcctctgtgcagggtttgttatcaaacccgtgggaaacacatcgttcttggagcttgtaaaatctctgaggacagaggtttcacagcctcccactcatctgaaggcttaaactacactggcagtcaggactccgctgtctaaccacacgggttcttgctttggtggaaagttcattctttcgctggtttcaggagaaaggttgta

SEQ ID NO: 3317 - DNA, 601 bp, Human
atttctgttggatccttgctgggagctgtgggggcatcgtgcggaaccctggggccacatactagtccctgcctctgtgcagggtttgttatcaaacccgtgggaaacacatcgttcttggagcttgtaaaatctctgaggacagaggtttcacagcctcccactcatctgaaggcttaaactacactggcagtcaggactccgctgtctaaccacacgggttcttgctttggtggaaagttcattctttcgctggtttcaggagaaaggttgtaaaaataggcttccaccatggaagaamaggaggcagcttttagtcttcatcttcgggcttaaaaatcggattgatttaaccttatagaccaaatatggcctgatcagaaatttgtttggttaattacaatgaattctgagtttctcaactggttttccattttgcatattatcctggctctttcatctgtctcttgcctcttcaagcttttgcagaattggccatcacttgatttgcaatataaatacatatagaaagagggcaaagtccacatcctttgttattttttgtttacgttgttaagtaggttaattgaagagtaaggtg

SEQ ID NO: 3318 - DNA, 601 bp, Human
ggttaattgaagagtaaggtgaagttattggctaagtcattttgtactatttggtaaaccaaatgtaaagacatgatgatgtccagtgcttgtgagatgggactggttcatatgtgttcacctgatgctgtttgcagaatcaattagcatagccctttcaaagaggaattctaccagacatttgaagtcatggaaatgtccatagtagttttccaatgtgtgtgtgtgtgtgcacgtgtgcatgtgtgtctgtttgttgttgttgttttgaaacagagtttccctctatcgcccaggctgragggcaatggcatgatctcagctcactgcaacttccacctcctgggttcaagtgattctcatgcctcctgagtagctgggactacaggcatgagctaccatggctggctaataggtatatttttagtagagatggggttttgccatgttggccaggctggtctcaaattcctggccccatcctcaagtgatttgcccgcctgggcctcccaaagtgctgggattgcaggcatgagccaccgtgcccagccttcatagtagttttatcctacacagataattcaaccccccatcaaaaaaa

SEQ ID NO: 3319 - DNA, 601 bp, Human
aggagatcgagaccatcctggctaacacgctgaaaccctgtctctactaaaaatacaaaaaattagctgggtgtagtggcgggcgcctgtagtcccagctacttgggaggctgaggcaggagaatggcgtgaacccgggaggcagagcttgcagtgaaccgagatcgtgccactgcactccaggctgggcgacagagcgagactccatctcaaaaaaaaaaaaaaaagaatagaaaagtaatgtggaaaaatgacaggcaattgatttgttagaggagtaggtttccaggtaacttgtttwtctttttctttttctttttttttttttttttgagacaaagtctccgtcacccaggctgaaatgcagtggcacgatcttggctcactggacctccgcctcccaggttcaagcaattcttatacctcagccttctgtgtagctgggattacaagtgtgcaccaccccacccggttcagataacttcttttttttttttctgagacaaggtctcactctgccccccaggctggagtgcagtggcatgatcatggctcaatgcagccacaatttcctggctcaagagatcctcctacttcagcc

SEQ ID NO: 3320 - DNA, 601 bp, Human
tgaaacctccgccgcctgggttcaagtgattgtcctgcctcagccttccaagtagctgggattacaggcgcccgccaccatgcctggctaatttttttgtatttttagtagagatgcagtttcaccatgttagctaggctggtttcgaactcctcacctgaagtgatctgcccgcctcagcctcccaaagtgctgggattacaggtgtgagccactgcacccagccattattctcattttagacttttttttctaaattcgttctcttgtttgaaaattgtgtgtgtgtgtgtgtgtgtggaaaccaaaccagactggggtcacacttctggggtctatttccttttttattttaacttgatgtagttaaatgtgagcattttttcatgtaattatttctgtgtggacattgtatgtttcattatgtgacatatcacatgtgttgtatttaacttttccccagtcatgggcgtagacagttggcagcttgtgcctgtcctaagtcatgacctcgtacatgaatcatatctggttattttcttacacttctagaagagaggttgctgggtcaaaggggatggacttacttaatgtttttgtg

SEQ ID NO: 3321 - DNA, 601 bp, Human
agggggatactgtccgctgcccctactcaggctcccagcagccacctccttggcctttctgaagtctgtcacctaaggcaaagaggtcagagctggggactagagtcccacgtgggagtgtggcattgggactctgggaaaggcactgtcattcacaaggatgtgtggccatgtatttggcaaggttttcatatgggtgagacaaatcctctttgaatgggcagctatgggtggaaagaaactccgcaccagcaggaagcaggactggagtttgtattaacacagttccattcccaaaacrtaggctacagagactgagtttgaagtattaaaatcagttatgggatggaatgggagaaaatatttgcaaatcatctatctgacaagggacttgtatccagaatagataacgaactcttacaattcaacaattagaagacaaataacccaattaaaaaccacagctgggcacaagggatcacacctgtaatcccagcactttgggaggccaaggcaggaggattacttgagtctaggagttcaagaccagcctgggcaacaaggagagacccccaactctacaaagaaattaaaaataaaa

SEQ ID NO: 3322 - DNA, 601 bp, Human
gaggccaggagtttgagaccagcctgaccaacatagtaaaaccccgtttctactaaaaatataaaaattaaccaggcatgatggtgcatgcctgtaatcccagcacattgggaggccaaggcaggtggatcacttgaggtcaggagtttgagaccagcctggccaacatggtgacaccccatctctactaaaaatacaaaaattacctgggtgtggtggctcacacctgtagttccagctactcgggaggctgaggcacaagaatcacttgaacccaggaggtggaggttgctgtgagccragattgcgctactgcactccagcctgggtgacagagcaaaactccatctcaaaaaaaaaaaaaaaaaaagcgggggggaactgtatggtacatataaattgtatctcaataaacctgcgttttgaacaaaagctctggggaaactattacacatgaaacagagaattctgtgaattgaaatccttttttccttcccagcaccgacagtaaatggttcacggccgacatcatgtccataggggtgaattgtacacagatcacagcaacagagtgtgacttcactgccgccagtccctcagc

SEQ ID NO: 3323 - DNA, 601 bp, Human
aggcaggtggatcacttgaggtcaggagtttgagaccagcctggccaacatggtgacaccccatctctactaaaaatacaaaaattacctgggtgtggtggctcacacctgtagttccagctactcgggaggctgaggcacaagaatcacttgaacccaggaggtggaggttgctgtgagccaagattgcgctactgcactccagcctgggtgacagagcaaaactccatctcaaaaaaaaaaaaaaaaaaagcgggggggaactgtatggtacatataaattgtatctcaataaacctgygttttgaacaaaagctctggggaaactattacacatgaaacagagaattctgtgaattgaaatccttttttccttcccagcaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatggtaagagaacttga

SEQ ID NO: 3324 - DNA, 601 bp, Human
ggatcttgatttagacaaactaatgtataagacaattgaaatgtgatcaccgtctagatatttgatatataatgaacaattttattgttgacttattttcagtgttataatggtgttttggttatgatttttaaaggaggaggaggtctggttaagatgttaaagtttatgttatgtgtattttaccacaataaaaaattgggggaataaaaagagttcctgctgggcgcggtggctcacgcctataatcccagcactttgggaggccgaggcaggcagatcacttgaggtcaggagttcragaccagcctggccaacatggtgaaaccccatctctactaaaaacacaaaaattagctggatgtggtggtgcatacctgtaatcccagctacttgggaagctgaggtaggagaatcgcttgaaccggggaggcagaggttgtggtgagctgagattgcaccattgcactccagcctgggcaacaagagtgaaactccatctcaaaaaaaaaaaaaaaaaaaaaaaaagcaaaataatccaaagaacaggagggacaaggacaaagcttccaggcatagaagaaacaaaattggccataag

SEQ ID NO: 3325 - DNA, 601 bp, Human
atgtggtggtgcatacctgtaatcccagctacttgggaagctgaggtaggagaatcgcttgaaccggggaggcagaggttgtggtgagctgagattgcaccattgcactccagcctgggcaacaagagtgaaactccatctcaaaaaaaaaaaaaaaaaaaaaaaaagcaaaataatccaaagaacaggagggacaaggacaaagcttccaggcatagaagaaacaaaattggccataagttgacagttgattcagttgggtaattagtacatgagtgtttgttaatgatcttccctctaytttttttttttttttttttttgagacggagtctctctctcttgcccaggctggagtgcagtggcgcaatcttggctcactgcaagctccacctcccaggttcacgccattctcctgcctcagcctcccgagtagctgggactacaggcgcccgccaccacacccggctaattttttgtatttttagtagagatggggtttcaccatgttagccaggatggtcttgaactcctgaccttgtgatccgcccgcctcggcctcccaaagtgctgggattacaggcgtgagccaccgcacccag

SEQ ID NO: 3326 - DNA, 601 bp, Human
cttccaggcatagaagaaacaaaattggccataagttgacagttgattcagttgggtaattagtacatgagtgtttgttaatgatcttccctctactttttttttttttttttttttgagacggagtctctctctcttgcccaggctggagtgcagtggcgcaatcttggctcactgcaagctccacctcccaggttcacgccattctcctgcctcagcctcccgagtagctgggactacaggcgcccgccaccacacccggctaattttttgtatttttagtagagatggggtttcaccrtgttagccaggatggtcttgaactcctgaccttgtgatccgcccgcctcggcctcccaaagtgctgggattacaggcgtgagccaccgcacccagcctatcttctctctactttctatgtgtttgaaattttctgtaataaaaagtttttttttgttgttgttgtttttgaggtggagtcttgcactgtcgcccaggctggcgtgcagtggtgcagtctcggctcactgcaacctctgcctcctgggttcaagtgattctccctcccgggttcaagtgagcctcccaagtagctgggact

SEQ ID NO: 3327 - DNA, 601 bp, Human
tgacagagcgaggctctgtcatttaaaaaaaaaaaggaatgatacttaccgccactgcccagggatcaagagaaggtaacagaagcaggatgtatcgtgacagtgggtccggtgccagccagctgccgcttccggccggagtcaagcacccatgtttctgttagttactggctgggttgctgttctctgccctcgtgcttgaaaagcttgacacagtggtggtctcatgtcacatctgccactttcacctctgctggtggcgttagaatcagtaatggatatggaggtggtttaccaagcrgaggagtgagatggtggttggagggggcaggctttagcatcaccctcacctgggttcatatcccaactctgccatttattggctgtgttactgtgggcaagtagtgtcacctcctggcttccgtttcctcgtctgagaaatggggataaccttatttgtttttttgttttgttttgttttttgagacagtctcgctctgtcgcccaggctggagtgcagtggagcgatctcagttcactgcagcctccgcctccaggtttaagtgattctcgtgcctcagcctccccagtagctaggatt

SEQ ID NO: 3328 - DNA, 601 bp, Human
gaagggccagccatcctttgatgtcactctgtgtcccttgtgtggggttgagactttgccggtgccctgcttacgatgcctttgccacgctctgtagtttggaggaggttttagtgggcctggttctccatgaggaatccacaactacagcctgcaaggcttaactgtataaatgtttgaacagtttgtgaaaagggcacatgcgaaatcggggggaaacagagggagaaagagctttccagagagcagtaccagcaggtatgagaaggcgtggcatacgtggagaactgcaggtgcttakattggtcagaaatgcaatccacaaggggctgtggcaggtgctcacgttgacagaggtgcatgacatcagagcggcctggtcagcctcggggagtataggaaaaagcatcatggtcttgaagcatctccagtgcctaaattatcctagctgcatttaaggaggttctgttatctatgggaacttcatgatttcctaaattcaacattatgatggtttttgataataagagcttacatttattgagagcttcctttgtgtttggctctgggccagaattttagatacttcatctcatttcat

SEQ ID NO: 3329 - DNA, 601 bp, Human
agattggtcagaaatgcaatccacaaggggctgtggcaggtgctcacgttgacagaggtgcatgacatcagagcggcctggtcagcctcggggagtataggaaaaagcatcatggtcttgaagcatctccagtgcctaaattatcctagctgcatttaaggaggttctgttatctatgggaacttcatgatttcctaaattcaacattatgatggtttttgataataagagcttacatttattgagagcttcctttgtgtttggctctgggccagaattttagatacttcatctcatttcwtcttttttttttttttttttttgagctggagtttcgctcttgatgcccagctagtttttgtatttttagtagagacagggtttttaccacgttggtcaggctggtctcagactcctgacctcaggtgatctgcccaccttggccacccaaagtgctgggattacaggcatgagccaccgtgcccggcccatttcatctttatactaatccgtttgcagagagagaatccaagtcgttaagtggcttgcctcaggtcagcagcgaatcactggcagagcagagcagagcagagatgcctag

SEQ ID NO: 3330 - DNA, 601 bp, Human
attggtcagaaatgcaatccacaaggggctgtggcaggtgctcacgttgacagaggtgcatgacatcagagcggcctggtcagcctcggggagtataggaaaaagcatcatggtcttgaagcatctccagtgcctaaattatcctagctgcatttaaggaggttctgttatctatgggaacttcatgatttcctaaattcaacattatgatggtttttgataataagagcttacatttattgagagcttcctttgtgtttggctctgggccagaattttagatacttcatctcatttcatyttttttttttttttttttttgagctggagtttcgctcttgatgcccagctagtttttgtatttttagtagagacagggtttttaccacgttggtcaggctggtctcagactcctgacctcaggtgatctgcccaccttggccacccaaagtgctgggattacaggcatgagccaccgtgcccggcccatttcatctttatactaatccgtttgcagagagagaatccaagtcgttaagtggcttgcctcaggtcagcagcgaatcactggcagagcagagcagagcagagatgcctagct

SEQ ID NO: 3331 - DNA, 601 bp, Human
aggctagagtactgtggtaccatcttggctcactgcaacctctacctccccggctcaagcagtccacccacttcagccacccgagtagctggaactacaggcctgtgccaaccacacctggctaatatttttaaatttttttttatagagatggggttttgccatgttgcccaggctggtctcgaactcctggtctcaagcgatctgcccacctcagtctccaaaagtgctgaggttacaggcatgagcccgttcccagcctcctcttcatttcattatggggaatatgaaactgggaagrgtgagactcactgaaaaacagacttagcatctaggaaatagggaaaaatcatttctccatatcagagctcaagatctgggtcgattagaatagagggagcctggcagaatccagaagagagactctgcctcttccaagtctgtcctctccaactggatacggtgccggaaatgcaagagataggatgggccctctggccacgcttttctccaccctttggttgctttcttcactcgagggcaccgtgttgccatgctccctccccaagggcccgcccatacttttgtttttttaggatgg

SEQ ID NO: 3332 - DNA, 601 bp, Human
ctgttacgttagctcttctgcagtctgtgactctaaattttaggaattccaattgaatgctgaaataaacccaaagggaatttttgtccttaaaatcgtgtcttcctctgccctggcagtccaacaccattaaacagaagaaaagaaaatgtaaaaccatcaagtaatactattattcatagatcatacaattacttttatatttttattttttaattttaatttttcagagacaatttcactctgtcacccaggctggagtgcagtggtgcagtcatagctcactgtagcctccaattcmcaggctcaagccatcctcccactttggccttccgagtagctgggacttataggcatgcaccaccatgaccagcttatttttttattattattttctgtagagacggagggagggggtctcactatgttacccaagctcaaactcctggactcaagtgatcctcccacctcagcctcccaaagtgctggaattacaggcatgagccaccatgcctggcctatttttgtattttaaaaaataacaacatgttctgtatttgaataatctgccttttttcagttaacaatttagcagccttgt

SEQ ID NO: 3333 - DNA, 601 bp, Human
agtagggcagtcacaaaaggatactgtctgcttccacttaaatgaggtccccagagtcatcaaatccataaagacaggaagtagaatggtggttgcggtggtggagggagggaagtgggaagttcgtgttgaatggggccagagtttcagttctggggctgtacagagttctggagatggatggtggtcatgattgcacaatgtgaatgtgcttggcactaccgaactgtacacctaaaaagagttatgatggtacattttatgttatgtgtattttaccacaatttaattttttttttttaatggcatggggttggctaaaaaggtggcctggcctggagattggctgcagtagacccctctccgaggcagcaggtctcctctgctgtctggagaatgctccagggaagtggcctggctggaggacgtgaaggcggtggagacagtgatcaggagcttgagctttggggcccacagggtgcttaggagggccctaaggcagagtcaacacccagagctgtgagtgccaggccccgtgtacccattgcccagtgggtattgctaatatttgaaaggacttgagaaagaacagtagcgtggg

SEQ ID NO: 3334 - DNA, 601 bp, Human
ggaagtgggaagttcgtgttgaatggggccagagtttcagttctggggctgtacagagttctggagatggatggtggtcatgattgcacaatgtgaatgtgcttggcactaccgaactgtacacctaaaaagagttatgatggtacattttatgttatgtgtattttaccacaatttaattttttttttttaatggcatggggttggctaaaaaggtggcctggcctggagattggctgcagtagacccctctccgaggcagcaggtctcctctgctgtctggagaatgctccagggaagyggcctggctggaggacgtgaaggcggtggagacagtgatcaggagcttgagctttggggcccacagggtgcttaggagggccctaaggcagagtcaacacccagagctgtgagtgccaggccccgtgtacccattgcccagtgggtattgctaatatttgaaaggacttgagaaagaacagtagcgtgggtcttgtggaaagtcttattttcctgcataaccccagccccctgaggctctgtgaggccattgggccttctgaggacacggtcaggacattttggggatcagaggcgagct

SEQ ID NO: 3335 - DNA, 601 bp, Human
atggtggtcatgattgcacaatgtgaatgtgcttggcactaccgaactgtacacctaaaaagagttatgatggtacattttatgttatgtgtattttaccacaatttaattttttttttttaatggcatggggttggctaaaaaggtggcctggcctggagattggctgcagtagacccctctccgaggcagcaggtctcctctgctgtctggagaatgctccagggaagtggcctggctggaggacgtgaaggcggtggagacagtgatcaggagcttgagctttggggcccacagggtrcttaggagggccctaaggcagagtcaacacccagagctgtgagtgccaggccccgtgtacccattgcccagtgggtattgctaatatttgaaaggacttgagaaagaacagtagcgtgggtcttgtggaaagtcttattttcctgcataaccccagccccctgaggctctgtgaggccattgggccttctgaggacacggtcaggacattttggggatcagaggcgagctgagagaagaacatttaaaaagcatttgcagccgggcgcagtgacccacacctgtaatcccaggacttggg

SEQ ID NO: 3336 - DNA, 601 bp, Human
acaatgtgaatgtgcttggcactaccgaactgtacacctaaaaagagttatgatggtacattttatgttatgtgtattttaccacaatttaattttttttttttaatggcatggggttggctaaaaaggtggcctggcctggagattggctgcagtagacccctctccgaggcagcaggtctcctctgctgtctggagaatgctccagggaagtggcctggctggaggacgtgaaggcggtggagacagtgatcaggagcttgagctttggggcccacagggtgcttaggagggccctaargcagagtcaacacccagagctgtgagtgccaggccccgtgtacccattgcccagtgggtattgctaatatttgaaaggacttgagaaagaacagtagcgtgggtcttgtggaaagtcttattttcctgcataaccccagccccctgaggctctgtgaggccattgggccttctgaggacacggtcaggacattttggggatcagaggcgagctgagagaagaacatttaaaaagcatttgcagccgggcgcagtgacccacacctgtaatcccaggacttggggaggccagggtgggcag

SEQ ID NO: 3337 - DNA, 601 bp, Human
gccaggcgtagtggctcacgcctataatcccagcactttgggaggccaaggtgggtggatcatttgcgatcaggagtttgagaccagcgtggccaacatagtgaaaccctgtctctactaaaaatacaaaattagccaggcaaggtggtgggcacctgtagtcccagctacttggaggattgaggcaggagaatcgcttgaacctgggaagcagaggttgcagtgagctgagatcacaccactatactccagcctaggcaagagtaagactccatctcaaaaaaaaaataaaaataaaaawaaaataaaaacaaaaactaaagttaaaaggtctggtatactgaactggtaaactaattacaattttgctttccaacctcctcaagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttcc

SEQ ID NO: 3338 - DNA, 601 bp, Human
tgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacacygagtggcccttcatgtacatccatggtgtgctggcttaaaatgtaattaatcttgtaaatatactcctagtaatttaagattttgtttttaaactggaaataaaagattgtatagtgcatgttttttaaagtctatgtgaagtgttttctttattgtagcctattttctgcagagtttcagctttctaaaattactcaatctaaacttgttttttcttaaataacacctgctagagctactgaggcctcatgggaactcagcaaacacttcctatggatgtcacttgatcctccaaaggt

SEQ ID NO: 3339 - DNA, 601 bp, Human
aaagtgctgggattgcaggcgtgagccaccacgcctggctaacggctctggggactttcacacgcgcgttcacacacactccagtgcggacccacgatctgtgcacgcagccggcaggtgagccctgggcacatgcatgcaaacctgcccacctccctgcacgtgtgcatctgcgcctacgtgcacctgccccacctcggcttcccagagcgctgtccctgcccgtccccactcacggtcgcctccggccgcaggcctcctggcttcggtggaccagcgggggcccccgcacacgcgcacyagcgcgcgtacgaagtggtggccgcacaacttctcacgcatctctggggtgggcgcggggcccaacgcgaacaccagggcagggcccagcagcaccagcgcccaggcgggcagacgggggtccatggtggtgggtggcgccggggccaagcggggaccccctttataggcgcctgggccgtcccagctgggggccttggagaagggacagaacattcttcaggaccgcccaggaaaaaggtcaagggtggggttagtgccagagcctttctcccagggccagggccttggatgtacttct

SEQ ID NO: 3340 - DNA, 601 bp, Human
caggctggtctcgaactcctgacctctggggatccacccgcctcagcctcccaaagtgctgggattgcaggcgtgagccaccacgcctggctaacggctctggggactttcacacgcgcgttcacacacactccagtgcggacccacgatctgtgcacgcagccggcaggtgagccctgggcacatgcatgcaaacctgcccacctccctgcacgtgtgcatctgcgcctacgtgcacctgccccacctcggcttcccagagcgctgtccctgcccgtccccactcacggtcgcctccggycgcaggcctcctggcttcggtggaccagcgggggcccccgcacacgcgcactagcgcgcgtacgaagtggtggccgcacaacttctcacgcatctctggggtgggcgcggggcccaacgcgaacaccagggcagggcccagcagcaccagcgcccaggcgggcagacgggggtccatggtggtgggtggcgccggggccaagcggggaccccctttataggcgcctgggccgtcccagctgggggccttggagaagggacagaacattcttcaggaccgcccaggaaaaaggtcaagggt

SEQ ID NO: 3341 - DNA, 601 bp, Human
tgactcacatcgctaatcccaacactttggaaggtcaaggtgggaggattacttgagctcaggagtttgagaccagcctgggaaacagagtgagactccctctctacgaaaaagaaaaaaaaattagctgggtgtggtggcagcacctgtatcccagccactccagaggctgaggcaggaggatggtttgagcccaggaggttgagcctgcagtgagccgagatctcaccactgcactccagcctgggcgtcagagtgagaccctgtctcaaaaaacaaacaaacaaagcaaaattaaggyaaaaattcatgaagatcaaaatattgaaattttaagacaggatctcaccatgtacttgcaagagcctacctctcctgcctcactctgtttctggcccctcagggggactcatgctctgaggactttcttttttttttttttttgagacggagtttcactctgtcgcccaggctggagtgcaatggcatgatatcggcccactgcaacctctgccttccgggttcaagcgattctcctgccttggcctcccaagtagctgggattacagatgtgcatcattatccccggctaattttttta

SEQ ID NO: 3342 - DNA, 601 bp, Human
gattgagaccatccttgctaacatggtgaaaccccatctctactaaaaatacaaaaaatttagctgggcttggtggcaggcgcctgcagtcccagctactcaggaggctgaggcaggagaatggcgtgaagccgggagacggagcttgcagtgagccgagatcacaccactgcactccagcctgggggacagagcgagactcaatgtcaaaacaaaacaaaacaaaacaaaacaagaccagactggccaacatggtgaaacctgttgtttcacctgttcacctgtctctactaaaaatacaaaaaaaaaaaaaaatcagctgtgcatggtagtgggtgacctggggagtggcctgtaatcccagctacttggaaggctgaggcaggagaattgcttgaactcaggaggcggaggttgcagtgagctgagatcgtgccactgcacttcagcccgggtgacagagcgagactccatctcaaacaaacaaacaaaatacaaaaattagccaggtgtggtggtgcgtgcccgcagtcccagctactctggaggctgaggcaggaaaattgctggaacccgggaggcagaggttgcagtgagacga

SEQ ID NO: 3343 - DNA, 601 bp, Human
aggccaggcacagcggctcacgcttgtaatcccaacactttgggaggctgaggcgggcagatcacctgaggtcaggagttcaagaccagcctggcccgggcacagtggctcatgcctgtaatcccagccctttgggaggccgaggcaggtggatcacgagatcaggagattgagaccatccttgctaacatggtgaaaccccatctctactaaaaatacaaaaaatttagctgggcttggtggcaggcgcctgcagtcccagctactcaggaggctgaggcaggagaatggcgtgaagccrggagacggagcttgcagtgagccgagatcacaccactgcactccagcctgggggacagagcgagactcaatgtcaaaacaaaacaaaacaaaacaaaacaagaccagactggccaacatggtgaaacctgttgtttcacctgttcacctgtctctactaaaaatacaaaaaaaaaaaaaaatcagctgtgcatggtagtgggtgacctggggagtggcctgtaatcccagctacttggaaggctgaggcaggagaattgcttgaactcaggaggcggaggttgcagtgagctgagatcgt

SEQ ID NO: 3344 - DNA, 601 bp, Human
gccgagatcacgccactgcactccagcctgggtgatagagtgagaccctgtctcaaaatatatatatataataataataatattaatatttttcccttttttgagacaagggtctctgtctcaggctgagtctcatattgcccaggttggtctcaaactcctggcctcaagtgatcttccctcctagcctcctgagtagcagggattacaggcatgagccaccacatccagcaaggtaagtattttaatgcaatacttttaaaataaaatttaaaatatttgtaaaaaggccaggcacagyggctcacgcttgtaatcccaacactttgggaggctgaggcgggcagatcacctgaggtcaggagttcaagaccagcctggcccgggcacagtggctcatgcctgtaatcccagccctttgggaggccgaggcaggtggatcacgagatcaggagattgagaccatccttgctaacatggtgaaaccccatctctactaaaaatacaaaaaatttagctgggcttggtggcaggcgcctgcagtcccagctactcaggaggctgaggcaggagaatggcgtgaagccgggagacggagctt

SEQ ID NO: 3345 - DNA, 601 bp, Human
ggtggacccacagacacacacacacccctacgaggacacacccttgcagaccgcctcccctggatccctaacaccgcaagtggagtggcacacagagacatgtggacacgtgttaacacatctgcacaaacttgtcgtatatccctgcaccagggccaggactagggtacagacagggaggcacgaagccatcaggatatttttttgaggccaggcaccgtggctcacacctgtcatcccagcattttgggaagcctaggtgggtgcgttgcttgagcccaggagttcatgaccagccttrgcaatacagcaaaacctcatctctgcagaaaatacaaaaattagctgggcataattctgcatgcctgtagtcccagctacttgggaggctgaggtgggaggatcgcttgagcctgggaaggcaaggctgcagtgacccgagatcgtgccactgcactccagcctgagtgacagagcaagactgtctcaaaagaaaaaaaaaaggacttatgaaaatttagagggttgtttaccctctacccaatctgcagtttacaattgacaccagtggttctcaaaccagggtgattttgtttccagg

SEQ ID NO: 3346 - DNA, 601 bp, Human
caactcatgtccacactcacatccccagctgcgtgggtccccatatgccacctgagtgccccatgccctgcccagggagtgtcgggggtcttggagctacagatggtgtcagtttccccaacaggtccaagggtccgtgagacacccagagcaggtcagagacccacccacagactcctcgtggtacagagacatgcaggggtgtacatgtgtctgtgggtccacttcctggtcacccacgcatgtgtggtggacccacagacacacacacacccctacgaggacacacccttgcagaccrcctcccctggatccctaacaccgcaagtggagtggcacacagagacatgtggacacgtgttaacacatctgcacaaacttgtcgtatatccctgcaccagggccaggactagggtacagacagggaggcacgaagccatcaggatatttttttgaggccaggcaccgtggctcacacctgtcatcccagcattttgggaagcctaggtgggtgcgttgcttgagcccaggagttcatgaccagccttggcaatacagcaaaacctcatctctgcagaaaatacaaaaattagctgggcat

SEQ ID NO: 3347 - DNA, 601 bp, Human
ctcagtggctcacgcctgtaatcccagcactttgggaggccgaggtgggtggatcacttgaggtcaggagtttgagatcagcctggccaacatggtaaaaacctgtctctactaaaaaatacaaaaattagtcaggcgtggtggtggacgcctgtaatcccagctactggggaggctggggtgggagaatcacttgaacccaggaggtggaggttgcagggagctgggatcatgccattgcactccagcctaggtgacaagaatgaaactccatctcaaaaaaaaaaaaaaaaaaaaaaargcgagcacttattaagcacctactgtacgccaggcacctggttaatcctctcatccactcaactcatgtccacactcacatccccagctgcgtgggtccccatatgccacctgagtgccccatgccctgcccagggagtgtcgggggtcttggagctacagatggtgtcagtttccccaacaggtccaagggtccgtgagacacccagagcaggtcagagacccacccacagactcctcgtggtacagagacatgcaggggtgtacatgtgtctgtgggtccacttcctggtcacccacg

SEQ ID NO: 3348 - DNA, 601 bp, Human
cagcaaaccttctgttggcaggagcagtcgtgagtttgcccacatcctgcattcatgataaacaatttgctgtttgatcatatagcctccaatggaatgttgagttggtcatgatccctttgctggctctctacgtggcagagcagcaaacacctcatacctactaacactttgcagcatccaacaacaataaataagtgatgttattttctctgtttcataggtcaggaaacagagggaaagtgctggtgagatccaggcagggagttgaatcctggccgcctggctgtagagtctaggygccctcagtggaaccagtggacccagtagctgacatcagaggctgaaatcccagctgtgctgcatccctgtggtctcctgtcccaactgggtgttgatccaggacctgcaggctcacaagctctggagaagagggaaacgggtaaatgctccactgggtgcagtgttgtgtttattccctaaggacttttctctcttcagttgccccaaaatcagattcaccctttctctgagagaagatgaggcccccacttttttcttcctccctccttgcttttcccagcccctgtcagttctctcc

SEQ ID NO: 3349 - DNA, 601 bp, Human
cagtggcgcgatattggctcactgcaagctccgcctcccgggttcacgccattctcctgcctcagcctccctagtagctgggactacaggcgcccgccaccacgcccggctaattttttgtgtttttagtagagatggggtttcaccgtgttagtcaggatggtctcgatctcctgacctcgtgatccgcccgcctcggcctcccaaagtgctgggattacaggcgtgagccaccgcgcccgacctcccgtctcctttcagtcctcctcgggatcgcgcatcacccgcattttctggtctcctcctgcacttgctctcctcgcctctcctccgtctcctctcacttttcggacaaaccagtccttctgaggcccctgggttcccgggctgctcctgtgaatggcattggaaggccgttccagcgcggccgctgaggcagccacttcccccggtgctgggggcggatctcaggtccctgaagtcctgtcctctcccggagccgatgtgttctcagctcctgggccgcagctcctggagttggggccctcctttcttgggacccggaggtggtgcttcttgctgctgtggggactgtgggggg

SEQ ID NO: 3350 - DNA, 601 bp, Human
tcctgacctcgtgatccgcccgcctcggcctcccaaagtgctgggattacaggcgtgagccaccgcgcccgacctcccgtctcctttcagtcctcctcgggatcgcgcatcacccgcattttctggtctcctcctgcacttgctctcctcgcctctcctccgtctcctctcacttttcggacaaaccagtccttctgaggcccctgggttcccgggctgctcctgtgaatggcattggaaggccgttccagcgcggccgctgaggcagccacttcccccggtgctgggggcggatctcagstccctgaagtcctgtcctctcccggagccgatgtgttctcagctcctgggccgcagctcctggagttggggccctcctttcttgggacccggaggtggtgcttcttgctgctgtggggactgtggggggtcctgactctcaagctgaggggttggagtctgcaggctccgggcagaggattcttcctgcgacttctgtcatccccagctcattctcccctcgcctccggctccgggggtcctctcctctctcgcatcccacccctactaatgaccaatgatctaaggacaccagattccc

SEQ ID NO: 3351 - DNA, 601 bp, Human
cctcctcgggatcgcgcatcacccgcattttctggtctcctcctgcacttgctctcctcgcctctcctccgtctcctctcacttttcggacaaaccagtccttctgaggcccctgggttcccgggctgctcctgtgaatggcattggaaggccgttccagcgcggccgctgaggcagccacttcccccggtgctgggggcggatctcaggtccctgaagtcctgtcctctcccggagccgatgtgttctcagctcctgggccgcagctcctggagttggggccctcctttcttgggacccrgaggtggtgcttcttgctgctgtggggactgtggggggtcctgactctcaagctgaggggttggagtctgcaggctccgggcagaggattcttcctgcgacttctgtcatccccagctcattctcccctcgcctccggctccgggggtcctctcctctctcgcatcccacccctactaatgaccaatgatctaaggacaccagattccctctcacctcctccctgcccatcttacggcgccctgggtcctgttgctctcccagctccctgctaccccttcctgtgtgctgttctctgatc

SEQ ID NO: 3352 - DNA, 601 bp, Human
cctcctgcacttgctctcctcgcctctcctccgtctcctctcacttttcggacaaaccagtccttctgaggcccctgggttcccgggctgctcctgtgaatggcattggaaggccgttccagcgcggccgctgaggcagccacttcccccggtgctgggggcggatctcaggtccctgaagtcctgtcctctcccggagccgatgtgttctcagctcctgggccgcagctcctggagttggggccctcctttcttgggacccggaggtggtgcttcttgctgctgtggggactgtgggggrtcctgactctcaagctgaggggttggagtctgcaggctccgggcagaggattcttcctgcgacttctgtcatccccagctcattctcccctcgcctccggctccgggggtcctctcctctctcgcatcccacccctactaatgaccaatgatctaaggacaccagattccctctcacctcctccctgcccatcttacggcgccctgggtcctgttgctctcccagctccctgctaccccttcctgtgtgctgttctctgatccatttctagggtgtcctctgccttcatcccccgccccc

SEQ ID NO: 3353 - DNA, 601 bp, Human
cactcctgtaatcccagcactttgggaggccgagtcaggtggatcacttgagatcaggagttcaagaccagcctgatcaacatggagaaaccccgcctctactaaaaatacaaaattagccaggcgtggtggcatatgcctgtaatcccagctactcaggaaagctgaggcaggagaatcgcttgaacccaggaggcagaggttgtggtgagctgagattgcaccattgcactccagcctgggcaacaggagcaaaactccatctcagaaaataaaaataaacattgattcttccagtccrtgaacatggaatgccttttccattttttgtgtcctcttcaatgttttgcatcagtgctttatagtttttattggagagatctttcacttcttcagttaagtctattcctaggtattttattttatttgtagctaatgaaaatgggattcgtttcttgatttctttttcagattatttgctgttagcacatagaaatgctattgatttttgcatgttgattttgtatcctgcaactttactgaatttgttcttcagttctaatagttttttggtggagtctttaggttttccaaatatcag

SEQ ID NO: 3354 - DNA, 601 bp, Human
gtaaccatcattctactttttgtttctatgaatttgaccactctaggtacctcatttaagtagaatcgtgtaatgtttgtctttttgattctggcttatttcacttataatatttcgaggttcatccaggttgtagtatgggtcagattttcattccttttaatgatgaataatactcattatatgtatgtaccacaccttggttatccattcctcagacaatggacacttgggttacttctaccttttggatattggcaaatatttcatttctcttgggtatatatttatttcttttgartatttcttttgggtatatatccagaaatagaattgttggatcatacggtatttcattttttaatttttagaggaatcaccatagtgttttccattgcaggcgtgccattttgtatttctagaagcagtatacaggggcttcagtttctctacctccttgccaaacttgctgtgtgtgtgtgtgtgtgtgtgtgtgtgtgtgtgtgtgtgtgtgataatagccaccctgattggtttgaagtggtatctcattgtggtttggatttgcattttcctaatgagtactgatattgagcatctt

SEQ ID NO: 3355 - DNA, 601 bp, Human
gtatatatttatttcttttgagtatttcttttgggtatatatccagaaatagaattgttggatcatacggtatttcattttttaatttttagaggaatcaccatagtgttttccattgcaggcgtgccattttgtatttctagaagcagtatacaggggcttcagtttctctacctccttgccaaacttgctgtgtgtgtgtgtgtgtgtgtgtgtgtgtgtgtgtgtgtgtgtgataatagccaccctgattggtttgaagtggtatctcattgtggtttggatttgcattttcctaatragtactgatattgagcatcttttcatgtgtttattgatcatttgtatattttctttgaagaattggccattgaagtcttgcccatttttctcccccacatagcttctcatggctattttgcccatttttgagtgggttgactgttttgttgtttttgtcaaacttttttgcatattctggaaactaatctctctctttttcttttttttttttttttttttttttgagatggagtcttgctctgttgcccaggctggagtgcagtggcacgatctcagctcactgcaagctccgcccgct

SEQ ID NO: 3356 - DNA, 601 bp, Human
tgtgtgtgtgtgtgtgtgtgtgtgtgtgtgtgataatagccaccctgattggtttgaagtggtatctcattgtggtttggatttgcattttcctaatgagtactgatattgagcatcttttcatgtgtttattgatcatttgtatattttctttgaagaattggccattgaagtcttgcccatttttctcccccacatagcttctcatggctattttgcccatttttgagtgggttgactgttttgttgtttttgtcaaacttttttgcatattctggaaactaatctctctctttttcttttttttttttttttttttttttgagatggagtcttgctctgttgcccaggctggagtgcagtggcacgatctcagctcactgcaagctccgcccgctagcttcatgccattctcccgcctcagcctcccgagtagctgggactacaggcgcccgccaccacacccggctaattttttgtatttttagtagagatagggtttcaccatgttagccaggatggtctcaatctcctgacctggtgatacacccgcctcggcctcccaaagtgctggaactacaggcttgagccaccacgcctg

SEQ ID NO: 3357 - DNA, 601 bp, Human
tgcattttcctaatgagtactgatattgagcatcttttcatgtgtttattgatcatttgtatattttctttgaagaattggccattgaagtcttgcccatttttctcccccacatagcttctcatggctattttgcccatttttgagtgggttgactgttttgttgtttttgtcaaacttttttgcatattctggaaactaatctctctctttttcttttttttttttttttttttttttgagatggagtcttgctctgttgcccaggctggagtgcagtggcacgatctcagctcactgyaagctccgcccgctagcttcatgccattctcccgcctcagcctcccgagtagctgggactacaggcgcccgccaccacacccggctaattttttgtatttttagtagagatagggtttcaccatgttagccaggatggtctcaatctcctgacctggtgatacacccgcctcggcctcccaaagtgctggaactacaggcttgagccaccacgcctggccttctggaaactaatctcttatcagatatatgacttgcaatatttatttcatttcaggggttgattgctttctcactctga

SEQ ID NO: 3358 - DNA, 601 bp, Human
ttttcatgtgtttattgatcatttgtatattttctttgaagaattggccattgaagtcttgcccatttttctcccccacatagcttctcatggctattttgcccatttttgagtgggttgactgttttgttgtttttgtcaaacttttttgcatattctggaaactaatctctctctttttcttttttttttttttttttttttttgagatggagtcttgctctgttgcccaggctggagtgcagtggcacgatctcagctcactgcaagctccgcccgctagcttcatgccattctcccrcctcagcctcccgagtagctgggactacaggcgcccgccaccacacccggctaattttttgtatttttagtagagatagggtttcaccatgttagccaggatggtctcaatctcctgacctggtgatacacccgcctcggcctcccaaagtgctggaactacaggcttgagccaccacgcctggccttctggaaactaatctcttatcagatatatgacttgcaatatttatttcatttcaggggttgattgctttctcactctgattgtgccctttgatgcacagatattttgaatttt

SEQ ID NO: 3359 - DNA, 601 bp, Human
tggccattgaagtcttgcccatttttctcccccacatagcttctcatggctattttgcccatttttgagtgggttgactgttttgttgtttttgtcaaacttttttgcatattctggaaactaatctctctctttttcttttttttttttttttttttttttgagatggagtcttgctctgttgcccaggctggagtgcagtggcacgatctcagctcactgcaagctccgcccgctagcttcatgccattctcccgcctcagcctcccgagtagctgggactacaggcgcccgccaccayacccggctaattttttgtatttttagtagagatagggtttcaccatgttagccaggatggtctcaatctcctgacctggtgatacacccgcctcggcctcccaaagtgctggaactacaggcttgagccaccacgcctggccttctggaaactaatctcttatcagatatatgacttgcaatatttatttcatttcaggggttgattgctttctcactctgattgtgccctttgatgcacagatattttgaatttttcatgagtccagtttgtcagttctttctattctatctgtgcttt

SEQ ID NO: 3360 - DNA, 601 bp, Human
ggaaactaatctctctctttttcttttttttttttttttttttttttgagatggagtcttgctctgttgcccaggctggagtgcagtggcacgatctcagctcactgcaagctccgcccgctagcttcatgccattctcccgcctcagcctcccgagtagctgggactacaggcgcccgccaccacacccggctaattttttgtatttttagtagagatagggtttcaccatgttagccaggatggtctcaatctcctgacctggtgatacacccgcctcggcctcccaaagtgctggaaytacaggcttgagccaccacgcctggccttctggaaactaatctcttatcagatatatgacttgcaatatttatttcatttcaggggttgattgctttctcactctgattgtgccctttgatgcacagatattttgaatttttcatgagtccagtttgtcagttctttctattctatctgtgctttggcgtcatatccatgaaagcactgtcaaaccctatgtcatgaacattatacccaatgtttttttctaagatatttttatgttttagttcttgagtttagagtttaggtctttgat

SEQ ID NO: 3361 - DNA, 601 bp, Human
agactgcctgcagaaactacagcgatatctgaaatccggggtggccatcaggagaacaggtaccgaccctggccaggggctctactgttcccgcaattctgctagagttgcctcgcctcccagctctgtccggggaaaccctccctgtgctatggatgcaggcgtttcctgttggcatattgtgtcctgatttgcctctcctgttagagccattggataaagacagtgggtctgggactgaactgtccagtgttgtaatctgggaaagcagtgggccctctgacagaagcctgagcctggkgtgggagttaggcaggagaggaagccctcagggccagggctgccccctctgcctcccggcctgcccatcccggagagttccctcctggccccatgacccaggagtccacccttgacatccccctcctcagcatcaatgtggggatcccagagcctgaggccacagtcccaaggcccatcctcctgctagcctggaggaattaggccccagggtgaggacagacttacagaaggtccgggatctgtgagggattcagccagagtgagaacagtggagaggagcagccctgttccctgcatc

SEQ ID NO: 3362 - DNA, 601 bp, Human
gaactgtccagtgttgtaatctgggaaagcagtgggccctctgacagaagcctgagcctggggtgggagttaggcaggagaggaagccctcagggccagggctgccccctctgcctcccggcctgcccatcccggagagttccctcctggccccatgacccaggagtccacccttgacatccccctcctcagcatcaatgtggggatcccagagcctgaggccacagtcccaaggcccatcctcctgctagcctggaggaattaggccccagggtgaggacagacttacagaaggtccggkatctgtgagggattcagccagagtgagaacagtggagaggagcagccctgttccctgcatctcccttagaggggagcagggcttcactggctctgccctttcttctccagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggt

SEQ ID NO: 3363 - DNA, 601 bp, Human
cgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctggtgagcctggggtgaccctggagagggtcaggccagggtaggaacagcarggacggctgtggctctctgcccagtgtataacaagtccctttttttcagggaaggcgctggtgcttcagagtcaacggacagactttccatatgtttctgctgctatgccatgttttgttattattattattctctgtgtcccttgttgcaagaagaaaacatcagcggcagagggtccaggtgagaaaaggggacagtttctggagatgggaaagctcctttctaggcagtagggtctcctcattgctcctgcccagacaagacgtaggtgacaaggctgctggaacaggggatggaag

SEQ ID NO: 3364 - DNA, 601 bp, Human
gggtaggaacagcagggacggctgtggctctctgcccagtgtataacaagtccctttttttcagggaaggcgctggtgcttcagagtcaacggacagactttccatatgtttctgctgctatgccatgttttgttattattattattctctgtgtcccttgttgcaagaagaaaacatcagcggcagagggtccaggtgagaaaaggggacagtttctggagatgggaaagctcctttctaggcagtagggtctcctcattgctcctgcccagacaagacgtaggtgacaaggctgctggracaggggatggaagctggggtatttgggaggggaatgggagctgcatctccatctacacccataagtgcttctcaagccagggctggggcaaggccttcgaatatccagctgtggcctcctcctgctgcaagtgaggagtgggcagcagggagggctgtggcacctgctctgtccccatcccagcctctctgtctctcgggctcactagggtgcgtccaggtggggtgagttgggaatcacgtgctgattgctgagggcctggatgatcatggtgtcagagggaggaaatagtaaaggtg

SEQ ID NO: 3365 - DNA, 601 bp, Human
tggtgcttcagagtcaacggacagactttccatatgtttctgctgctatgccatgttttgttattattattattctctgtgtcccttgttgcaagaagaaaacatcagcggcagagggtccaggtgagaaaaggggacagtttctggagatgggaaagctcctttctaggcagtagggtctcctcattgctcctgcccagacaagacgtaggtgacaaggctgctggaacaggggatggaagctggggtatttgggaggggaatgggagctgcatctccatctacacccataagtgcttcycaagccagggctggggcaaggccttcgaatatccagctgtggcctcctcctgctgcaagtgaggagtgggcagcagggagggctgtggcacctgctctgtccccatcccagcctctctgtctctcgggctcactagggtgcgtccaggtggggtgagttgggaatcacgtgctgattgctgagggcctggatgatcatggtgtcagagggaggaaatagtaaaggtggctgtgatctggggagggccagaaactggagaggaatccaaggagaggcggtgcccacccgtgtgcctcctcc

SEQ ID NO: 3366 - DNA, 601 bp, Human
ccatctacacccataagtgcttctcaagccagggctggggcaaggccttcgaatatccagctgtggcctcctcctgctgcaagtgaggagtgggcagcagggagggctgtggcacctgctctgtccccatcccagcctctctgtctctcgggctcactagggtgcgtccaggtggggtgagttgggaatcacgtgctgattgctgagggcctggatgatcatggtgtcagagggaggaaatagtaaaggtggctgtgatctggggagggccagaaactggagaggaatccaaggagaggcrgtgcccacccgtgtgcctcctccaggaggcactttccaggttcccaccacctggcctccctgagtttccttgcagatgacacagatgaatagataagcagatgtccctgggccatttgaggagcggggcccagcccctcatcagggcagttgtggtccctgttttcatcctacctccagcgtgttttcttctgcagtccctgagggacacagtccccaggcgccatctctttgaggctttgttctgtgctctgtggccttaccttgccctccctgagccaatttccctttctcaaggtgg

SEQ ID NO: 3367 - DNA, 601 bp, Human
catctacacccataagtgcttctcaagccagggctggggcaaggccttcgaatatccagctgtggcctcctcctgctgcaagtgaggagtgggcagcagggagggctgtggcacctgctctgtccccatcccagcctctctgtctctcgggctcactagggtgcgtccaggtggggtgagttgggaatcacgtgctgattgctgagggcctggatgatcatggtgtcagagggaggaaatagtaaaggtggctgtgatctggggagggccagaaactggagaggaatccaaggagaggcgrtgcccacccgtgtgcctcctccaggaggcactttccaggttcccaccacctggcctccctgagtttccttgcagatgacacagatgaatagataagcagatgtccctgggccatttgaggagcggggcccagcccctcatcagggcagttgtggtccctgttttcatcctacctccagcgtgttttcttctgcagtccctgagggacacagtccccaggcgccatctctttgaggctttgttctgtgctctgtggccttaccttgccctccctgagccaatttccctttctcaaggtggt

SEQ ID NO: 3368 - DNA, 601 bp, Human
tcgaatatccagctgtggcctcctcctgctgcaagtgaggagtgggcagcagggagggctgtggcacctgctctgtccccatcccagcctctctgtctctcgggctcactagggtgcgtccaggtggggtgagttgggaatcacgtgctgattgctgagggcctggatgatcatggtgtcagagggaggaaatagtaaaggtggctgtgatctggggagggccagaaactggagaggaatccaaggagaggcggtgcccacccgtgtgcctcctccaggaggcactttccaggttcccacyacctggcctccctgagtttccttgcagatgacacagatgaatagataagcagatgtccctgggccatttgaggagcggggcccagcccctcatcagggcagttgtggtccctgttttcatcctacctccagcgtgttttcttctgcagtccctgagggacacagtccccaggcgccatctctttgaggctttgttctgtgctctgtggccttaccttgccctccctgagccaatttccctttctcaaggtggtcactgcctggtaagtttggagtaagggacggtcagaagcatttcccc

SEQ ID NO: 3369 - DNA, 601 bp, Human
gagggacacagtccccaggcgccatctctttgaggctttgttctgtgctctgtggccttaccttgccctccctgagccaatttccctttctcaaggtggtcactgcctggtaagtttggagtaagggacggtcagaagcatttcccccacagtcaggttgtttgatgggggatgaaaagagacagcagaagttttgtgtttctgcaaaaacagaggcagtgcaggggacagtgagaggctggggtgtccaggagacctgagtctggcggtaggggcgctggtttctcatccttgaacctarttgcactgtcagtcggcccctcatgcctgagcagatgggaaggttcgtcccctgccctgcagcaagagggccctgtccaggaggcacccacagcaggggcagtgcaggtctgtggtcactcctgctctcacctgcggcgtctcccgtggagggattgtcacttctggttccctgtgggcaggaatggtttcctcgtaggtcactggggttttggccaggaaaagggtatgaaattcatgtgccagtttatcaaaattcctgctttcaatgttgatgtccaataaagatgttcgtaatttc

SEQ ID NO: 3370 - DNA, 601 bp, Human
aggagacctgagtctggcggtaggggcgctggtttctcatccttgaacctaattgcactgtcagtcggcccctcatgcctgagcagatgggaaggttcgtcccctgccctgcagcaagagggccctgtccaggaggcacccacagcaggggcagtgcaggtctgtggtcactcctgctctcacctgcggcgtctcccgtggagggattgtcacttctggttccctgtgggcaggaatggtttcctcgtaggtcactggggttttggccaggaaaagggtatgaaattcatgtgccagtttmtcaaaattcctgctttcaatgttgatgtccaataaagatgttcgtaatttcagctctataatcttaataggatttcctctaatactgctgttgtaaagcatattaaataaaacaggaactcaaatttggagccccctctccagaagggtctgtgtggagatggtggctgtggcagcggcagttcccaggtgcagagggtgggcagaggcagcctcaggctaaggggtctcccctactccacgtggagaaaagtccttgtaggttgcaagggcagtggcctgggtggaatccctgctaggg

SEQ ID NO: 3371 - DNA, 601 bp, Human
atgttgatgtccaataaagatgttcgtaatttcagctctataatcttaataggatttcctctaatactgctgttgtaaagcatattaaataaaacaggaactcaaatttggagccccctctccagaagggtctgtgtggagatggtggctgtggcagcggcagttcccaggtgcagagggtgggcagaggcagcctcaggctaaggggtctcccctactccacgtggagaaaagtccttgtaggttgcaagggcagtggcctgggtggaatccctgctagggacagagcaggaaggcctcrcagcctcaccaagcagcagccctggggtgaagtaagtggaccaggagtaagtggaccaggcaggagcagtagtgactcaacagcaggtcacaggcctaggtgggtgctgaaggtcatgggaggccaggcctcctcgagcaaggtggggggtcccagggtcatgtcaggtgcagatcctgtggcagccatgtctttccatgctgggcctgctgggccccccaggcttcctgatggggtccccagttaggagctgcctgctcagggctgggaggggaggagtgctgagctgcagatagaggg

SEQ ID NO: 3372 - DNA, 601 bp, Human
gttcgtaatttcagctctataatcttaataggatttcctctaatactgctgttgtaaagcatattaaataaaacaggaactcaaatttggagccccctctccagaagggtctgtgtggagatggtggctgtggcagcggcagttcccaggtgcagagggtgggcagaggcagcctcaggctaaggggtctcccctactccacgtggagaaaagtccttgtaggttgcaagggcagtggcctgggtggaatccctgctagggacagagcaggaaggcctcgcagcctcaccaagcagcagcyctggggtgaagtaagtggaccaggagtaagtggaccaggcaggagcagtagtgactcaacagcaggtcacaggcctaggtgggtgctgaaggtcatgggaggccaggcctcctcgagcaaggtggggggtcccagggtcatgtcaggtgcagatcctgtggcagccatgtctttccatgctgggcctgctgggccccccaggcttcctgatggggtccccagttaggagctgcctgctcagggctgggaggggaggagtgctgagctgcagatagagggcagggcccacagtgggcaggg

SEQ ID NO: 3373 - DNA, 601 bp, Human
gttcccaggtgcagagggtgggcagaggcagcctcaggctaaggggtctcccctactccacgtggagaaaagtccttgtaggttgcaagggcagtggcctgggtggaatccctgctagggacagagcaggaaggcctcgcagcctcaccaagcagcagccctggggtgaagtaagtggaccaggagtaagtggaccaggcaggagcagtagtgactcaacagcaggtcacaggcctaggtgggtgctgaaggtcatgggaggccaggcctcctcgagcaaggtggggggtcccagggtcakgtcaggtgcagatcctgtggcagccatgtctttccatgctgggcctgctgggccccccaggcttcctgatggggtccccagttaggagctgcctgctcagggctgggaggggaggagtgctgagctgcagatagagggcagggcccacagtgggcagggcctgccctggtgtgcaggtgcctctgcaggagaggagggcctggggactgagagcaagggtcagggcctctctttggggaggcctctcactgtaacaggactggtcaggcctgagaggagggcactgggttccctcttggg

SEQ ID NO: 3374 - DNA, 601 bp, Human
gcagcctcaggctaaggggtctcccctactccacgtggagaaaagtccttgtaggttgcaagggcagtggcctgggtggaatccctgctagggacagagcaggaaggcctcgcagcctcaccaagcagcagccctggggtgaagtaagtggaccaggagtaagtggaccaggcaggagcagtagtgactcaacagcaggtcacaggcctaggtgggtgctgaaggtcatgggaggccaggcctcctcgagcaaggtggggggtcccagggtcatgtcaggtgcagatcctgtggcagccaygtctttccatgctgggcctgctgggccccccaggcttcctgatggggtccccagttaggagctgcctgctcagggctgggaggggaggagtgctgagctgcagatagagggcagggcccacagtgggcagggcctgccctggtgtgcaggtgcctctgcaggagaggagggcctggggactgagagcaagggtcagggcctctctttggggaggcctctcactgtaacaggactggtcaggcctgagaggagggcactgggttccctcttgggtcttgtccttttgtcttggggcccttt

SEQ ID NO: 3375 - DNA, 601 bp, Human
ccaggcaggagcagtagtgactcaacagcaggtcacaggcctaggtgggtgctgaaggtcatgggaggccaggcctcctcgagcaaggtggggggtcccagggtcatgtcaggtgcagatcctgtggcagccatgtctttccatgctgggcctgctgggccccccaggcttcctgatggggtccccagttaggagctgcctgctcagggctgggaggggaggagtgctgagctgcagatagagggcagggcccacagtgggcagggcctgccctggtgtgcaggtgcctctgcaggagagragggcctggggactgagagcaagggtcagggcctctctttggggaggcctctcactgtaacaggactggtcaggcctgagaggagggcactgggttccctcttgggtcttgtccttttgtcttggggccctttcactccctgcacggtgagtggtgggcacaggacaggggctgatgttgatggagtgatgggagagaactgacaggggctgggaaaagcaaggagggaggaagaaaaaagtgggggcctcatcttctctcagagaaagggtgaatctgattttggggcaactgaagaga

SEQ ID NO: 3376 - DNA, 601 bp, Human
tctttccatgctgggcctgctgggccccccaggcttcctgatggggtccccagttaggagctgcctgctcagggctgggaggggaggagtgctgagctgcagatagagggcagggcccacagtgggcagggcctgccctggtgtgcaggtgcctctgcaggagaggagggcctggggactgagagcaagggtcagggcctctctttggggaggcctctcactgtaacaggactggtcaggcctgagaggagggcactgggttccctcttgggtcttgtccttttgtcttggggccctttcmctccctgcacggtgagtggtgggcacaggacaggggctgatgttgatggagtgatgggagagaactgacaggggctgggaaaagcaaggagggaggaagaaaaaagtgggggcctcatcttctctcagagaaagggtgaatctgattttggggcaactgaagagagaaaagtccttagggaataaacacaacactgcacccagtggagcatttacccgtttccctcttctccagagcttgtgagcctgcaggtcctggatcaacacccagttgggacaggagaccacagggatgcagcac

SEQ ID NO: 3377 - DNA, 601 bp, Human
ggagagaactgacaggggctgggaaaagcaaggagggaggaagaaaaaagtgggggcctcatcttctctcagagaaagggtgaatctgattttggggcaactgaagagagaaaagtccttagggaataaacacaacactgcacccagtggagcatttacccgtttccctcttctccagagcttgtgagcctgcaggtcctggatcaacacccagttgggacaggagaccacagggatgcagcacagctgggatttcagcctctgatgtcagctactgggtccactggttccactgagggcrcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgag

SEQ ID NO: 3378 - DNA, 601 bp, Human
aatttcttgggattgagtgctatgaagctgcaaaaattagatttgctgccaattgctcacttgcatctaagttatatccttctggatttaagaaattattatataaaagaaaatgagacagaaagtctacaaattctgaatgcaaaaacccttcaccttgtttttcacccaactagtttattcgctatccaagtgaacatatcagttaatactttagggtgcttacaactgactaatattaaattgaatgatgacaactgtcaagttttcattaaatttttatcagaactcaccagaggtycaaccttactgaattttaccctcaaccacatagaaacgacttggaaatgcctggtcagagtctttcaatttctttggcccaaacctgtggaatatctcaatatttacaatttaacaataattgaaagcattcgtgaagaagattttacttattctaaaacgacattgaaagcattgacaatagaacatatcacgaaccaagtttttctgttttcacagacagctttgtacaccgtgttttctgagatgaacattatgatgttaaccatttcagatacaccttttatacacatgctgtgtc

SEQ ID NO: 3379 - DNA, 601 bp, Human
ttttctctcggaagcatttgagagatgttaaagacacagtagcacagaattgagactttctctttaagatcatcacaaggctgagagaaaactggaaagaagtcacttctcactttgtgattcagcattttgcaatgccatgctccattctttagaaagctgggaaggggtgttgcacagcttccttcatccctcctttcccgacctttgcccgcctaccacgaggggcccgttttactcactgcttctgtctcttccaagcctgcgattcccataaaaacagcaacttgtcttcccagaygttttctgtaatcgccgccacaatctccacctcttgccatcaaaggcagaaaccgaaggaaagtctcctgacttacaatcacctaaataaagcaatatattatatgacagccatctggcaaggaggctgctttataatgtccagagccctggctgaagatttaatcaggtgtgcagagttagctcaattcagcaagaacttaacaaggtatggatgttggaagggaaagcagagaaactgaactctgccttggtaaacagaatctaagggtagaccaaaaccataccatgggagactgga

SEQ ID NO: 3380 - DNA, 601 bp, Human
ccctgggaaaggagggaaaagcaatagcccatgtggcatgaagtgggacagagggagggcagaggggcaggaggaagagggagagccggcacagagttcctgggattagattcccaagagaggtatctctctggaaacccttgaaaacctggtacaagtgctgagtttcttgtctgggtaggaacagggacccaggctattttatttgggcattaaaaaacatttgggttcatctgagttatcccaaaattgcactcactaccttccttgtaacaataacagcaaaaaataataatttttwaaaaaaatcccacagaagatccttcagcctcttcttgtccaggaatacttgcgtgtgtaaaatgatcttggaagtggaaaggcctggaattggccactttgtcgtttgtctaggcaggaaaactcatgcatttcagagagagagtaaaaaaaaggtttttttgtagttcaaaaaaaagctcatagatcttttaacactatccacatcattaatatgtttcacaagccacatctgttaacattcaggtccagtggttctcaattttttttccaccaagtggcacatgagtctcctgctctt

SEQ ID NO: 3381 - DNA, 601 bp, Human
ctcagcagaagggcaatcaggattcaggccgcgccctccagggcccctgctactctgcgcagcccctgaagagatcaatgacatcatcagcaaagcaaaagctacagaaagagctcaccccacctcccactggttgtggggtttctctacctagagcaggaaggaaccatgcttaagacctttatctggccaggcaagttggctcatgactgtaatcccagcgctttgggaggctgagatgggtagatagcttgaagtaaggccagtagtttgagaccaacctgtgcaacatagtgagacmcccatctctacaaaaataaaaaaaattagccaggcatggtggcgcacctgtagtcccagctattggggaggctaaggcaggaggatcacatgagcacaagagttcaaggctgcagtgaacgatgatcacaccactgcactccagcctgggtgacagagcaaggccctgtctctaaaaaaacttttatcttagatgcattaaagaaaaaaaatcataatttaattgtttgcacttgagggttacatctctagggtaggtgaccagagatagccaactcttttttatttttaaatcaaaaca

SEQ ID NO: 3382 - DNA, 601 bp, Human
agttgtccaccagacactgagtattgcggatgtgagtgaccagaagttcccgattgcttttcagtaattgaatgtgggggtgagactctgatgggattatttccatctcactgtggccctgctcttccatagttaaagtagcaagcggctacttttcccaaattcatcttcagctgcgtgtgtcctctcagcagaagggcaatcaggattcaggccgcgccctccagggcccctgctactctgcgcagcccctgaagagatcaatgacatcatcagcaaagcaaaagctacagaaagagcycaccccacctcccactggttgtggggtttctctacctagagcaggaaggaaccatgcttaagacctttatctggccaggcaagttggctcatgactgtaatcccagcgctttgggaggctgagatgggtagatagcttgaagtaaggccagtagtttgagaccaacctgtgcaacatagtgagacacccatctctacaaaaataaaaaaaattagccaggcatggtggcgcacctgtagtcccagctattggggaggctaaggcaggaggatcacatgagcacaagagttcaaggctgca

SEQ ID NO: 3383 - DNA, 601 bp, Human
aatgaagtgtctgggaaccaatacacacagcaatgagaactgagatgtcagggtttgctccagacacaaacacagaagtaaaatacctgactgtgcaacctgctaacccaggcatttgtgtgctattagtaccccaaaatgcagccctgcccgctggactaaactcccacgctcttcactcagatcagcagggagaggcctcttctagctcccggggtccacacaatgccatgcccgtccctgtccccggggcaccttgtcaggctgggtggggcaggcacacacaatctccgcatcttcsgccgagaagtagtcattcttcagcaagttgtccaccagacactgagtattgcggatgtgagtgaccagaagttcccgattgcttttcagtaattgaatgtgggggtgagactctgatgggattatttccatctcactgtggccctgctcttccatagttaaagtagcaagcggctacttttcccaaattcatcttcagctgcgtgtgtcctctcagcagaagggcaatcaggattcaggccgcgccctccagggcccctgctactctgcgcagcccctgaagagatcaatgacatcatca

SEQ ID NO: 3384 - DNA, 601 bp, Human
gaactaatcagttaactgatggggtcttccattagtttggaaataaggactggcactcaacggtgacagaatactttgcctagaatcaaacctggcaaggctttttaatttttttctttccttttttagagacagggtctcactctgtcacccaggctggagtgtaggggcacaatcatagctcgctgcagccttagactctggggctcaagcagtcctcttgcctcagcctcctgagtagctggaactacaggtgtgtgctaccatgtccagctaaagatttttttaaaagaaaaaaaaatacaaccttgaatttgtgcaaccattaaaatgtctacatatgtcagaataggaagaaagcaaggggtcagaacacaggccattcccatacttccaaaggcccctctataaaccagaccatcgaggtgtgggcagttcaatcgcagccacctgggctgcacttgggagacaggattcagctgttcctttctaaaatcaaaatagcacctgggcctgcttcctgaggtggcactcagggctggcccagccattaccaaaccccccagggccctgcttgcactggtgcctgcggtcttgctgg

SEQ ID NO: 3385 - DNA, 601 bp, Human
aggggctgtggaagctggagcctagcactgacactctgccggctggccttgtttcccctaagcacacacctgtcttgtgcttctgtttccaacaacatattggattctttaaaaggcaggacttaggtccttggtgctggtatgttaccaacagctgtctcaaagtggagagttcaaaagcagggaaagaagactcctgccccagagcagatcctggccctaatgatatgttctcacatgccttggactgccgctgtcctgacacatttttgagattgctgactggtggtctcttccagcwgacttgaagctccctgagggcaggaaccctgtctgtgtctgctcaccactgtctccctgacatccagcacagtgtagggtcttggcatgtggtggatacagcaaaaaatacttattgaactaatcagttaactgatggggtcttccattagtttggaaataaggactggcactcaacggtgacagaatactttgcctagaatcaaacctggcaaggctttttaatttttttctttccttttttagagacagggtctcactctgtcacccaggctggagtgtaggggcacaatcatagctc

SEQ ID NO: 3386 - DNA, 601 bp, Human
tttgtctatagatttaccttttctggacatttcatataaacagaatcatacaatatgtagtcttttgtgtgagactgcttgtagagtgaattacactgtaaaagctagtaaagtagctggctaacggaaccaacagagaagtctttcgaaagaatgattcctcatgggaatactttctttttttttcatgggggaaggaaacaaggggagacaggaaggagcagacagagtcagaagctagcagtggctggcaggcacctgcaggggctgtggaagctggagcctagcactgacactctgycggctggccttgtttcccctaagcacacacctgtcttgtgcttctgtttccaacaacatattggattctttaaaaggcaggacttaggtccttggtgctggtatgttaccaacagctgtctcaaagtggagagttcaaaagcagggaaagaagactcctgccccagagcagatcctggccctaatgatatgttctcacatgccttggactgccgctgtcctgacacatttttgagattgctgactggtggtctcttccagctgacttgaagctccctgagggcaggaaccctgtctgtgt

SEQ ID NO: 3387 - DNA, 601 bp, Human
tgggtagcagtagtgcttgaagagcaggtcctgcagacacagcctgtcactttccttgaagcagctgaacatgcggcagcgaaagtggaagaagaatttgacccctgcgtctagccggcccgtggcccagaggctctgcagccgctgtagcagcatggacttgcccaccccagcatcacccaggatgaagatggtctcaccctgctcattgaggatgccggtggtgtggtccaggaggcaggccaggctgttcaggctgcccaggctctcattgctgaagccaaccagctccatgatggtrtccatgtagatctcctccagcagcagctcctccttctgggcatagcacagcacgaacttggagtcacggcccagatggtgtcgcagctgctgggtatacctgctcactggagggagggggtggcagggcacagcagcagggtgaggagagaggcagaaacagcatcaaacagggaggtctcaaagaggagaggcgagtgcataaacaaaattcacaacctgggccctgaggccagcgcagccactcctcagatgcaggacctggggagcgtcacagagccagcattcctgaccctgaggg

SEQ ID NO: 3388 - DNA, 601 bp, Human
ggaacatcctcctggcataggcgcgcaggtggctgggggagaagccccggagaagcaccttcttccgcaggaactggcgcgggacctcgatgcctgtgcgggctgtgagcagcttgctagcccccttgagcagcttcccactgagcaggttggccagcaagaccagggggtgggcaggctcccaggggcaggagctgtcaggcacgcggctcaggtccaagtccgagtgcagctcgtccaggccatcgaaggtgaagagggccacgtgggggaagcgcagcaggaaggcaaacacctcctyggggtcccgctctgggtagcagtagtgcttgaagagcaggtcctgcagacacagcctgtcactttccttgaagcagctgaacatgcggcagcgaaagtggaagaagaatttgacccctgcgtctagccggcccgtggcccagaggctctgcagccgctgtagcagcatggacttgcccaccccagcatcacccaggatgaagatggtctcaccctgctcattgaggatgccggtggtgtggtccaggaggcaggccaggctgttcaggctgcccaggctctcattgctgaagccaaccag

SEQ ID NO: 3389 - DNA, 601 bp, Human
gcccctggccgccagctgccccaccttctggctctgtgtctcgtagatgcagcgcagcatccagatgaacgtgggcatggcctgcacctggttgaagctttcgacctgaacgcggggcaggctcttcaggtagccccgcaggctggaaaacaggtgtgcccacagggccttgcgctttctcctcagggctgccgcgggcaccagatgccgcaggagtttctgtttggctttggacaacagcccgcacaggaagaggttggtgaactggaagtgatccttgttcttgaagaggtcttcccgygccggaccactgccctgcaggcactggaacgggaggaagggaggatagcaggacgtggtcgctgcccccgcagggggcatccactcctggaagaacctgagcagctcctgagtgcccaccctgtcgtccagcacgaggaagaaggctgtaaagaaggcctggagggtgaggtggaaaaactcataggactgctggtcacccccggggcccagctccggcaaagcccgcaggaagcccagctgcatgtctctctcctgcagcccggaggcctgcacctcctcctgggtgaagacaaagagg

SEQ ID NO: 3390 - DNA, 601 bp, Human
ctgcgttccaataaaactttacttagaaacacaagccttgggcccaattagacccacaagctgaccttgataacaagtaaaaggctgaacaattaaaagcttgatttttaggccacatcaaaatgatcaagtcagacactctggaccctttccctcagagtccccagcttggtgctgggaaatagtgtgtatgtacatggcatggccagcccaagacagcacaggctgctagacattcccaatatctatactttcttagcaatagattcccccatcttttagctgggcccatctcattaarttctgcccataccattaagttctgaaatctaagcagcaatataattagtaatagccaagaagtgttcttaaaagattgaggcatgctctcaatctttgcccttccttcttactgatagctagagtgtcgactagatggctggagtttgagcagccctcttgggccaagatgggaaagccgggtagtgaggatggcagaacaggaaggcagaagagagcctgggctccggagggtcatggagactccataccagtcctgaactacctacctctagacttttacatgagagaaataagcttg

SEQ ID NO: 3391 - DNA, 601 bp, Human
aggatatacacacaaagctttatacattgcagcatgcattgtggtattatcctaatgtaaaatctgaacaaatttagatcagaaacaactgatgaaatatattgtgatatctattcgagatgttgtgcagcttgtagggagaatgaggtagaatgaggagggagaagaacacagcattgacatctactccggactcagcctgggcaggtttgtatcacccaccagcagggtgacctcgggcaacaggcttaagttctttgggtctgagttttctcactggtgaacgttaacagtagagatagtatagagtggttgtgaggctgagtgagttaacacagggaaaaagtgtagaataacacatggcatgcagtcagcacttgagggcttctaggtgttgacattactactatccatgtgatttcactctccatggggcacctggccatgtccggaggcatttttgatcctcaccactgggaggtacagggcagagatgcggctaaaccgtctatgatgcacaggacagccctaccataataaagaatcacttggaccaaaatgtcaacagcatcaagatggagaaaccctaaaggagacatgt

SEQ ID NO: 3392 - DNA, 601 bp, Human
taccctacagtgtgcaaggatatacacacaaagctttatacattgcagcatgcattgtggtattatcctaatgtaaaatctgaacaaatttagatcagaaacaactgatgaaatatattgtgatatctattcgagatgttgtgcagcttgtagggagaatgaggtagaatgaggagggagaagaacacagcattgacatctactccggactcagcctgggcaggtttgtatcacccaccagcagggtgacctcgggcaacaggcttaagttctttgggtctgagttttctcactggtgaaagttaacagtagagatcgtatagagtggttgtgaggctgagtgagttaacacagggaaaaagtgtagaataacacatggcatgcagtcagcacttgagggcttctaggtgttgacattactactatccatgtgatttcactctccatggggcacctggccatgtccggaggcatttttgatcctcaccactgggaggtacagggcagagatgcggctaaaccgtctatgatgcacaggacagccctaccataataaagaatcacttggaccaaaatgtcaacagcatcaagatggagaaac

SEQ ID NO: 3393 - DNA, 601 bp, Human
ttcttaaagacagaactcatcaagggacttcagacttccaagttattttcagaaaggaatgaggtagaaataagtgtcagtacagttaacaagtccaaggagaaggcttactctgtaagtgttggctccaagcagagctgctccctgaacgtggctccccggccagctcaaccacaaccctgtggcctggtgtggcagtccctggcagggccaacaaagccacagccttctcagagcccagtcccatgaagtcacacacagaggagcatgctctggaggctcccagaacaagccagggacytaagtgaagacactcccaagaccagcacccatgccgcctgtcctgccctctctgaattggtggccagttcccctctccaccctgacacaagtgcaggccttgaagctgaagtctcctggccctactaaaatggttccttgtgtaggaatggtgaccctcaagagggaagcaatgcagattttgaaacttgacagaattaaagcaactgtaggtctttactacccgcctgaccagctacagagaaaagtggaagccaactgtgctctgcaaactgttctgtagtctggcagtctccttcct

SEQ ID NO: 3394 - DNA, 601 bp, Human
tcatctcttccctgcatcagtacaatgtcctactgacaggtcatttccacgtactctggccttctccaattcagtttcctagaagagccaagaattggtctttttgcattgcagatctgatcacatgcctctcctgcttcaaactgttcactgactttccatcacttttaggataaagaccaaaatgcacatcatgacccacagatcttttatggtccagtccctgcctatctcctcagcctcctgtagtcccctcttccacactgtctgaaccctggggcacagcagcttctggcagttyttccaggacaccacactccctcctgccccagaccctttgcacatgctgttccctacgcagaatactcacctcagctgactagctcctattcatccttcatggcttagtgtaagtgctgcttcctcagagaggccttccctgcaacctcatctaaatcaggttccctcttggccttcccctttgtgatagtacccatcacagttgtaattaaataattacgcaaatgattttttctttaatgtgcttctccctttctagacagtgaacccatgaagccatgttgttcaccactggattttt

SEQ ID NO: 3395 - DNA, 601 bp, Human
acccccaccctcatggagcagccaccacaagcccaccatggtggggggtgtccaacatgctctgctggcccagttcccagccgatcccctgagtcttggcgcccgtttagtcacccttcagctgcttgggaggcaggaagagacttcccctcttcacgaggtaagggagacaaaagcagccatttggatgccagggccacaggggcaagccatgccctatttctttggagggacagaatcacttcttcccaaggccagacactgtagcccatggtactcagccttctagaggagggtagcytagcagaggagaagccctgagtggaagcagcattttgaaggcatcgtcattcttagaccagctaagagctgagggcattctctatctttgccagcagacagtgagactccaggattaaaattaaaagcccgtggtgcatcctttccttgacattaactttccacaaaaccttggaggagtcaaatcccacactgcacatactccggtgtctccagctgtgaagtgggaccagtatcaatacatgggaaagtgctgagaaggaagaaaatatttcaggtataatactaatccatcaaacac

SEQ ID NO: 3396 - DNA, 601 bp, Human
aggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattrtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaacta

SEQ ID NO: 3397 - DNA, 601 bp, Human
gtatttaatagaacaacagggtgactatagttaataataactgtacattttagagtaacttaaagagtctaattggattgtttgcaactcaatggataaatgcttgaggtgatgcataccccattcttcatgatgtgcttatttcatattgcatgcctgtatcaagacttttcatgtaccttataaatatatatacctactatgtacctgcaaaagttaaaaattaaagaaaataaatccaggattgcctaataccaaaatccatttccattatcattcatgtgcagaaccacaaacccayggcacagttaaatacttgtggtaggttgtcttagccaccatttaaaaaatagagtcccaatatcagcatattctatgtaactttttctgacataattctagtactattataaatccctatgttagattagttataaaccatttctgcacttaactttatagattagactttacatattttatataatcttgaaatatgtactttgcatattttatattatgtatttaaaatacatagaagtgttatagataaagtgtatccaggtagcgttgatagttcatattatcttaacataaagtc

SEQ ID NO: 3398 - DNA, 601 bp, Human
tagtcttcactttagatttagatttgttctttctttttaagtatgggatgagtcacatatctgtgagagtgtacttgtttatttctgttcaccttcatccacacccttgtgctttcatctcctggatccacaaccttctctatccacatacccgataatgattatgacgaggaagatgacaatagtagcaactgcttgatacattgcatatgctataccaagcacacacactatcttactcatgacaactctgcaaagtaatcatcattatatccgatttatagatgaggcatctgagatkctgagagactgagtgacttaccctaggtgccatatcaacacgcggtggagctgccctttgaatccagaccaaacttttaaaatggtgcttttcactggctgaccagcaggcttagatatttctgttgacaggaagcacaaaaataataatacctgatacttacatgatgccaggcactgctctgagatctttatatgtactgattgacttaagctttacctctgtcccatgaggtaaacccacttgttaaccacatgtcacccgtgaggaaactgaagaccagagatgtcagggtctttc

SEQ ID NO: 3399 - DNA, 601 bp, Human
tctgcgtcttcaccaaagggaagaagaagaagggtcagcccagctcagcggagcccgaggacgcagccgggtccaggcaggggctggatggcccgccccccacaggtgctctaggaccctgggttagagctagtctggggcctggacggggttggcgctcatccgcgtgagtgagccacttgcacagtgggccggcaagtggggctggaaggcgcgtctgtctccctgctttcacctgtgccgcaatctggggggctgggaggccttcagcctagtcagggacaccgacatcaccctttarggtgttggccgccggccctgtgcgcgtctaggggaggacggtcccgcttggcgctggccgccccgcccggtgggcggtgggctggggccggggctgacgcggctttcccggcgcagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgct

SEQ ID NO: 3400 - DNA, 601 bp, Human
cgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtgsagaacctctaccccaagtgagcagaccaggggctgggcccgggccggcagggagggtgtcctctgtaggaggggtgtcgaggggtgtcgaggtgtgccgccggcagcttttagtgaggtcggtgtttgcagagttttgggtccgagaatgcaggggtgggacttggactccctggggcagagcctggacaggcagagactgggcctggacacagggataaggctggggctgggtctgcgttgctcttggaatccttaatttcctgggcctcagtcacattctgctgttggggaaactgag

SEQ ID NO: 3401 - DNA, 601 bp, Human
ggcatcgttgaagcctgtgtgccagaaatgtggggaacggagggacacagctgcatctggattgggtgaggggcagagagaaggtcatttgtaaacctctaggcagacaaagggcccttaggaagtgccagggctgggcagtcccctgggagctctggggcgctgcagaggcgccaggacagtgagccaagatgcgtctgtggagcagtttggggcagcccttcctgcccattctggcctacccctgggattgggaggtggccggggctggtgagatgcccaagacctgcagggctggagygcagtgggctgggagctggctggattccagggctgctgtgagtaggagcagggttttatctgggtgacaggtagtcttggagcaggaagaagatcagatcttaaaggtggctctggctgctgggtgaagaaggaattgttggaggtgagggaaggagcagagaggccgggaggaggcttttgcagtgagccagcggggagctgatgggagccggccagggcgccagagtggcatgaggctgctgattttgggggctattttggagcaggacctaatggggggggtggtgagagagtcaga

SEQ ID NO: 3402 - DNA, 601 bp, Human
acctgcagggctggagcgcagtgggctgggagctggctggattccagggctgctgtgagtaggagcagggttttatctgggtgacaggtagtcttggagcaggaagaagatcagatcttaaaggtggctctggctgctgggtgaagaaggaattgttggaggtgagggaaggagcagagaggccgggaggaggcttttgcagtgagccagcggggagctgatgggagccggccagggcgccagagtggcatgaggctgctgattttgggggctattttggagcaggacctaatggggggggtggtgagagagtcagaggaggcatgatgacttcagagtttctgttccaaaccaaactaagtagatggaggacccatcatctgaaatggggaccgggtgggggtgcgggagggtgtgctgggcagtctgggcctgccagagaccaaggctgagggcctgggctctagcttgagtggtggtgctgatttggtatagttgtcctcatgccagcctcccctgcctgcagtgacatcatcaacagccccaagctggtgggtgagctgcagggtatggggctcgggagcctcctgccccccaggca

SEQ ID NO: 3403 - DNA, 601 bp, Human
aaggaattgttggaggtgagggaaggagcagagaggccgggaggaggcttttgcagtgagccagcggggagctgatgggagccggccagggcgccagagtggcatgaggctgctgattttgggggctattttggagcaggacctaatggggggggtggtgagagagtcagaggaggcatgatgacttcagagtttctgttccaaaccaaactaagtagatggaggacccatcatctgaaatggggaccgggtgggggtgcgggagggtgtgctgggcagtctgggcctgccagagaccaasgctgagggcctgggctctagcttgagtggtggtgctgatttggtatagttgtcctcatgccagcctcccctgcctgcagtgacatcatcaacagccccaagctggtgggtgagctgcagggtatggggctcgggagcctcctgccccccaggcagatccgactgctggaggccacattcctgtccagtgaggcggtgagtctccacctgggccagggaggggcagggaggcagcagaggagaggctcggagacagacaggacatgggcagggagcttgacgggtcttccaggtgagcgag

SEQ ID NO: 3404 - DNA, 601 bp, Human
ggcggtgagtctccacctgggccagggaggggcagggaggcagcagaggagaggctcggagacagacaggacatgggcagggagcttgacgggtcttccaggtgagcgaggtgagggatagtgccccagtgacctgcccctcctcctccaggccaatgtgagggagttgatggaccgagctctggagctagaggcacggcgctgggctgaggatgtgcctccccagaggctggacggccactgccacagcgagctggccatcgacatcatccaggtactgcaatctgccccagggcacacrtaccgcccgtgcacgtgcatggggagccccacgcacattccgtcctgtgtgcatacccatgcccacctcggggcaccccctctgttcccgcctgtttcctccccgtcccctgcccccttgtccaggcgagcccctgctcagctcacccaccaccaccctgcagatcacctcccaggcccaggccaaggccgagagcatcacgctggacttgggctcacagataaagcgggtgctgctggtggagctgcctgcgttcctgaggaggtgggtgtgtgcccaggatggggtccctgtagccac

SEQ ID NO: 3405 - DNA, 601 bp, Human
cgggaggtgaggaggctctgggctggtggctgggtcttggggagttgggggcagcccggacacgcacactagcacgtctgtgtacactcacgcacatgtgctcacacacgcacatgtgaacacacgtgaatgcacgagcatgtgaacacgtgcacatgtgaacacacgtgaaggcacgaacatgtgaacgcacgagcatgtgaacacacacatgtgaatgcacgagcatgtgaacacatgcacacatatgaacacacgtgaaggcacgagcatgtaaacacacacacatgtgaacacgtgracacatgcacatgtgaacacacacgcatgtgaacgcatgagcatgtgaacgcacacatgtggacgcacgagcacgtgtgcagtcttttgctctggcatctgcctctctctggaggcctggctacaaggcttcaagggaggtggcgagctccccatcagcagacagctcacacgcccctggctgcttgccctcccaggagctcatggaggccttgcacctgcacctggtgaaggagtacatcatccaactcagcaaggggcgcctggtcctcaagacggccgagcagcagcagcagctggc

SEQ ID NO: 3406 - DNA, 601 bp, Human
ggaggtggcgagctccccatcagcagacagctcacacgcccctggctgcttgccctcccaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacgtaagccgctgcccacctctcccaagcccctctgaaatggctgcctcttctcccctagccctttcagggtcggagataggccgytggtgcctctctaagcccaacgagtcgctgacccgagcctctggacccctgggtccctccaaccacacccactcctgcagggctccccggcgacctggctgcagcctgctctccctacgctggccgagatcattcgcctgcaggaccccagtgccatcaagattgaggtggccacttatgccacctgctaccctgacttcaggtgagaacctggggcacctcaggaccactgtcacatcactgtggccaaggcctcacagggctggcattgggaacccagatcctggcagctgcccacgt

SEQ ID NO: 3407 - DNA, 601 bp, Human
cagcttcacccagcctggggggcctctgcggcctaggcctatgctctgggaccagggctcatattcgggagtggaggcttagcccttggctgcctgaagttctggtgggccagggacattgtttcttcctgggctgggtcctctgacatgttagggtaagtttgaatgggtcttgacagggttgaccccagcttcgccaagtccagtccctgtctgatccattccacccattcattcattcacccaccatacaagcacccatctgctcatccacccattccttcacccatctggctatccrtctatcttctcacccactcatcacctgtctacccatccacccacccacccacccacccgtctatccatccatctattcatccacctacccatgtaagcacccatccacccatctactcatccatccacccctccacccatttagctatccatccactcaaccactcacccacccacccatccacccatgcatctactcactcatccatgctcccatccctccacccatctagctctcatccatctgctcacccacccaccatccatctacctatgccaccaacaattatggagaagtctg

SEQ ID NO: 3408 - DNA, 601 bp, Human
ccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgaccyggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccactttttttttttttttttgagacagggtcttgctgtgttgcccaggctggagtgcagtggcctggtcatggcatcaaggctcactgcagcctggacctcct

SEQ ID NO: 3409 - DNA, 601 bp, Human
tgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccactttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcac

SEQ ID NO: 3410 - DNA, 601 bp, Human
cccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcgrtctcaggcatgactcagcccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtggctgtggagtgatttattt

SEQ ID NO: 3411 - DNA, 601 bp, Human
ccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcgawctcaggcatgactcagcccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtggctgtggagtgatttatttt

SEQ ID NO: 3412 - DNA, 601 bp, Human
gtccctcctcctcactggggacaaggggccacccccgtgccgctggggatggggaatagcagttctgggctgactgatcggggcgtctggagggtcctgggctgagagctggaatctgctgggttgggtgggaaatgagttagaatccgactcctgatttccttccagggcacctccccaagcccaccctctgggctgaaccaggctctgtgatcacccaggggagtcctgtgaccctcaggtgtcaggggggccaggagacccaggagtaccgtctatatagagaaaagaaaacagcacyctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggtgagctgacactcaggggtcccagccccagactctgccctcaggaagggggacggctctcaggggcttctccctctcacagcccagccctggggatgacgcgggtggtctgagccacatttaacacggtgcctccttctctcct

SEQ ID NO: 3413 - DNA, 601 bp, Human
ctgatcggggcgtctggagggtcctgggctgagagctggaatctgctgggttgggtgggaaatgagttagaatccgactcctgatttccttccagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacaygcagggcggtatcgctgttactatggtagcgacactgcaggccgctcagagagcagtgaccccctggagctggtggtgacaggtgagctgacactcaggggtcccagccccagactctgccctcaggaagggggacggctctcaggggcttctccctctcacagcccagccctggggatgacgcgggtggtctgagccacatttaacacggtgcctccttctctcctaggagcctacatcaaacccaccctctcagcccagcccagccccgtggtgaactcaggagggaatgtaatcctc

SEQ ID NO: 3414 - DNA, 601 bp, Human
tgatcggggcgtctggagggtcctgggctgagagctggaatctgctgggttgggtgggaaatgagttagaatccgactcctgatttccttccagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatrcagggcggtatcgctgttactatggtagcgacactgcaggccgctcagagagcagtgaccccctggagctggtggtgacaggtgagctgacactcaggggtcccagccccagactctgccctcaggaagggggacggctctcaggggcttctccctctcacagcccagccctggggatgacgcgggtggtctgagccacatttaacacggtgcctccttctctcctaggagcctacatcaaacccaccctctcagcccagcccagccccgtggtgaactcaggagggaatgtaatcctcc

SEQ ID NO: 3415 - DNA, 601 bp, Human
tcctggaaaccatgaccaccttttcccaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagygaccccctggacatcctgatcgcaggtgaggagcccagcgggttcagtcagggacccaggctccgcacaggccctgccgggggagctcaggtagtgatggccgggatgagggatgggggtcccaagggagggagagacagacagagacaggggatgggcggggagggggagactcagagaaaacagagacagagacactgagggtcccagagggagacctggggaggtgtcagctcagagcaaggtggggcagcccctcgcccatccttcttctctccaggacagttctatgacagagtc

SEQ ID NO: 3416 - DNA, 601 bp, Human
ctcctcttcctcatcctccgacatcgacgtcagggcaaacactggacatcgagtgagtagggaatggggggaccctgagggctgaccgagggtgggctcagggcacagccaaagagaatccaaaccactgggcaaatgcagctttgagaaactgttccagcatttctcaccaggccaatcgacagtcagtcccatctacaaatgtaaagtgtccttcgggctcagtgccatctacaaatgtaaagtgtccttcgggctctgtccatcctatgaggcatttggaacatggaggcaggagtgtttttaggtttccttccttaccttcgagctgtgtgtgcagggcagggggctccaatgttcccagggctgaggctctgtccttcttcccccagcccagagaaaggctgatttccaacatcctgcaggggctgtggggccagagcccacagacagaggcctgcagtggaggtaattctgcccgaagaccccagactcccacctgctcgtggcccatacactgcccctaaagctcccattcttcccccaggtccagcccagctgccgatgcccaggaagaaaacctctgtgagtgagaggaaga

SEQ ID NO: 3417 - DNA, 601 bp, Human
ttcctcatcctccgacatcgacgtcagggcaaacactggacatcgagtgagtagggaatggggggaccctgagggctgaccgagggtgggctcagggcacagccaaagagaatccaaaccactgggcaaatgcagctttgagaaactgttccagcatttctcaccaggccaatcgacagtcagtcccatctacaaatgtaaagtgtccttcgggctcagtgccatctacaaatgtaaagtgtccttcgggctctgtccatcctatgaggcatttggaacatggaggcaggagtgtttttargtttccttccttaccttcgagctgtgtgtgcagggcagggggctccaatgttcccagggctgaggctctgtccttcttcccccagcccagagaaaggctgatttccaacatcctgcaggggctgtggggccagagcccacagacagaggcctgcagtggaggtaattctgcccgaagaccccagactcccacctgctcgtggcccatacactgcccctaaagctcccattcttcccccaggtccagcccagctgccgatgcccaggaagaaaacctctgtgagtgagaggaagaggtgac

SEQ ID NO: 3418 - DNA, 601 bp, Human
gcacagccaaagagaatccaaaccactgggcaaatgcagctttgagaaactgttccagcatttctcaccaggccaatcgacagtcagtcccatctacaaatgtaaagtgtccttcgggctcagtgccatctacaaatgtaaagtgtccttcgggctctgtccatcctatgaggcatttggaacatggaggcaggagtgtttttaggtttccttccttaccttcgagctgtgtgtgcagggcagggggctccaatgttcccagggctgaggctctgtccttcttcccccagcccagagaaargctgatttccaacatcctgcaggggctgtggggccagagcccacagacagaggcctgcagtggaggtaattctgcccgaagaccccagactcccacctgctcgtggcccatacactgcccctaaagctcccattcttcccccaggtccagcccagctgccgatgcccaggaagaaaacctctgtgagtgagaggaagaggtgaccagccaggagggagatgggggccccgaagtttccgtagcaatggggaaaggggcactggctggaaagggtctggggctcagggtgagatcatctca

SEQ ID NO: 3419 - DNA, 601 bp, Human
ggtggtggagcacgcgtgccgcagcgacgggaggcgggcccgtgtcacctgtgcaggtacgagcgcaccccctacacgggcccccacctgccccactccccaggccttcagccactgcccctggctccagaccctggacgcaagcctcgccctccagacctccacccccaccgcctaccagtgcaaacgcaccgggttcccacaccggaggacgacctcgagtcatttccagatctgagcgtttccttggatctggcctccagactccacccccacacttggttcctagtcccacccctgkgttcccaaagctaacccggtctctaaccccacttactgggcccgccgcttccctgtccccgcccgctctgggtctctcctcccctttcgccatatacataaacatgccaggttcacagggtccctaagcgctgtggctcccaggctcccaaacctgccctccaggccccgcccaccaggtctctggtccctcccaccagcctgcggctctacctaacccatctgcagtcctggggggattcccagtcttgcctaccgggctacagccctctcactgggtccacaacacgctcacaactct

SEQ ID NO: 3420 - DNA, 601 bp, Human
gctacagccctctcactgggtccacaacacgctcacaactctccggccagtccaaccatcaccccaaccctcccttcctggtcgggtgccccagcatccacaaccccctcccacccctagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcaygcccggccgcgggcctatccaccgggaccaggtgaactgctcgggggccgaagcttacctgtgggactgcccggggctgccaggacagcactactgcggccacaaagaggacgcgggcgcggtgtgctcaggtcagtgggcggagtcgctgaagcccggtcactaccaacactcaccataggcctactgggcgccaagcctggagttagtgccggagaggtggtccctgcccttgagatgtcacagttcaggaggggagatgagactgagacaaacataattcaggagagaaagtggcaa

SEQ ID NO: 3421 - DNA, 601 bp, Human
agaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgyggtgtgctcaggtcagtgggcggagtcgctgaagcccggtcactaccaacactcaccataggcctactgggcgccaagcctggagttagtgccggagaggtggtccctgcccttgagatgtcacagttcaggaggggagatgagactgagacaaacataattcaggagagaaagtggcaaatgcccccaagaaaggcagtcaggtggagtctagaggcagcagaccatgcggagctgtaggctaaggctgaccacctcccggaagaggtgacattaaaagtgagactcttcccgagtggg

SEQ ID NO: 3422 - DNA, 601 bp, Human
ccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcaggtcagtgggcggagtcgctgaagcccggtcactaccaacactcaccataggcctactgggcgccaagcctggagttagtgccggagaggtggtccctgcccttgagatgtcacagttcaggaggggagatgagactgagacaaacatrattcaggagagaaagtggcaaatgcccccaagaaaggcagtcaggtggagtctagaggcagcagaccatgcggagctgtaggctaaggctgaccacctcccggaagaggtgacattaaaagtgagactcttcccgagtgggagttggccacctgcattcaagcagcaaggggagactgaagggagggaggcctctgaggaggctgttggtctgtccaggtggggccagaaggttctggaccagccagtgcctctctttgataagcaggagatgggggaggtgggggtgttaaaatgtaga

SEQ ID NO: 3423 - DNA, 601 bp, Human
cacgcccggccgcgggcctatccaccgggaccaggtgaactgctcgggggccgaagcttacctgtgggactgcccggggctgccaggacagcactactgcggccacaaagaggacgcgggcgcggtgtgctcaggtcagtgggcggagtcgctgaagcccggtcactaccaacactcaccataggcctactgggcgccaagcctggagttagtgccggagaggtggtccctgcccttgagatgtcacagttcaggaggggagatgagactgagacaaacataattcaggagagaaagtggyaaatgcccccaagaaaggcagtcaggtggagtctagaggcagcagaccatgcggagctgtaggctaaggctgaccacctcccggaagaggtgacattaaaagtgagactcttcccgagtgggagttggccacctgcattcaagcagcaaggggagactgaagggagggaggcctctgaggaggctgttggtctgtccaggtggggccagaaggttctggaccagccagtgcctctctttgataagcaggagatgggggaggtgggggtgttaaaatgtagattctgattcagtaggtctg

SEQ ID NO: 3424 - DNA, 601 bp, Human
cacctgtgttggggtggaggatggtttggtcctcatcctccacctccagccaatggacttgcctccccggggctctctgggtggcatttctgctccttctacatcccctccttgccaagtcagcccatagatcactgagtcctgatacttcctggacagaagtccattcccccactttcctgtgagctgctggagggcagaaggaaagagctggagagagctgataccacctcaagcaggggtcagggtcggggcagcagggggagggtgatcttggcccagctgggtagcgggaatgccrgcacacagccctgtgttcataaccggccagacactgggcctagggctttatagccattatttcccaaccctttaatcctcttggtagccaaatgggagaggtcttattataacccttacatcaagaaaggagctgaggctccgaggctgaagtcacagctagagattgctggccagaactgacaaccaaggctctgaattccagatccattcttggtctacccaccagctgcgtgtagcttggctggcatcagagcagactcccaggactcaactcccagctgtgcctcttgctagctgt

SEQ ID NO: 3425 - DNA, 601 bp, Human
ttaatcctcttggtagccaaatgggagaggtcttattataacccttacatcaagaaaggagctgaggctccgaggctgaagtcacagctagagattgctggccagaactgacaaccaaggctctgaattccagatccattcttggtctacccaccagctgcgtgtagcttggctggcatcagagcagactcccaggactcaactcccagctgtgcctcttgctagctgtgccctgttgggcaactcggaacctctctgagcctcagacacctcaattataaaatgggggtgataagcatayagtactttctcctagcattgctgtgaggctccagtgaattaatttttgtaaagcacttagaacagagcctcaaagacagtaagaactgtccgaaagtctgctgttgctatgagtatttagttcaggcattgagcccctttgcagtcctgggatacccacaggactcccttgctctgcctcctagctctctgtcatcttctctcagacacccagaagcagtgaacaggggtttggggagagggcacagaggccttagccatagatgacagcacagagaggaaatgaaatgtacaactgcac

SEQ ID NO: 3426 - DNA, 601 bp, Human
gtcctgggatacccacaggactcccttgctctgcctcctagctctctgtcatcttctctcagacacccagaagcagtgaacaggggtttggggagagggcacagaggccttagccatagatgacagcacagagaggaaatgaaatgtacaactgcacaggctgccgggcaagctcctgccaggccccgcaggcaacctgcacacgctttctcttcctgaggttggagtggggatccacgccatcctggaagggcaaagagtgaagcacaaagagagatccagggaccacaccccggccctyggtccatcagcccctccctcggccaaggccctctgtacccacattcacgggtctccccatggccgcaacacccagcctcactctcacatctgcttcctgctgccagatccagctcccatcctggcccaaacttccccatttgcagacagagaggggagaggagaaaatgaagacggggagaggagaaaatgaagacagggagagggttctctcccaggggaagcagactctgcccccagcaaagaggtctggatgatctcatctccctccccgttgctgtcactactagtcatctagccc

SEQ ID NO: 3427 - DNA, 601 bp, Human
aaaccctgtctctacaaaaaatgcaaaaattagacaggtgtggtggcgtgcacctgtaatcccagctacttgggaagctgaggcaggagaatcgcttgaacctgggaggcggaggttgcagtgagccgagatcacgccactgcactccagcctgggcgacagagcaagactctgtctcaaaaaaaaaaaaaaagaaaagggtcagtcattcatcctttatgatatatggatttatacctcttgcagaggaatttgagcttaatcaccttgcattatgaatgtattcaatcacctttatcgsaaagagttcaatgacataaaaaccaatacaaaactcagccaaatattataaatatcctttgcacagagagtccatatatatgaaaagagaatgtgaatacagcatctagcataaggcttagcataaggcagctgctcactgaatagcacagtctagaggtttagagccagactgccggctctgggccaggtaagaacctgtctgtgcctcagttccctccaaggcaaaatggggataataatgtacccacttcacagagttatcatgagggttaaatgaggtaatacttgtaagtgttag

SEQ ID NO: 3428 - DNA, 601 bp, Human
cgagggggatggatcgcttgagcccaggagtttgagaccagcctgggcaacatggtgaaaacctgtctctacaaaaaattcaaaaattagctgggcgtgatggtgcatgcctgtggtcccagctactcgggaggctgaggtgggaggatcgcctgagcccaggaggtcaatgctgcagtgagctgtgatggcaccactgtactccagcctggacaacagagtgagaccctgtcccagaaaagaaagaaaaaaaaagggggctacttggtgctcccctgctactctgcctctcacctctgcygttcatactctaccatctctccctacgcctttccgcccaccactttgccatgccctcgactctgttctctccccagttttcatgctgcccatccaggtccaggccccgccccctgaggactcagactctggctcggactcagactatgagcactatgacttcagcgcccagcctcctgtggccctgaccaccttctacagtgagtgcctggccgggctcccgagggcccacctacctgaatctgggagggggccccgaggggaccgtcaggtcagtagtcccacctagtaacccctgcat

SEQ ID NO: 3429 - DNA, 601 bp, Human
aggtcagtagtcccacctagtaacccctgcatgatgcagacagaatccccctggttacccactggattgactgtaaatggtcctacactgacgtttgcaccgtgctttgtgaccctggggtcatctcgatgtctcaggacatctccactctgacctctgtctctcccatgtttgtctctggccacgtaaggtcttaagaccaggcctttgacattcacctgaagatggctctctgtgtgagagcgggggagtgcggatgagagacacagttggcaggggttctcgcatgccatatccctcygtgtcccatcctgccctgtctgaccccatcagccccactcacttcctcacctccacgctcttgccagcttgtgcctcatagccagctcttttcattgccttctggggataggaagaggaaagataacgctgaaggcagttccctggcaatgctgggaggttggaatagaccagagcgtcccacaccttattgtggaatcacttgggagcttgtcaaaaattcctgagcccctccccacacctaatgttatcagtcaggatgagaatttggctgtgtgtgacagaaagctccaaatgacag

SEQ ID NO: 3430 - DNA, 601 bp, Human
gatgtctcaggacatctccactctgacctctgtctctcccatgtttgtctctggccacgtaaggtcttaagaccaggcctttgacattcacctgaagatggctctctgtgtgagagcgggggagtgcggatgagagacacagttggcaggggttctcgcatgccatatccctccgtgtcccatcctgccctgtctgaccccatcagccccactcacttcctcacctccacgctcttgccagcttgtgcctcatagccagctcttttcattgccttctggggataggaagaggaaagataaygctgaaggcagttccctggcaatgctgggaggttggaatagaccagagcgtcccacaccttattgtggaatcacttgggagcttgtcaaaaattcctgagcccctccccacacctaatgttatcagtcaggatgagaatttggctgtgtgtgacagaaagctccaaatgacagtgtcttgagaggttggcaggggcccaggccccttctttcttgctgctgtgcagtccctaagatgttgccttcatctacatggtccagaatggctcacctccatgtccacattccaggcaagggcaag

SEQ ID NO: 3431 - DNA, 601 bp, Human
cagtgtcttgagaggttggcaggggcccaggccccttctttcttgctgctgtgcagtccctaagatgttgccttcatctacatggtccagaatggctcacctccatgtccacattccaggcaagggcaagggaacgatgggatgctggagatggccacagattcccgctcacaacccagcacccagaacgaaaacccactagctgcaagagaggcagggaaacgaaggctctgtcctgggcagctgtgtccagataaaagccagaatggatattggggaacagacagccgtccctgccccrcctgctaacccagggcttctgggggtgggacacggatgattccacttcttctggcctgtggaccagtgtttgggcgccacagggatgaagtgtctgtcgaacctgagattccgagcccaggcatataagatgcaagactgagagtccacagtgctataacattgaaattaaaagtcagtggtacccggttcaaaagagctgactccaagatcccagacactcatatcctcaagactctataaatctctgattctgaaacgtgaaggtgccacagagcctgtgatgcagtgattccagacc

SEQ ID NO: 3432 - DNA, 601 bp, Human
ccagagctgccaggtcacaaggacagaaccaagactcttgatacctctctaagtagcaggagggacagctggggctgggggctggggggttgtagggcactagagtttctgtccccaggctagattaaggcgaaggctctgctggattgggatatgaacctggaatttgatgggaaatgctaagccctctctgcctccggagttgtcctcccaccctattcagcctacccaggccccgggaaatccagcctcttctccaggctcctaaatgatgaggttgagccttcacccctccccaccrccgcctctgcttgcagattcccagcggcatcgggtcacagatgaggaggtccagcaaagcaggttccagatgccacccttggaggaaggtgagtcaggatgggaaggggtgtgaatggcagtcccacctccagagagtagctcagctcagcttgagaccttccagcaggaacctccctcaatgagtctttcctgactttcacaaatcctataggcagtaagtgctttctgaagtctgacttaaagccctcttgctgcactgcttctttcgtcaccattctccctttcctgccttaggact

SEQ ID NO: 3433 - DNA, 601 bp, Human
gtttctgtccccaggctagattaaggcgaaggctctgctggattgggatatgaacctggaatttgatgggaaatgctaagccctctctgcctccggagttgtcctcccaccctattcagcctacccaggccccgggaaatccagcctcttctccaggctcctaaatgatgaggttgagccttcacccctccccaccaccgcctctgcttgcagattcccagcggcatcgggtcacagatgaggaggtccagcaaagcaggttccagatgccacccttggaggaaggtgagtcaggatgggraggggtgtgaatggcagtcccacctccagagagtagctcagctcagcttgagaccttccagcaggaacctccctcaatgagtctttcctgactttcacaaatcctataggcagtaagtgctttctgaagtctgacttaaagccctcttgctgcactgcttctttcgtcaccattctccctttcctgccttaggacttgaagagttgcatgcctcccacatcccaactgccaaccctggacactgcattacagacccgccatccctgggccctcagtatcacccgaggagcaacagtgagt

SEQ ID NO: 3434 - DNA, 601 bp, Human
gcagtcccacctccagagagtagctcagctcagcttgagaccttccagcaggaacctccctcaatgagtctttcctgactttcacaaatcctataggcagtaagtgctttctgaagtctgacttaaagccctcttgctgcactgcttctttcgtcaccattctccctttcctgccttaggacttgaagagttgcatgcctcccacatcccaactgccaaccctggacactgcattacagacccgccatccctgggccctcagtatcacccgaggagcaacagtgagtcgagcacctcttcrggggaggattactgcaatagtcccaaaagcaagctgcctccatggaacccccaggtgttttcttcagagaggagttccttcctggagcagcccccaaacttggagctggccggcacccagccagccttttcaggtaagctgtgcctcccccaaacccccatcccatagccagcctggctggaggaggcataaagctgggagccctgagtcaggctgaggtcaggattctacccagttccgcagccattcgctgtgtgcccttggacacatctcccatctctgggccttcactttgtcatt

SEQ ID NO: 3435 - DNA, 601 bp, Human
tgaagtctgacttaaagccctcttgctgcactgcttctttcgtcaccattctccctttcctgccttaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggcyggcacccagccagccttttcaggtaagctgtgcctcccccaaacccccatcccatagccagcctggctggaggaggcataaagctgggagccctgagtcaggctgaggtcaggattctacccagttccgcagccattcgctgtgtgcccttggacacatctcccatctctgggccttcactttgtcatttgccaagctagggacttggctctcgtgagtcacgtgggccccccagctctggcaacttgagaagtggctgtgtgctggcagagggtgactggttctgggggtttccagcag

SEQ ID NO: 3436 - DNA, 601 bp, Human
gtttggctgtccaggtgccaatatctggggaagggatgtgggagggggacagagagggactggggagtaaatgagtggggaactattggatgcattcgctcaaggggaaaaggagaaaggaagggtaaaagaagagagggaaagtaactttttaaaaaacaaagcaaggccaggcatggtagctcaagcctgtaatcccagcacaaggcaggaggattgcttgaggccaggaatttacgactagccccgggaacatagcaagaccagtctctacaaaactaaaaactaaatattagccaagggtagcacgtgcctatagtcccagctcctcaggaggctgaggtgggaggatcgtgtgagcccaggagatccaggctgcagtgagctatgatcgtatcactgtgtatcatgcccctgcagggtcagagcaagaccctctttctacaagaaaacaaacacaagcacaacaagaatatgaagaggtggggaaaatggatgtggacgggatggagaaatagtcaaacaggttgctttgataagaagtgagctccctgtcagtggaggcattcaagcagaagcagctggttggctccttggggga

SEQ ID NO: 3437 - DNA, 601 bp, Human
ttggctgtccaggtgccaatatctggggaagggatgtgggagggggacagagagggactggggagtaaatgagtggggaactattggatgcattcgctcaaggggaaaaggagaaaggaagggtaaaagaagagagggaaagtaactttttaaaaaacaaagcaaggccaggcatggtagctcaagcctgtaatcccagcacaaggcaggaggattgcttgaggccaggaatttacgactagccccgggaacatagcaagaccagtctctacaaaactaaaaactaaatattagccaaggttagcacgtgcctatagtcccagctcctcaggaggctgaggtgggaggatcgtgtgagcccaggagatccaggctgcagtgagctatgatcgtatcactgtgtatcatgcccctgcagggtcagagcaagaccctctttctacaagaaaacaaacacaagcacaacaagaatatgaagaggtggggaaaatggatgtggacgggatggagaaatagtcaaacaggttgctttgataagaagtgagctccctgtcagtggaggcattcaagcagaagcagctggttggctccttgggggaga

SEQ ID NO: 3438 - DNA, 601 bp, Human
gtccaaggtaaagcaggcttggtcctgtgtagtccctcctggggggagaggggtgacccagctgggcccctcagatgaagggctcaggttgagtggagagcctcgggccactgctcccatctgctgggagacagtctcagcccctggcagccacagtgatgagaggagcaaagaaggagtgtatgttgtgtgtatgtgtgcctgagggagggagagagagagacattgagaatgctcttgtgagcctatgtgtctaagcagtgaaagacatcataatttcacacgggggatgacacacacwtctgacatctaagactcccagcctctgagtgggaagggctttgctgatccaagtgtccatttgaacatgattttacttttgaagtattcccaatctaaaggttaaagtcatgaagtcgttccatgagcagacactgaagtcactcaagaacgctgaatgagcagttgtcataaacacgtcttgtgtgtattaagatcacacacgaatgctgcttgcacatatttaggtcagaccagcatgttagctgtcatgcatctacacccagagcatgcaggaaggtcttaactgcctgaaggttgg

SEQ ID NO: 3439 - DNA, 601 bp, Human
ttccatgagcagacactgaagtcactcaagaacgctgaatgagcagttgtcataaacacgtcttgtgtgtattaagatcacacacgaatgctgcttgcacatatttaggtcagaccagcatgttagctgtcatgcatctacacccagagcatgcaggaaggtcttaactgcctgaaggttggagattgattgtggatgcagtaggcacagctttaggccacgcagaaatgttttgtggacgtgcaatatcatgcctgagtgtggagcgcacatggtcaagatgtagaaaaggccgtgtgcycacgctaggtcctgacagcacatggaatttgtgtttacaaattcagggcctgtagaagttatgcacacatgacacaagaatgtcagggatatgctcaaatgcctcagtccctaaaagaatgctgtggggtggggcccagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactc

SEQ ID NO: 3440 - DNA, 601 bp, Human
ggttggggagagagcaactgaaggcaccaaactagttcagacaatgtggggactttgtggggaggaggacacccggacctgctgggggaaaggtggtgacttgggtggtagggctgcaggctggggaaaattgagccaagggttaaaaccccaagggtgccccttccctcggtgctctcagggccttgcagctgcaccctctcctctctcagcctgccccaaaatgggaagagcctcgccctcagacagtttcagcaaaaccagctgctaggtgtggctcaactgttgtagggtttacccygtgacacagagctccagccccagcagggttccttgctctgggccctgtgtgagctgaggcttaggagggtgatcccatggctaggtcctgtgaccaaggggtacgcccagcacgggacccaggaggccaatccctccagaggctgtggcctccccagggagaaaagacgaaggctgagtgggggtgtgaggaggggcgatagctgtgggcagatggaaggagtccacgttcagacacagacaccatgggagtgtctcttccttccttgaaatgtgaaggagctcattttgaccaatacga

SEQ ID NO: 3441 - DNA, 601 bp, Human
gctgggggaaaggtggtgacttgggtggtagggctgcaggctggggaaaattgagccaagggttaaaaccccaagggtgccccttccctcggtgctctcagggccttgcagctgcaccctctcctctctcagcctgccccaaaatgggaagagcctcgccctcagacagtttcagcaaaaccagctgctaggtgtggctcaactgttgtagggtttaccccgtgacacagagctccagccccagcagggttccttgctctgggccctgtgtgagctgaggcttaggagggtgatcccatgrctaggtcctgtgaccaaggggtacgcccagcacgggacccaggaggccaatccctccagaggctgtggcctccccagggagaaaagacgaaggctgagtgggggtgtgaggaggggcgatagctgtgggcagatggaaggagtccacgttcagacacagacaccatgggagtgtctcttccttccttgaaatgtgaaggagctcattttgaccaatacgaaggggttctacctcctcaggctggtttgaagcaacctcctttccccacctccaagactcccagggatctacaggtctcgg

SEQ ID NO: 3442 - DNA, 601 bp, Human
aggctgtgcggtcaggccgatctgagttctaatcctgggcctggggcttactggcggtgtgactctgggtcagttacttaagttttctggagccccagccactcacctgtgtaggaagcagtggagataatcgactcgcctcacagagttgctgtaggactcaagggagtgcaaaagctgtctgacaatggcatgtgctctctgaggacaaggctatggttgtttgccttttcttcctgcctcaacccacatgtgttgtgttacacacacgcttcactcacagccctgttccatttcatcwgctgagtggttgaaatttccccctgaggataaatatacatgccatttttgggacagaatcctttggtcccataatatttcaaggatggcccagatcacaccattggccagggagggttttgaggcagccttgcaaagtgatggaagcagggacttgggagactggtgggcctacagaaaatcctggatctgcccctgtaaactgggtggccttgagtaagtcacctaacatttctgagctctatgtcctcccccgtaagatggagatatggtaggacttcctaggattggtgtcaggata

SEQ ID NO: 3443 - DNA, 601 bp, Human
ctttgttgaaaaggctccagagacaaataggtgggtgggggaggagggctgggtgtggaacccagaagtcatggtctcactggaggcagcctgccggtggaactgccttcccacgcaggctgcctggaacacagtcaggggaactgctcctcagccaagcttcagggaaggggattgcgaaacccacttgcctctctgtttctctcccctatccatcctggacttctttccttcctcccaacaaatacctattgaaagttccatgaggatgagaagtcgcataggcactggggatccagayatgaagaagacagacaaggccctgcccttgtgagccttcctgtgagcttgccttgtgtgttttccatgatggtccccacgtggtaatctcaggacatccctgtgtaattagtacactaattccatcttactgatgagggagctgaggctcaaaatgatgatgtaacttgcacaaggtcacccagctaaaggggcagtgctaacacctgctcctaggactgtgactcagtgtctctcttttgctttctaggccatgggtttcttgcaggaggagctctgtcttctttccttctttccacac

SEQ ID NO: 3444 - DNA, 601 bp, Human
gggtttcttgcaggaggagctctgtcttctttccttctttccacacagttggctcatccccatgctcagtgaacgtttgttgaatgaatcaccatgtaagtgattgcatggcgttgttgccccatcctgttgactgactcattagtgtctctgttcctcttcctcaggtcttcaaggtcacaagggggccatgggcatgcctggtgcccctggcccgccgggaccacctgctgagaagggagccaagggggctatgggacgagatggagcaacaggtacgggtctttttcttctgaccctyaatcattttcctcctccttctctggcttcactctgaattccctttcccttccaggcccctcgggaccccaaggcccaccgggagtcaagggagaggcgggtgagtaggtgctgggtatgtacccagaaatacacagcaagtttctcagagtgactgctgtgggctgcagacgcagcctccctccagagtctggacctctgaggggtctgtaggtgaacggaggcctggtgggagaccccagaggggatgagaggctgggaagcaccctttctggtggccagagtagggctgggcagccgc

SEQ ID NO: 3445 - DNA, 601 bp, Human
tcgttgcttggaaagtattagtttccatttttttagactgttgcctaattctgcccagccatcttattaatataaatgggttcacggggcccggtcagagaatggggggcccagagctgtccctccccagggacaaacccaaacatcagttttccattccactctgctcccatccacccttaatttagaaactccaacttgcaaattccgcaaggggttgaggctgctgggatgtgaagatgcgaagacattaagacctttactagacaaagggcagatgagaggatttacaagggagtgkggagtaaacaaagcaggtctctaagccgccaggctgctgaggcagaaagaaaacaccaccagttacaagaaaggaaacttgttaggaggtagaatcctccagaaattgattttgggaaggaatttaatagaagggaccccaaagagcctattgatctgtgtccagcagggggttttctgaggagggtttaagcggggaggataggcagaccagaagaaggaaggtttatggtgcagtcagaggtgtgcacatgcattcacaccacacacactcacactcatgtctgagggcacatctgtg

SEQ ID NO: 3446 - DNA, 601 bp, Human
ccggtcagagaatggggggcccagagctgtccctccccagggacaaacccaaacatcagttttccattccactctgctcccatccacccttaatttagaaactccaacttgcaaattccgcaaggggttgaggctgctgggatgtgaagatgcgaagacattaagacctttactagacaaagggcagatgagaggatttacaagggagtggggagtaaacaaagcaggtctctaagccgccaggctgctgaggcagaaagaaaacaccaccagttacaagaaaggaaacttgttaggaggkagaatcctccagaaattgattttgggaaggaatttaatagaagggaccccaaagagcctattgatctgtgtccagcagggggttttctgaggagggtttaagcggggaggataggcagaccagaagaaggaaggtttatggtgcagtcagaggtgtgcacatgcattcacaccacacacactcacactcatgtctgagggcacatctgtgcacatacttgcattctcacactcactcacgcaccaatgtaatcacactcatgcacacacatgcactcacatacacacatatactcatgca

SEQ ID NO: 3447 - DNA, 601 bp, Human
cacatgcactcacatacacacatatactcatgcacatatatgcactcacatacacgcatatactcatgcacacccgtgtctgagcacacatctatgtacatatttgcattcttacacttgcacaagtacaatcacacttgtgcacatatgcatatgctcacacacatttgcagacattcgcaccccccatgcacacacactcacactcagcctgtgggggcttgagcagagcaggctcactcagaggggagtgggtctccctccatcctctttcctccgagagagagggactcaggctagktgactgaaactcaccagagtggagccactgaggctggcttgaagggaaaagccagaagcctgaggagcacagtcatttccttcaagaaggaatagagctggagcctccccttctctttaggactctgacaggtaggcacatcacacagccttgacagagggctcagagcaggactgtgcaaccactagcactaaaaccaggcaacccctttttcagcccaaatcatctggaacccacatacatgaaacagatccacaaagtaggctgttgtggttccatagagagtgtggagtccagagc

SEQ ID NO: 3448 - DNA, 601 bp, Human
gttctggacctttgggaagagagctgtcttagcctgttttgtgtcactactacagaatacctgagactgggtaatttacacagaatagaggtttacttagctcatgattctgcaggctgggaagttcaagattgggcagctatctctggcagcttctggtgagggccttgtgttgagtcaaaatgtggtggagaaatggaactagctctcttggtaactaatctagtctcacaagagcaggaactcactccatcttgccagatgggattaatctcttcataagagatctgtctttgtgacycaaacacctccccactaggacctgctgcattaaggaccaggcttccaatgcatgaacttttgagggacactttcatgccatagcaagagcaaacactgcctggaactgccagggactctgctggttgtgtttgtgcaatcatatgtgtgtgattgtgtgtgtgcatgtgtgtgaaaaagagagagagagagagagtgagagtgagagagagagaaagatctccttctgggaaccttgctcaactaagggaatctagaatgtcagctgattaaagacattttagacattctcaggccacag

SEQ ID NO: 3449 - DNA, 601 bp, Human
cttgctcaactaagggaatctagaatgtcagctgattaaagacattttagacattctcaggccacagcaactgagctcttttttccttcctcacaggcctccaaggaccccagggtgctccagggaagcaaggagccactggtaacttgtacttgctctgctagggacaaatgatgcatagcctgaggcactgaggcagttcccccccaccccccatcctctttccacagccccaccccagcccctgacagttactgcccaccctacagtcctcttctcttgagtcctgtcacatttcttyaagaccacccaagaaatgagctagcacatcccccagaggaaatctggggatcccattcccttctctcccaaatgcttcctgcccctttgcctctggtagcctgtccccaaaaggatagtgggagcccatctcaccagccattctctttgcaggcaccccaggaccccaaggagagaagggcagcaaaggcgatgggggtctcattggcccaaaaggggaaactggaactaagggagagaaaggagacctgggtctcccaggtgagggccgtattgggggtgtcggtgcttgccaggaggc

SEQ ID NO: 3450 - DNA, 601 bp, Human
gagagaaaggagacctgggtctcccaggtgagggccgtattgggggtgtcggtgcttgccaggaggcctgagggaactagggcctgacctctgtgccattgggtctattcagtgcccactgagggcaaggcagtgctctgtctatgggaatctctggagcaccacacatagtctcttctttccgggtgagcaaagagatgcaatatgagagggagaacaatgtcattccaggcatgactatggcaagctggggcacaggcagtgctaggagctcagagaggaagccaaggggatgaggagrgtgggcctgcactgggccttgggaagcagggcagactgactggtggcaagggcaaggggattgattcaaggagggagaccccaggcagccagaatcccccattgactgagggtgctatctctagaacagtgttcctcaagccaagggccaatatcataagagctgtttgggtgcttgcttaaaatgcagggagggctcgagggtctgtttcaaatgccctggatggttctgaccatgaaggtctgtgcaccacactcgaagaaacactggcttatgggctctggacttgactgagcatgc

SEQ ID NO: 3451 - DNA, 601 bp, Human
tgaaggtctgtgcaccacactcgaagaaacactggcttatgggctctggacttgactgagcatgccacgctctccgcctctcagcctcctgcagtcattggggaggctctgcagtgaatggcagagagtgaggattgcggggccaggcgggcttggttcccatccctgctctgcacctgctcccctgtgtgactaacgcaatacttcacccttctgagctttaatgttctcattttagaaaagaatggtaattaagttaaaaaataattaaattagatatattttacaagacagtaataakggttagagaccatgttttcaagctgtctgcaacatgataggcattaaatacatgacaactagtaataggcattaaatatgtgatagctagtaatagtaatagtattagtaataataatagtagtagtagttatcctgtaacgtagaaagggaaggacttcagtttcaagatcagacagacctgggttctgatatggctcactaactgtgtgaccttgggcaaatgaattaacctctcttagcctcaatttactctcctagaaaagggagctaataataatacaaacctttaatgaggatg

SEQ ID NO: 3452 - DNA, 601 bp, Human
acctggcacatgggaattccttacaaaaaaactgggaagccttgccctcaagaagacagcccttagtagggatgtgtcagccatcctcaaatattcaaagggcatttgtgggaaagaaaatggtcttgcccagggtggtacccagcagaagaacaaggaccaatggactaaggtttcaggaggaccaattgtgctaaggcaagggaggaagaatgattcagaacctggggctgacccatgatgaagtgcgtgggcatgggttttagcgggaagctgactgctgggaggggaggaggggctrcagaattctcctaggctggtctgatgagggatactggcaccaggaacatggttgggtggttgacctctgaggatccttccaaagctggaacaacacagttctctttatagatgggaaagggagacccagactttctcaaggtggtcctgccagccccagagaaggggcctcagccaggtctttgcccactgagtctgagttatgcagcttcccaaccacactgtcacaaaggcacgcatagaatccacacccagactcaggcttggaaacgctgtggttggcgaagggaaaggcagcagt

SEQ ID NO: 3453 - DNA, 601 bp, Human
cctgccagccccagagaaggggcctcagccaggtctttgcccactgagtctgagttatgcagcttcccaaccacactgtcacaaaggcacgcatagaatccacacccagactcaggcttggaaacgctgtggttggcgaagggaaaggcagcagtttgagttcttcaaaaatcaggactcaggcccacccctcctcttcccaaatttcctctcccaagatcatgaggtctctcttacccatggcttgctcaatccactgctggtggctgggctgtgcaaaccaagagagacctgaccccartagtgctgagattttacctattctcttcctgctagtagacagataagccaccaacttaaagtcccaggggataagcctattttcctcactctactacttagctacagttgggaagttctgaagtcaggcagctgtgcttccttggctagagccagagtgtggtcctctgactgatgtgatactgccctcttcccaaagccattccctttgctggggagtggaagttatagcaacacagatgcaggtccagaccattctgaagaaacttcatgtggcccagcaatgctgtaacttgatggt

SEQ ID NO: 3454 - DNA, 601 bp, Human
ccttaggattgctttgtcttcctcaaggagcagccacccttcaagtattcagccatctcaaggggtctgattcatgagcctcatacctcgtgaattcacagcactcaatgctaagacccagggctctcccttcttcctcacctcttcagagctctctctccccttttctaattcactggagagaaagctggtgtcatgcctgagtcctccccagcttcagaattatcaaaatcatagattggagcaataaatgccttttagcaaaattgcatcccaataagcctttttgaaagcctaaaakgttgtgttgaggtgagatattcctctttagacctttgccccactctacccacccccaggggagtggagttgagcacggacacccagctgatggtgggaccttggcagcctaccagtagtaccctgcattgcatggctggcaaggtccaggcagtccacccctaaaccaaagaagtcacagagccctaccccagtgaggagcctctgtcaattgatatgcaccaggcaccagcaagagaggagggagcgacagaggactcagaaggggacaggctaggatgagctctgaattctgatgata

SEQ ID NO: 3455 - DNA, 601 bp, Human
ctgcattgcatggctggcaaggtccaggcagtccacccctaaaccaaagaagtcacagagccctaccccagtgaggagcctctgtcaattgatatgcaccaggcaccagcaagagaggagggagcgacagaggactcagaaggggacaggctaggatgagctctgaattctgatgataagtggaaaatttgaaatcttgggtaccaggaaagcccatgtctgaagtgctggcaggaatatgagctgctgcagtgtttttctctctattgatgcctcagagttgctattctcagcatttgggatctgcttttcggaatactcaggtttcaatttttgaagtgaattcaaataattgccaaaatgcagacactaaaacaagccagacagtgctggctgagccttggctattgtccctcccaaggggaccagggctttctgttgactgtcagccataccagatcacctcaccaaattttcatgagtttctttcttgtctctggggcaaagcggtgcactccttgagggcagcggtcatatcttccactcgcgggcaccaagtaggagctcaaggagtttagggtttgggatttcagtggaatgg

SEQ ID NO: 3456 - DNA, 601 bp, Human
accagatcacctcaccaaattttcatgagtttctttcttgtctctggggcaaagcggtgcactccttgagggcagcggtcatatcttccactcgcgggcaccaagtaggagctcaaggagtttagggtttgggatttcagtggaatgggaagtgtcagaggaggacatggtggcctgattggagttcctcccacaactaaccaagactttttggtttttcaggaagcaaaggggacaggggcatgaaaggagatgcaggggtcatggggcctcctggagcccaggggagtaaaggtgactycgggaggccaggcccaccaggtaagagggcacgtggtcacatccactgacctctaggtatttccttttttttttttttctggctggctgagccaaaggaaaaaaaaattcctaaaagttctttttcatcttaggtttggctggttttcctggagctaaaggagatcaaggtaagaactacaggaatctgggcatcatcccagctacgactgtccctggcagagtgaagctggggaccagacaccaccatcttttgcttcattgtagtattcacccagaacacctggggttttttagacat

SEQ ID NO: 3457 - DNA, 601 bp, Human
gtttagggtttgggatttcagtggaatgggaagtgtcagaggaggacatggtggcctgattggagttcctcccacaactaaccaagactttttggtttttcaggaagcaaaggggacaggggcatgaaaggagatgcaggggtcatggggcctcctggagcccaggggagtaaaggtgacttcgggaggccaggcccaccaggtaagagggcacgtggtcacatccactgacctctaggtatttccttttttttttttttctggctggctgagccaaaggaaaaaaaaattcctaaaagtyctttttcatcttaggtttggctggttttcctggagctaaaggagatcaaggtaagaactacaggaatctgggcatcatcccagctacgactgtccctggcagagtgaagctggggaccagacaccaccatcttttgcttcattgtagtattcacccagaacacctggggttttttagacatctggccctggccaagaggaacagagcagccagtgggcggtgggggcaggcctcactgatgtttctctctagactttaccccactttgccacccagggggtggagttggacagtcacacc

SEQ ID NO: 3458 - DNA, 601 bp, Human
ttataccataatgccaacagagtctaggttagtctaggttatataccatcatgtctatttagtctaggtcgtaaaccattgtaccaatatagtctactttataagccgttttggtccagtcacagtgtgcttgcttggtctagaaagtccagaccactatcacaatgcataagatcaattcctgcctttctgccctgacatgcagggtattgcagtgaacagagactgttgccagatgatgtgggcacactctgattgggcatttctgtggagaactgttgcacattggaaagccaagagygggcaggaggggcaatggggaaggcagggttgtgatgtaaagctgcatgtctgccaaggacatctgtagacagtctgcctccacccctgtcctctgcctgagaaggtcacgcttgtgtcagacaacctggatgccctcacccccgtgctgtgctagagacctacactgggacctggccctccacagctctaatcaattgattgattcattcatcaccacctcctggcaaaccttgggctctgggcttgagcttttgtgtttctttgaaagctgtcgggagccatggcaagcgcagtttta

SEQ ID NO: 3459 - DNA, 601 bp, Human
gggttgtgatgtaaagctgcatgtctgccaaggacatctgtagacagtctgcctccacccctgtcctctgcctgagaaggtcacgcttgtgtcagacaacctggatgccctcacccccgtgctgtgctagagacctacactgggacctggccctccacagctctaatcaattgattgattcattcatcaccacctcctggcaaaccttgggctctgggcttgagcttttgtgtttctttgaaagctgtcgggagccatggcaagcgcagttttacaccctctctgtccttgtaatctgtcsagccccagagcaattgtgttttttatggacagtgtgtttgggaggatccctgctacctgatcccatgtggatgccacctgaaggccactagctgggtctcaccataggaaagtttccatctgggtatagtcgtcagatgttcctgacttgttcactgtccattctgatcttataattccatcttctctggtccccagtctcagagtccatctgactatgagacctgatgctctcttgcccctgagccttctgtgtgatttcatggagatgattgctttcatctctcggttgtaaatagta

SEQ ID NO: 3460 - DNA, 601 bp, Human
tttgggaggatccctgctacctgatcccatgtggatgccacctgaaggccactagctgggtctcaccataggaaagtttccatctgggtatagtcgtcagatgttcctgacttgttcactgtccattctgatcttataattccatcttctctggtccccagtctcagagtccatctgactatgagacctgatgctctcttgcccctgagccttctgtgtgatttcatggagatgattgctttcatctctcggttgtaaatagtagtcaccctctgcccccacccccactgccagactaacrgttctcaactaaccaagagtattggaggtaaaacatgattttacccacaggagcattgtgcttactccccaagccccaagcttgtgtcttccacagtctgagggtagggaatcctgccctgccctttgcatcctgggaggatttgcagaacaaaagcagctcctgctaatgagcatcttcttgacacccagtgggacaagcactctttgtagcacaactttacggtcaaacagccattaagagatgcagccaggttcaaatctaggccagtacaagacaaagcttgggatcttattagta

SEQ ID NO: 3461 - DNA, 601 bp, Human
caggccctatcatggttcttagttatttaaccaggaccccacacccattttagcaaaagacttttggcccatagcttggggatcattttaatttcatcctcatcgagaccttttatatctgctgaatacccttatggagttctccaataattaggcctagtggtgagtaccagccagcaaattctaggggttacccttaattctggctgaccaagtaaacatgaggaagtgcatttcaatttggggcttgtgataattcccgtttatctaaaactgtgcaggttgcccacccgagtccaaatgttttccttgatttagtagctgacagtccacatggacatctcagaggggaattccaataggaccataatctggctaatttagctgggtatgtagatcatcctggagtcataggctaataaacttccggagagattagatttgacaacttctgaagtgggagaagcaggggcaggcagagggtgggagcccaatctccccatcatggagcacagtgtatacttgtcaatgtcaggatgtcggtattccccaaactaaagccactgcagtgcttggccagtgttgatatatcaagccaggt

SEQ ID NO: 3462 - DNA, 601 bp, Human
ttagatttgacaacttctgaagtgggagaagcaggggcaggcagagggtgggagcccaatctccccatcatggagcacagtgtatacttgtcaatgtcaggatgtcggtattccccaaactaaagccactgcagtgcttggccagtgttgatatatcaagccaggtttccaaactgatgtatttcccattttgtaaataaaatcgttaatctctcaagagaatatctagccactttagatgaaaacagaaaaattacagtgcgttggcttgacctaggtgacagctaggtttcattactgygcattaattattttaaaaacatgagcggtctgttcattattatcagtgcctctgggccaggcactgtgcctgggtcttgactcccatgatcacactgaacttatcattcctactttacaaacaaggaagcaaaggctcagagagagtaaaccctttgctcacagtgtcacagggagcatgaactgaattcagaagtgaatcccaaagtctgattccagagttgtgcttttccagaatcggttttatggaagaacgtagagtgtatgatttgagagaaatcggttaccttcaccctgtccc

SEQ ID NO: 3463 - DNA, 601 bp, Human
gaagcaggggcaggcagagggtgggagcccaatctccccatcatggagcacagtgtatacttgtcaatgtcaggatgtcggtattccccaaactaaagccactgcagtgcttggccagtgttgatatatcaagccaggtttccaaactgatgtatttcccattttgtaaataaaatcgttaatctctcaagagaatatctagccactttagatgaaaacagaaaaattacagtgcgttggcttgacctaggtgacagctaggtttcattactgtgcattaattattttaaaaacatgagckgtctgttcattattatcagtgcctctgggccaggcactgtgcctgggtcttgactcccatgatcacactgaacttatcattcctactttacaaacaaggaagcaaaggctcagagagagtaaaccctttgctcacagtgtcacagggagcatgaactgaattcagaagtgaatcccaaagtctgattccagagttgtgcttttccagaatcggttttatggaagaacgtagagtgtatgatttgagagaaatcggttaccttcaccctgtccccaccccagccacacctcccactcctcc

SEQ ID NO: 3464 - DNA, 601 bp, Human
gctgggcatagtggcatgtacctgtagtctcagctactcaggtggctgaaggaggaggagaaggatcacttgagccaaagaatttgagcctgcagtgagctatgattgcaccactgcactccagcctgagcaacagagtgagaccctgtcaaaaagaagaaagaaagaaagagagagagaggaaggaaggaagggagggagggagggagggaaggaaagaagaaagaaagaaagaaagaaagaaagaaagaaagaaagaaagaaagaaagaaagaaagaaagaaagaaagaaagaaagaargaaggaaaggaaggaaggaaagaaagaaagaaagaaagaaagaaagaaagaaaagaaagaaagaaagagaaagaaagagaaagaaagaagaaagaaagaaaagaaagagtgtgagagaaaagaaaagaaagggaaagaaagaaagttttcttaatgtattggagatttctccatttcactcagaatcaggagatctgagcctcagcttgaacttacccctgactagctgagtgaccacaggctcagctacttgacgttgctgagcctgtttccttttctgtggcgtgcaagcagtataga

SEQ ID NO: 3465 - DNA, 601 bp, Human
tgctctccagcgtagttttacaacatgcagctctagaacctattttttagccatttctccctctactctgcaggagctgatcctatcaggatgctgccttgatttatagtgaagtaattactagttcctccatcgattagtccatggacaaccactcagccagtgttctcttagagtccagcgaggcttggagagaaatgatacaaacctcaattctaatttccaatacccattaaatacatatcagaaggcatttcatcaaggtccaacctctgctataggaactgtgggtctgggaggrttcagatgcgagaggggctgtgagctcctaaagagacaaggaaggctgctcgtaggaggtgggctgtaagctggtcgctcaagaatgagtgagagttgtttagggcagtgttactcaaaatgtggtcctgagacttgcagcattagcatcacctgggaacttgttagtactgtggattcttggattcccactccagtcccactaaatcagtgactccggtgggacctagcaagttgtttactaacaagatgcacccagatgattctgatgtattctctagtttgactactcctcttttag

SEQ ID NO: 3466 - DNA, 601 bp, Human
gagcctagtactagtggaacaaaggtgccttcagggaacattgggaggctgggcctgggtgacagccccaacttcccccattcactcttatgtgaccttgaattactcacctagcatctctgagtgtgtactttctcctctgtaaaggagggaaatcacactgccttggagggtggctgaaagatcaaacaaggtcatggatgtaaagcccctggcacagtgcctggcgtgatgcaggcagcagaaaatgctgagtcccctggaggtgaggagctaggaagggagagtgtgggaaatgaaragggagagtcaggcttggggctatggacctggtgaacaggggcttccctatgattcctgtctttagagggtgtttgctgctcggtgctttaggggacagttggaggggtgcatctctttaggtggtcacaataaagggtggtcacagtgttttgaggccccttctacttacctgcatgtgaacagcgtatgtcaagactggtggggagaaagaccacaatctatatgtctatgatggtgatgaagcaggaaacagtccacatccagactcttggccccttctatctgcatcccagagggt

SEQ ID NO: 3467 - DNA, 601 bp, Human
aacagcagggaatgggattggatttagatgccaggtcaggttaccggggggcagggaaggccagtggtgcatctggggtctgtctaatccaggctttcatccagtactttgccgtttcacccccaacacacctgttctcattcatctgcagactgtctcttttcatgatctgctgaagaggctttaaacaatcgtggagaaccaatgtatctttccatctgcattaatcagacaaaaggtagaggttgtctaagattaaaaatgtctaatacctaagttttattatctcctccccccccccttttttgttttgatcttaggacttcaaggacagcaaggaagaaaaggagaatcaggagttccaggtaaagggcaggctgcatcttcatccctcggagtgatgacggggaaggcctgccttctcagagggcaggtcttgttgacattgaatgcacagctgtgaccttctcccaaagtggaggttaagactccagggctctgtcactcaagcctcagatttctccgctgcaaaacctgggaaccacaggaactcaacatcctgaggggtgtagcgtatggggcaggggctgaggatggcaaa

SEQ ID NO: 3468 - DNA, 601 bp, Human
gcagaggctccaggctctacagccgccatggagctgtgccccttctgctccatccacggctgctgcttccccacctcagctgtggcccacttgtctcttcttggcccccaagcttctcctctctgcctcctgctgcctgtcactgggctttcttattcttatcctcacctccagagcctgtgcttcagttgggtactgagctggcaccagctggacggtgtttctaggcctctcaagagccctgcccctgtgagtgcaaaagtgagatttttcagacacatttcttgagcaagttttcttyctcataagctagatattctattatgttttatggttttttttttttttcaatttttttagagacaaattctctgtgtcacccaggcccgaatgcagtggtgccaggacaggatagctcactgtagccttggcctcccgggatcaagtgatcctcccaccttcgtctcccaaagcttgggattacaggagtaagccactgtactcggcctctgttactatttcaattcactaaaggagacatcgaggcttagaaacattctagcaaattctcccagcatggctagaacttccacataactat

SEQ ID NO: 3469 - DNA, 601 bp, Human
caaatgcccactttagagcagggcgatggcttgattacagaggcatgtgaggcaggtggacgcagcaggagtgaatttgcagggaggaaactaaaggacacccgcctaggaagatatttcaaatagtgtggggtttaagcattaaagatttgcatgagacttttgtcaaagggtagagaatagaacggaggcaaagtcattataaaaacaacaacaacaacaacaacaacaaaaacaggctaagccagccatcagcacattgggccggaatgggccagaatgagtgagaagtcggcagtcyacctcagatggaagctcccaggcgcacacgtggcttctttgctttgactctaatcctacccttcttcctctgtctcttgctttctctctatcaaggcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctct

SEQ ID NO: 3470 - DNA, 601 bp, Human
gcgacactgcagggtcaggctgcctccgcgggccacgacagagccctgcgggatcaggagggagggcttcctagacacgcctggagggaaagaggaattgggacttggaaggctggttcctcccccgccccttccttctcccgtcctggcgtcctggccctgcaggtctcactgtctctcacgctctgtgtctcggatcccggggcctccttctcacctgggtctgtcttggagtagttccagaccgatagtgtctctctgactcctggccactgtctgtctggtctgtcctctcctcatygagggacaggaaattgcagcaaatacacccattgccttcctgagtcgaccccttccaggtgagggtgactcaggctcctgtttccccatctgagcctccccgtggggtcttcctcacgccttcagcccatccatcaacacatccttctggggtccttgccatgatcagtcatcaaccaaactcccaacaacctatctggttccccaaaattatataaagaagtgtggtggctttttcacctgggaccagaatctccaggaggtcactggggttcgaccacacctgagggtttttcctgta

SEQ ID NO: 3471 - DNA, 601 bp, Human
tgggagagcccagcctggggctgctggccagagccctggacgaggtcatgttccccctccttgtacagaacgaatatgtcatagccgacatcagagcgacactgcagggtcaggctgcctccgcgggccacgacagagccctgcgggatcaggagggagggcttcctagacacgcctggagggaaagaggaattgggacttggaaggctggttcctcccccgccccttccttctcccgtcctggcgtcctggccctgcaggtctcactgtctctcacgctctgtgtctcggatcccggggyctccttctcacctgggtctgtcttggagtagttccagaccgatagtgtctctctgactcctggccactgtctgtctggtctgtcctctcctcattgagggacaggaaattgcagcaaatacacccattgccttcctgagtcgaccccttccaggtgagggtgactcaggctcctgtttccccatctgagcctccccgtggggtcttcctcacgccttcagcccatccatcaacacatccttctggggtccttgccatgatcagtcatcaaccaaactcccaacaacctatctggttcccc

SEQ ID NO: 3472 - DNA, 601 bp, Human
cgcctcatcccggccatcactaattggattcccccggcaggacctgtgcagagcctgggtccctgactgaacccgctgggctcctcacctgcgatcaggatgtccagggggtcgctgggggccgaccacctaggggagaggttgtgtgcaccgtagcatctgtactggcccccgtgggagcggctcacagggcccagggtgaagttggcctgggagagcccagcctggggctgctggccagagccctggacgaggtcatgttccccctccttgtacagaacgaatatgtcatagccgacaycagagcgacactgcagggtcaggctgcctccgcgggccacgacagagccctgcgggatcaggagggagggcttcctagacacgcctggagggaaagaggaattgggacttggaaggctggttcctcccccgccccttccttctcccgtcctggcgtcctggccctgcaggtctcactgtctctcacgctctgtgtctcggatcccggggcctccttctcacctgggtctgtcttggagtagttccagaccgatagtgtctctctgactcctggccactgtctgtctggtctgtcctctcc

SEQ ID NO: 3473 - DNA, 601 bp, Human
tgccatgactgacacagcagggtcacgttctctcctgaggccaccttggggcccggctgcaccgagagggcgggtatgtcagggatcagtcctggagagaagaaggatgggtgaggggctgccccaccttgctctgagctgagacctccccaggcctctctaggagcctctgtctctgttttctctgagtcttcccctccccacccatcccctgtctctgtctgtctctccctcccttgggaccacccccccgcctcatcccggccatcactaattggattcccccggcaggacctgtgcrgagcctgggtccctgactgaacccgctgggctcctcacctgcgatcaggatgtccagggggtcgctgggggccgaccacctaggggagaggttgtgtgcaccgtagcatctgtactggcccccgtgggagcggctcacagggcccagggtgaagttggcctgggagagcccagcctggggctgctggccagagccctggacgaggtcatgttccccctccttgtacagaacgaatatgtcatagccgacatcagagcgacactgcagggtcaggctgcctccgcgggccacgacagagcc

SEQ ID NO: 3474 - DNA, 601 bp, Human
ctatctgatgccatgactgacacagcagggtcacgttctctcctgaggccaccttggggcccggctgcaccgagagggcgggtatgtcagggatcagtcctggagagaagaaggatgggtgaggggctgccccaccttgctctgagctgagacctccccaggcctctctaggagcctctgtctctgttttctctgagtcttcccctccccacccatcccctgtctctgtctgtctctccctcccttgggaccacccccccgcctcatcccggccatcactaattggattcccccggcaggrcctgtgcagagcctgggtccctgactgaacccgctgggctcctcacctgcgatcaggatgtccagggggtcgctgggggccgaccacctaggggagaggttgtgtgcaccgtagcatctgtactggcccccgtgggagcggctcacagggcccagggtgaagttggcctgggagagcccagcctggggctgctggccagagccctggacgaggtcatgttccccctccttgtacagaacgaatatgtcatagccgacatcagagcgacactgcagggtcaggctgcctccgcgggccacg

SEQ ID NO: 3475 - DNA, 601 bp, Human
tgggcccacggtgggatgcggcagagctgggaagtgaacccaggagtctgacccgcagcccttgttctctgcacctgagcggagccccggagctgcagggaaagagcctgaatgccccaaaccacggccctgctcccctcccctgccccaggtcaccgtcactgctgccggtgggacaggacagtcccctgaagaatcccatcaatgcaggcctctctcctttacacttggagaaactgaggcccaggcaggggaagggcttgtgcacttcaccatctccagaggagcctgaacctacgayagaacccacccctgcctcccctggtctccgcccacctcccactcagagcccctcactcaccactctggggatccaaccccgtgggggtgaggggctggtcctcagggcctgctgggtcaggacggggaggtgagggctggggctgccctgctccccacatcagcccggctgctcctcccccaggctgggccccaacacccaacatctctctctgcctcgacgcccgccccctcaccggcccagcctcagagccccggggagcctgtggcccctcctctggctctgcccagctccctggag

SEQ ID NO: 3476 - DNA, 601 bp, Human
caggccctggtccttgggctctggccccgcagcccctgcaggacggtagaaatgggctggacagagatggacagagggtcaggcctgggagaattcgaaccagctgccctgcacacacaactcgagcggaaagaaggaaacctggaggcccactggcactgaggctttaaatacgtcgtaagtttaaagtaaaatcagaagaatcaagcacttccacacatgctcacatttattctcttctttctcgatcgatttttcacctgggaatttctggagcagtttttctaagctgactttcctytgtgtttggtttccctctggctggtgccccgagcccaccctcggtcggcccacgggttcccccattccctactcacccgatgtcctgtgtttgctctgatgccgatgtcggaggaggaggaagaggaggaggaacagcagcaggacgaaggccactgagaccccagtcacaacccccaggtgccttcccagaccttgagcgtgatgacgttgggaatggggatgacgtcattgatgtgagcaccttctgtgtgcaggcgcgagctaggtctttccttcatgagctccaaccctcacagca

SEQ ID NO: 3477 - DNA, 601 bp, Human
ccgggaggaggcccacgaggtcccaggacagcagaagagagtgaggtcgcagcaggcgggaggcagcgtgctggacaaggaggggtccaccgtgacgatgctgagagccgggggaaggaggacagagaagtcctgctggattagatctggcaccaggaggcctttggtgcccgggacaggggcggggcctcacccgagcatccatctccaccccgtccttgggctgtgtgtccttcacggcagcatctgctgggccagagcaaggggttcatctcctgggaaggttctctgagacttctcmgtcctgccagcccttgccctgttcccactagggtggctgagatccagggagggactgtgatgtccctgaggtcccacagtgtgggttcagaccacctcccccttggccccagacccctcccagcctgtgctcctgcccccattgctacagaaactttggtgctcccttgcccaccccaggtgccctccgcttctagtcactcactgagaatttcctcctggatgtcagcaactgggctggccctgggggaggacacgggagtgtgaggggcagtgagggggctgtgcgggtggatgggag

SEQ ID NO: 3478 - DNA, 601 bp, Human
tgggggaccggggtggttcatttattcctcatcctcctgaggcctggggagagctctaacaaccagacggccaaacagaggatgaggagcaggaaggggacccgggaggaggcccacgaggtcccaggacagcagaagagagtgaggtcgcagcaggcgggaggcagcgtgctggacaaggaggggtccaccgtgacgatgctgagagccgggggaaggaggacagagaagtcctgctggattagatctggcaccaggaggcctttggtgcccgggacaggggcggggcctcacccgagcrtccatctccaccccgtccttgggctgtgtgtccttcacggcagcatctgctgggccagagcaaggggttcatctcctgggaaggttctctgagacttctccgtcctgccagcccttgccctgttcccactagggtggctgagatccagggagggactgtgatgtccctgaggtcccacagtgtgggttcagaccacctcccccttggccccagacccctcccagcctgtgctcctgcccccattgctacagaaactttggtgctcccttgcccaccccaggtgccctccgcttctagtca

SEQ ID NO: 3479 - DNA, 601 bp, Human
ctgggggaccggggtggttcatttattcctcatcctcctgaggcctggggagagctctaacaaccagacggccaaacagaggatgaggagcaggaaggggacccgggaggaggcccacgaggtcccaggacagcagaagagagtgaggtcgcagcaggcgggaggcagcgtgctggacaaggaggggtccaccgtgacgatgctgagagccgggggaaggaggacagagaagtcctgctggattagatctggcaccaggaggcctttggtgcccgggacaggggcggggcctcacccgagyatccatctccaccccgtccttgggctgtgtgtccttcacggcagcatctgctgggccagagcaaggggttcatctcctgggaaggttctctgagacttctccgtcctgccagcccttgccctgttcccactagggtggctgagatccagggagggactgtgatgtccctgaggtcccacagtgtgggttcagaccacctcccccttggccccagacccctcccagcctgtgctcctgcccccattgctacagaaactttggtgctcccttgcccaccccaggtgccctccgcttctagtc

SEQ ID NO: 3480 - DNA, 601 bp, Human
tgaaggggagcctgggggaccggggtggttcatttattcctcatcctcctgaggcctggggagagctctaacaaccagacggccaaacagaggatgaggagcaggaaggggacccgggaggaggcccacgaggtcccaggacagcagaagagagtgaggtcgcagcaggcgggaggcagcgtgctggacaaggaggggtccaccgtgacgatgctgagagccgggggaaggaggacagagaagtcctgctggattagatctggcaccaggaggcctttggtgcccgggacaggggcggggyctcacccgagcatccatctccaccccgtccttgggctgtgtgtccttcacggcagcatctgctgggccagagcaaggggttcatctcctgggaaggttctctgagacttctccgtcctgccagcccttgccctgttcccactagggtggctgagatccagggagggactgtgatgtccctgaggtcccacagtgtgggttcagaccacctcccccttggccccagacccctcccagcctgtgctcctgcccccattgctacagaaactttggtgctcccttgcccaccccaggtgccctc

SEQ ID NO: 3481 - DNA, 601 bp, Human
taggggtccaggctggctggggttcattggtgtccactgggggcagctcctgtgccttctggagtctctgagtctccttctgttgagtatgagatctgggtcccccgtgggctagtggatggccaggggggcgtagatgctgggttcagctggaggttccctttcctgggatggaggaggctcagttgcctcccgtctgagggtcaagctgtgcagctgggcgtaggtcacatcctggggggcttcagatgcagcagcctgcagcgggggagagtgagagggaaggaacgtggtgggggtgggggaggcctgggggcctggagaggaaaggactctctcagtgtccatctgtctgtcctcttctgcctgtctgtcctttgtgtccaggaattccccagacagtggggagggaggagaggccatttctctcctaggtctggagtgtttcacctcggcatacgtcactgcctgggggtcttcatcgtgtgggctctgctggagagagacagtggtggggggtgtccttgagtccccctgacctcctggagtcaattttcctcactgttcccggggtgatccgattacatccctttcctgatgg

SEQ ID NO: 3482 - DNA, 601 bp, Human
aattacgtaggttttattcttttctaattcattcgctcatttgtagttttccgatttcatcatttaatgtgtaatatttacattatcattccaaatttataccatgctctaatttctgtttcagttttctcagctcattgatttattgagaagtctgtggcttcatttcaaaaatgcaaggatattagtcatctttgactgcagaatctagtgagtcccagagttcccaggatgtcctggtggtctttgttaggggtccaggctggctggggttcattggtgtccactgggggcagctccygtgccttctggagtctctgagtctccttctgttgagtatgagatctgggtcccccgtgggctagtggatggccaggggggcgtagatgctgggttcagctggaggttccctttcctgggatggaggaggctcagttgcctcccgtctgagggtcaagctgtgcagctgggcgtaggtcacatcctggggggcttcagatgcagcagcctgcagcgggggagagtgagagggaaggaacgtggtgggggtgggggaggcctgggggcctggagaggaaaggactctctcagtgtccatctg

SEQ ID NO: 3483 - DNA, 601 bp, Human
ccgggttcacacaggggacactgagcagcagctggacgtagacagagctaatggagtcttcccaggtggtccctcctttcagaaaggcccctctgtctgagctccttaactctgaaaccagataagaaggtgggagacaggggccccttttctcatgggattaaatgaactcaattgacagagctctggaaaacttcattgtcgcgtaacatagtgagaccagctttggcagtggtgcgttctttctctcagcctccacggcggtttctttgcaggatagggcctcacagtgggcctggayggctttgaactgctggatttaaagacccactcccacaacataagcaagtatcagagggtcgacagagccacagaccctagtcctgagaaagaggccgcctggtgggataacagtgcacaggattcagctttgggagacttggtctgcaggcccagccctgccacttactgatcctgatcggtgctgtctgatcctgaggaagccacatgtcctctgtgagctgtgcagtctccctctgcccccctcactggtattttcatggaggtgatgtgtgtaaaaccacgctgtgaattgaacacg

SEQ ID NO: 3484 - DNA, 601 bp, Human
actcgaaaactctgctcactgcagaagcactggcgggacaggcgtcccaggctggcgagagtgggcactgccatgctgcccctcactccatctcgccccgggttcacacaggggacactgagcagcagctggacgtagacagagctaatggagtcttcccaggtggtccctcctttcagaaaggcccctctgtctgagctccttaactctgaaaccagataagaaggtgggagacaggggccccttttctcatgggattaaatgaactcaattgacagagctctggaaaacttcattgtcrcgtaacatagtgagaccagctttggcagtggtgcgttctttctctcagcctccacggcggtttctttgcaggatagggcctcacagtgggcctggatggctttgaactgctggatttaaagacccactcccacaacataagcaagtatcagagggtcgacagagccacagaccctagtcctgagaaagaggccgcctggtgggataacagtgcacaggattcagctttgggagacttggtctgcaggcccagccctgccacttactgatcctgatcggtgctgtctgatcctgaggaagc

SEQ ID NO: 3485 - DNA, 601 bp, Human
gacactgagacattttctttgggaaatactccatatctttgatcattctgactgcagcagacataagggatggaaaagatgcattcttttgccaatgggaaggacatcacgcacatataacacttgtctttctccctggtagccacagagcaggggggggcatgaatctgtttctgttgtcatccaaaccaggacacccttgagagggaaagacggtagtattaataattatgccagaacaggcagaaactgggatgctgctggacaacctaggctgcatgcccactttagtgtcttgtgsaagacattttccccacagcatgcaggtaagggggcatggagatggctgtgacagccgtccctgaagtcagtccccagaatctgacctcctgcgagtgttctgctggactttgggaagatgagcgccacttttcggaccctctctgctaagaagaggactcgaaaactctgctcactgcagaagcactggcgggacaggcgtcccaggctggcgagagtgggcactgccatgctgcccctcactccatctcgccccgggttcacacaggggacactgagcagcagctggacgtagacagag

SEQ ID NO: 3486 - DNA, 601 bp, Human
ctgcatcatatgcttcatctcctcttgttctgcaagcagcaaagagcaatgttgtcccttgaaagcatacgctgacgctgaactacaagtcagccttcaccactgagcatgggcaactgaaagagaaggttcctctgccatgtggaacagcaaagctgaaacagcggtggccggcactctgatggcatggcccagcccatcctccccactctaacaaatggtttccatcaccgaaggcaactctagtaatagccatgccttgctgagtatgtcgtctggaccaggcaccaggtcaggtgcrttccatattttcttacatcctcaagacaaggctaggacattggtataactgctcctacctgaaataatcgaggtacacagaaataggtgacttgctcaaggacactacattatttcgatttcattccaaagtttgtgttcttagtctctgtactaactgccacccatctttgctgctgtaaggaaaactgcagcctagccaaagtgaacccaaggcttgcaagcagcaagtccgcctgtcattgcctatgcacaccccacctcctgggagatggggaaggggcgatctttggacactgag

SEQ ID NO: 3487 - DNA, 601 bp, Human
tcacaatacccccgaggtctccgtgttactcccttcattttgcatgtgagaaaacaggctcaagaacctgcacgaggtcacaaagctgatgcatgaacagtggtctttgaacccagacctgccttgctccgaacttgtgtgtctaacatccaggacagcttcaggggacgacctaaatccaaattcattaaaatccaaaaccttaaacttatagcgtggcacaggccacatttctagtgcttcaatagtcatatatggctcgtggctactgcactggaatgtgcagatacaaagttctacyggacggcatggcttattctgccttaatcctgacaccgtctccttgccaaccacccccacccgtccccggcctcagcccagaagcaaagttctgagcgctcaaggttagtagaattccctcttagaatccagctgaacattttcctgttgtctattggggtaactctactctttggggggggatttgttaacactgaaaactttgctgtgataatcactcctaacaacagctactctgccacagtacctcattcaattctcacaataactctgtgaagaaggtgctgtaattccatttcac

SEQ ID NO: 3488 - DNA, 601 bp, Human
acaggatcgctctcttgctttcaggaagctgtctgtttaagtcatgccgtgtaggtgggcagccctcctgctgtgggcagatcttgaggggaccccctggctacctgcccctgtgttttacaaccactgcagctagaactactctcttcattccaagcccagatctctcactgggcagcttgagcccatttcttcttgttatgtgtgacctcaggagacagctggtcacaaacttttggaagagagcccttacaagattcttctccttcccttgcaaatacctcacacttgtcctcatgacctcctcatcattctgggcatgaggctctggcgtccagctggggccagcagggagacgtttcccatgtttgggcaggcctcgtggtcctccctttgatctgcccatcctgtctcccttcctccccagggcttccggagccaggcacggacctgtctggtgagcaggatggccgtgtcgtagtgctctgggtggcggtcgctgggctggttgaaacgccgctgccagttgcagaagttacgcagtgtaagccccccattgtcggacacctctgggccccatttttcatcttctacgatcagc

SEQ ID NO: 3489 - DNA, 601 bp, Human
aggagctggagacaaggctgggcaatatagtgaaaccccattcctacaaaaagcaaaaaaaaaaaaaaaaaaaaaatttagctgggcaaggtgcttgcgcttgtcatctcagctactcaggaggcttgaggtgggtggatcatttggacctagcaggcagaggctgcagtgagctgtgattgtgccattgaactccagcctgggtgacagagcgagaccttgtctcaaacaaaacaaaacaaaattaaaaaccaaaaagaatataaaatacaaaggctatcaagatggatttctgagtgayaagatcgggaaatctctgtctgtcttcacatcagccattcatgtaagggagcctgttctatgttacaggctggctgtatcctagggctggctgcatcctagggctggctgcatcctagggctggctgggacttcaaaggctttttgtggggacaggacagcacagtcattcagaacatgactctacagcagcactgtcttggctggactatgggcgctgccgctatgtggcacgagagctgtgtggccactctgtgcctcagttttctctgttacaaaatggggataacaccagggcctg

SEQ ID NO: 3490 - DNA, 601 bp, Human
ccacctagtggcctcgctttattggttctttttgtgtttatggtcaagccagttcacccgtcccccatctttctaaattggagagtaacctgtgaaatttccttttgttaaaaaataaaaacagtctgtaatctcagcattttgagaggacgaggcaggtagattgcttgagtccaggagctggagacaaggctgggcaatatagtgaaaccccattcctacaaaaagcaaaaaaaaaaaaaaaaaaaaaatttagctgggcaaggtgcttgcgcttgtcatctcagctactcaggaggcttgaggtgggtggatcatttggacctagcaggcagaggctgcagtgagctgtgattgtgccattgaactccagcctgggtgacagagcgagaccttgtctcaaacaaaacaaaacaaaattaaaaaccaaaaagaatataaaatacaaaggctatcaagatggatttctgagtgataagatcgggaaatctctgtctgtcttcacatcagccattcatgtaagggagcctgttctatgttacaggctggctgtatcctagggctggctgcatcctagggctggctgcatcctagggctggc

SEQ ID NO: 3491 - DNA, 601 bp, Human
cgcttgccatgtgcctggctgaccttttttaaggaggaagacgcaacagcagtttcaacgtgtctggatatcccacctagtggcctcgctttattggttctttttgtgtttatggtcaagccagttcacccgtcccccatctttctaaattggagagtaacctgtgaaatttccttttgttaaaaaataaaaacagtctgtaatctcagcattttgagaggacgaggcaggtagattgcttgagtccaggagctggagacaaggctgggcaatatagtgaaaccccattcctacaaaaagmaaaaaaaaaaaaaaaaaaaaaatttagctgggcaaggtgcttgcgcttgtcatctcagctactcaggaggcttgaggtgggtggatcatttggacctagcaggcagaggctgcagtgagctgtgattgtgccattgaactccagcctgggtgacagagcgagaccttgtctcaaacaaaacaaaacaaaattaaaaaccaaaaagaatataaaatacaaaggctatcaagatggatttctgagtgataagatcgggaaatctctgtctgtcttcacatcagccattcatgtaagggagcc

SEQ ID NO: 3492 - DNA, 601 bp, Human
tgagatgcagtcttgctctgtcatccaggctggagtgcagtggcacgatctcagctcactgcatcctctgcttatggggttgaggcgattctcccacctcagcctcccaagtagttaggactacaggcgtgcaccaccacacctggctaatttttgtatttttagtagagacagggtttcaccatgttatccaggctggtctcaaactcctgacctcggacaatccggctccttcggcctcccaaagtgctgggattacagccgtgagccaccgtgcccggcctaaattaaactttagagrcgaggtctggctatgttgcccaggctggaatgcagtggctattcacaggagtaattgtagctcacttagcctcaaactcctgggcacaagtgattctctcacctcagcctcccaagtagctgggactacagccgcttgccatgtgcctggctgaccttttttaaggaggaagacgcaacagcagtttcaacgtgtctggatatcccacctagtggcctcgctttattggttctttttgtgtttatggtcaagccagttcacccgtcccccatctttctaaattggagagtaacctgtgaa

SEQ ID NO: 3493 - DNA, 601 bp, Human
atttgccctctcacatgacagtccctggaccattgttcttcccccagatcccacggcttagcttgtgcacagctccacgcctccaccccagcacgtgtctggtgtcctgtgtcctggcatttgcccggtgacctgtgataatcgtgtgggatgctgcttttgtattttggccatgtgctcggggtgggagcggagttgtgttcagcactgtcaagcgcggtatctgtttgtatacagtcaccctgtcaaaattaggaggagctattcctaagcaagggccgcatattccttaggatctacrcaaccttggatctggaagagcagttccctccgatgtggtgaagtgggctttggcacagcaaatcttacctagttcatgggccagggtgtgggccgcctggagcccctcatcctcgatcacggagcagcttttgttggggtcacaaatggtcccgatgtctgccacacccagggtgtcacacagcccctcctgcccacagaagttctgcgtggcggggagagagcaagagagtgcatcagtgtgtgtgtggggtgcgctgcaggcctgcagggccgggtgtggccagcgtgcacgtgggag

SEQ ID NO: 3494 - DNA, 601 bp, Human
agaagcaattttttttttgagatgaagtctagctctgttgcccaggctggagtgcagtggctcgatctcggctcaccgcaacctccacctcccgggttcaagcgattcttctgcctcagcctcctgagtagctaggactacaggcgtgtgctaccacgcctggctaattttttgtatctttagtagagatggggtttcaccatgttggacgggctggtctcgaactcctgaccttgtgatccacctgcctcagcctcccaaagtgctgggattacgggcagaagccactgcacctggcccttttttttttttttttttttaaagagatagcgtctctctctgtcacccaggctggagtcagtggcatgatcacagcttactggtagccttgacctcctgggctcaagtgatcctcctgcctcagcctcctgagtatctgggaccacaggtgtgcaccccatgcctggctccagtcctttgaaccagctccccgccctcttgctctcacaggacgcagtcactgcctctgtcacgcctgagctgttgtaggttcgtctctcctctgtgctatgtgcttctattccttcaagcgctgctcaaa

SEQ ID NO: 3495 - DNA, 601 bp, Human
cttctgagaagcaattttttttttgagatgaagtctagctctgttgcccaggctggagtgcagtggctcgatctcggctcaccgcaacctccacctcccgggttcaagcgattcttctgcctcagcctcctgagtagctaggactacaggcgtgtgctaccacgcctggctaattttttgtatctttagtagagatggggtttcaccatgttggacgggctggtctcgaactcctgaccttgtgatccacctgcctcagcctcccaaagtgctgggattacgggcagaagccactgcaccyggcccttttttttttttttttttttaaagagatagcgtctctctctgtcacccaggctggagtcagtggcatgatcacagcttactggtagccttgacctcctgggctcaagtgatcctcctgcctcagcctcctgagtatctgggaccacaggtgtgcaccccatgcctggctccagtcctttgaaccagctccccgccctcttgctctcacaggacgcagtcactgcctctgtcacgcctgagctgttgtaggttcgtctctcctctgtgctatgtgcttctattccttcaagcgctg

SEQ ID NO: 3496 - DNA, 601 bp, Human
aagaccaaataatgctgtctggatcatcttatttttgcatcatacatgtccctgtctccctcagtgagaaggatctagaatattactttaccaacaattccaaccacttaaaattgttttttctttaatcccctcttctgagaagcaattttttttttgagatgaagtctagctctgttgcccaggctggagtgcagtggctcgatctcggctcaccgcaacctccacctcccgggttcaagcgattcttctgcctcagcctcctgagtagctaggactacaggcgtgtgctaccacgccyggctaattttttgtatctttagtagagatggggtttcaccatgttggacgggctggtctcgaactcctgaccttgtgatccacctgcctcagcctcccaaagtgctgggattacgggcagaagccactgcacctggcccttttttttttttttttttttaaagagatagcgtctctctctgtcacccaggctggagtcagtggcatgatcacagcttactggtagccttgacctcctgggctcaagtgatcctcctgcctcagcctcctgagtatctgggaccacaggtgtgcaccccat

SEQ ID NO: 3497 - DNA, 601 bp, Human
atgaagaccaaataatgctgtctggatcatcttatttttgcatcatacatgtccctgtctccctcagtgagaaggatctagaatattactttaccaacaattccaaccacttaaaattgttttttctttaatcccctcttctgagaagcaattttttttttgagatgaagtctagctctgttgcccaggctggagtgcagtggctcgatctcggctcaccgcaacctccacctcccgggttcaagcgattcttctgcctcagcctcctgagtagctaggactacaggcgtgtgctaccacrcctggctaattttttgtatctttagtagagatggggtttcaccatgttggacgggctggtctcgaactcctgaccttgtgatccacctgcctcagcctcccaaagtgctgggattacgggcagaagccactgcacctggcccttttttttttttttttttttaaagagatagcgtctctctctgtcacccaggctggagtcagtggcatgatcacagcttactggtagccttgacctcctgggctcaagtgatcctcctgcctcagcctcctgagtatctgggaccacaggtgtgcaccc

SEQ ID NO: 3498 - DNA, 601 bp, Human
ggtctccctctgttgcccaggctagagtgcagtggcatgatcatggttcactgcagcctcaaactcctgagatcaagtgatctccctgcctccgccttctgagtagctgggactacaagcgtgagtcaccatgcctgacctattttttatttttttgtacagacaggatctcactatgttgcccaggctggtctcggtgcaagtgatccttctgcctcagcttcccaaagtgctgggattccagtgtgagccgctctgcctggctgtctctcggttcatgactctcaagtgtggtttcctyctggagaacagccctcagtcctccccatttccttttgtttctcctttcccctccccgctatcctcaggggctgtccctcaccttgggcctctccacttcctcctcaggtagacagctgccttctgagcagaggtgcccaggcccgcacggcgtgccgtcagcccagggcaggctgccattcttcgtgtggcacaggggctcagccccatcagtgtggcaccaaagctgggcgcagacgtcctgagcagaggtgttggggcagtggcggaaatccggcccaaagatctgcctgcactgctg

SEQ ID NO: 3499 - DNA, 601 bp, Human
gtcaacccactgaccgaggggatagccttcacgggctcctcaccgtgtggataaatatgctttggtttgtttgttaaaagatgagtgattttacctagaagtcctatgttgcagcctggcccgaagtttcttttcttttttttttttttttttggagacagggtctccctctgttgcccaggctagagtgcagtggcatgatcatggttcactgcagcctcaaactcctgagatcaagtgatctccctgcctccgccttctgagtagctgggactacaagcgtgagtcaccatgcctgacytattttttatttttttgtacagacaggatctcactatgttgcccaggctggtctcggtgcaagtgatccttctgcctcagcttcccaaagtgctgggattccagtgtgagccgctctgcctggctgtctctcggttcatgactctcaagtgtggtttccttctggagaacagccctcagtcctccccatttccttttgtttctcctttcccctccccgctatcctcaggggctgtccctcaccttgggcctctccacttcctcctcaggtagacagctgccttctgagcagaggtgccca

SEQ ID NO: 3500 - DNA, 601 bp, Human
atgtctggagccacggcagtgtcaacccactgaccgaggggatagccttcacgggctcctcaccgtgtggataaatatgctttggtttgtttgttaaaagatgagtgattttacctagaagtcctatgttgcagcctggcccgaagtttcttttcttttttttttttttttttggagacagggtctccctctgttgcccaggctagagtgcagtggcatgatcatggttcactgcagcctcaaactcctgagatcaagtgatctccctgcctccgccttctgagtagctgggactacaagygtgagtcaccatgcctgacctattttttatttttttgtacagacaggatctcactatgttgcccaggctggtctcggtgcaagtgatccttctgcctcagcttcccaaagtgctgggattccagtgtgagccgctctgcctggctgtctctcggttcatgactctcaagtgtggtttccttctggagaacagccctcagtcctccccatttccttttgtttctcctttcccctccccgctatcctcaggggctgtccctcaccttgggcctctccacttcctcctcaggtagacagctgc

SEQ ID NO: 3501 - DNA, 601 bp, Human
tcattctcccaacctgtaattatgcattcagttcaagcacgggcaggctatgaatacttttcactcaattcttgatggaatttattccgcgtgtctctgtgttcatgacggaattgacagtggctccatctgttgtgtgctcaccttcctgtctccaccccgctcaccaatctgcacctgcaccagccctgaggcagccccaaagcagctccctaatgtctggagccacggcagtgtcaacccactgaccgaggggatagccttcacgggctcctcaccgtgtggataaatatgctttggtttgtttgttaaaagatgagtgattttacctagaagtcctatgttgcagcctggcccgaagtttcttttcttttttttttttttttttggagacagggtctccctctgttgcccaggctagagtgcagtggcatgatcatggttcactgcagcctcaaactcctgagatcaagtgatctccctgcctccgccttctgagtagctgggactacaagcgtgagtcaccatgcctgacctattttttatttttttgtacagacaggatctcactatgttgcccaggctggtctcggtgcaagtg

SEQ ID NO: 3502 - DNA, 601 bp, Human
aaatgcgatcagcctcacagtttggatgtattcagagcagggcaaagaagtgaatcatttaaaaaccctcactggcactgccttggtttttcttgtgagtttactctctcctgggccaagtttttttctgcctggccagaggcagctctgaatctgtctcctctcctcctctttgaatacggaattcccacaactgctctcattctcccaacctgtaattatgcattcagttcaagcacgggcaggctatgaatacttttcactcaattcttgatggaatttattccgcgtgtctctgtgytcatgacggaattgacagtggctccatctgttgtgtgctcaccttcctgtctccaccccgctcaccaatctgcacctgcaccagccctgaggcagccccaaagcagctccctaatgtctggagccacggcagtgtcaacccactgaccgaggggatagccttcacgggctcctcaccgtgtggataaatatgctttggtttgtttgttaaaagatgagtgattttacctagaagtcctatgttgcagcctggcccgaagtttcttttcttttttttttttttttttggagacagggtctc

SEQ ID NO: 3503 - DNA, 601 bp, Human
tttctcactttctttctttcttgaaagtcttgctctgtcgcccaggccagagtgcagtggtatgatcttggctcactgcaactgccgcctcctgggttcaagtgattctcctgtcttggcctctggagtagctgggattataggcacctgccaccacacttggctaattgttgtatttttagtagagacagggtttcaccatgttggtgaggctggtctcgaactcctgacctcaggtgatccacccgcctcggcctcccaaagtgctgggattacagcacctggcctgattctataaatrtgtattttctgatctgacttcttaaaaatagaggccacacatcattccatgatcatttcacgtcaacctctccctgcacttagctcggctgtgctctgggattggtggcagatccctctgctctcccctcaataacatgtgatgagaatgaacagggtgaatgggaggtggctgaggatcagtccatgaatcctgcaccagctcaggcttaggacaagagtacagagcttacctggtgcaggcgggctcccaaggctcagtgcaaaagacatgcactgaggagtgcttgggccaccctgg

SEQ ID NO: 3504 - DNA, 601 bp, Human
tgacacccttttatgggaataaggttgcatataatgcagtggttctccgttggggcgaattctgccctccaggggacatttggcaatgtctggagatactctggtggctacagctgtggagggtgtacgtgaccacatctagtgggtagaggccagtgatgctgctccacatccagcaatgcacaggccccacggtaacaattatccagtcctaagtgtccctagtgccaaggcagaggaactctggtctaaaggaaacatccctgcgaggtgttgccatagtctaccagccactggttcyggtgataggacaatgcttgggaaagaaacagaattgcttcctttttttttgacagagttttgctctgttgccaaggctggagttcaaaggcgtgatctcggctcactgcaacctccgcctcctgggttcaaatgattcctgtgcctcggcctcccgaataactgggattacaggtgcacacctccacgcctggctaatttttgtatttttagtagagatggggtttcaccatgttggccatgctggtcttgaactcctgacctcaagtgatcaacctgcctcggcctcccaaagtactgg

SEQ ID NO: 3505 - DNA, 601 bp, Human
cacaggtccgagaacattctccccagggtccccacggtgcccagcctccatctgccacgggctgcaacatacaatggcacactgaatgaggagcaaaggccaggaggcttcagtatctgtgtcactgggtggccaatgccctggcttcctcatctagtcattatcatcttggtgcatggagtgccgtaaactgcctcaatcatttgtttaatgactgtgtggcctgcatggctttgtgagcacagagaccaggctggactcattcactactgactcctcagtgtctaaaacagtgccttaygcttagtaaggtgctcaataggctatctgctgaatgaatgaatgacacccttttatgggaataaggttgcatataatgcagtggttctccgttggggcgaattctgccctccaggggacatttggcaatgtctggagatactctggtggctacagctgtggagggtgtacgtgaccacatctagtgggtagaggccagtgatgctgctccacatccagcaatgcacaggccccacggtaacaattatccagtcctaagtgtccctagtgccaaggcagaggaactctggtctaaaggaaa

SEQ ID NO: 3506 - DNA, 601 bp, Human
cccctctgggagtaactctatatcccgggacacccacttcactcccactttacacatcctctggggatgcgtcatagcaatgatagtagctgctctggcaggggcggccctgagtggtaattaccgtcaggggggcattcctccgtgtggcatgactggtacttggctctccgacccaggcagtatcttcctccattctgaggctcggggtccttgcactcacggtgtgaaaactgtactcctcctccacaggtccgagaacattctccccagggtccccacggtgcccagcctccatctrccacgggctgcaacatacaatggcacactgaatgaggagcaaaggccaggaggcttcagtatctgtgtcactgggtggccaatgccctggcttcctcatctagtcattatcatcttggtgcatggagtgccgtaaactgcctcaatcatttgtttaatgactgtgtggcctgcatggctttgtgagcacagagaccaggctggactcattcactactgactcctcagtgtctaaaacagtgccttatgcttagtaaggtgctcaataggctatctgctgaatgaatgaatgacacccttt

SEQ ID NO: 3507 - DNA, 601 bp, Human
acccatgcggaagcaggagcatccggtggagaaatcccgaatttacagcacttttcttctttcttttggttttgaactcaacccaggcgcccagggccagtgtcttctgggcacaacattcctagacgcatgtgtgacccttactcaaaagggcaaggaaaggagcctccagccgcatgctgggctttctaggataaatgccctttccattagggaaagagactcattgtactctacaggtgaataaacgcagggagcaacagggaacaattcagtaagcttggaaggcacagaatggcaygtggagctatattctcaggacactactaattgtgcagtatcgatttcctcagtgacaccggacatgaatccaaagactcctaaatctacatgtctagctctgatcttgcccctacacccacattccgtaattctgggtgtccctggggagctccgtttgtatgtactgtgattacctccaactcagcatggccaagctcccgatggtccttccacgaactgtcttgactttcatttgctgatcttaccatgcccaagtctgagactggtatcctggtatctcccgaacatttgagcatct

SEQ ID NO: 3508 - DNA, 601 bp, Human
ctccccatctctggatctgagtcccagggtgattctcaccttggcctcgaacactttgaactcgctcctcccccgggctcggcagaacaacttgcagcggtcccggggggacaccccagcatacttggggacccactgcaggagattcccgtccatgtcagtgtaattgtaggcattatacttctcacactgctgctccctgaagcttttccctagaaagaggaagaaacggcatggaggtgacacccatgcggaagcaggagcatccggtggagaaatcccgaatttacagcacttttcktctttcttttggttttgaactcaacccaggcgcccagggccagtgtcttctgggcacaacattcctagacgcatgtgtgacccttactcaaaagggcaaggaaaggagcctccagccgcatgctgggctttctaggataaatgccctttccattagggaaagagactcattgtactctacaggtgaataaacgcagggagcaacagggaacaattcagtaagcttggaaggcacagaatggcatgtggagctatattctcaggacactactaattgtgcagtatcgatttcctcagtgac

SEQ ID NO: 3509 - DNA, 601 bp, Human
tggtaacccccttctctgaagatccatctgcagaaaggacaggggcttgccaggcttagggtgagacgtccttcccaaaacaggcctgggagagctgttttctggcagaggtccaggttactcagtgtggctcgattgactcagagatgacagctccctatccacatggcctccagccctcgtaaaagtcacggctgccctgtgttctatcttttctatgagctcgacactgccaagtgcacatcccatctcaggaaatccttacaacgactctgagatagagatactgctgacattttayaaagaaactgaagctcggagagtttaaataacttgcccaaccctcacagctattaagtagcagccacagttcaatttgggcctagcagagtgcaaagcccattatgctcttctaccaagcaaggtacagaacttctggggagactcacttggtgggggtgagggacccggagaccttcctgcaggagttgcctttgcccccacacaccccgcatttgtccagcttccgaggcgagtccaccacatggtcacagccggccttgacacactggccacggacacagatggccagtgtttctgg

SEQ ID NO: 3510 - DNA, 601 bp, Human
atgacgaaacccagtctctactaaaaatacaaaaattagctgggtgtggtggtgcatgcctgtaatcccagctacctgggaagctgaggcaggagaattgcttgaacctgggaagcaggttgcagtgagccaagatcgtgccaccgcactccagcctaggcaacagagtgagactctgtctcaaaataataaaaataaattaaaaaaaatgaaaacagtcccaagttgcctgctgtaggctgattctgttctctcagactggtgagatgagagatgtagagacagacagacagacagacasacacacacacacacacagaatggggcagggtttgcgagcttcactaggtagaatacaatacagtgaacacttctcaaaaactctgagaccgtgagtgggggaagtggctggacaggtggatgctcacataagccctaggacacattgatgtactggaggcagacaggcagagtgtggcccatataaaacacccgaacttgcccttactctgcaggaagtacatggaatgggagacaaaagtcatccaggacttaggaaaactaggttctcttctggctgtcattaaccatcaatgtgacc

SEQ ID NO: 3511 - DNA, 601 bp, Human
aaaaacaaagcaagtaattaagcaagttgcctcaaagttctcaataaattagctgtttaggcagacagaaatgtctgtacattgggattttcaagggtgtttgcttcatctggcaactctatttcaaaagtgtggttgaggagttgaggtatgtgggtgttgagaacagcatagagacgaggagaacccagaaggatgtggaaagctgcactggtgtagccaaacctggcacctgtcaaatgtgatctcaaatacctctagctccttgcactggtatacaactttgattggccacctccayacccagagctcaaacccacatggaaaaaactgttccacacaccccttccagaacgtgaacaggagggaaatttcacaccacctctctgagtcagtcggctcctagtatttgatgaatatggccctagggtgggatcagggtggggttgggagttgggggtttaagcctgcttctttgaagccaccttctgggagtgcccaggcaccatgagcactgtgcttctggaatgataggaagcagttttgggaaactgtttccagtccattataggcttagggctttaggtaggatgaagaaaga

SEQ ID NO: 3512 - DNA, 601 bp, Human
ccttagaccagtggctgcccagcccaggtcacgatgatgccttggagactgaagtgggcaccccaggtggcagacacgaaaaaaacaaagcaagtaattaagcaagttgcctcaaagttctcaataaattagctgtttaggcagacagaaatgtctgtacattgggattttcaagggtgtttgcttcatctggcaactctatttcaaaagtgtggttgaggagttgaggtatgtgggtgttgagaacagcatagagacgaggagaacccagaaggatgtggaaagctgcactggtgtagcsaaacctggcacctgtcaaatgtgatctcaaatacctctagctccttgcactggtatacaactttgattggccacctccatacccagagctcaaacccacatggaaaaaactgttccacacaccccttccagaacgtgaacaggagggaaatttcacaccacctctctgagtcagtcggctcctagtatttgatgaatatggccctagggtgggatcagggtggggttgggagttgggggtttaagcctgcttctttgaagccaccttctgggagtgcccaggcaccatgagcactgtgct

SEQ ID NO: 3513 - DNA, 601 bp, Human
ttagtggcaccagctgggatggtgacaatgtcattgtagccataactgtgatagaaacagaaggacacccttagaccagtggctgcccagcccaggtcacgatgatgccttggagactgaagtgggcaccccaggtggcagacacgaaaaaaacaaagcaagtaattaagcaagttgcctcaaagttctcaataaattagctgtttaggcagacagaaatgtctgtacattgggattttcaagggtgtttgcttcatctggcaactctatttcaaaagtgtggttgaggagttgaggtatstgggtgttgagaacagcatagagacgaggagaacccagaaggatgtggaaagctgcactggtgtagccaaacctggcacctgtcaaatgtgatctcaaatacctctagctccttgcactggtatacaactttgattggccacctccatacccagagctcaaacccacatggaaaaaactgttccacacaccccttccagaacgtgaacaggagggaaatttcacaccacctctctgagtcagtcggctcctagtatttgatgaatatggccctagggtgggatcagggtggggttgggag

SEQ ID NO: 3514 - DNA, 601 bp, Human
tgaatcacagggggcacagctggctttcgcagggcttggcatcctcgggtttcagagccttgttgcaggtggcagaggcctggccggaggggtccctgcactctacagttcgcctctgccagccggccccgcaggtgctagagcactcagaccagtcccccagcacccactgtgcgtggagcagcggctggatgatgttggtggttgctctctctttgctgctctgcatgctaaagtccacgtcattaggaacaaagaaggtgtatttgacttttggggggaagacctcgccagggactgycaggagctgcactgtcagaggctctggcaagggccggaagctctgcaggcgctccagggtggcgatggagccgctgtacttcaggatggtccccttcaccaagatgtcctgctctatggcagagatggccaggttgccgttgagcaggtactgcccatcagccgtcttcagcgccaggtagttcccatcgttctgcacacccgggtggctccgctgcttcacgtcaatattagtggcaccagctgggatggtgacaatgtcattgtagccataactgtgatagaaacagaaggacaccct

SEQ ID NO: 3515 - DNA, 601 bp, Human
gtagacctctatgaaccaaatatgcttcaggcttgggttgagcacaggagagggaggagggaaaggtcactggggctgggagtgcctacttccctctgtgagtgtcaccccagtccacccagtaccatacctttctctctctggacccacttccttttgctgccggctcctccccattgaataacagccaagttgctttggtttctatttctttgttaagtcgttccctctacaaaggacttcctagtgggtgtgaaaggcagcggtggccacagaggcggcggagagatggccttcagcrgttcccaggctccctacctgagtccagtgagttccagggctatgggcacagggctgcctcagccagagggacacagctctggggctctgaggaagcaactcctgggtggcaggggatgggggtgggggcatcccaaagagaacacaagcagggcagaaatatcagaggaggtcatcctggcacacctgtgccgtgctgagctcactcatgcctggagggatgctccttcccacgagtcatggctttgacagtgttgactgagctgtcctgtcctgtcctgtcctgtgtgctcaggggaag

SEQ ID NO: 3516 - DNA, 601 bp, Human
tgtgccgtgctgagctcactcatgcctggagggatgctccttcccacgagtcatggctttgacagtgttgactgagctgtcctgtcctgtcctgtcctgtgtgctcaggggaagacatgtagagcggggtggttcatgtaaagaggaagcaagcacgcttctgggacagtaaggacgctacccggcatggtagttaagggtgcttactgtgaaggtggcctccctgggtccagctatttactggctggtggtctctgggcctcagtttccatatctgtgaagtgggaataatacttgagcyccccactcccagggttgggatatggattaaggaagtagtgtatctagtgtgtttgaacagtgcctgacacactgtaggtgctttgggagtgtttcatgttattgggtgtctgagggcagcagggaagacctcccgaggaggtgtctgtgctctgaaggttgggcatgggcatgttcagggcatctgtggaggggcagtctcagaggtgagaggggggtgaggactgtccctgcagcgtggggtcagagggcggcaggtgccttgctgaaaccctgtgaggtttatgagtccccttcatac

SEQ ID NO: 3517 - DNA, 601 bp, Human
gctgaaaccctgtgaggtttatgagtccccttcatacacggaaaatctgaggctcagggaggcagaggccagttgccaaatgcctccagatgggagtggcagccccaggagcccaggagacttcaggggtcactgtgtcctgggccggctcctgtcataggatctcaccccgccttggcaaagagcttcccgaggggctggagagggtgggctgatgggtccttcctgggtggggaggcagggtggggagggtgggcagaggcagggtactgagggagggaagctgccatggcccacctcrgcagaggccagggtcgggcttgagtgccccctggtgacactgagtccagaatgaggctgcctacgttctggtctgcagagctcggctctgctttctaaactccagagagaaagaatggggaaaggaggcctgtttcctcctggctgtcaccaatgacacctcagccaccctgtggaggcccctgaggtaggacctgcacagagggggctgggggaagctggaacaggccgctggtgggggccttagggtcagcaggtgctgccttgggcatgtcaccctgtctctggttttctgtcaaag

SEQ ID NO: 3518 - DNA, 601 bp, Human
gtttccttctggaggccccaggggaaaatctgtttcttttccttttccatcttctagaggctgcctgcaggccttggcttatgacccctcctgccatctttaaaaccagcagctttggctgggcccagtggctcatgcctataatcccagcactttgagaagccgaggcaggaggatctccttaatccaggagtttgagaccagcctgggccacaaagtgagaccacgtctctacaaaaaatagacaaacattagccaggtgtggtggtgcatgcctgtagtcctagctacctgggaggcrgaggtgggagggtcacgtgagcctgaggaagtggaggctacagtgagctgagatcgcgtcaacacactccagcctggctgacagaatgagatcctgtctcaaaaaaaacaaaaaacaaaaaacgaaaacaaacaaaaaccccccaaaaacgcaaaccagcttcttcttgcttctgtgcttctgttgtcacatctcctacctctgacactgatcctcctgccttccttttataggatccttgtgatcacattgggaccacctttaaaatcaggacaatctccccatgccaaaattactaat

SEQ ID NO: 3519 - DNA, 601 bp, Human
cctttgtgttataatgctgcaatgaataaccttgtttgtaggatgatattcaatttaaaaactcatttttcaggccaggcatgatggttcatgcctgaaatcttggccctttgggaggccgagccggaaggatcacttgagctagcccaggcaacacatagagaccccatctttacaaaaaatattgtaagattagtgggacatggtggcctgcacctattttgtcccagctattcgggaggttgaggcgggaggattacttgagccagggggtggaggctgcagtgaaccatgatcacasccctcactgaactccagcctgggcaacagagtgagaacccatctctaaataaataaataaataaataaataaataaataaataaataatcttgtttttccgaattttgggggcactatttaagatattttgaaacctcacagagcttttttggggaacttgttgccttggagattagcctgtcctgtcccgcccccatgatctgtacttcctctttctccctcctggcttccttaattaagccttgtgtgtacttgccagcccatgtccatcacgctctgccttcaattctagatgctgt

SEQ ID NO: 3520 - DNA, 601 bp, Human
agaaaaatgttccacagacatgtttcagggaaaacaggcttcccaatcctaggccgtgctggtccataattggatcaggctgactctccttcccctacactgctggtgtagacagggacaagaatgagaagtcagagacacagagaagctgtgatttgcttgaggtcactaaagtacttaatggcagagttcagacctgacctgaggggcaacaaaagacacccccctcaaatccatggggagcagagtctaactgaatcagatcccagatttcctggggctctcacggtgccaggtgtggacactgagctaggatgggtttcccagggttctgtgtggtcacacaactcaacaatacagaccagaaagcagtggcaagtaggctgaatttggctggtgggtgttttctgtttggcctgcacagtgtttcttttaacgttttattataggaaattcaaacatgcagaaggaattgtaccatcaacaacacacacccatcactctgctccaacaatgatcaactcaggcctatcttgcttcatcctataccctccctcgcttgcttccttcccaccctcagatatgtggaagcaaatccaaa

SEQ ID NO: 3521 - DNA, 601 bp, Human
actaaagtacttaatggcagagttcagacctgacctgaggggcaacaaaagacacccccctcaaatccatggggagcagagtctaactgaatcagatcccagatttcctggggctctcacggtgccaggtgtgtacactgagctaggatgggtttcccagggttctgtgtggtcacacaactcaacaatacagaccagaaagcagtggcaagtaggctgaatttggctggtgggtgttttctgtttggcctgcacagtgtttcttttaacgttttattataggaaattcaaacatgcagarggaattgtaccatcaacaacacacacccatcactctgctccaacaatgatcaactcaggcctatcttgcttcatcctataccctccctcgcttgcttccttcccaccctcagatatgtggaagcaaatccaaagataccattccatttcaaatatttcattttgtatctctataatatgggaatttggggggtttcaagacaggatttcactttgttgcccaggctggagtacagtggtgtgatcatggctcactgcagcctccacctcccaggctcaagggatcctcccacctcagcct

SEQ ID NO: 3522 - DNA, 601 bp, Human
tctcacggtgccaggtgtgtacactgagctaggatgggtttcccagggttctgtgtggtcacacaactcaacaatacagaccagaaagcagtggcaagtaggctgaatttggctggtgggtgttttctgtttggcctgcacagtgtttcttttaacgttttattataggaaattcaaacatgcagaaggaattgtaccatcaacaacacacacccatcactctgctccaacaatgatcaactcaggcctatcttgcttcatcctataccctccctcgcttgcttccttcccaccctcagayatgtggaagcaaatccaaagataccattccatttcaaatatttcattttgtatctctataatatgggaatttggggggtttcaagacaggatttcactttgttgcccaggctggagtacagtggtgtgatcatggctcactgcagcctccacctcccaggctcaagggatcctcccacctcagcctcccaagtaactagagttaaaggtgtgcaccaccacacctagctattttttttttattttttgtagagatgggggacccattacgttgttcaggctggcctcaaactcctgggct

SEQ ID NO: 3523 - DNA, 601 bp, Human
cctataccctccctcgcttgcttccttcccaccctcagatatgtggaagcaaatccaaagataccattccatttcaaatatttcattttgtatctctataatatgggaatttggggggtttcaagacaggatttcactttgttgcccaggctggagtacagtggtgtgatcatggctcactgcagcctccacctcccaggctcaagggatcctcccacctcagcctcccaagtaactagagttaaaggtgtgcaccaccacacctagctattttttttttattttttgtagagatgggggwcccattacgttgttcaggctggcctcaaactcctgggctcaagtgatccttctgcctcagcctcccaaagtgctgggattatagatgtgagccactgtgcccagccaggagcttttacataatcctttttgacaaattttcccccaagaaattagaaagttttatagaaaaaaaaaatccggacttctgtcttctcttaaaaatttggaagctctgccaatactgggcccagatggcaatcactgcttagcacggagtagatgttgacttttcagatgaggggtgtgacatctactttgc

SEQ ID NO: 3524 - DNA, 601 bp, Human
tattttgagatggagtctcgctctgccaccaggctggagtgctgtggcgctatctgggctcactacaacctccgcctcctgggttcaagtgattctcctgcctcagcctcctgagtagctgggactacaggctcatgccaccatgcctggctcattttttgtatttttagtcgagacggggttttaccatgttggccaggatggtctcgaactccagacctcgtgatccacatgcctcagcctcccaaagtgctgggattacaggcgtgagccatcatgcccagccaatttttttttttttaactagagatgagctctcactatgttgcccaggctggtctcaaactcctgggctcaagtggtccacccgccttggcctctgcgcccagccccaatttcacatgctctttacatttgttctcttctttcccatttaatcaggcatgtgctggcctccaacaagtgtccactggcacagaaggctctctcttctaggtgtgcttaacaacttccatcttcggtatcaattggtaatcactttccaagacctatgtttcttgtttgctaataccagcacttttccttaaccgttttctatttg

SEQ ID NO: 3525 - DNA, 601 bp, Human
cagataacacgctcatttccttgtgaggtgttacccatggctgcctagtctccttatgcaccttcatctgaatctacaggtgcacctgctgcttcttttactctgaaaataagaactagaggagtcatcacgttgctatttggtgttgtgtgtctttgaattccaagctcattccattcctctgctatagccattcctcctctccaggtcactggtaacatttatttttcagcgacatcgttccagcctttatccagggtctattaagggtatagttttgtaagcacattgcaaattaccyttgcaagcagagtaggtctctgggcttgagaagcctgtgggtaagtcagtccaagtatgcttatctgagataaggatgtccccattcgttcagtatgcaacctgaggtcacctctcctctgctccccatgagcattttatgcatatataaataataccgctgcagccataaaaaggaatgagatcatgtcctttgcaggaacatggatggagctggaagcctttatccttaaactaacgcaggagcagaaaaccaaacaccacatgttcttacttataagtaggagctgaacgatgagaa

SEQ ID NO: 3526 - DNA, 601 bp, Human
tggcacccgtttacctagttaacaaatctgcacatcctgtacttgcaccctggaacttaaaatcaaagttgaaggggatggaaatggcagatcacgcctataatctcagcactttgggaggctgaggagggcggatcgcttcaggtcaggagtccaagaccagcctggccaacatggtgaaaccccatctctactaaaaatacaaaaattagctgggtatggtggtgggctcctgtaatcccagctactcgggaggctgaggcacgagaatcacttgacccactgcactccagcctgggcracagactgacattccatctcaaaaaacaaaaaaaaacagttgaaggaaaaataaataattaataaatgaaaccccaggtgagctaagactagaaagacaaacctactgcaggaaacaaccagaagaacgaaaagtccaactggagcctggtagagactcgggttgatgcactttgggtcacacacacgttcctgtaactggccccacactgaagaccagactcaggtcttcattttctagaaagagggtccaggagctcaggggtggtccccatcccagcctgggatgcctcccccagaa

SEQ ID NO: 3527 - DNA, 601 bp, Human
taccaataccatgtgaaaaatgggaagattagggtatgctgggcccacattcccacagggcaccagcagctgggtgggagctgctgttacccttttggcattcgaggctgctccctgagatcagcgaagcacacagtaggccctcagcaaatctgggcttctcgccctttggtcctcatctctcattccctccttccctgactctctcccctgcgggtggtaggggagggaagagctggagggagaccgcacccctgcactgctcaccagagcctggctctttcccatcccatcttggcakggccctaacccccttgcctcatcgccctgcctgcctggtctctccctcttgcccctgcctctgcctttcggcttctccttggctctattaatgcttctcctcactgcccggtgccttttgttttaacagaacccccgcacagtccctgttcagcctgccttctccacggtgccgttctcccagcctgtctgtttcccacccaggcccagggggcgcagacaaaaagtgagttcaacacagaggccctgggtggccgagcagacagtaggaaggaccgagggtctgagaggctggccccag

SEQ ID NO: 3528 - DNA, 601 bp, Human
gcgggtggtaggggagggaagagctggagggagaccgcacccctgcactgctcaccagagcctggctctttcccatcccatcttggcatggccctaacccccttgcctcatcgccctgcctgcctggtctctccctcttgcccctgcctctgcctttcggcttctccttggctctattaatgcttctcctcactgcccggtgccttttgttttaacagaacccccgcacagtccctgttcagcctgccttctccacggtgccgttctcccagcctgtctgtttcccacccaggcccagggrgcgcagacaaaaagtgagttcaacacagaggccctgggtggccgagcagacagtaggaaggaccgagggtctgagaggctggccccagccagcaggccactcagggcctacaggccgcatcttgcccacccaagagttccctgtctctgtccgctgggcacccagagctggggacctgggggtcaccctggattcttcactccctcttctttacgtctctccaaggcacgaacgtgtctccctcctgaagccaccgatgtggtccaggcctctgggattcctcaccatgacgacaggggt

SEQ ID NO: 3529 - DNA, 601 bp, Human
gccctaacccccttgcctcatcgccctgcctgcctggtctctccctcttgcccctgcctctgcctttcggcttctccttggctctattaatgcttctcctcactgcccggtgccttttgttttaacagaacccccgcacagtccctgttcagcctgccttctccacggtgccgttctcccagcctgtctgtttcccacccaggcccagggggcgcagacaaaaagtgagttcaacacagaggccctgggtggccgagcagacagtaggaaggaccgagggtctgagaggctggccccagcmagcaggccactcagggcctacaggccgcatcttgcccacccaagagttccctgtctctgtccgctgggcacccagagctggggacctgggggtcaccctggattcttcactccctcttctttacgtctctccaaggcacgaacgtgtctccctcctgaagccaccgatgtggtccaggcctctgggattcctcaccatgacgacaggggtccagttccccaccccctacacccaaccactgccacagtgaccttcttataagcaaatgtgatcacaccctctccctgcttaaaaatcttc

SEQ ID NO: 3530 - DNA, 601 bp, Human
gcctctgcctttcggcttctccttggctctattaatgcttctcctcactgcccggtgccttttgttttaacagaacccccgcacagtccctgttcagcctgccttctccacggtgccgttctcccagcctgtctgtttcccacccaggcccagggggcgcagacaaaaagtgagttcaacacagaggccctgggtggccgagcagacagtaggaaggaccgagggtctgagaggctggccccagccagcaggccactcagggcctacaggccgcatcttgcccacccaagagttccctgtytctgtccgctgggcacccagagctggggacctgggggtcaccctggattcttcactccctcttctttacgtctctccaaggcacgaacgtgtctccctcctgaagccaccgatgtggtccaggcctctgggattcctcaccatgacgacaggggtccagttccccaccccctacacccaaccactgccacagtgaccttcttataagcaaatgtgatcacaccctctccctgcttaaaaatcttcacagcccccagcccttcaaataaagcccaaattccccagcagggtatatgaattc

SEQ ID NO: 3531 - DNA, 601 bp, Human
acagaacccccgcacagtccctgttcagcctgccttctccacggtgccgttctcccagcctgtctgtttcccacccaggcccagggggcgcagacaaaaagtgagttcaacacagaggccctgggtggccgagcagacagtaggaaggaccgagggtctgagaggctggccccagccagcaggccactcagggcctacaggccgcatcttgcccacccaagagttccctgtctctgtccgctgggcacccagagctggggacctgggggtcaccctggattcttcactccctcttctttaygtctctccaaggcacgaacgtgtctccctcctgaagccaccgatgtggtccaggcctctgggattcctcaccatgacgacaggggtccagttccccaccccctacacccaaccactgccacagtgaccttcttataagcaaatgtgatcacaccctctccctgcttaaaaatcttcacagcccccagcccttcaaataaagcccaaattccccagcagggtatatgaattcctccccagtctgccccaatccacgtccctgcctcacccccaacccacgaagctcacgcagcctctgcag

SEQ ID NO: 3532 - DNA, 601 bp, Human
taggaaggaccgagggtctgagaggctggccccagccagcaggccactcagggcctacaggccgcatcttgcccacccaagagttccctgtctctgtccgctgggcacccagagctggggacctgggggtcaccctggattcttcactccctcttctttacgtctctccaaggcacgaacgtgtctccctcctgaagccaccgatgtggtccaggcctctgggattcctcaccatgacgacaggggtccagttccccaccccctacacccaaccactgccacagtgaccttcttataagcmaatgtgatcacaccctctccctgcttaaaaatcttcacagcccccagcccttcaaataaagcccaaattccccagcagggtatatgaattcctccccagtctgccccaatccacgtccctgcctcacccccaacccacgaagctcacgcagcctctgcagctcactcaaggccctcttgggccaccatgcttttgcatatgctgtccctggtcccggaagcaccctctgccagcctgccccgagcacatgcctaattgcccttccatgctctgcctaagtgccgctcctctgggagtcct

SEQ ID NO: 3533 - DNA, 601 bp, Human
cccacccaagagttccctgtctctgtccgctgggcacccagagctggggacctgggggtcaccctggattcttcactccctcttctttacgtctctccaaggcacgaacgtgtctccctcctgaagccaccgatgtggtccaggcctctgggattcctcaccatgacgacaggggtccagttccccaccccctacacccaaccactgccacagtgaccttcttataagcaaatgtgatcacaccctctccctgcttaaaaatcttcacagcccccagcccttcaaataaagcccaaattcyccagcagggtatatgaattcctccccagtctgccccaatccacgtccctgcctcacccccaacccacgaagctcacgcagcctctgcagctcactcaaggccctcttgggccaccatgcttttgcatatgctgtccctggtcccggaagcaccctctgccagcctgccccgagcacatgcctaattgcccttccatgctctgcctaagtgccgctcctctgggagtcctccccgcctggaatattgttggacgctcccctggtgtccccacagagtctgtatgtatctgtgccatgccag

SEQ ID NO: 3534 - DNA, 601 bp, Human
caggggtccagttccccaccccctacacccaaccactgccacagtgaccttcttataagcaaatgtgatcacaccctctccctgcttaaaaatcttcacagcccccagcccttcaaataaagcccaaattccccagcagggtatatgaattcctccccagtctgccccaatccacgtccctgcctcacccccaacccacgaagctcacgcagcctctgcagctcactcaaggccctcttgggccaccatgcttttgcatatgctgtccctggtcccggaagcaccctctgccagcctgccycgagcacatgcctaattgcccttccatgctctgcctaagtgccgctcctctgggagtcctccccgcctggaatattgttggacgctcccctggtgtccccacagagtctgtatgtatctgtgccatgccagttcacagcaccccattgtaactgtatttgcgtgtctgtccccgttactccacccccatgtccctatgcccatgaggccccagagggccaggactgtggcttgttcatttgcactgtgcctggcactcagtagggactcagtgaatgaatgtggaatgtggttcacacag

SEQ ID NO: 3535 - DNA, 601 bp, Human
agaaacggagctggagctgtggctggggaggtgttgatgaactggcttagcttgtcagccgttcttgcctgggtaacttttcctacccttggctgccactgacaggggtgaagctccttctcccaagggatggacacagtgggtgggaggaggtgccactgccatctttcatgcatgtgccatgtgtgaagctattatttaagtttactcaacacttagtgtctgttttcccattagagtccctctaacagccctgtgaagggggttgtacccattttacagatgaggatattgaaaggtctggtgatttggctaaagtcatactgctaagagatggcggggcctgcatttgactgcaggttcatctgtgtatttgatctctacagtgtcttccctctttacatctgagagatgaatttttgcagctcaattgcaaatttcctaatggtttttgctgtaatcctggagacatgttcctctagagaatttcagagtcccaagataacataaaactacattttaaaatgcaagtcttttccaaaatcacaattttgagatggattgaggacaaaaaggccaatttgctagcaactgcacttta

SEQ ID NO: 3536 - DNA, 601 bp, Human
ggtgcctctagctgttaagacatgtacaagagaagacttgctaagctttggctgcactggtgaaggatcccgggccctctggaatcatacacaatccatcagagattcctagattccatgataaggaacccaactgcaaacggagagtccaccttgcagatcaaccagagccccgcgttcagaatcttgcctttcttagggtaccccggtcctcttttttttgccctaaatatagccctttcaatctgggctcagaaatacataaactgaactcacacctgaatgatgcagctctttcttkccatgtgaaaaatacattcagctttgattcagaatgctttcgggtggtcttacttgccataattttaaggtgaggaggacccagcctgagaaacggagctggagctgtggctggggaggtgttgatgaactggcttagcttgtcagccgttcttgcctgggtaacttttcctacccttggctgccactgacaggggtgaagctccttctcccaagggatggacacagtgggtgggaggaggtgccactgccatctttcatgcatgtgccatgtgtgaagctattatttaagtttactcaa

SEQ ID NO: 3537 - DNA, 601 bp, Human
gaatgcagggagcacacgtcccgatggagcccagagtctcagggagactgggctgggcagcccctcttcgagtgagtttacttatggaacccgcacccaacctcaggcaaatgaagtcaatagtacacagtgggtgagccacacattggggaccgttgggctgggaagggtggttgggagaaactcatgcagtggacaaagagtgagaccacacacaggtggccttgggttgcaactcaaagtgactgggccatcatgtccccagtacgtcccctcaatgtgtgggagtccatgttgccaygcctgtttgacatggtgcctctagctgttaagacatgtacaagagaagacttgctaagctttggctgcactggtgaaggatcccgggccctctggaatcatacacaatccatcagagattcctagattccatgataaggaacccaactgcaaacggagagtccaccttgcagatcaaccagagccccgcgttcagaatcttgcctttcttagggtaccccggtcctcttttttttgccctaaatatagccctttcaatctgggctcagaaatacataaactgaactcacacctgaatgat

SEQ ID NO: 3538 - DNA, 601 bp, Human
aagacacttgcccaaggtcacacagcctgtaagtggcagatcgtggcagtgtccccaggcctggctggctctcaccgctcctctagctgactcccagggttgttatgaagatcaaatgagataacagaaaaaaagaggtggtgagggggctttaaaaaccaacgtccattgcagtggggagtgaatgtgggcattgtcactagagtaggggatgggagtgcaagggggcgtctggccttcagggaccctggggaaccttctggaaggcaagctccaggagggctgggaccgtattggcacycagtggtatttagcacatagtagatgctcaacaaaatggattcaactcaactaaatgaacaggtgggtggagagaaaagaagagtaccgtagtcggggacagtataggattgccagccctgagaaaggagttaccagtccgtggcatctttgggttggcctctgccacctagtccgcagtgacagccgtagggccagtaggagaggatgggcattttcccagtcacttgcttgaccatcttgttcaggttcaggatcccgccctggattggaatcacacctgccaagcagcccagcaacc

SEQ ID NO: 3539 - DNA, 601 bp, Human
tgctttatctatgcattctctcttactccttaaaaccaccatgggatggaggtactcatattatccgctcttcagagatgaagaaactgagactcggggaggtcaagacacttgcccaaggtcacacagcctgtaagtggcagatcgtggcagtgtccccaggcctggctggctctcaccgctcctctagctgactcccagggttgttatgaagatcaaatgagataacagaaaaaaagaggtggtgagggggctttaaaaaccaacgtccattgcagtggggagtgaatgtgggcattgycactagagtaggggatgggagtgcaagggggcgtctggccttcagggaccctggggaaccttctggaaggcaagctccaggagggctgggaccgtattggcacccagtggtatttagcacatagtagatgctcaacaaaatggattcaactcaactaaatgaacaggtgggtggagagaaaagaagagtaccgtagtcggggacagtataggattgccagccctgagaaaggagttaccagtccgtggcatctttgggttggcctctgccacctagtccgcagtgacagccgtagggcca

SEQ ID NO: 3540 - DNA, 601 bp, Human
ctgctccccctactggagaagaacccgtgtccccacctgggaagagtcaaggcctgcagggctgcagtcttcctcaggatcatgatgactaacattttttgagcgattcctatgcactagacacttgctttatctatgcattctctcttactccttaaaaccaccatgggatggaggtactcatattatccgctcttcagagatgaagaaactgagactcggggaggtcaagacacttgcccaaggtcacacagcctgtaagtggcagatcgtggcagtgtccccaggcctggctggctckcaccgctcctctagctgactcccagggttgttatgaagatcaaatgagataacagaaaaaaagaggtggtgagggggctttaaaaaccaacgtccattgcagtggggagtgaatgtgggcattgtcactagagtaggggatgggagtgcaagggggcgtctggccttcagggaccctggggaaccttctggaaggcaagctccaggagggctgggaccgtattggcacccagtggtatttagcacatagtagatgctcaacaaaatggattcaactcaactaaatgaacaggtgggtgga

SEQ ID NO: 3541 - DNA, 601 bp, Human
gttaagcaatgtggtcaccaagctggtcagtcgtgggcctgaattccaggtgctaaaggggccaaacctcccatgggtcctctccatacccccatacccattcttgcctcttcacagcccaactgcagccagtggacccatgcaaaaaaaaaacagagaggtcaagtagctgtgctgtgaaggcagtgggggccagatctcccttcctggggtctccagctcctgccctgaggtctgcgtactcacagcagtggatgttcccctgggaaaagttgtatctgtaatagtccttgtagatgcygcacccctgggtcttcaggtggtcatagcagcagtcatgggtctggcagcacctggagcagacagggtgcacagctgcatgggtccccagcctactggggtctctggctgctccccctactggagaagaacccgtgtccccacctgggaagagtcaaggcctgcagggctgcagtcttcctcaggatcatgatgactaacattttttgagcgattcctatgcactagacacttgctttatctatgcattctctcttactccttaaaaccaccatgggatggaggtactcatattatccgc

SEQ ID NO: 3542 - DNA, 601 bp, Human
ctcaataaatgttggatattattgttactattattatgaagccctcaattaacagcagctgctgtgatgagccctttagattcccagccctgaggacctgctacatttctatgcttgtgatgctggaaaggatgtaggggccaggtgccctgggttccagcccaggctctgtcagttggaggcagacacttccccactctagttttggtttcctggtctgtacaatggagataatcagggttttgccgatcctcgacaggctgccacgagcatcagtgatgatgaaagtaacagccaatcrgtagctctgtgtaatttattatggcaggcatcctgtgaggcccattctgtctgtctcattttagctcttgcaataacttaatggggtagattacagatgaggatactgaggttcagagaggttaagcaatgtggtcaccaagctggtcagtcgtgggcctgaattccaggtgctaaaggggccaaacctcccatgggtcctctccatacccccatacccattcttgcctcttcacagcccaactgcagccagtggacccatgcaaaaaaaaaacagagaggtcaagtagctgtgctgtga

SEQ ID NO: 3543 - DNA, 601 bp, Human
ggtcagaccaagcagagaggtggttccaggagaggcctggcctcagcccgatcccaggaacaatttgagagtgtcattcaacccagacaatgctgcacagacacgggggagctggcaattgtaccctccatggtgtcactctcctggccatgagtgacaggtggcctcttggtgggagaggtggggcagggggaaggcagctcccactagaccagggcagtatttaggggaaggaggcagattggagcagttggctgccaacacctggcctcactcagggagaggggccttgggcctggawgatatctgggtgaggtacccacaccatctgctgcaacctctgtgtatccattatgggctcacgccattcacaggcatgaattgagcacctagtatgtgggaaaacaggggaaacagagatggcacagacatggtctccatccttcgggggctccagtctagttgggggagatcagagaagttccatttgccactctaggccaagctaggtaagcggcagagccatgaagcattgtgggagcttggaggagggagtgagcccttgcagtcagggagaaggagtcagcctggggagacttcc

SEQ ID NO: 3544 - DNA, 601 bp, Human
gtgactgcaggtgcctcagccccctggctggaaacagctagccacacacaaatggcagattgggagtcctcataggaaaaagttgtccctcttcagtctctttccttagaagcagagcctgagacaaggattcttgtgcaaatgctttactgagggagtactttctggagaaacctgtgagggaaccaggaaaactggataggccaaggggtcagaccaagcagagaggtggttccaggagaggcctggcctcagcccgatcccaggaacaatttgagagtgtcattcaacccagacaatsctgcacagacacgggggagctggcaattgtaccctccatggtgtcactctcctggccatgagtgacaggtggcctcttggtgggagaggtggggcagggggaaggcagctcccactagaccagggcagtatttaggggaaggaggcagattggagcagttggctgccaacacctggcctcactcagggagaggggccttgggcctggaagatatctgggtgaggtacccacaccatctgctgcaacctctgtgtatccattatgggctcacgccattcacaggcatgaattgagcaccta

SEQ ID NO: 3545 - DNA, 601 bp, Human
acagaggggagcagccgcgcgctggcaccgtcgtggcagcctcggggtggaaagccgagagggctgcggcactttgggctctgaggacggccccgagcacccgcgaccccctccctgctccgcaaagctctcctgcggcgcttccgagacccccatcagcggaatggacggcgcggggttagatcgcccgtgcgcctgcgagcgaccaggggtaacgggcaggttttcagtccgagtccctgcagcttgccgggccggtctgggtgcggcctccgggatgccttcgccgtcgcagggaccyggggccttggccgactggctgcccccgggactagacccttaaagctcggtcgcagccagtcctgggggtccctctggaggtgccacaaggttctgggccgcggggaaagtgcaggaggcccgggccctctctgggtgtcccgggggcacgcagtactcacccggcaggagcagcgggagcgcggccggcagcggtcgggtcccagccagagcccggagctcctatttaagcccgaggccggcgccccgggccggccaatgaggctccagttcctcctgtcttcgatgctgcacggcctgg

SEQ ID NO: 3546 - DNA, 601 bp, Human
ccggccgcgccgcggaccatggtcagacactgcggtcgggcttggattccagggggcgccccaggaaatccctccccgccgcccgcagggaaccatggcccccagtcacgtcggaccgtgacaccctgtggctgcccctgccgcgacccacctgcgccctccccgtgagcgccccctgcccccaccgcatccccggaaccgcacaccgcaggcgctcggcaaacattctggtgttagagtctcccgacgtcagcacgccccagactgggaagcgccgccgtgcagctgtgcggggggctcsggcgccgcagccctcctggtggagcaggaggcgaggagggggctgtacttacccagcagcgaagaccactgcgcaggggggcggaacagggggtactgcttggggaaggccgtctggctccacttgcccgtgaaggtgatgctgtatttggccggggctctggcggaacagatggactctcccccaagaggctggccggcggcgccgagagtggccaggaggagagcgcagagggccttgcccagggcggcggccgggctggggttttccatcacctgggagcacagaggggagcagccg

SEQ ID NO: 3547 - DNA, 601 bp, Human
gagaaggtgaagccgctgtccgtcccggcgtcgtaggggtacaggtccagcgccgcctgttcccgccaacggtccccgtcgcacaggtccaggctgtccacgcccacgaaccagtcggggctgggcacgatgcgcaccacaaacgagacctgcggcgacagcggctcagcgcgcctggccccggccccccggaccccgcccccggccggccccgcgctcaccagcgagtgcctgcgctgcacctccagctccgccgacgtctgcccggtgccgctggggacggcgggcgccgaaaacacckcgtgcacgctctgcagcgcctcccccgccgcctcgatctccttcatcagcgcccaggcctcgccgcgctccgcaaagtcgcgcagcccgttactgacgtactggttcttcctccacatgctgtagtcggagctatgcgcggcccctgcaggaccacccggccgcgccgcggaccatggtcagacactgcggtcgggcttggattccagggggcgccccaggaaatccctccccgccgcccgcagggaaccatggcccccagtcacgtcggaccgtgacaccctgtggctgcccctgccgc

SEQ ID NO: 3548 - DNA, 601 bp, Human
tctcattgtccctgctgggcaggactggggcgggagggatgaaggccctggggctctgtcgcagccgcagcagtgtcaccctggcgatgggaggcagggccttcagccgcgggtagtagaaggagttggccgggtggctgggagaggaggacgttatctggggaggaagaagaggaggttggcctggggtccgagaagcccaccttctggtatgcgtatggcctcactggggccactgcccagcgtccagcgtgccctctgcaccactgttggggacagggtcccatgtactcctctcagycatcccacggaacacgggctggaaaccgaggccaggaaggggcggcctcctcgggacgcgcgtcccgctgtcctccctgcggtgctgtgaccccgggttgggagagtatgggagggctgcacccccttgctcactgctggcgctagaagcagagcctcttccacacaaaagccgcaagcggctgtcctgggctgggaggcgagggtgcagccaggccccagccccgtccccaccgcgggggccatagcggcccttgcgcacgcggggtgcccactcacctcggtcaccgtgtcctgcggg

SEQ ID NO: 3549 - DNA, 601 bp, Human
agggtggaggacgacggggcccatggccaggttggtgggctccagttcctcctcgggaaagtctgaagtccgctgttgtctggggcctacactgactgtcccacacccatatcaggtgagacccagagacccagagccaacaggccctgacccacgacccagcaatgcgctccagaccacaggcgctccgtgaggccagtggctgccacccagctgagtagggagggaactgccactcggccccagcgttcccagcctgccctgtccagcaggtgcctggaagagctaggagaatgctcaycagcacctgccccgccccaggccaaggcgcctgtgagcagagccccgagctgtgtggtggctgggtcccgagacccccacaggtgccctgcagcatagctgtcacccggtggccacacagggccatcctagcaagcttccttgtcagctgtgacacacaggtcacctgtgggtgcgtgtctgacaggacagagtctctcaggtactgtctggagcctcctttcattctttcctctgggctgtggccctgtaagatgctttcaactgcaaataatgtgcaagagtcacatcttcagtgtgt

SEQ ID NO: 3550 - DNA, 601 bp, Human
catggcttggggggcaggtgtggggcggccccgtacctgcctcaactccagccagcaacatggagggtggaggacgacggggcccatggccaggttggtgggctccagttcctcctcgggaaagtctgaagtccgctgttgtctggggcctacactgactgtcccacacccatatcaggtgagacccagagacccagagccaacaggccctgacccacgacccagcaatgcgctccagaccacaggcgctccgtgaggccagtggctgccacccagctgagtagggagggaactgccactyggccccagcgttcccagcctgccctgtccagcaggtgcctggaagagctaggagaatgctcatcagcacctgccccgccccaggccaaggcgcctgtgagcagagccccgagctgtgtggtggctgggtcccgagacccccacaggtgccctgcagcatagctgtcacccggtggccacacagggccatcctagcaagcttccttgtcagctgtgacacacaggtcacctgtgggtgcgtgtctgacaggacagagtctctcaggtactgtctggagcctcctttcattctttcctctgg

SEQ ID NO: 3551 - DNA, 601 bp, Human
acgacatctgtccctaccacatggcttggggggcaggtgtggggcggccccgtacctgcctcaactccagccagcaacatggagggtggaggacgacggggcccatggccaggttggtgggctccagttcctcctcgggaaagtctgaagtccgctgttgtctggggcctacactgactgtcccacacccatatcaggtgagacccagagacccagagccaacaggccctgacccacgacccagcaatgcgctccagaccacaggcgctccgtgaggccagtggctgccacccagctgagyagggagggaactgccactcggccccagcgttcccagcctgccctgtccagcaggtgcctggaagagctaggagaatgctcatcagcacctgccccgccccaggccaaggcgcctgtgagcagagccccgagctgtgtggtggctgggtcccgagacccccacaggtgccctgcagcatagctgtcacccggtggccacacagggccatcctagcaagcttccttgtcagctgtgacacacaggtcacctgtgggtgcgtgtctgacaggacagagtctctcaggtactgtctggagcctc

SEQ ID NO: 3552 - DNA, 601 bp, Human
gcaaccacgtgggagccaggcccctggacgatgaaggacaatctcctggagcagcaataacttataaggagacataatttagagtagctggagccttggggatgactttatcctgcaggaggaggaggctgagagcagacgggacacgggggcccctaagaagcaaggttgggaaaggaggaggctgtttcccaatgcccgtgccggccaccagagggcccttcagtgcagagatggtcggcgcggcctcaccgcggtcaggagcagcgcgaaaccccctgtgccctcggccgcctgcagyatgagcctgcacaggagcccccgacaccccatggctccggggggccccaggggctgcggggctctggtcttagacgcagttatcagggacgcactcagcctcttcttcgagctcggggcaggggctcccgttgttggcgggctggacccggacgtagcgagtcctgctcttggtcccgagcctcccacagtggcctccgcacagtccccaggacgaccacagggagacctcgcagtccagcggcgtttctggaactggaccaagcaaaggggagaccgaggtgaacgctcgcgtgaagag

SEQ ID NO: 3553 - DNA, 601 bp, Human; identical to SEQ ID NO: 1555

SEQ ID NO: 3554 - DNA, 601 bp, Human
aggagctgacataatttaactacttgtttgtggggaaaaaaattggttgcctgcgaggaaaataatattgagtctgtatgttatgcaaatatatttcgtgacaaaaaaacaaaaacagaaacaaaaccttgtgggaaccagcatatgaagaaagtgacttgaaaaccattacacagtctagaaaggtgggttcttacattgatctctgatttcagctggaggtccacgctgctgccattaaatccctgggagagctcgacgtctttctagcctggattaataagaatcatgaagtaatgtyctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaatagccaaaaagtctactgtggtatttgtaataaactctatctgctgaaagggcctgcaggccatcctgggagtaaagggctgccttcccatctaatttattgtaaagtcatatagtccatgtctgtgatgtgagcc

SEQ ID NO: 3555 - DNA, 601 bp, Human
tccatgagttgttaatcacaaattacaattgaacaatgcctgaataaaatcaggcttcagatttcatattagaatattagatcctgactttgacctctgattctcacaagtgcaaaatattccctaatctttccccacctttctgcattcaactgcacatcctagaacaataatattgaagatctatttaatgttttacctttgcagtgatatgtcttgtcattcccttgatgatccgaagaagcattttgaaggtttaattctacttggaatatttcctgtttggttcctgaaatggagmttttattgcccttaagtttcctttgctgcctctttgggtcctgggccagactcacttctgagtaggttcctctttgtttattcatctctgcagctgtgtgatgtcagggactgtgctctatgataactgcacttaagaagctataagtggtgtatattttgacaggatccctggtataggcaaactgcatgtgttggaggctgagtagtaatgttcattttgctgttgaccaatataaaagtctggtactaatttcctaaagttttaaactgaaatctctttaaacaataggtcactttt

SEQ ID NO: 3556 - DNA, 601 bp, Human
tacctagaaaaattaaagtgattcttacaaaattaatatctagacaaattataataaattcagttgcttactttgaaatacaaaatttaaaattattttaaattggaacaatctgaaataaaaatgacttttctataaaaataatgagatctttaaaacaaatatttttaaagccattagcataaaacttcaccatctcttatagtatttgatctaaccactttcaaaaattaatttgtttttctaaatattttttctcttaaaacatgtctttgagtcatgaaatcagaatacatctctstgtgtgtgtatcatatatacatatatatttagtacacacaaaaaaataaatgttttctacaattattctgttatttataaatttgaaaagttcagaagcagcatattatcttggggttcagagatatacattaaacagagaattctaatcctcattattatgaaatgtttcaaggcgcttccaatcattatagtgaaaagttcccttataatctttcaagaatatgcttacaaggaataagaactattgtttttaacacagtggccatcaggacaatgcaaatgattcctaggacctcag

SEQ ID NO: 3557 - DNA, 601 bp, Human
taagtatagtaaaattatttatctcttatcatcttatagtagtaggaaatttcagttaattaaatgcaacaagagggtataatgattttaactgagcatttctacttattattggagaaaaggacatgccctcatataatctttattttataaacatttatggctcaatgttatagtttattttcccaaaacattttattatcattttgcatccctttagagacaaaatataaactgtactaacatcagaacattgacaatcataatgtacctttctgcattcttctattcagggaaaaaytgttctgctccagtactccaatacctagaaaaattaaagtgattcttacaaaattaatatctagacaaattataataaattcagttgcttactttgaaatacaaaatttaaaattattttaaattggaacaatctgaaataaaaatgacttttctataaaaataatgagatctttaaaacaaatatttttaaagccattagcataaaacttcaccatctcttatagtatttgatctaaccactttcaaaaattaatttgtttttctaaatattttttctcttaaaacatgtctttgagtc

SEQ ID NO: 3558 - DNA, 601 bp, Human
aacgagtcactcatacgcacatgcacaataaaaggtccacctctcatcccttaattgtgttcccatacaaaacaagcccgccaacaaaaatccaccctacacatcttaaacatcactgaacaaaactgctttttaagtatagtaaaattatttatctcttatcatcttatagtagtaggaaatttcagttaattaaatgcaacaagagggtataatgattttaactgagcatttctacttattattggagaaaaggacatgccctcatataatctttattttataaacatttatggctcawtgttatagtttattttcccaaaacattttattatcattttgcatccctttagagacaaaatataaactgtactaacatcagaacattgacaatcataatgtacctttctgcattcttctattcagggaaaaactgttctgctccagtactccaatacctagaaaaattaaagtgattcttacaaaattaatatctagacaaattataataaattcagttgcttactttgaaatacaaaatttaaaattattttaaattggaacaatctgaaataaaaatgacttttctataaaaataatg

SEQ ID NO: 3559 - DNA, 601 bp, Human
gcaaactctttcttcccaagttcttctttccttaccaatgtaataacaactgttggaatatgtaatccactcctcaggacaatggccacaatgacgtgctaaataaaaatatgaattactatgcaaaacaatatgtttacaaatgaaaattattttatatatttgcaaagctataaacatacaggtacacaatatctgcatcctcataagttgttaaatatatattttaaaataacgagtcactcatacgcacatgcacaataaaaggtccacctctcatcccttaattgtgttcccatayaaaacaagcccgccaacaaaaatccaccctacacatcttaaacatcactgaacaaaactgctttttaagtatagtaaaattatttatctcttatcatcttatagtagtaggaaatttcagttaattaaatgcaacaagagggtataatgattttaactgagcatttctacttattattggagaaaaggacatgccctcatataatctttattttataaacatttatggctcaatgttatagtttattttcccaaaacattttattatcattttgcatccctttagagacaaaatataaac

SEQ ID NO: 3560 - DNA, 601 bp, Human
cccgttcagggttggggctcggtgggaacctccccgtgcccgaagggacgaccccgtcagagagtcccccgacccttgcacctaccgtccttggcaggacgtggagctgctcggaagccattccgggttggcccccttacccgtgtgccacgacccctcggcgggcccctgccgcccgagtgccctcaccgccagcctccggagcggcggagtctcggcttccccgagcacgagcggcctgtcctgcctgtccagctcccgctcagcccgctgccggccccgtctccccgagcgcccgagsactgggaggggtggaacagggtccctccgatctccggggattccctgcggggcgccccaaccaatccttagggcccaaggctacgcgctcggcagccggctcctccggagcgtccccggacgcgagccccggcgccgcctcgccctggctcccccctcggacccgctggggctgactctgcgctcttggccgcggggcttttcccggccctccgtccccaccctccgcgactcaggagccgccagtgctccgaggctcccccggcccaaggcgctcgggggcggtgcggggcgccccctg

SEQ ID NO: 3561 - DNA, 601 bp, Human
gtcactcacctccggctaacaaggaaatcggcagagcctcaggggacctggcccagctgggcctctctggcctgcccagcccctggttgaccctccccgccccaccctgccccctcagccaccccactcacaatgttcatgagtgtcagcaggtacttctgtacgtgctccttcccgtggaactgcaccacagagtcatccacgcccagcaggacctcgatgttgtagtcatcgtctgcagcatgcctgcgtgccctccgcctcgagctgttggcgtgctcctctaggatgcccagggcgyggctgaggctgtccaggctgtccagggaggcccctgcaaggagaggacaccgtcttcagcggcagggcaaacccacccggacacaaacctaccaggcgccagcttggccatcctctcatttaaaactcatagcaccctgaaccgagggtattattccattttacagaggaaagcgaggtgcagaggaagatggcagagacttgccaagctgtctcagacacagcagggcccagacaggcacctctgtgacttccaggaccgctcgttccccagcccctggtggcaaccccagccacagca

SEQ ID NO: 3562 - DNA, 601 bp, Human
cctgagactgtgtcactcacctccggctaacaaggaaatcggcagagcctcaggggacctggcccagctgggcctctctggcctgcccagcccctggttgaccctccccgccccaccctgccccctcagccaccccactcacaatgttcatgagtgtcagcaggtacttctgtacgtgctccttcccgtggaactgcaccacagagtcatccacgcccagcaggacctcgatgttgtagtcatcgtctgcagcatgcctgcgtgccctccgcctcgagctgttggcgtgctcctctaggaygcccagggcgcggctgaggctgtccaggctgtccagggaggcccctgcaaggagaggacaccgtcttcagcggcagggcaaacccacccggacacaaacctaccaggcgccagcttggccatcctctcatttaaaactcatagcaccctgaaccgagggtattattccattttacagaggaaagcgaggtgcagaggaagatggcagagacttgccaagctgtctcagacacagcagggcccagacaggcacctctgtgacttccaggaccgctcgttccccagcccctggtggcaaccc

SEQ ID NO: 3563 - DNA, 601 bp, Human
tgagacagagtctcgcactgtctcccaggctggagcaaagtggtgcgatctcgactcattgcaaactccgcctcccgggttcacaccattctcctgcctcagcctcccgggtagctgggactacaggcgcccgccaccatgccctgctaatttttttgtatttttattagagacggggtttcaccatgttagccaagatggtctcgatctcctgacctcgtgatctacctgcctccgactcccaaagtgctgggattacaggtgtgaaccaccgcgcccggccttttgtctctttttaaaraaaacatctcttactccaagaacatggagccatccacctacgttatcttctttcattattttgcgtttcttatttagacctaaaatccatgtgagatgctctctgtctatagagtgagtggaggtgacaggcctcctttctttccaaattggccccacaccatttgttaggctgttttcctcctcttctctgaaatgtcacttttgtgacacattagcgtccctatacacataggtccaattcaggacactggattctcttctaatgatgtatttgtccatcagtgcactgccccacacc

SEQ ID NO: 3564 - DNA, 601 bp, Human
tgcctttaatgcacaaacttttgaaatgtgctactatttatcagttttttccattgagttcatggtttgtttggttttttttgtctcttttttttttgagacagagtctcgcactgtctcccaggctggagcaaagtggtgcgatctcgactcattgcaaactccgcctcccgggttcacaccattctcctgcctcagcctcccgggtagctgggactacaggcgcccgccaccatgccctgctaatttttttgtatttttattagagacggggtttcaccatgttagccaagatggtctygatctcctgacctcgtgatctacctgcctccgactcccaaagtgctgggattacaggtgtgaaccaccgcgcccggccttttgtctctttttaaagaaaacatctcttactccaagaacatggagccatccacctacgttatcttctttcattattttgcgtttcttatttagacctaaaatccatgtgagatgctctctgtctatagagtgagtggaggtgacaggcctcctttctttccaaattggccccacaccatttgttaggctgttttcctcctcttctctgaaatgtcacttt

SEQ ID NO: 3565 - DNA, 601 bp, Human
catgcccagcctcattgttttaattgcatttttccaatgtctagtgaggttgagtgccttttcatatgtttattgctcattcatattttgtcaagagcctgataagagtctcctgcccattatctgactggattgtctttattatccttattatgatttgtaggcgttcttcacatacttcagatataaatccttttttataaatatttcccccagtggattagcgtgcctttaatgcacaaacttttgaaatgtgctactatttatcagttttttccattgagttcatggtttgtttggktttttttgtctcttttttttttgagacagagtctcgcactgtctcccaggctggagcaaagtggtgcgatctcgactcattgcaaactccgcctcccgggttcacaccattctcctgcctcagcctcccgggtagctgggactacaggcgcccgccaccatgccctgctaatttttttgtatttttattagagacggggtttcaccatgttagccaagatggtctcgatctcctgacctcgtgatctacctgcctccgactcccaaagtgctgggattacaggtgtgaaccaccgcgccc

SEQ ID NO: 3566 - DNA, 601 bp, Human
ccatgcccagcctcattgttttaattgcatttttccaatgtctagtgaggttgagtgccttttcatatgtttattgctcattcatattttgtcaagagcctgataagagtctcctgcccattatctgactggattgtctttattatccttattatgatttgtaggcgttcttcacatacttcagatataaatccttttttataaatatttcccccagtggattagcgtgcctttaatgcacaaacttttgaaatgtgctactatttatcagttttttccattgagttcatggtttgtttgkttttttttgtctcttttttttttgagacagagtctcgcactgtctcccaggctggagcaaagtggtgcgatctcgactcattgcaaactccgcctcccgggttcacaccattctcctgcctcagcctcccgggtagctgggactacaggcgcccgccaccatgccctgctaatttttttgtatttttattagagacggggtttcaccatgttagccaagatggtctcgatctcctgacctcgtgatctacctgcctccgactcccaaagtgctgggattacaggtgtgaaccaccgcgcc

SEQ ID NO: 3567 - DNA, 601 bp, Human
agtggtgtgatcatagctcacttcctgggctcaaacaatcctcccacctcaggttcccgagtggctgggactacaggcatccaccaccatgcccagcctcattgttttaattgcatttttccaatgtctagtgaggttgagtgccttttcatatgtttattgctcattcatattttgtcaagagcctgataagagtctcctgcccattatctgactggattgtctttattatccttattatgatttgtaggcgttcttcacatacttcagatataaatccttttttataaatatttccccyagtggattagcgtgcctttaatgcacaaacttttgaaatgtgctactatttatcagttttttccattgagttcatggtttgtttggttttttttgtctcttttttttttgagacagagtctcgcactgtctcccaggctggagcaaagtggtgcgatctcgactcattgcaaactccgcctcccgggttcacaccattctcctgcctcagcctcccgggtagctgggactacaggcgcccgccaccatgccctgctaatttttttgtatttttattagagacggggtttcaccatgttag

SEQ ID NO: 3568 - DNA, 601 bp, Human
gctgtgtcggtttcccctcctaggggatagctctgctccccattagtgccctccccaagacaaaacagccaacagcactctcatcacatggtcagggcaacacctggctgcgctgtgtttgaggggagctatccactcctcacccagacatggtagtttcagtctttttaacctagctatgctattaggtgcgtcttgatatttcattgtgtttttaaattttcctttttttttttttttgtaagacaaggcctcgctctgtcacccaggctggagtgcagtggtgtgatcatagctcacytcctgggctcaaacaatcctcccacctcaggttcccgagtggctgggactacaggcatccaccaccatgcccagcctcattgttttaattgcatttttccaatgtctagtgaggttgagtgccttttcatatgtttattgctcattcatattttgtcaagagcctgataagagtctcctgcccattatctgactggattgtctttattatccttattatgatttgtaggcgttcttcacatacttcagatataaatccttttttataaatatttcccccagtggattagcgtgcctttaa

SEQ ID NO: 3569 - DNA, 601 bp, Human
tgagccaccacacccagccaatttcacatttttaaatgagggatcaggtcacttaatataaaagctgtgtcggtttcccctcctaggggatagctctgctccccattagtgccctccccaagacaaaacagccaacagcactctcatcacatggtcagggcaacacctggctgcgctgtgtttgaggggagctatccactcctcacccagacatggtagtttcagtctttttaacctagctatgctattaggtgcgtcttgatatttcattgtgtttttaaattttccttttttttttttyttgtaagacaaggcctcgctctgtcacccaggctggagtgcagtggtgtgatcatagctcacttcctgggctcaaacaatcctcccacctcaggttcccgagtggctgggactacaggcatccaccaccatgcccagcctcattgttttaattgcatttttccaatgtctagtgaggttgagtgccttttcatatgtttattgctcattcatattttgtcaagagcctgataagagtctcctgcccattatctgactggattgtctttattatccttattatgatttgtaggcgttcttc

SEQ ID NO: 3570 - DNA, 601 bp, Human
cattacaggagcctgcgagatctgaaagcgcatctttatgtttttctttgttttcttccctcttattttactttgtggctgttttctctctccggaatcttattagatagagtgtgcctcctcgatggagggtctgtctcctaacttttctctcatgttaatctttttgtcttttgctcccattgggagatggccttgactttttatttcagctttcgattttttttttttttttttgagatggagtctcactctgccgtccaggctggagtgcagtggtgtgatctcggctcactgcaasctccgcctcctgggttcagtccattctactgcctcagcctcctgagtagctgggactacaggcacccgccaccatgctcagctaatttttgtatttttactagagacgggatttcaccatgttagccaggatggtctccatctcctgacctcgtgacctgcccgcctcggcctcccacagtgctgggattacaggcgtgagccaccgcgccccgtctacctttcgaattttttacttcccccatcctatccataattttatacaaatggtttgttgttctctaatttttcatagaaaact

SEQ ID NO: 3571 - DNA, 601 bp, Human
tgggaagacaggagaccacaccccaagtggctttgacacagggcgtgtccctcttaaggcacagaggagaagtgggcagccagggctggggatcctagggtggcccctctgtgccccacccttccccaggccacttacacgtggccagtctcatgggccaccacaaacgctgaggagaagccgtcctcatggttcagggtgcagctgcggaccggatggcacatgccggtgacaggagcatagcctgggaggagacaagaggcggctccagatgctgccatagcctggccgggaaggtgargcctggcctaactcccaggcgctgcttctcctcaaggccccaatgccctctctaccacaggcaactgcccccggctggcacagctcagaagacaccacagcagacagctcatagcctgtgacatctggctgacagcaggcccccagcccgtcaccacacaagccccgtggccgttctgcctgtaacagccacactgcagctggggccctctgcttagtcagatgtcacctgctatggcttgtctgacacctgactttcctgcctgccgttctctttcacgccacctgcctctgccccctg

SEQ ID NO: 3572 - DNA, 601 bp, Human
ggggcaaggtccccagctctagctggcccagagcgcctgctcagtctgcaggcaagcccttcctccttcaattggttccttcagcaaaagtgggcctcgggccagcactgcccagcgctgggaagacaggagaccacaccccaagtggctttgacacagggcgtgtccctcttaaggcacagaggagaagtgggcagccagggctggggatcctagggtggcccctctgtgccccacccttccccaggccacttacacgtggccagtctcatgggccaccacaaacgctgaggagaagccrtcctcatggttcagggtgcagctgcggaccggatggcacatgccggtgacaggagcatagcctgggaggagacaagaggcggctccagatgctgccatagcctggccgggaaggtgaggcctggcctaactcccaggcgctgcttctcctcaaggccccaatgccctctctaccacaggcaactgcccccggctggcacagctcagaagacaccacagcagacagctcatagcctgtgacatctggctgacagcaggcccccagcccgtcaccacacaagccccgtggccgttctgcctg

SEQ ID NO: 3573 - DNA, 601 bp, Human
tccgagcctcctctataacatggggtagagcccaccctgcctgggggcttggatgtgataatggggcaaggtccccagctctagctggcccagagcgcctgctcagtctgcaggcaagcccttcctccttcaattggttccttcagcaaaagtgggcctcgggccagcactgcccagcgctgggaagacaggagaccacaccccaagtggctttgacacagggcgtgtccctcttaaggcacagaggagaagtgggcagccagggctggggatcctagggtggcccctctgtgccccaccyttccccaggccacttacacgtggccagtctcatgggccaccacaaacgctgaggagaagccgtcctcatggttcagggtgcagctgcggaccggatggcacatgccggtgacaggagcatagcctgggaggagacaagaggcggctccagatgctgccatagcctggccgggaaggtgaggcctggcctaactcccaggcgctgcttctcctcaaggccccaatgccctctctaccacaggcaactgcccccggctggcacagctcagaagacaccacagcagacagctcatagcctgtg

SEQ ID NO: 3574 - DNA, 601 bp, Human
ccacaggcctgccctctctgcagcctcggcctcccctggacttcacagtcctgttccctggcctttctgcttcctgtcctgatagcacttcctgcaggacgtccctgagggatcagctgaaactcagacgtggccctgagcctcccctactcaagcctttccagagcccccatcgccatgagaatcgagtccactgtgctccttagggagtcttggaaggaggtggccctcctgcgttggtactcgactctaccacttgctcgctttgtgggctcaggcaggttacctagcctctccgggyctctgtttcctcatctgtaaaatgggactactttgcttctttccttcatgcagcagaggcgagcattaagacgctcatagacactgaagctcccacagtgtggcctccatgccgatggccggttcctctgacggctcagccctggcacttggccctggagagcagcgagtgctcctgtgcctgccgcgctctcctccaggcctctgcgtccgtggcctctgcgtccgtggccctcccttcctgaatgccctctccttccgcttagcctgcaggcctcccttcttccttgggagccctcct

SEQ ID NO: 3575 - DNA, 601 bp, Human
ggcacctgctgaccctttgccgtggatttccctcctaaaccctggcgaagccctacccccacccccacaggcctgccctctctgcagcctcggcctcccctggacttcacagtcctgttccctggcctttctgcttcctgtcctgatagcacttcctgcaggacgtccctgagggatcagctgaaactcagacgtggccctgagcctcccctactcaagcctttccagagcccccatcgccatgagaatcgagtccactgtgctccttagggagtcttggaaggaggtggccctcctgcgytggtactcgactctaccacttgctcgctttgtgggctcaggcaggttacctagcctctccgggtctctgtttcctcatctgtaaaatgggactactttgcttctttccttcatgcagcagaggcgagcattaagacgctcatagacactgaagctcccacagtgtggcctccatgccgatggccggttcctctgacggctcagccctggcacttggccctggagagcagcgagtgctcctgtgcctgccgcgctctcctccaggcctctgcgtccgtggcctctgcgtccgtggccctcc

SEQ ID NO: 3576 - DNA, 601 bp, Human
cctggacgcggctgggcctctctgcctccagtctttggaggctgcacacctcagggagcctggcgggcagctgggccctaagtgccagcctgaggctaggtgggcacctgctgaccctttgccgtggatttccctcctaaaccctggcgaagccctacccccacccccacaggcctgccctctctgcagcctcggcctcccctggacttcacagtcctgttccctggcctttctgcttcctgtcctgatagcacttcctgcaggacgtccctgagggatcagctgaaactcagacgtggcyctgagcctcccctactcaagcctttccagagcccccatcgccatgagaatcgagtccactgtgctccttagggagtcttggaaggaggtggccctcctgcgttggtactcgactctaccacttgctcgctttgtgggctcaggcaggttacctagcctctccgggtctctgtttcctcatctgtaaaatgggactactttgcttctttccttcatgcagcagaggcgagcattaagacgctcatagacactgaagctcccacagtgtggcctccatgccgatggccggttcctctgacgg

SEQ ID NO: 3577 - DNA, 601 bp, Human
attacagattgtcaatattttcaggcaaatcaaaatctttaaaataccagacaggccaaaaaggaaagaccgaagctctgtgtgtctaagcagctgcagggcctgcggcgtaagagcccgctgcgcaggtgggagacgggggtaacgctgatgtttgtggagggttctccctccatgccagcccccccgggacactccctgggtgaggccagggtgagcgttcaggcaggaggagacaggcagtggaggagggagaggagggtgtggatgagaaagtggctgcgggctgaggagggagcaygggcccgggagatatttacggggtgtgtgggggtgaggtgggaggaatgagaaggggcaggaggacagcacagggcatggggcctgcgtggcgggtggggctgaggtatagctgagcatggggatgcagctggcatgggccggctctacaggttgtccctcccctgggcagccagacactgatgacaaatcccgaccctgccctcacctggctgcaaacagctgcccaggtgctagcatcgggggggctgagagaccacccccgcttacccccatttccccagctcggtcctccctcctc

SEQ ID NO: 3578 - DNA, 601 bp, Human
ggccgcagaggccggagcgcagcagccgggacgcacccggagccctgcccgccagctggtaactgggcccggctgtgcatctgtgatgcccaatttggaggctggaaatctgttttgtttgtttttctaatgtgaaattacagattgtcaatattttcaggcaaatcaaaatctttaaaataccagacaggccaaaaaggaaagaccgaagctctgtgtgtctaagcagctgcagggcctgcggcgtaagagcccgctgcgcaggtgggagacgggggtaacgctgatgtttgtggagggytctccctccatgccagcccccccgggacactccctgggtgaggccagggtgagcgttcaggcaggaggagacaggcagtggaggagggagaggagggtgtggatgagaaagtggctgcgggctgaggagggagcacgggcccgggagatatttacggggtgtgtgggggtgaggtgggaggaatgagaaggggcaggaggacagcacagggcatggggcctgcgtggcgggtggggctgaggtatagctgagcatggggatgcagctggcatgggccggctctacaggttgtccctcccc

SEQ ID NO: 3579 - DNA, 601 bp, Human
ttcgcttcactgggaacagcaccaacccacacactgcctcttgaggttctaaatgcccagcaatctctttccgagtctggcgtaaaagccccaggggtgcttgaggaggggccacggggctccctgtctgcttctggccgggagggcagcctggagcctggggcaggaggacagcaggggtaggagagggctccatgcacgagcgtgttcacacgtgctgctgagggaggctgtcccactgcgggatccctccgcggagccgtgactgcgggtcctctctggctccgcagggtccagctcrggcctggccagagcaaggagagcagcccgagtgaacaggacccaggagcggccgcagaggccggagcgcagcagccgggacgcacccggagccctgcccgccagctggtaactgggcccggctgtgcatctgtgatgcccaatttggaggctggaaatctgttttgtttgtttttctaatgtgaaattacagattgtcaatattttcaggcaaatcaaaatctttaaaataccagacaggccaaaaaggaaagaccgaagctctgtgtgtctaagcagctgcagggcctgcggcgtaaga

SEQ ID NO: 3580 - DNA, 601 bp, Human
ccagagtcccggtgctgcagttctcagcaagtgtcttggcacaaagcagacgcatcacggccgctgggttttctccctgtggagaaggcgggctgcgtttctgcaacgtcttcgcttcactgggaacagcaccaacccacacactgcctcttgaggttctaaatgcccagcaatctctttccgagtctggcgtaaaagccccaggggtgcttgaggaggggccacggggctccctgtctgcttctggccgggagggcagcctggagcctggggcaggaggacagcaggggtaggagagggmtccatgcacgagcgtgttcacacgtgctgctgagggaggctgtcccactgcgggatccctccgcggagccgtgactgcgggtcctctctggctccgcagggtccagctcgggcctggccagagcaaggagagcagcccgagtgaacaggacccaggagcggccgcagaggccggagcgcagcagccgggacgcacccggagccctgcccgccagctggtaactgggcccggctgtgcatctgtgatgcccaatttggaggctggaaatctgttttgtttgtttttctaatgtgaaattac

SEQ ID NO: 3581 - DNA, 601 bp, Human
ggcatgctgaggccccagagtcccggtgctgcagttctcagcaagtgtcttggcacaaagcagacgcatcacggccgctgggttttctccctgtggagaaggcgggctgcgtttctgcaacgtcttcgcttcactgggaacagcaccaacccacacactgcctcttgaggttctaaatgcccagcaatctctttccgagtctggcgtaaaagccccaggggtgcttgaggaggggccacggggctccctgtctgcttctggccgggagggcagcctggagcctggggcaggaggacagcasgggtaggagagggctccatgcacgagcgtgttcacacgtgctgctgagggaggctgtcccactgcgggatccctccgcggagccgtgactgcgggtcctctctggctccgcagggtccagctcgggcctggccagagcaaggagagcagcccgagtgaacaggacccaggagcggccgcagaggccggagcgcagcagccgggacgcacccggagccctgcccgccagctggtaactgggcccggctgtgcatctgtgatgcccaatttggaggctggaaatctgttttgtttgtttttc

SEQ ID NO: 3582 - DNA, 601 bp, Human
ctcctctgcagctggccctgggcaccgagcctagcacagaaagaggcatgctgaggccccagagtcccggtgctgcagttctcagcaagtgtcttggcacaaagcagacgcatcacggccgctgggttttctccctgtggagaaggcgggctgcgtttctgcaacgtcttcgcttcactgggaacagcaccaacccacacactgcctcttgaggttctaaatgcccagcaatctctttccgagtctggcgtaaaagccccaggggtgcttgaggaggggccacggggctccctgtctgctyctggccgggagggcagcctggagcctggggcaggaggacagcaggggtaggagagggctccatgcacgagcgtgttcacacgtgctgctgagggaggctgtcccactgcgggatccctccgcggagccgtgactgcgggtcctctctggctccgcagggtccagctcgggcctggccagagcaaggagagcagcccgagtgaacaggacccaggagcggccgcagaggccggagcgcagcagccgggacgcacccggagccctgcccgccagctggtaactgggcccggctgtgcatctg

SEQ ID NO: 3583 - DNA, 601 bp, Human
cagcactgatgcctgggcttggagatgaacaggaagctgtgattgggtgtttaggttctgtgttccccacagggcgaaaaccccagcacggcaggagctgagtgagtctcctctgcagctggccctgggcaccgagcctagcacagaaagaggcatgctgaggccccagagtcccggtgctgcagttctcagcaagtgtcttggcacaaagcagacgcatcacggccgctgggttttctccctgtggagaaggcgggctgcgtttctgcaacgtcttcgcttcactgggaacagcaccaasccacacactgcctcttgaggttctaaatgcccagcaatctctttccgagtctggcgtaaaagccccaggggtgcttgaggaggggccacggggctccctgtctgcttctggccgggagggcagcctggagcctggggcaggaggacagcaggggtaggagagggctccatgcacgagcgtgttcacacgtgctgctgagggaggctgtcccactgcgggatccctccgcggagccgtgactgcgggtcctctctggctccgcagggtccagctcgggcctggccagagcaaggagagcag

SEQ ID NO: 3584 - DNA, 601 bp, Human
ttgtccagcctgtcaggcctcagagtgaagctcttgaaaggacaggacaggatggccacatcctccctcctggggttcctgtggggaggcagcatctgctcacagccctggtgccacctcctccccagcactgatgcctgggcttggagatgaacaggaagctgtgattgggtgtttaggttctgtgttccccacagggcgaaaaccccagcacggcaggagctgagtgagtctcctctgcagctggccctgggcaccgagcctagcacagaaagaggcatgctgaggccccagagtcccrgtgctgcagttctcagcaagtgtcttggcacaaagcagacgcatcacggccgctgggttttctccctgtggagaaggcgggctgcgtttctgcaacgtcttcgcttcactgggaacagcaccaacccacacactgcctcttgaggttctaaatgcccagcaatctctttccgagtctggcgtaaaagccccaggggtgcttgaggaggggccacggggctccctgtctgcttctggccgggagggcagcctggagcctggggcaggaggacagcaggggtaggagagggctccatgcacg

SEQ ID NO: 3585 - DNA, 601 bp, Human
ttggccgggctggaggagaaagcaaaggccttgccgctccgtgccattggaaagaggcagcacccgggtgcccttgtgagatctttttaggggggatccctaagtctcaggtgtccggggggcagctctgctgagcaaagggaccttgccctgccatgtcctagctgtaagacctgggcagttgtccagcctgtcaggcctcagagtgaagctcttgaaaggacaggacaggatggccacatcctccctcctggggttcctgtggggaggcagcatctgctcacagccctggtgccacctyctccccagcactgatgcctgggcttggagatgaacaggaagctgtgattgggtgtttaggttctgtgttccccacagggcgaaaaccccagcacggcaggagctgagtgagtctcctctgcagctggccctgggcaccgagcctagcacagaaagaggcatgctgaggccccagagtcccggtgctgcagttctcagcaagtgtcttggcacaaagcagacgcatcacggccgctgggttttctccctgtggagaaggcgggctgcgtttctgcaacgtcttcgcttcactgggaacagc

SEQ ID NO: 3586 - DNA, 601 bp, Human
agtacaggtcccactggcggcactgctcctcgcggaagtcagccagggagtcggggcagtcctggcggctgcagagctggaagtcgtaggcaaggcccgagcaggtgcggcccccgttggccgggctggaggagaaagcaaaggccttgccgctccgtgccattggaaagaggcagcacccgggtgcccttgtgagatctttttaggggggatccctaagtctcaggtgtccggggggcagctctgctgagcaaagggaccttgccctgccatgtcctagctgtaagacctgggcagttgyccagcctgtcaggcctcagagtgaagctcttgaaaggacaggacaggatggccacatcctccctcctggggttcctgtggggaggcagcatctgctcacagccctggtgccacctcctccccagcactgatgcctgggcttggagatgaacaggaagctgtgattgggtgtttaggttctgtgttccccacagggcgaaaaccccagcacggcaggagctgagtgagtctcctctgcagctggccctgggcaccgagcctagcacagaaagaggcatgctgaggccccagagtcccggtg

SEQ ID NO: 3587 - DNA, 601 bp, Human
cctcccagaagggctcaccatcccggtgctcgtggggcagccagtggtgctgggcgtcgccgtgctcgaagtacaggtcccactggcggcactgctcctcgcggaagtcagccagggagtcggggcagtcctggcggctgcagagctggaagtcgtaggcaaggcccgagcaggtgcggcccccgttggccgggctggaggagaaagcaaaggccttgccgctccgtgccattggaaagaggcagcacccgggtgcccttgtgagatctttttaggggggatccctaagtctcaggtgtcyggggggcagctctgctgagcaaagggaccttgccctgccatgtcctagctgtaagacctgggcagttgtccagcctgtcaggcctcagagtgaagctcttgaaaggacaggacaggatggccacatcctccctcctggggttcctgtggggaggcagcatctgctcacagccctggtgccacctcctccccagcactgatgcctgggcttggagatgaacaggaagctgtgattgggtgtttaggttctgtgttccccacagggcgaaaaccccagcacggcaggagctgagtgagtctc

SEQ ID NO: 3588 - DNA, 601 bp, Human
aagcccccaccctgcccaccctagggcctgcctgctgagcccccactgatgcctcccagaagggctcaccatcccggtgctcgtggggcagccagtggtgctgggcgtcgccgtgctcgaagtacaggtcccactggcggcactgctcctcgcggaagtcagccagggagtcggggcagtcctggcggctgcagagctggaagtcgtaggcaaggcccgagcaggtgcggcccccgttggccgggctggaggagaaagcaaaggccttgccgctccgtgccattggaaagaggcagcaccygggtgcccttgtgagatctttttaggggggatccctaagtctcaggtgtccggggggcagctctgctgagcaaagggaccttgccctgccatgtcctagctgtaagacctgggcagttgtccagcctgtcaggcctcagagtgaagctcttgaaaggacaggacaggatggccacatcctccctcctggggttcctgtggggaggcagcatctgctcacagccctggtgccacctcctccccagcactgatgcctgggcttggagatgaacaggaagctgtgattgggtgtttaggttct

SEQ ID NO: 3589 - DNA, 601 bp, Human
cagccttgccccatgcaggatcagaggcacaagcccccaccctgcccaccctagggcctgcctgctgagcccccactgatgcctcccagaagggctcaccatcccggtgctcgtggggcagccagtggtgctgggcgtcgccgtgctcgaagtacaggtcccactggcggcactgctcctcgcggaagtcagccagggagtcggggcagtcctggcggctgcagagctggaagtcgtaggcaaggcccgagcaggtgcggcccccgttggccgggctggaggagaaagcaaaggccttgcygctccgtgccattggaaagaggcagcacccgggtgcccttgtgagatctttttaggggggatccctaagtctcaggtgtccggggggcagctctgctgagcaaagggaccttgccctgccatgtcctagctgtaagacctgggcagttgtccagcctgtcaggcctcagagtgaagctcttgaaaggacaggacaggatggccacatcctccctcctggggttcctgtggggaggcagcatctgctcacagccctggtgccacctcctccccagcactgatgcctgggcttggagatgaa

SEQ ID NO: 3590 - DNA, 601 bp, Human
gggcaacagccatggaggagaaacaaggactgtgtttacagtccgtcccaggagggtccccagctgccacacaagcactgccatgcccaaggccaccagactcctcaggtccctgagccaataaatgccttctagtgctgaaaccggttggagtcaactttctgacactcgcaactgagagtcccgactaatagagaaggtcagaggtcaccagattccttggcagggtcagccctggcctcagccctgagctgaccacacagctcaagcctcgtccacccacggtgaactgcaggagccyggcccctgccgagcccgcagcccggccacctcttccatgtcctcagctactctggggtgttctggtgctctgggattgcagccctgctaggaactttaatgccccacccaggagtgggccagggcagccacaccagccagggtgggctctcctgccagcccagggtcgcggcagccttgccccatgcaggatcagaggcacaagcccccaccctgcccaccctagggcctgcctgctgagcccccactgatgcctcccagaagggctcaccatcccggtgctcgtggggcagccagtggt

SEQ ID NO: 3591 - DNA, 601 bp, Human
ggccgagcttgcagtgagccaagactgcgccactgcacactgcactccagcctgggtgacggagcaagactccatctcaaaaaaaaaaaaaaaaaggccaggagcagtggctcatgcctgtaatcccagcactttgggaggccgaggcaggcggatcatgacgtcaggagatggagaccatcctggctaacatggtgaaaccctgtctctacaaaaaatgcaaaaatttagccgggtgtggtggcgtgcgcctgaagtcccagctactcaggaggctgaggcaggagaatagcttgaaccygggaggcagaggttgcagtgagcagagatcacgccactgcactccagcctgggcaacagagtgagactccgtctcaaaaaaaaaaaaagtaaataatccttttcagtcaatctctgaaatccagaatgaggccagcctgcctcgattcagactcaggtccctggaaccttcccttctcagcctttatctgaggcaactaaaacgctgggcccccagactgtggcctccgccagagggggaccccatctgctgtgtcacctccaaccctgcactggcccacatgaggcagcagctgctggg

SEQ ID NO: 3592 - DNA, 601 bp, Human
aggcaagatggctcacacctgtaatcccagcgctttgggaggcagaggcaggtggatcacttgaggtcaggagttccagaccagcctggccaacatggtgaaacccgtctctactaaaaatacaaaaattagctgggtgtggtggtgagcgcctgtaatcccagatacttgggaggctgaggcaggagaatcgcttgaacccaggaggccgagcttgcagtgagccaagactgcgccactgcacactgcactccagcctgggtgacggagcaagactccatctcaaaaaaaaaaaaaaaaaggccaggagcagtggctcatgcctgtaatcccagcactttgggaggccgaggcaggcggatcatgacgtcaggagatggagaccatcctggctaacatggtgaaaccctgtctctacaaaaaatgcaaaaatttagccgggtgtggtggcgtgcgcctgaagtcccagctactcaggaggctgaggcaggagaatagcttgaacctgggaggcagaggttgcagtgagcagagatcacgccactgcactccagcctgggcaacagagtgagactccgtctcaaaaaaaaaaaaagtaaat

SEQ ID NO: 3593 - DNA, 601 bp, Human
ggggtctgcaaggagccctgatggcttccccatgtgtgtgcaaaggaggcaccaagcaggagaaatttccacaagggtccccacgtggcccaccctccagggcagacagagagggaaaggggtgggtgacagcagcccccttcctgtctctgtgtctcctaagcctttgaccctggtggttgtggactttggaagagcttttcccaaccaagccagccaggctgttggtgcagcccggctctcacatccccgaggccccgcttggagacctccgaggctgcaaatgtctgtttgctgggtygctatctaaagaacccttttcaggccaggcaagatggctcacacctgtaatcccagcgctttgggaggcagaggcaggtggatcacttgaggtcaggagttccagaccagcctggccaacatggtgaaacccgtctctactaaaaatacaaaaattagctgggtgtggtggtgagcgcctgtaatcccagatacttgggaggctgaggcaggagaatcgcttgaacccaggaggccgagcttgcagtgagccaagactgcgccactgcacactgcactccagcctgggtgacggagcaag

SEQ ID NO: 3594 - DNA, 601 bp, Human
ccaataccccgaaaagggggaggtcagtacccaggaagctgagacttgacacggtagccccccgtgccggcctctgtgtactcaccctgcagtccccgcgcacacagaggctgaaggcgtccttgtaggagcagcgcgtcccgtcatgcaccatgcgcttcatggacaccacctccccggtctccctggactcgcagtacaggtggcatctctccttggctggaagggaagcagctgggggtctgcaaggagccctgatggcttccccatgtgtgtgcaaaggaggcaccaagcaggagawatttccacaagggtccccacgtggcccaccctccagggcagacagagagggaaaggggtgggtgacagcagcccccttcctgtctctgtgtctcctaagcctttgaccctggtggttgtggactttggaagagcttttcccaaccaagccagccaggctgttggtgcagcccggctctcacatccccgaggccccgcttggagacctccgaggctgcaaatgtctgtttgctgggttgctatctaaagaacccttttcaggccaggcaagatggctcacacctgtaatcccagcgctttg

SEQ ID NO: 3595 - DNA, 601 bp, Human
gacgtctgaggtggagtccaaactctccaggtgagtcctaggcatactcaagtctcaggctcccagcacaggggaggggtaaacagacatttgccaagagcctgccctggtccgggcattgtttctgacacttcgtatgcttcacctcatgcatcttgccaataccccgaaaagggggaggtcagtacccaggaagctgagacttgacacggtagccccccgtgccggcctctgtgtactcaccctgcagtccccgcgcacacagaggctgaaggcgtccttgtaggagcagcgcgtcccrtcatgcaccatgcgcttcatggacaccacctccccggtctccctggactcgcagtacaggtggcatctctccttggctggaagggaagcagctgggggtctgcaaggagccctgatggcttccccatgtgtgtgcaaaggaggcaccaagcaggagaaatttccacaagggtccccacgtggcccaccctccagggcagacagagagggaaaggggtgggtgacagcagcccccttcctgtctctgtgtctcctaagcctttgaccctggtggttgtggactttggaagagcttttccca

SEQ ID NO: 3596 - DNA, 601 bp, Human
agtgccctgcagggtgcaaggatggggcctgcttcacaagggtcccctgtaggtcacgtgcattggaaatcacctgggatgctcctaaaaattcatgctcccaggccgccaccaccgtgacctgtggaatcaggacgtctgaggtggagtccaaactctccaggtgagtcctaggcatactcaagtctcaggctcccagcacaggggaggggtaaacagacatttgccaagagcctgccctggtccgggcattgtttctgacacttcgtatgcttcacctcatgcatcttgccaatacccygaaaagggggaggtcagtacccaggaagctgagacttgacacggtagccccccgtgccggcctctgtgtactcaccctgcagtccccgcgcacacagaggctgaaggcgtccttgtaggagcagcgcgtcccgtcatgcaccatgcgcttcatggacaccacctccccggtctccctggactcgcagtacaggtggcatctctccttggctggaagggaagcagctgggggtctgcaaggagccctgatggcttccccatgtgtgtgcaaaggaggcaccaagcaggagaaatttccaca

SEQ ID NO: 3597 - DNA, 601 bp, Human
ggagcctggcagggacaagtctatgttcatgtcaccgtcacatggcgaggtgacacgagattgtttttcctgacagccaaagattgaagccaaaggcatcataataaaagaaaacagaggagggcatttctacaaagcaccaaaccagtgaccctcacagtggccacccagatccagcaagaagctgcccagtgccctgcagggtgcaaggatggggcctgcttcacaagggtcccctgtaggtcacgtgcattggaaatcacctgggatgctcctaaaaattcatgctcccaggccgccrccaccgtgacctgtggaatcaggacgtctgaggtggagtccaaactctccaggtgagtcctaggcatactcaagtctcaggctcccagcacaggggaggggtaaacagacatttgccaagagcctgccctggtccgggcattgtttctgacacttcgtatgcttcacctcatgcatcttgccaataccccgaaaagggggaggtcagtacccaggaagctgagacttgacacggtagccccccgtgccggcctctgtgtactcaccctgcagtccccgcgcacacagaggctgaaggcgt

SEQ ID NO: 3598 - DNA, 601 bp, Human
aagctggagtcagtggcgcgatcttggctcactgcagcctccgcctcccaggttcaagtgagtctcctgcctcagcctcccgagtcgctgcctgtagtcccagctaattttttttttttttgtatttttagtagagacggggtttcaccatgttggtcaggctagtcttgaaccccagacctcaaataatctgcccgcctcggcctcccaaagtgctgggattacaggcgtgagccaccacgcccagcccctatccttctttaatacccatgtcaggagtgacgtgatagccacacccacrgagacagtgcattagtgatcttccctccccgttaggtttacaaccatgatcacagctgccatctgaagctacttgtactacaactgtttcccatgcttgctgcctgtattaattatgtttttgtttttcaaaacgtcctatgtcttgatattttgacatcttaaaaatcttcctgtctggggagagactacacctcccaggggtatccagttctaagggacagcaaagcactgggttggggacacacctttcacatgcaagccagccagtcttcagtctataccccaagcacctccttta

SEQ ID NO: 3599 - DNA, 601 bp, Human
cttcttgggtgaccgtgtgaacgtgcccttgaccactttgcagtggctgttgtcccctccgcacacgccacacttgtcttcctgcttgctggagccgatcacaccgtcacagcccaccttctgttgggggaggaggcagtgagcacttgagacgtcctgctagtagagtcagggtcatactatgttgcccccagtctcgaacacctggcctcaagcgatcctcctgccttggcctcccaaagcattgggattacaggcgtgaaccaccttgcctggcctcatcttttattatctccaaaawcagagtgcgtctagtcatcagttaaacggaccttgcctgccacctacagcagtgtctcgacctggcagtttccgtctgggcccctgtgcacgcggctggtcttgggcaggggactcatcgaggcccaggcaggcaccgtccctggcttgatgaacatttatgtttggcaagcaggagatgctgtttatttttacatttttttttgagacggaatcttgctctgtcgcccaggctggagtacaatggtgcaatctcagctcactgcaacctctgcctcctgggttcaagcaattcttctgc

SEQ ID NO: 3600 - DNA, 601 bp, Human
cctggctcaggtcatggctgcacaacccgggcccctgacccctgacccctggcactctgcccattgatcccagaggagccaggtcctgaggacgtcaagttgtccggctctgagactcacccagatggtggctggtggcgtctacctcctgaatgagcaggtgtctggctcctgcagggatctcaaacatcttgatgtaacctttttttgatgtggaaagacacagaaaactgagaagggaaggcgccgctcaaattcgcaccatgcaaggaggggcctcgctcttgaaggcagctcctcsggaggctctcccaggaccctggtatttctctggctttgaggacccacctgagaggggccaccaggaaagctgctgcctccaggctagtctttaaggcccaacccgggcatcctcatatactggcattctccactctaacccctgtgaccccggcccccactctcctcttccccacccaccctggcacccagctggggctgtccccgacttaggattctccctccccctcagtgtcacagacctctccccctccccagaacagtcataagcccggacagccccaggatgagtcaggccctc

SEQ ID NO: 3601 - DNA, 601 bp, Human
cgtctctgtactcccactccacgcccatggcaatgaaggttttggaactggcatccacgtcattctcttcatttaagatgaacttgcctgtctccaggttcttgacggctgagaatggcaagaccaagtcccccgttgtggtcacccaagagcaggacccaggcccactggtttgggctggtcggggagtgggggcagctagctggaccccttgtctctctggctgcccccggccagtttcctctgtgccacgacagcccagatggctctgggagccctgcttgcccatcactgctccctygggaccagattaccctccactcgcatcctctgcccccaccagccctggaggtgccggctccccttggaagccactcagtagccgtcaaggccacctacccataccctattgggagcactcagtgggcgcttagaggccacccggggcaggatggctgggaggggtctgtacgcggtgcagggcatctgctggacaggcgagcacatgaccctgctggagtagggcttcctgccatggggtgagtatatgtctggctgaaacagcagaacccccaccccatcagggaccatggcccagccg

SEQ ID NO: 3602 - DNA, 601 bp, Human
agggtcaggaggctcagcgtcccaggcacccccatccctcccccagtggccacccgcacccttccctgggcccagccctgcttggactcaccagaacggtgatggtgccgtggagggggcccatggtctgcagcgtctcccggccgtcctcgtctctgtactcccactccacgcccatggcaatgaaggttttggaactggcatccacgtcattctcttcatttaagatgaacttgcctgtctccaggttcttgacggctgagaatggcaagaccaagtcccccgttgtggtcacccaagrgcaggacccaggcccactggtttgggctggtcggggagtgggggcagctagctggaccccttgtctctctggctgcccccggccagtttcctctgtgccacgacagcccagatggctctgggagccctgcttgcccatcactgctccctcgggaccagattaccctccactcgcatcctctgcccccaccagccctggaggtgccggctccccttggaagccactcagtagccgtcaaggccacctacccataccctattgggagcactcagtgggcgcttagaggccacccggggcagg

SEQ ID NO: 3603 - DNA, 601 bp, Human
gaatcaattttagtgagcaggtgaatttgcaaatacagaaaccgtgagtgccgaggaccagctgctcacacactgatgcaggcaggtcaccaaaggcacgtccagggggccagaagtcactgcaggcgaggcaggcagggtgccagggggtacacggggcatacctggctcactgctgcacctgcttacaggtgcacccacgtgtggagcgctgggggctggtggattaatcccaatgccagcatgcccaccttagggaggggctccagagcatgggagccttatttgtgatatgtacctyttttgacaaataaaatatatccctatgcagttaaattacattttaaaaagtgatctgacctcctcaaaaccaggtaaaaagaaagtgatttgaaaatccagcccccgtggtactttcctacaaccaggagatctggggtcccatcctgcttagagacacagtccagctcaacctgggtctgggcatctagcttcccagaccctgagcgtcacctcccagagtgtcaccgattccaatgtaacagcacactcgaacgagcatgctgatggcagctgtgaatgtcattcagatggtgaaacc

SEQ ID NO: 3604 - DNA, 601 bp, Human
actgcaacctccgcctcccaggttcaagcgattctcctgcctcagcctcctgagtagctgggattacaggcgcccgccaccacgcctggctaatttttgtatttttagtagagacagggcttccccatgttggccaggctggtcttgaactcctgacctcaagtgatccacccgcctcggcctcccaaagtactgggattacaggcatgagccactgcgcctggcctatgtgtgagtctgtttaaagacactttatttaatttttactgtgattcattaacactgaactcacagtcaatcrcactgcagcccatgcctgaacgaagcttattcaacacatgtattttcttcttaagacaccactgcttcctgggcttaggaacactggacagcacttcagcaacaggctcagggtgattttcaacagcgaaatcgcccccaaaatagcacaaaatgtgatgtatgtgacactcaacagactgcagaaagaacccctgtttgtgggatgagagcagaaacaagcagacagcgtgctgagttgctcccacctccgctgggaacacgtgtggcaggcgactcacacttcaccactctgtgcgtg

SEQ ID NO: 3605 - DNA, 601 bp, Human
tgctccctaccttctcgtggtcaccctcatgtcacccaggtccccagcttcgagaccccctcacctccgccacagggcttggagcacggagaccacttcttcagggcccactcgtagaccacagagtcctcttccaggacgttgttgtcgtcgacattcagtgagtcctcatggatcatgtatttgtacgtcagtgagacccgggtgtctcccaccgggatgacctgtgccagcccaagagccttgatgtgcctgacctgccctccatgcttcctccccagccagcttaggaacggcagcygaggccgactccagaggagtctcatcattcatggcagttacattccatgaagtcgccccgagcaccaaattcttgaatagggagccattaccccagggggcacagggtgaggttcctgtgagcctctgtctcaacatttttgttacccgatcaatatataaccttgttttatgtgtgagtctgtttatttttttgtttgtttttgtttgtttttgagatggagtttcgctcttgtagcccaggctggagtgtagtggcacgatctcggctcactgcaacctccgcctcccaggttcaagc

SEQ ID NO: 3606 - DNA, 601 bp, Human
gctttgggcttcgagagggcggcacagaagccacggtgtaccatcttgtggtccagcctccggcggcagccatacttggtgaactgggaccctgaaggcagagagctcgacgggggtcggtggggcagcatgccctgcccgagggtgcaaggaggggtgggctgcaccagcagtgctggcctcgttttcctgctcacccttgtgatgacaataagggtgggcagggcaccgagcctgcggctggctggggggaggccttggtgtgtcccgggtggaggggcgagagggcaggagaggccaytttctcccctaggctgcctctccctcactgggctcctgggtcagagtggaggccctatttccttgctactgctaggcaccgcttctaccttgacctcacatgcccagcaggcctggtgcaagccaggagccgggcaagcactgggcccgcagcccgcatgcttcctcccacaggcccagagcagccgtgctcaacccgggtgattttctccagcaggggacatttggccacgtctgggacatgtttggttgtcacaactgggggaaggggtgctactggcatctggtgagcaaaggccaa

SEQ ID NO: 3607 - DNA, 601 bp, Human
ttggtcaaatgcctcggatgatgccaggcccaggccccacacctccaagcacgggagcccctggtggcccctggcctgtctcctctagtgggagcccgagctgggggcactcacactggctgggagcattcctgtgggttgcacgctctgcggatggctttgggcttcgagagggcggcacagaagccacggtgtaccatcttgtggtccagcctccggcggcagccatacttggtgaactgggaccctgaaggcagagagctcgacgggggtcggtggggcagcatgccctgcccgaggrtgcaaggaggggtgggctgcaccagcagtgctggcctcgttttcctgctcacccttgtgatgacaataagggtgggcagggcaccgagcctgcggctggctggggggaggccttggtgtgtcccgggtggaggggcgagagggcaggagaggccattttctcccctaggctgcctctccctcactgggctcctgggtcagagtggaggccctatttccttgctactgctaggcaccgcttctaccttgacctcacatgcccagcaggcctggtgcaagccaggagccgggcaagcactgg

SEQ ID NO: 3608 - DNA, 601 bp, Human
tacagggccaggaggcgagccctgcgcctctgaacccccatttccccatctgggcatccctgtttcttgtcatctctaagatgctgttcagtttggcgggtttgaagctggggtgcgccttctgccctgcagcatcttagattccatgaaatgtggtgagagagacttggtcaaatgcctcggatgatgccaggcccaggccccacacctccaagcacgggagcccctggtggcccctggcctgtctcctctagtgggagcccgagctgggggcactcacactggctgggagcattcctgygggttgcacgctctgcggatggctttgggcttcgagagggcggcacagaagccacggtgtaccatcttgtggtccagcctccggcggcagccatacttggtgaactgggaccctgaaggcagagagctcgacgggggtcggtggggcagcatgccctgcccgagggtgcaaggaggggtgggctgcaccagcagtgctggcctcgttttcctgctcacccttgtgatgacaataagggtgggcagggcaccgagcctgcggctggctggggggaggccttggtgtgtcccgggtggaggg

SEQ ID NO: 3609 - DNA, 601 bp, Human
agctgggcccagccccagggcctgaacgtcaaagccactgcttaagaaacatctaccccatggtacagggccaggaggcgagccctgcgcctctgaacccccatttccccatctgggcatccctgtttcttgtcatctctaagatgctgttcagtttggcgggtttgaagctggggtgcgccttctgccctgcagcatcttagattccatgaaatgtggtgagagagacttggtcaaatgcctcggatgatgccaggcccaggccccacacctccaagcacgggagcccctggtggccccyggcctgtctcctctagtgggagcccgagctgggggcactcacactggctgggagcattcctgtgggttgcacgctctgcggatggctttgggcttcgagagggcggcacagaagccacggtgtaccatcttgtggtccagcctccggcggcagccatacttggtgaactgggaccctgaaggcagagagctcgacgggggtcggtggggcagcatgccctgcccgagggtgcaaggaggggtgggctgcaccagcagtgctggcctcgttttcctgctcacccttgtgatgacaataagg

SEQ ID NO: 3610 - DNA, 601 bp, Human
atgtcaccactgggaggccctggtggagctggtggctctggaggtccctagcctgaagaggtttcccagcctccttagggtctgggccctgctacctggcctcaccttctgctgacgtcacaaatccttctcggcagagctcaagagcagtgtggattccctcagcacgctgtcctatgtggcccccacctgcccatttcccaactgtcttccccactgaggtccctggacccagaaacgcagctgggcccagccccagggcctgaacgtcaaagccactgcttaagaaacatctaccccrtggtacagggccaggaggcgagccctgcgcctctgaacccccatttccccatctgggcatccctgtttcttgtcatctctaagatgctgttcagtttggcgggtttgaagctggggtgcgccttctgccctgcagcatcttagattccatgaaatgtggtgagagagacttggtcaaatgcctcggatgatgccaggcccaggccccacacctccaagcacgggagcccctggtggcccctggcctgtctcctctagtgggagcccgagctgggggcactcacactggctgggagcattc

SEQ ID NO: 3611 - DNA, 601 bp, Human
ccagcgccgctccctgcagcccaggtagacagcgagcacagagggcagcctgcacccctccccggtgcaccttctcttattctcactaagatgctggctgtccaggcttgcacagaggggaaactgaggctcagctgccccaggtcctactgaccatgagtcccatgcatgtcaccactgggaggccctggtggagctggtggctctggaggtccctagcctgaagaggtttcccagcctccttagggtctgggccctgctacctggcctcaccttctgctgacgtcacaaatccttctcrgcagagctcaagagcagtgtggattccctcagcacgctgtcctatgtggcccccacctgcccatttcccaactgtcttccccactgaggtccctggacccagaaacgcagctgggcccagccccagggcctgaacgtcaaagccactgcttaagaaacatctaccccatggtacagggccaggaggcgagccctgcgcctctgaacccccatttccccatctgggcatccctgtttcttgtcatctctaagatgctgttcagtttggcgggtttgaagctggggtgcgccttctgccctg

SEQ ID NO: 3612 - DNA, 601 bp, Human
agcacctggagaacctgcctggctgagctccagcgccgctccctgcagcccaggtagacagcgagcacagagggcagcctgcacccctccccggtgcaccttctcttattctcactaagatgctggctgtccaggcttgcacagaggggaaactgaggctcagctgccccaggtcctactgaccatgagtcccatgcatgtcaccactgggaggccctggtggagctggtggctctggaggtccctagcctgaagaggtttcccagcctccttagggtctgggccctgctacctggcctcrccttctgctgacgtcacaaatccttctcggcagagctcaagagcagtgtggattccctcagcacgctgtcctatgtggcccccacctgcccatttcccaactgtcttccccactgaggtccctggacccagaaacgcagctgggcccagccccagggcctgaacgtcaaagccactgcttaagaaacatctaccccatggtacagggccaggaggcgagccctgcgcctctgaacccccatttccccatctgggcatccctgtttcttgtcatctctaagatgctgttcagtttggcggg

SEQ ID NO: 3613 - DNA, 601 bp, Human
ggcacacgccaccacatctggctaattttttttaatttttttgtaaagacggtgttttgccatgccgcccaggctggtctctaacacctgagttcaggcgatccacccgcctgggcctcccaaagtgctgggatcactggcgtaagccactgtgcccggccaacgcctgttttcaagactggcccttgtgcagctcctgggaaccaagctcatggaaggctccacctattaagagtgtttttgcctgcctgaggccttgagtcaccagtaccagttggtctgggtagttcataccaacagygatggatggggaacacctgcttttcctctacagtctgaggtcacacctatgtagctgaccccattgaaaaccctggacgcccaggctctggtgggctcccctgcttggcagcatttcacatgcattgccacacatgggtgcagggagaattcagggcatttccgtgaccccactgggaggggacaccgggagcctgcgcctggattcctcccaacctccttgcctgtgacttttctttttcccgattctactctgtatcctttcaccgtaagcccctgcaactgcgagtcccgcttctga

SEQ ID NO: 3614 - DNA, 601 bp, Human
ccacctcccaggctcaagcaatcctcccaccttagcctcccgaggagcagggagtacaggcacacgccaccacatctggctaattttttttaatttttttgtaaagacggtgttttgccatgccgcccaggctggtctctaacacctgagttcaggcgatccacccgcctgggcctcccaaagtgctgggatcactggcgtaagccactgtgcccggccaacgcctgttttcaagactggcccttgtgcagctcctgggaaccaagctcatggaaggctccacctattaagagtgtttttscctgcctgaggccttgagtcaccagtaccagttggtctgggtagttcataccaacagtgatggatggggaacacctgcttttcctctacagtctgaggtcacacctatgtagctgaccccattgaaaaccctggacgcccaggctctggtgggctcccctgcttggcagcatttcacatgcattgccacacatgggtgcagggagaattcagggcatttccgtgaccccactgggaggggacaccgggagcctgcgcctggattcctcccaacctccttgcctgtgacttttctttttcc

SEQ ID NO: 3615 - DNA, 601 bp, Human
gtcctcgctgtctcaggacgctcctcctggcagatgccgaagctgtcgtccgcggtgcggcagagcactggccgctcctgggtgccgttgccacaggttactgagcactgcagggggagagtcgccaggcagggttcacctcccacacagggcccgcactggcagagctggaggagcccacagtccccaggcacatgacccatgcgctcaggaggaggtgtgggacagtggggagagtggggtttcaggttgccttgccccaccctcgggggcagccccaatctcctggggctctaaagamgggacccacatgcctgtctctctgagctgctgtgagacagtgcccatatacagactggcataggcctggcgctgctggactctcagtgacagcctcacttctctggctggaggaggtccaaggcccaggagaacctgctgtgccctgggcaggggttgaggtggggcactgggaaagctctgacccagcctaggaggcgccagtaggctccccacaatcctgggcatgagggtccaccactagtgccctcactggctcctccagcccccagcaccaccactgctccaccacactgaccag

SEQ ID NO: 3616 - DNA, 601 bp, Human
gacctggcctgcagtgccccgcttctccatgctcacagatgttgagtccagctactctccgggaagagccagatttgcctgaaccaagcctctgacacccccgccctgggctgctgcatgctgggagcaggggcaggggctgcaggtggcttacggggacaggggccaagcctgcaggtcctcgctgtctcaggacgctcctcctggcagatgccgaagctgtcgtccgcggtgcggcagagcactggccgctcctgggtgccgttgccacaggttactgagcactgcagggggagagtcrccaggcagggttcacctcccacacagggcccgcactggcagagctggaggagcccacagtccccaggcacatgacccatgcgctcaggaggaggtgtgggacagtggggagagtggggtttcaggttgccttgccccaccctcgggggcagccccaatctcctggggctctaaagaagggacccacatgcctgtctctctgagctgctgtgagacagtgcccatatacagactggcataggcctggcgctgctggactctcagtgacagcctcacttctctggctggaggaggtccaagg

SEQ ID NO: 3617 - DNA, 601 bp, Human
agacctggcctgcagtgccccgcttctccatgctcacagatgttgagtccagctactctccgggaagagccagatttgcctgaaccaagcctctgacacccccgccctgggctgctgcatgctgggagcaggggcaggggctgcaggtggcttacggggacaggggccaagcctgcaggtcctcgctgtctcaggacgctcctcctggcagatgccgaagctgtcgtccgcggtgcggcagagcactggccgctcctgggtgccgttgccacaggttactgagcactgcagggggagagtygccaggcagggttcacctcccacacagggcccgcactggcagagctggaggagcccacagtccccaggcacatgacccatgcgctcaggaggaggtgtgggacagtggggagagtggggtttcaggttgccttgccccaccctcgggggcagccccaatctcctggggctctaaagaagggacccacatgcctgtctctctgagctgctgtgagacagtgcccatatacagactggcataggcctggcgctgctggactctcagtgacagcctcacttctctggctggaggaggtccaag

SEQ ID NO: 3618 - DNA, 601 bp, Human
cgagtcagaaggacacgctcagcaaagggtcggcggcagcagcgacggcggtggcagccgggaagcacctggcagtgccggaaactcggggtggggtccccgcacgacgccgcgagaccgcgaacccccccgggccgggacgggctcggcccggagggtcgccctttggccaccggcccctcctgcaaccacgacagatctttgcccctttacaagccatcaccaaccaggttcggccccagcagaggcccgagcccccgccagcaggcagcgcggcccggagcggacgccgagctcagasgcccgggagaaaacggtcaccccagagcgcgcccgcagagtcaggggagctttccatagacagagaggaggggggcccaaggcaagctccacagggcgcagggcatgcactggagggcagaggcagagttataaacgggtcggttacttgacgagatcttccggatgggcgagtcggggtccgggcgggacagccactgaactacgtagctcttcttggagggatctgagatgtttcctagagggaggagagaggggctgcggccgcagggcaccaggctggggcccccaccccaggcag

SEQ ID NO: 3619 - DNA, 601 bp, Human
gttcacacgcgtgggcgaggcacgcgcgcaccagacggccactctctctctcagccctgcggcgggggagctgtgcgcgaggcgagaaaaggccaccggggccgacgggcggacagtggaggtggggagtgtccccgcgcccctccgccgcctccgcgaccggacccccgcaggacagggccgcgcggggctgtgagctgcgcgaaggccgggcggaagcgggccatagttccacgagtcagaaggacacgctcagcaaagggtcggcggcagcagcgacggcggtggcagccgggaagcmcctggcagtgccggaaactcggggtggggtccccgcacgacgccgcgagaccgcgaacccccccgggccgggacgggctcggcccggagggtcgccctttggccaccggcccctcctgcaaccacgacagatctttgcccctttacaagccatcaccaaccaggttcggccccagcagaggcccgagcccccgccagcaggcagcgcggcccggagcggacgccgagctcagaggcccgggagaaaacggtcaccccagagcgcgcccgcagagtcaggggagctttccatagacagaga

SEQ ID NO: 3620 - DNA, 601 bp, Human
acaccttccctgccttctactggcccacgttccccctctgaagctggagttggcagccaatcccgttacctttcaactttaaggcatcttctacatagtttttctaagcaaaaaagcaataaaaattgaggtaattctgtagtggttcacacgcgtgggcgaggcacgcgcgcaccagacggccactctctctctcagccctgcggcgggggagctgtgcgcgaggcgagaaaaggccaccggggccgacgggcggacagtggaggtggggagtgtccccgcgcccctccgccgcctccgygaccggacccccgcaggacagggccgcgcggggctgtgagctgcgcgaaggccgggcggaagcgggccatagttccacgagtcagaaggacacgctcagcaaagggtcggcggcagcagcgacggcggtggcagccgggaagcacctggcagtgccggaaactcggggtggggtccccgcacgacgccgcgagaccgcgaacccccccgggccgggacgggctcggcccggagggtcgccctttggccaccggcccctcctgcaaccacgacagatctttgcccctttacaagccatcac

SEQ ID NO: 3621 - DNA, 601 bp, Human
gaggggccctaaatatctatgttgggcagtggggagtggggcagtaaagtcattcaaattagaaaccggggtagttaatgctactgagtgaggccccgcaactcctcagtgtctgggcccccaaaaagagaaggagccatcagcttgccaaacccacgcacccagtttcatggaacttttattgagtttatttgtgggatgcatgacaggaggtctttccatcattagtaagaatgaaaggtcattttcacagtcactttggcacacgctaacgtctcataaaaaaaaccagaaaagcaamgacaatggaacctatagaatacgtcattaaatacatacaaaacactaataaaatatccctgataaaccaaagtgcatatgcccaggacagtattgcaccttccccagtcgcgcgtgtcgctcgcatggcctcgtcaaagttggaagttaacagtcgtgagattagtacgcaggtgcacaccagttatttacagaacggcggtcagagccgcgggagtaggggccggccgcccggcaggggtgcggtgtgaacagaggcggtggctggggtggaggggcggggaggagtgctacatggatc

SEQ ID NO: 3622 - DNA, 601 bp, Human
ttctatgtctgattttctccccacagtgggcggcattgctcttagtttaaaaaaataaaaatacgtcaatgagtaaatacaaaattgaaataaaatcctggccaagagattgactatgcaaatagcctaggaaaatttcaaaatagcctagaaaaatttcaaagtcatcatgaccaactgatcttaaagatgccccaggtttgtacatttttaagtatcatcacggaccacagagaagagtgatgcacctgaggtaatgactggcgatgcctctccgccaagatgaacactgtggttttayaatatttggtcttcggccatttccagtagcaatcaagtagtgagacctattgtcttccagtgaatgacaatcaaccattgagagtaaacacagttttcataaacttaagtcactgtaggctactcccacgatcttggctacacctgaacagcacctgcattattatttgcttagtcatatcctttaaattaactcctttttacacttaaaatttgttttagaagaccttatactattaccactcatggaaagctactgcagtgaacaaaggtaaccctaaaataggaatacaaaaaaaaa

SEQ ID NO: 3623 - DNA, 601 bp, Human
aatgcccaaaatattgactacctggccctttacagaaaaggttgactgatcgtgggtcaagtgcacgcctaggtcagagccatgcacgagaaagtgctccataaatgcccattgagtgaggggtggcagccccaggtggggtcccccttccacctggtctacatactggacttctatgtctgattttctccccacagtgggcggcattgctcttagtttaaaaaaataaaaatacgtcaatgagtaaatacaaaattgaaataaaatcctggccaagagattgactatgcaaatagcctakgaaaatttcaaaatagcctagaaaaatttcaaagtcatcatgaccaactgatcttaaagatgccccaggtttgtacatttttaagtatcatcacggaccacagagaagagtgatgcacctgaggtaatgactggcgatgcctctccgccaagatgaacactgtggttttacaatatttggtcttcggccatttccagtagcaatcaagtagtgagacctattgtcttccagtgaatgacaatcaaccattgagagtaaacacagttttcataaacttaagtcactgtaggctactcccac

SEQ ID NO: 3624 - DNA, 601 bp, Human
cggccctgagcttctacgtggccaaaataaggagaacacatgactggctgcagggtccaccatgaaaagggagttaaaacccatcggccatcaggagaagtggggatctccctgacactgagcccaagaaccatgctcacagtgccaaggaggaagggggagggcctggtacccaggggagatgccagaaatcaaatcggaagatcctgagatgtggctgtcaggattttgaaactggcagaaggcttttctcagataaaaatcttacacaggtgcccaatatatgaaacagatagactcrgactgctgatgatagtactgtttgaaggtgggtggaggagacacagagctcccatccctgccccaccccatcctctccagcagcctggtttgtgaaaccactgagccctaccctcagggaaacacagggggttctggataagagctgatggtggcctcccttctccctaccccataggctttgacaaaggagggagcctgggcctgatggtgctgggagggacaccctggctgcacactgccccctctcctgttgcccatagtttttccttcacacagataaggctggtgttacacattt

SEQ ID NO: 3625 - DNA, 601 bp, Human
cccaacaccgcctgttgtggtctctgctcagctgctctctactctccacagtgatgacttcagacctttcccacacaaacccccgacgtgccctccttttccctcactctccttagttgaactcatctactattgaaaggaaggaaggagggagagggtgaaaggaaggaggaactgaaggaaggaaagaaaggaaaaaaggaaagggagggagggacaaaaggaagaaagggaggaggaaagggagggagaaagggagggagaaaggctcaggcattggatgggagccacatctgacagytatcccatacaccaacatatgacacaatctacacctgaagctgtccaaaacagacaagacccccttccttccatcgagggccagtggttctgatgtcctgcttcttaatggccactgctccagcctgtaattttcccttagaagctggtgacagaccaccagctccaaacccctgaagcttcagacttgctacaagccaaatccaccaagggcctgtgggtcccaaaagcccgagacccaacccctgcagcgtgagcttagggcctctgctgcccaccctgtctcggtgcatggtgtttc

SEQ ID NO: 3626 - DNA, 601 bp, Human
aaacctgcatgggctttcttatacttgcctcaacttacccaacaacctcatttccagcctctgctccatccccctatagcaccgccaccttgcgcatccagccatttcccaaagaaacgtgctgccctcacatagattaatcgttccaccctgcacatctttctctttcctttccacccaagaaactggtcatctgtggtccagcttacatggagagccccgactctccacagaagccaccattatctctcactttccacccagccatcttctccctggcccatctcgacctctgtctgcrgctatgttcattcaacccatcaactcttcttgcgctcacactctctttactctctgtctccttcccaagttttcaccccttccctctccccatcccctcattccacaacacaaaaattaagatgattttaaaaaattcactcaagaagaaagaataagtcatgttacaggagatacttgatccagtataaattccgaatcactgacctccgtgagcccaacaccgcctgttgtggtctctgctcagctgctctctactctccacagtgatgacttcagacctttcccacacaaacccccg

SEQ ID NO: 3627 - DNA, 601 bp, Human
acagagtgattccaaactcatcttaaagaataggactttatcacatcttcacatttgacatcccagtggtaaccccagtgaaattctgtggcaaggcttgactctacaataatctctaagtagtaactataacaaaattaaacctaaaagagccaattcctaagacccaatatagcaaatcccagggccgctgtggccccaccatgctccacaactccctgatgttgctcccattctgacccagatgccccggacgatcttttaactgaacagcacctaaaggaaagttaaacatcacccraacctgcatgggctttcttatacttgcctcaacttacccaacaacctcatttccagcctctgctccatccccctatagcaccgccaccttgcgcatccagccatttcccaaagaaacgtgctgccctcacatagattaatcgttccaccctgcacatctttctctttcctttccacccaagaaactggtcatctgtggtccagcttacatggagagccccgactctccacagaagccaccattatctctcactttccacccagccatcttctccctggcccatctcgacctctgtctgcg

SEQ ID NO: 3628 - DNA, 601 bp, Human
catcatattccagttcttatgactaattttcagtttttgtggcttcatgtcccagttaataaacctttattttaaaattcttcttttcgacataaattatcaacttcaggttgcttttcttaataatattcttgtttctacttctatgttttttttaatggatttcttgctacttaaaatattctctctacatttagagtccctcccatttaggggactctatatttagagtctcttatagtctttgttaagctgacttgccatattcatatatacactaatatatccctatcctgaaatygtgcgtcagtcacagtcagtattataaagtttagctactgattttaaaaagaaatgttgattttgtgtcaggagcgatggtgtgttcacaagtgtgtgtatgtgtgtgtgtgcatgtgtttctatgagagcaagtgtaaccttcacttctggtttgaaactgtccaggtaaatttttaagaggtttcttttttttttttttttttttttttttaaaatatgtctttgctatgtctctactcctccttcaccctcacctgccaatccttgtcctggaacataaatacttgtttcattaata

SEQ ID NO: 3629 - DNA, 601 bp, Human
ttctgccctggtttccagaattagcagtgcaatttactgaaactatagtcattgtcaaaattagtaagttatagagacactaatccttaaatattgctagacattaatgattcatttaacaagtacttaggaatcaactattttttttttttttttgagatggagtttcactcttgttgcctgggctgtagtgcaatggtgtgatcttggcccatcacatcttccacctcccaggttcgagtgattctcctgtctcagcctcctgagtagctgggattataggcatgtgccaccatgcccrgctaattttgtatttttagtagagacagggtttcaccatgttggtcaggctggtctccaactcccgacctcgggtgatccacctgtctcagcctcccaaagtgctgagattacaggcatgagccaccgcacttagccggaatcaactattattttcagcaatgtacaaaggttaaaaataagtgtaaaatataactgccctctagaagcaggaatctgtcacactattccctgtagcctacaataaaccacaaagatataaagtattattattaatttactcttgattttagccaaaaag

SEQ ID NO: 3630 - DNA, 601 bp, Human
tgattcatttaacaagtacttaggaatcaactattttttttttttttttgagatggagtttcactcttgttgcctgggctgtagtgcaatggtgtgatcttggcccatcacatcttccacctcccaggttcgagtgattctcctgtctcagcctcctgagtagctgggattataggcatgtgccaccatgcccagctaattttgtatttttagtagagacagggtttcaccatgttggtcaggctggtctccaactcccgacctcgggtgatccacctgtctcagcctcccaaagtgctgrgattacaggcatgagccaccgcacttagccggaatcaactattattttcagcaatgtacaaaggttaaaaataagtgtaaaatataactgccctctagaagcaggaatctgtcacactattccctgtagcctacaataaaccacaaagatataaagtattattattaatttactcttgattttagccaaaaagctatgaagtgattattattattttgaaatatcttgctgtcatcataaattcattcaacaaatctctcttaaagtgctgtcacaggtgctgggaagatagaaatgagc

SEQ ID NO: 3631 - DNA, 601 bp, Human
gaatcaactattttttttttttttttgagatggagtttcactcttgttgcctgggctgtagtgcaatggtgtgatcttggcccatcacatcttccacctcccaggttcgagtgattctcctgtctcagcctcctgagtagctgggattataggcatgtgccaccatgcccagctaattttgtatttttagtagagacagggtttcaccatgttggtcaggctggtctccaactcccgacctcgggtgatccacctgtctcagcctcccaaagtgctgagattacaggcatgagccaccgcrcttagccggaatcaactattattttcagcaatgtacaaaggttaaaaataagtgtaaaatataactgccctctagaagcaggaatctgtcacactattccctgtagcctacaataaaccacaaagatataaagtattattattaatttactcttgattttagccaaaaagctatgaagtgattattattattttgaaatatcttgctgtcatcataaattcattcaacaaatctctcttaaagtgctgtcacaggtgctgggaagatagaaatgagcaaaatagacatagaatctggcta

SEQ ID NO: 3632 - DNA, 601 bp, Human
taaaatattagcaaatcaaattcaacaacacatccaaaagattatacatcataatcaaatgggacttatccttggtatactgacttaacctacacaaattgatcaatgtagtatatcaattatatcaacagactgaaagacaaaaaatacatgatcatatcaattggtgaaaaggcattaaacaaagtttaacatgctttcttgattaaaagtttaggtagttaaataatggtgtggagttaatggttcttgatttgagagtttaggcatagaagaaaagttcctcaacatcataaaggcyatttatttatttatttatttatttatttatttatattttttagcagtcaaatataccttattttattctcataaaatgctacaaattatcttgatttaggatatttgtaaacattctatagcagctaggaacatgtttttccaaaaccaaataaagttttttacatgccagttacatttcagagattttgtcattcttatattcttctttcttcataaaagtaagtgcttgctcaaatatgtgggccttctactgaaattcatttaatatataacttttatccttggcttagttggaatt

SEQ ID NO: 3633 - DNA, 601 bp, Human
attctcataaaatgctacaaattatcttgatttaggatatttgtaaacattctatagcagctaggaacatgtttttccaaaaccaaataaagttttttacatgccagttacatttcagagattttgtcattcttatattcttctttcttcataaaagtaagtgcttgctcaaatatgtgggccttctactgaaattcatttaatatataacttttatccttggcttagttggaattcgagttttgataagaaaggtgtggttgaatggacataatcataggctttcagcaaccacacaaaygttgatagtgtgcaatgcagttgttgatgattaaacaataatgaaaatttaagaacactgttgcattattttatttgaagctggaatgatgtgaaactctaaaatatgtctcagcccaagcattaaggtttacctgcccactcttctttctccttatttattttttaaattaaaagccatttatggaaagccgctgataacatcataatcaatcggaaagcagaaatagccattcttctggtaccaggcaaggatgcctactcttaccacttctattaaacatgtaccagaagtactatc

SEQ ID NO: 3634 - DNA, 601 bp, Human
aatgatgtgaaactctaaaatatgtctcagcccaagcattaaggtttacctgcccactcttctttctccttatttattttttaaattaaaagccatttatggaaagccgctgataacatcataatcaatcggaaagcagaaatagccattcttctggtaccaggcaaggatgcctactcttaccacttctattaaacatgtaccagaagtactatcaaaagcatttagaaaagacacattcaacttggaaatgaagaagtaaaattacctctatttgcagatgaaatgattctacctgtaraaaaccctaatgactccactgaaaaaccattaacactaacaaataagttcaataaagttgcaggatataaaatcaacatacaaaatctgtgacatttctatacacgaataacaacctagccaaaaatgaaatcaagaacaccattccatttataacataaataatacttgggaataaattttactaaggaggtgaaagacctgtataccgaagacaataaaacattaatgaaggaaattgaagaaaatgcaaataaatgaatatcccatgctcatgaattagaagaatgttgttaaaatg

SEQ ID NO: 3635 - DNA, 601 bp, Human
aaggtttacctgcccactcttctttctccttatttattttttaaattaaaagccatttatggaaagccgctgataacatcataatcaatcggaaagcagaaatagccattcttctggtaccaggcaaggatgcctactcttaccacttctattaaacatgtaccagaagtactatcaaaagcatttagaaaagacacattcaacttggaaatgaagaagtaaaattacctctatttgcagatgaaatgattctacctgtaaaaaaccctaatgactccactgaaaaaccattaacactaayaaataagttcaataaagttgcaggatataaaatcaacatacaaaatctgtgacatttctatacacgaataacaacctagccaaaaatgaaatcaagaacaccattccatttataacataaataatacttgggaataaattttactaaggaggtgaaagacctgtataccgaagacaataaaacattaatgaaggaaattgaagaaaatgcaaataaatgaatatcccatgctcatgaattagaagaatgttgttaaaatgttcatactacctaaagcaatgagtagattcaatgcagtcc

SEQ ID NO: 3636 - DNA, 601 bp, Human
acctgcccactcttctttctccttatttattttttaaattaaaagccatttatggaaagccgctgataacatcataatcaatcggaaagcagaaatagccattcttctggtaccaggcaaggatgcctactcttaccacttctattaaacatgtaccagaagtactatcaaaagcatttagaaaagacacattcaacttggaaatgaagaagtaaaattacctctatttgcagatgaaatgattctacctgtaaaaaaccctaatgactccactgaaaaaccattaacactaacaaataarttcaataaagttgcaggatataaaatcaacatacaaaatctgtgacatttctatacacgaataacaacctagccaaaaatgaaatcaagaacaccattccatttataacataaataatacttgggaataaattttactaaggaggtgaaagacctgtataccgaagacaataaaacattaatgaaggaaattgaagaaaatgcaaataaatgaatatcccatgctcatgaattagaagaatgttgttaaaatgttcatactacctaaagcaatgagtagattcaatgcagtccttataaa

SEQ ID NO: 3637 - DNA, 601 bp, Human
ctattaaacatgtaccagaagtactatcaaaagcatttagaaaagacacattcaacttggaaatgaagaagtaaaattacctctatttgcagatgaaatgattctacctgtaaaaaaccctaatgactccactgaaaaaccattaacactaacaaataagttcaataaagttgcaggatataaaatcaacatacaaaatctgtgacatttctatacacgaataacaacctagccaaaaatgaaatcaagaacaccattccatttataacataaataatacttgggaataaattttactaaggaggtgaaagacctgtataccgaagacaataaaacattaatgaaggaaattgaagaaaatgcaaataaatgaatatcccatgctcatgaattagaagaatgttgttaaaatgttcatactacctaaagcaatgagtagattcaatgcagtccttataaaaaccccaatgacagtatttacagaaatcagaaaaaaatcataaaatttgtatggaaccacagaatatcccaaatagtcaaaggaattctgagaaaaaaaaagacatcatactacctgatttaaagttatattacaaagata

SEQ ID NO: 3638 - DNA, 601 bp, Human
aagtactatcaaaagcatttagaaaagacacattcaacttggaaatgaagaagtaaaattacctctatttgcagatgaaatgattctacctgtaaaaaaccctaatgactccactgaaaaaccattaacactaacaaataagttcaataaagttgcaggatataaaatcaacatacaaaatctgtgacatttctatacacgaataacaacctagccaaaaatgaaatcaagaacaccattccatttataacataaataatacttgggaataaattttactaaggaggtgaaagacctgtayaccgaagacaataaaacattaatgaaggaaattgaagaaaatgcaaataaatgaatatcccatgctcatgaattagaagaatgttgttaaaatgttcatactacctaaagcaatgagtagattcaatgcagtccttataaaaaccccaatgacagtatttacagaaatcagaaaaaaatcataaaatttgtatggaaccacagaatatcccaaatagtcaaaggaattctgagaaaaaaaaagacatcatactacctgatttaaagttatattacaaagatatagtaatcgaaagagtat

SEQ ID NO: 3639 - DNA, 601 bp, Human
atacatctgcttgagggccagctctttagagaatttcacctattctgaaataactacctagtaactcaatgtcacatgcccactttaatccttcacatagtactggccaccatctgatatgtttatgtttgtctcttggtctctctgctgatggagctcacatggtgatttcactactgcatttgcagttcccagagcactctcagtgtattgtaagtgctaataaatatttcgttcccatggagggtaggaagtaagtacatgtctcatcagataatacctaaaaatctatcttcaggartttcttctttgtaatcgaactttagttacctattaaaagacatgcacttccagaaatgcaatctaataaactttgatgagctattatttagtaggaataatctgttggtcccttttcaatgagtcaatccactatgtaactttttttttttttgagatagagaaaggaacagaacattggtaagtttgaaacatgggaaggagattcaactctgcctgaagagaacaaagtagactagaaacaatggtgtctctgcattgcaccattgataacggagcatgtatttcaccaggatatgaa

SEQ ID NO: 3640 - DNA, 601 bp, Human
atcagaccagaatattgctggtgtcccttcacctccaaatttatgagccttgtcagtagataatcctgtcggttgaattggtgttaaaatgctaatattgtctgcctttactccagatatcaaccaactgcttataaaattacagatgtcaaataatagaagaacttttgcagaaaacaatattgtatcagtaattctactctttatatttcagaaattgaaagacaggaaggttcaggaacatgagaaatacatagaatattatttggtcctggataatggtgaggtaattatatgagayaaatgtgctgtcttccaaaactcccacccacatatatttatttattatgtgagacattaaatatctggatgagatttaaagaatcatgaatatgagctatggttacatgttcttctaaaactatgaaatttgacatttataattaagctgatatgacttcttttcagagcgatcagggcaattgatatgatatgcataaattgttggcacttataacactattttcttattgacttaagagtacccaacttagtttccaattacattcttctgtcattttgtcttttgttaagttgttaa

SEQ ID NO: 3641 - DNA, 601 bp, Human
taattggtcacaatgaaagcttagtgaatggaatcctctgaaaaggcaaatctttggtaatagtcactgtttatcttctactgtaagaatgcattttcatatactgtgttttcaaaatttaaaatgcacatgtgtatgaaaatataagtcaaccattagctcaggccctaaagctttggtcttacttactgtgcttaattcatgtactgttcatgtatgtgtctcttaaattaataagatattccttctgttaattctgcacaccttagaaaaccatagaatttaagtgaaaatacatttggagtaattctttagagctttatactgagctagtacttcagaagagaaaacatcatattcactcccaaagtgctttaatgtagctagatgaataggaattaatttgattctaacttttaattaaatctaataactaatctttaattaaaatcaataataagtaatataagagaagatgcctttttaaccttccaagtatattcatttttatcaatgcccatattctttcttaatttttcttttagtttaaaaggtacaatgagaatcaagatgagatcagaaagagggtatttgagatggc

SEQ ID NO: 3642 - DNA, 601 bp, Human
gattcaaggggaaggcactactcaggctgagaatactgcaaggctggttcattgagggggtcacctttgggaagcagccgacacaatttcttaatttggaaaggtgagttttagactcgagagcccattctttgtggaggagtttagtggttttctaaggtctcatagctggtaagtaataagggagccagacaaattgctgaatactccatcactgtaagtaataacgtagaagcttaaaaataatagacgagatgataaatgtataggtaaaaataaatgacgatacaatgtcaagaayagattccttgaagagatcagaataaagatacgatgaaaggaaatagttgttcttccagttatgcaattaatgtcttaccatttaccaaacaagttaacaaaagagacctatacttaggtataagtaggttaaaaaaattagagtccgaatatactgtttacttaaaagataaaccaaaatatataactccaaaatgaacgaaatgttattttttgcaaatgagcaagtggggagaactgaaaccacaaaaatgtagaatgaagtataaataactttgtgatataattttaaaagagaaca

SEQ ID NO: 3643 - DNA, 601 bp, Human
gaacaggtatcataaaccttttaagtatgcataatgtaaaatatattttcaaaataaatatctgaaatcagattaaatagataaaatctgcagggaatgaaaaattggaacgttttctaattttctcattttatacagcagaattaaaactctctatttttagtattgttttatggtaaaatacaggttcaatttcccacgtaagtgcatctactaaggaaattaaaaacttgatgcaatttggcaaatttctagagacaattaagggccaggatcttgtacagatagcaaaaaaaaaaacaaaaaaaaaaaaaaaacccaaaaaacaaaaactaaaaggaaagagtatgaaattattgaaggtttatagaaaaatcaaaaggaaccaaaaaagcaaaattaaaattaccaaagacaaaacatattatctatggaagtataagtgcaaatgattcaaacccctctccagtataaaacttatttgaataatataaatgatcactaatacaaatgctttcaaaatgggcccaatccctaaacctactgtagctaaaacaatgctaatgtaaaacaaaagtatgtgatataaaaatatgagtaa

SEQ ID NO: 3644 - DNA, 601 bp, Human
caggtatcataaaccttttaagtatgcataatgtaaaatatattttcaaaataaatatctgaaatcagattaaatagataaaatctgcagggaatgaaaaattggaacgttttctaattttctcattttatacagcagaattaaaactctctatttttagtattgttttatggtaaaatacaggttcaatttcccacgtaagtgcatctactaaggaaattaaaaacttgatgcaatttggcaaatttctagagacaattaagggccaggatcttgtacagatagcaaaaaaaaaaaaaacaaaaaaaaaaaaacccaaaaaacaaaaactaaaaggaaagagtatgaaattattgaaggtttatagaaaaatcaaaaggaaccaaaaaagcaaaattaaaattaccaaagacaaaacatattatctatggaagtataagtgcaaatgattcaaacccctctccagtataaaacttatttgaataatataaatgatcactaatacaaatgctttcaaaatgggcccaatccctaaacctactgtagctaaaacaatgctaatgtaaaacaaaagtatgtgatataaaaatatgagtaagat

SEQ ID NO: 3645 - DNA, 601 bp, Human
gtatcataaaccttttaagtatgcataatgtaaaatatattttcaaaataaatatctgaaatcagattaaatagataaaatctgcagggaatgaaaaattggaacgttttctaattttctcattttatacagcagaattaaaactctctatttttagtattgttttatggtaaaatacaggttcaatttcccacgtaagtgcatctactaaggaaattaaaaacttgatgcaatttggcaaatttctagagacaattaagggccaggatcttgtacagatagcaaaaaaaaaaaaaaaaacaaaaaaaaaacccaaaaaacaaaaactaaaaggaaagagtatgaaattattgaaggtttatagaaaaatcaaaaggaaccaaaaaagcaaaattaaaattaccaaagacaaaacatattatctatggaagtataagtgcaaatgattcaaacccctctccagtataaaacttatttgaataatataaatgatcactaatacaaatgctttcaaaatgggcccaatccctaaacctactgtagctaaaacaatgctaatgtaaaacaaaagtatgtgatataaaaatatgagtaagatata

SEQ ID NO: 3646 - DNA, 601 bp, Human
tcataaaccttttaagtatgcataatgtaaaatatattttcaaaataaatatctgaaatcagattaaatagataaaatctgcagggaatgaaaaattggaacgttttctaattttctcattttatacagcagaattaaaactctctatttttagtattgttttatggtaaaatacaggttcaatttcccacgtaagtgcatctactaaggaaattaaaaacttgatgcaatttggcaaatttctagagacaattaagggccaggatcttgtacagatagcaaaaaaaaaaaaaaaaaaaacaaaaaaacccaaaaaacaaaaactaaaaggaaagagtatgaaattattgaaggtttatagaaaaatcaaaaggaaccaaaaaagcaaaattaaaattaccaaagacaaaacatattatctatggaagtataagtgcaaatgattcaaacccctctccagtataaaacttatttgaataatataaatgatcactaatacaaatgctttcaaaatgggcccaatccctaaacctactgtagctaaaacaatgctaatgtaaaacaaaagtatgtgatataaaaatatgagtaagatataaat

SEQ ID NO: 3647 - DNA, 601 bp, Human
aaatctgcagggaatgaaaaattggaacgttttctaattttctcattttatacagcagaattaaaactctctatttttagtattgttttatggtaaaatacaggttcaatttcccacgtaagtgcatctactaaggaaattaaaaacttgatgcaatttggcaaatttctagagacaattaagggccaggatcttgtacagatagcaaaaaaaaaaaaaaaaaaaaaaaaaaaacccaaaaaacaaaaactaaaaggaaagagtatgaaattattgaaggtttatagaaaaatcaaaaggaaccaaaaaagcaaaattaaaattaccaaagacaaaacatattatctatggaagtataagtgcaaatgattcaaacccctctccagtataaaacttatttgaataatataaatgatcactaatacaaatgctttcaaaatgggcccaatccctaaacctactgtagctaaaacaatgctaatgtaaaacaaaagtatgtgatataaaaatatgagtaagatataaataaaaacaaagcctgtgtggtactgctaatatcaaaacaagatacatgtagacagatgtttattaagaccaaaaa

SEQ ID NO: 3648 - DNA, 601 bp, Human
atcaaaaggaaccaaaaaagcaaaattaaaattaccaaagacaaaacatattatctatggaagtataagtgcaaatgattcaaacccctctccagtataaaacttatttgaataatataaatgatcactaatacaaatgctttcaaaatgggcccaatccctaaacctactgtagctaaaacaatgctaatgtaaaacaaaagtatgtgatataaaaatatgagtaagatataaataaaaacaaagcctgtgtggtactgctaatatcaaaacaagatacatgtagacagatgtttattargaccaaaaatagcctttctttttcttcacaagggatacatctcacaatgaaaagtgttataatcagaaatgatagaaaatattcaacataattctatctaggtgtttggattttaagtaacacaaaagccattctatagaaaaatgccttatgcaaattcaaaaactaaagaaaaatatgacagtgatggttcacagtgagtttttctgctaaccatttagggttttggatgtattgtctataaaaatagagcttagcattataatttgttacatcaatttattcctttcttgcagagca

SEQ ID NO: 3649 - DNA, 601 bp, Human
tacaaaccactgctcaaggaagtaagaaaggacactaacaaatggaaaaatattccatgctcatggataggaagaatcaatatcatggaaatggccatactgcccaacataatttatagattcagtgctatacccatcatacaattgactttcttcacagaattggaaaaaactattttaaatttcatatggaaccaaaaaagagcctgcatagcaaagacaatcctaagaaaaaagaacaaagctggaggcatcacactgcctgacttcaaactatactacaaggctacagtaagcaaawcagcagggtactgggaccaaaacagatatatagaccaatggaacagaacagaggcctcagaaataatactacacatctacaaccatctgatctttgacaaacctgacaaaaacaagcaatggggaaaggattctctatttaataaatggtgttgggaaaaatgtacagattttttaagagtatgcctctaactctttcttcccatctattgtgctattattatcatatgtttaactttatatcaccataaatacacaatacattgttattaattttgttttagatatccatctttcattg

SEQ ID NO: 3650 - DNA, 601 bp, Human
aaagtgctaggctgatgaacaattttagatccctgatggccaaatgcatcatagacttctaaaaggcaagccaaatgtaagggagatagatcacttaaaaaaaagttctgatttcttattgttgatgaaaatttgccatctttcttggaaagaaaactagaacaatttccttcattataggaacctactcaaagaggaaagggcagaccatatatgctgtgatgggcattcagttccatttagtactctctctctcttgctctgtgtgtgtgtgtgtgtgtgtttgtgtgtgtgtgtgtgwgagagagagagagagagagagagagagagatggcaagtagagtgatgtataatttcattcgaaaatcagagaatctttttcttctttcatacctttaggaccacagcgataatcttcttagagttgcagggacaatggcacatgaaatgggccacaactttggaatgtttcatgacgactattcttgcaagtgtccttctacaatatgtgtgatggacaaagcactgaggtgaggctctctgggccctggggacatgctatgtagccctggttttgatccactgtgggctgtactacttt

SEQ ID NO: 3651 - DNA, 601 bp, Human
gtaagattattttattctattttaataattatgattacatttttatacattaacatctcagtgattatgttaactgaaataagcaatgcaatatttttctttatataaaatgatatatttactatttatgaagcacttactcagtgttctacacacatggcctattgaatcttccagtgatccttcacagtagatattatttcattttgtttttgagaaaaaaatgcagagtagaaaatgaacaaaataatatggccactatttgctacagcctggatacacctgagaacattatgccaastgaaataagccagcatagaaagacaaacactgcatactgatctcacttgtatgtggaatccaaaaacgttgaatacacgcaaacagagtagaatggtgtttaccaagggcaaggaggctcggaaaatggggagatgatggtcaaaagggacaagttacagttatgtagcatgagtaaggttaaagatctaatgtacaacatgactataggtacaggtacaatgtgaccgtattgtatgttaataatttgctaagagagtagattttaagtgttctcaccacacacacacccacaccaaca

SEQ ID NO: 3652 - DNA, 601 bp, Human
gcgccaggttaaaggtggaaacaaaattgattgttggttaagaagctcatgtttccttggctaacttcagtatacggcaaaaaccaggagaaagaaaatctttagcacagaggtgaagttctgagcatcacctttattatcttgtagtaaatattaactgcaaacaatattaactgttaccctcctccctcctttgtccgactttatgattagtctcctcggcaaatctgtaaacttcctggaacagggacattgtctacattgttcacagttgtattcccagtgcctcccagcacagtgyctggctttagtaaaaagctcaaaattgtctattgaattaacattgaacatatttatctgatcaggaaatggagtagacctcttaagtcatacatttaaatacagccattataaaaggccagagaaaacaatttgcctaaacaaaattccaaattttataattcacagaggatcacgtatttattttaaattaatctgggaagtttgaaaagtcttgcaactttgtaagtaatttaaaaatcattctttttggcatcaaatcattcccacaaatcaattctaattccaagtattgaaaatg

SEQ ID NO: 3653 - DNA, 601 bp, Human
acaaaattccaaattttataattcacagaggatcacgtatttattttaaattaatctgggaagtttgaaaagtcttgcaactttgtaagtaatttaaaaatcattctttttggcatcaaatcattcccacaaatcaattctaattccaagtattgaaaatgtggctaaggcataagcaggcaatttgtcataaagaagaaatacaaatgtcctgtaaaattaaaatcattttaactcattagcaatatacaaaacctgaatgaaaacaagttaatcttctacatttgctaattggcaaaastttgctacagatgttaatgttcagtgtcacagaaaacataaccaaacaactcccttcgtacactgctggtaaatacacaagttagcatcatctttacggacagaaaaatgcatacacaaaatctaaaaataattgttttttactccttctcctagcaattgtactcaaataattatgaggatttttcaaccagcattttttaatgatagtggataactgaaaaacatctcaaaatccaaaatatatggattagttaaataaagtgcattaattcaatacaatttttgcagctgtgatgct

SEQ ID NO: 3654 - DNA, 601 bp, Human
ctgcaaagcaaagtaagtggccttgtctgaaccttcctgcttcacagactagagcaatggtacacttccagctacacattctgatttattccagttaaagggaaagtgcatttggtcatcaatcatttgacaaacatttattgagtaactactatgtgccatgatgtgggctaggtaccgagtctaaaacaacaaataagaaatggcttctttcttcaagtatctcatggtgggtgcttcagatgacacaaagcacagtcattgttgggtagaatgaatggttgtgatggaacatgccacraagaatgggtctggttagaaatttgtccagggatttcccagtataaatcagatgctttctcaatctcatgtttttccttgtaagattcagagtagaaatatttatctacccagaggaataacagatgcagtgcttgaacagttttttaaactttcagtagaattacataaagaaaaaatacaatatgaaaatattgacaattcatctgaagagtttgttagttttagtactgatatccgggaaaacactatagaacagcacaccagaagaacttgggatttttctatggtttaattctgc

SEQ ID NO: 3655 - DNA, 601 bp, Human
tttagtcctgttggcagtaaatgaatggcttgagtgagtgttgagcagtttaatctgcaccttcagggagacagttcttttagtaactccacctgatgccttgcagtgtcaagggaggctcagctttgttctgacagcattatagtggagacttgggctttcttttggtggaattattctgcagccagttgtacaaataaatgagtaacctatctgaaacaagctagaaattgatgtctcagatgcctccatgatgttaggaatccatgttttatcctctagctccatcatccacatgacyttcatttccatgtgtttctctaggcctatgatagcttctctagctatcatactccaatcagcaaaaaatgagaaaatgttgagaaatagaagataattcctcatttaaggccaccttctagaatttgtgcttaagattctgttttcttctcatgggccagcacttcggcaactggcaaaaattaggtgtacagggatctaggtaatactgtttatttgagcaataatatattgtgctaacgttcaggcatcctattactgagaaataagggaaaatgagtgtaaagtacaactaagagtc

SEQ ID NO: 3656 - DNA, 601 bp, Human
ataaatgagtaacctatctgaaacaagctagaaattgatgtctcagatgcctccatgatgttaggaatccatgttttatcctctagctccatcatccacatgactttcatttccatgtgtttctctaggcctatgatagcttctctagctatcatactccaatcagcaaaaaatgagaaaatgttgagaaatagaagataattcctcatttaaggccaccttctagaatttgtgcttaagattctgttttcttctcatgggccagcacttcggcaactggcaaaaattaggtgtacagggwtctaggtaatactgtttatttgagcaataatatattgtgctaacgttcaggcatcctattactgagaaataagggaaaatgagtgtaaagtacaactaagagtctcggctacagggaaaaataccatcagttaaatatccatagtcctagagcatttatgtaaaactgcaatttgaatcctgcaatacattttggctttttcctcagtgataccatgtgtgggaagttgttctgtcaaggtgggtcggataatttgccctggaaaggacggatagtgactttcctgacatgtaaaacatt

SEQ ID NO: 3657 - DNA, 601 bp, Human
acctatctgaaacaagctagaaattgatgtctcagatgcctccatgatgttaggaatccatgttttatcctctagctccatcatccacatgactttcatttccatgtgtttctctaggcctatgatagcttctctagctatcatactccaatcagcaaaaaatgagaaaatgttgagaaatagaagataattcctcatttaaggccaccttctagaatttgtgcttaagattctgttttcttctcatgggccagcacttcggcaactggcaaaaattaggtgtacagggatctaggtaatrctgtttatttgagcaataatatattgtgctaacgttcaggcatcctattactgagaaataagggaaaatgagtgtaaagtacaactaagagtctcggctacagggaaaaataccatcagttaaatatccatagtcctagagcatttatgtaaaactgcaatttgaatcctgcaatacattttggctttttcctcagtgataccatgtgtgggaagttgttctgtcaaggtgggtcggataatttgccctggaaaggacggatagtgactttcctgacatgtaaaacatttgatcctgaag

SEQ ID NO: 3658 - DNA, 601 bp, Human
aatcagcaaaaaatgagaaaatgttgagaaatagaagataattcctcatttaaggccaccttctagaatttgtgcttaagattctgttttcttctcatgggccagcacttcggcaactggcaaaaattaggtgtacagggatctaggtaatactgtttatttgagcaataatatattgtgctaacgttcaggcatcctattactgagaaataagggaaaatgagtgtaaagtacaactaagagtctcggctacagggaaaaataccatcagttaaatatccatagtcctagagcatttatrtaaaactgcaatttgaatcctgcaatacattttggctttttcctcagtgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtaagttgaaattgtggctttcactcaaaatagtgttttttactttggtgtgctttgttgttttgcccctcggttattcactatgtgccttgt

SEQ ID NO: 3659 - DNA, 601 bp, Human
aaatagaagataattcctcatttaaggccaccttctagaatttgtgcttaagattctgttttcttctcatgggccagcacttcggcaactggcaaaaattaggtgtacagggatctaggtaatactgtttatttgagcaataatatattgtgctaacgttcaggcatcctattactgagaaataagggaaaatgagtgtaaagtacaactaagagtctcggctacagggaaaaataccatcagttaaatatccatagtcctagagcatttatgtaaaactgcaatttgaatcctgcaatamattttggctttttcctcagtgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtaagttgaaattgtggctttcactcaaaatagtgttttttactttggtgtgctttgttgttttgcccctcggttattcactatgtgccttgtttcccgattttggggttcgccatgcctt

SEQ ID NO: 3660 - DNA, 601 bp, Human
ctggtcagcctagcggggacagtaacaggatcattgctcccctaggtgtgtgaccatgagctccagtgtcaatgtgaggaaggatggatccctcccgactgcgatgactcctcagtggtcttccgtaggtaacattacacatctaacctgagaaaattgctctcctcttccaagcctttattttgtattatatgagatttcactgcttcttttctctgttcttgaaatttctgttctgttgatgttgaatccacaatatttatcccccaaatctccttaataccttttaattatattttcygtgtcttcattttcactgcacatgcaaaaaaatttcctcaacctttatatttgtaatcttattttaatttcacaaattttcttactttaggactcttccattttcatagcagcctcaagttaatggaaaaatgtaatatcctcaaaactctctaagaatatgacctattattttgtatgttcagttctattctttgaattatctgtttcttttgagttggtttgttctgttgtcaccacgtcacttgtattctgttgtactagttttcttcaggatatgtgatccttagttcaatgtgga

SEQ ID NO: 3661 - DNA, 601 bp, Human
tataataagggccaagaaatagacccagacatctgctttcctgcctcttttcagtctgatctcccctctttctctaagggttgaccattaatctttcttttgtcataatcattttgttagttttctttgtagttttgcttcctaaatacacatccttaaacagcagcttttggttatataattccatgtgtataaagtttttaaacacaggaaacacagcttccctcactatcaacactgtcaccagagacatacatttgttacatccatgaacatacccggacacatcattatcaccaaragtctttaaagtttgtatgtatgaaatttttctatgctcattttcttctttttctctaccttatgctttcaagatcatccattctagtgattggattaaggtccactagttctctttcaagtttctaagaattctgtcaaatacttccttatttattaaaatgttttcccctttactctattagtactgtcaaataagtcaattggtttgtgaacatttatctaactttgcaacctttgaataaacctaagttagaaataatatcttttttatatagtgaaggatgtttactcttatttt

SEQ ID NO: 3662 - DNA, 601 bp, Human
ttaaagtttgtatgtatgaaatttttctatgctcattttcttctttttctctaccttatgctttcaagatcatccattctagtgattggattaaggtccactagttctctttcaagtttctaagaattctgtcaaatacttccttatttattaaaatgttttcccctttactctattagtactgtcaaataagtcaattggtttgtgaacatttatctaactttgcaacctttgaataaacctaagttagaaataatatcttttttatatagtgaaggatgtttactcttattttatactyttgggtgatattggactgtgattttttcatattgaaaaaattgctgaattttggtatcaaggttatgctagtcgcataaagtgtattggagagtattcatttatattctctggaagaatttgtattttttggctattttatattcatgggtgatattggactgtgattttttcatatacgtgttctgtagtattctccagatattttgtttatcaagtttattaattgtctgatatataaattaagcctaacattgtttatttgttctaccaattactgtgctgggagtgttaaaatacc

SEQ ID NO: 3663 - DNA, 601 bp, Human
ttccctttaactgagaaatccttcacatctagaaatgttttttgtttttccttctgttagtcaccgtagttataataataagagtgatattaactctcattatgacagattttttgaatttgttgtaagaatataatatctaacattatttgatcaatatacgatgagcactgtgctaagcaccgccccacccacttttttttgagacaagagtctccctctgtggcccaggctggagtgcgatgctgcgatctcggctcactgcaacctccacacctcccagtttcaagtacttctcctrcctcagccccgagtatctgggattacatgcacataccaccacaccgggttatttctgtatttttagtagagatggggtctcaccatgttggccaacctggtctcaaactcctgacctcaaatgatccacccactttggcttccctaagtgccgggattacaggtgtgagtctccacacccggccgtgtgctaagcccttttatatctattatcttatttacacttcacaagaacttcataaagtggtcatgagtttcattttacagatgagaaatgttttatgctaacccttacacaatt

SEQ ID NO: 3664 - DNA, 601 bp, Human
gttagtcaccgtagttataataataagagtgatattaactctcattatgacagattttttgaatttgttgtaagaatataatatctaacattatttgatcaatatacgatgagcactgtgctaagcaccgccccacccacttttttttgagacaagagtctccctctgtggcccaggctggagtgcgatgctgcgatctcggctcactgcaacctccacacctcccagtttcaagtacttctcctacctcagccccgagtatctgggattacatgcacataccaccacaccgggttatttytgtatttttagtagagatggggtctcaccatgttggccaacctggtctcaaactcctgacctcaaatgatccacccactttggcttccctaagtgccgggattacaggtgtgagtctccacacccggccgtgtgctaagcccttttatatctattatcttatttacacttcacaagaacttcataaagtggtcatgagtttcattttacagatgagaaatgttttatgctaacccttacacaattttgcaaggttaggaacttcacattttgatggatatagaaacaagctcagagagat

SEQ ID NO: 3665 - DNA, 601 bp, Human
aagagtgatattaactctcattatgacagattttttgaatttgttgtaagaatataatatctaacattatttgatcaatatacgatgagcactgtgctaagcaccgccccacccacttttttttgagacaagagtctccctctgtggcccaggctggagtgcgatgctgcgatctcggctcactgcaacctccacacctcccagtttcaagtacttctcctacctcagccccgagtatctgggattacatgcacataccaccacaccgggttatttctgtatttttagtagagatggggtytcaccatgttggccaacctggtctcaaactcctgacctcaaatgatccacccactttggcttccctaagtgccgggattacaggtgtgagtctccacacccggccgtgtgctaagcccttttatatctattatcttatttacacttcacaagaacttcataaagtggtcatgagtttcattttacagatgagaaatgttttatgctaacccttacacaattttgcaaggttaggaacttcacattttgatggatatagaaacaagctcagagagattattagcaaacatgctttcagtct

SEQ ID NO: 3666 - DNA, 601 bp, Human
ctagtagtgattatgaattacaaggcaatgaaagaggctgacggggaagtaaaaactgatccagggagcagataaaaacccaggcaataggcaagaaagacataatgggaaaaagaagttgggaatcttctacggagtttccctgtcatgctgaaggagctgctaagtcaattgatatcatgtgtttctctcttacaggccactatctaccactggcaccaggccacacaaacagaagaggaaaccccagatggtaaaggctgttcaaccccaagaggtgaactatatagtctgggctgtrattaccatggccccactttgcgtttctctcacactcttatcctgactacctatctatcatttctacccagcagcgttttgcagtaaaacattcagaaatgtctcctttgccttttgttaaaggcaaaagagtccctaaaatgccgaggctactttgccggggttcatgaaatgcaaacagaataaagagaacaaagaatgcacataccggatgtctgtctgtctctctctttgtctctgcttcattctctctccctctctcacacacacacactccctctagcttatttctttgcaaatt

SEQ ID NO: 3667 - DNA, 601 bp, Human
taggcaagaaagacataatgggaaaaagaagttgggaatcttctacggagtttccctgtcatgctgaaggagctgctaagtcaattgatatcatgtgtttctctcttacaggccactatctaccactggcaccaggccacacaaacagaagaggaaaccccagatggtaaaggctgttcaaccccaagaggtgaactatatagtctgggctgtgattaccatggccccactttgcgtttctctcacactcttatcctgactacctatctatcatttctacccagcagcgttttgcagtaamacattcagaaatgtctcctttgccttttgttaaaggcaaaagagtccctaaaatgccgaggctactttgccggggttcatgaaatgcaaacagaataaagagaacaaagaatgcacataccggatgtctgtctgtctctctctttgtctctgcttcattctctctccctctctcacacacacacactccctctagcttatttctttgcaaattgacaaaatagatacaaaaatatgtatgtctgtatgataatacatgtaatatttataacccaaatgtcctactcatgtcctgtaaatt

SEQ ID NO: 3668 - DNA, 601 bp, Human
ccaccctagttcaatctccaggaaatatcggtgaaagtcatagcccacaacacttcattatttcttcaggacaatattgaaatctatgtgaatattaatataaaatacaaattcttctgcaaaatattttgaaaatataaaaaaatgaacatgtatgtcactccatgccaacttgtgacaagaagaggactaatctgcttaatagagtaccactgttttcatcagctcaggctgctgtaactaaattaacatagattgagtggcttaaacaacagatatttacttctcacattctggagaytgggaagtccaagttcaaggagctggcagatccagtgtctggtgaagcggccttctggcttgtagacagctgcctttttattgtatcctcacatagcagagggagagcatctctcttgtgcttcttcttataatggcattaatcctatcatgagagctgcaccctcacgacctcattatttccaaaaggccccacctccaaataccatcattctggggattagggtttcaacatatgaaattgtggggtgacacaaacatacagtttatagcaatcatctttatcagatacctattgaca

SEQ ID NO: 3669 - DNA, 601 bp, Human
ctggtgaagcggccttctggcttgtagacagctgcctttttattgtatcctcacatagcagagggagagcatctctcttgtgcttcttcttataatggcattaatcctatcatgagagctgcaccctcacgacctcattatttccaaaaggccccacctccaaataccatcattctggggattagggtttcaacatatgaaattgtggggtgacacaaacatacagtttatagcaatcatctttatcagatacctattgacattggacttaggtctcaactgtgtatgtacaactaaatgraagcaatcaaactcatattttacaatattctcatgggtggggtcatggcttctccatttctgaaaatgatttaagtcttttctttatgcacgcctattttcaggaccctatctttgaatgtaaatgttttatccttttactagctaattacaaagccagattttccaccaccgccaattcctgcacctatatcatcttctttgcttgtaactatcagatagtcattggtgaatttttaatctctcacctgctcattgcaaatactgtctccacatccatcggttatcaggatgtgtactt

SEQ ID NO: 3670 - DNA, 601 bp, Human
aagaaatatctccgaagttaaaatctgtaataggaattgattcattctctaatgaaaacaaaacataaaaacatcacactaatcttggaggaataagaaaaattgtacatccattaaatgtacaattgattgcaacatcttgattgttttaaccattaacttgtcaaattacaatcacagttaagaaaatgatgtaaaattctgttttgtggatctctttcctagattagcttctgaaatcattattagctatatcatttgaggttttctacaatttggtataactaagaatttaaaaatrttttatcatatatatttgtataattaattactggcatggttaaagtggttttcactttttaaatggagaaaatttcagttaaattaataggataaaccaggttgcgaactggtgacctgtaggccatgtttgcactgcaaatatatttggtctgaatgatattgatattggacacatagtacttttacatgttttgaatgtattgctaatatttaaaaattgagagatcttgcataaacaatagattcccagctttgtcagatgtaatcaaaaagtaatccgatgctttgtcaacaacag

SEQ ID NO: 3671 - DNA, 601 bp, Human
ctgccatctttgtgtaactttgtgtaacatcttttatgtgtaacttggattcagctggggcctaccttcaggaagaaaaaaccgcccagaccaaagaactgctgtaggtgggcaaatgagcactacaacagcttagtctcattttgctgctcacagctaaatggtgaaatgttgattcttgtttaagtttgtttaaagcagtgggtctcaaagtgtggtccgtagaccagcagcctcagcctcacctgggaacgtggtagagatgtttggccccaccccagacttcccaggccagaaactyttagggtggggtccagcaactggtgcttaacccttaagtcatcacgatgcgagccttagtttgaagactactggtttaaatctgcaaatggtcacttgaaaacaagttagatctcccacaaactcaagcagcaaaggcagaacccctctccgatgttaaattaggacccccaaacttgactgctatgcgaatggtgagaaccaggttcctccgtccacttagaagcaaaggaccccggcccctccaccagggtaactagaatgggggttggagtcgatgtctgtaatctctaacacccag

SEQ ID NO: 3672 - DNA, 601 bp, Human
aggtgcctgctggcccagggtgagtgggggtctctagcttgtcctttgcacctttttactccataatggtctcaagaggtccctggcttttccgtttgaggaggaagaatcatttgacaaatagtttttacctgcctggcgtgtgccagatctccatagccccaagtcccctggctccgccctctcatacccattgtcctagaatttgagagggcaggtgggaggggtgggactacttccactttccccaaattcttttgccttattcactgtctactgatgaggccagatccaggtttaaaaaaaaaaaaaaaaaaaacaggcagaaaggaccagaggaaacaaaaaacaaagatactgatttccctgaccttggattttgctgtggttgttgctttgttcttatttttggctgaatattcgggagtgggtgggaacgggggtctttgggcatagatgggtgacagaggtgtgtgtaatccatccaccttcccttcctcccttctcttcagtggcgttttaccttcagccactttgtggttgaccctgaccaggaatatgaggtgaccgttcaccacctgcccaagcccatccctgatgg

SEQ ID NO: 3673 - DNA, 601 bp, Human
tgctgcaacctccattccctgaggcagaggccattctctgttggcacaacagtggacggtggcccaagatcccaggagttttatgggaaccagagcacctccctctatctagagaagcacccagcctgcccagaaaatagcataaaggcaagccacaagccactcgtggggaagttgcagcctctgcccccagcctggtcccagcctccgtggcttgctcttctccttccaccttacattctgcctgcatcatccaacgttcatcccatgcatggcgctctactccccatgcctatccacmctgcctgtgattaccgccaggcttttcttctcaggcatcctttgatgtacatgtaccttctacttctctgtcctccccagaagctcagctattacctacatttctctctttttgtttttaatagagatagggtcttgctttgtcacccaggctatagtgcaattttgctatcctagctcaatgcagcctcgaactcctgggctcatgcgattctcctgcctcagtctctctacaattctctgtccatagccagctatgtcaggaagcccacttgaaaacaaagcctgggtcttctgccca

SEQ ID NO: 3674 - DNA, 601 bp, Human
tccgtggcttgctcttctccttccaccttacattctgcctgcatcatccaacgttcatcccatgcatggcgctctactccccatgcctatccacactgcctgtgattaccgccaggcttttcttctcaggcatcctttgatgtacatgtaccttctacttctctgtcctccccagaagctcagctattacctacatttctctctttttgtttttaatagagatagggtcttgctttgtcacccaggctatagtgcaattttgctatcctagctcaatgcagcctcgaactcctgggctcawgcgattctcctgcctcagtctctctacaattctctgtccatagccagctatgtcaggaagcccacttgaaaacaaagcctgggtcttctgcccatttttataatctccagaacctcacgaattgccttgcatatagtaggttggtcaagaaatgcttgttaaggatggtgttgaccttcttcatcctgggaccaccctgcacacacgcgtgcacacacactctgtgcttaccctgctttatgtcaccgcgtgtggctcatcactccctgactggtactgcatgctgtgtgtttgctttta

SEQ ID NO: 3675 - DNA, 601 bp, Human
tccttccaccttacattctgcctgcatcatccaacgttcatcccatgcatggcgctctactccccatgcctatccacactgcctgtgattaccgccaggcttttcttctcaggcatcctttgatgtacatgtaccttctacttctctgtcctccccagaagctcagctattacctacatttctctctttttgtttttaatagagatagggtcttgctttgtcacccaggctatagtgcaattttgctatcctagctcaatgcagcctcgaactcctgggctcatgcgattctcctgcctcrgtctctctacaattctctgtccatagccagctatgtcaggaagcccacttgaaaacaaagcctgggtcttctgcccatttttataatctccagaacctcacgaattgccttgcatatagtaggttggtcaagaaatgcttgttaaggatggtgttgaccttcttcatcctgggaccaccctgcacacacgcgtgcacacacactctgtgcttaccctgctttatgtcaccgcgtgtggctcatcactccctgactggtactgcatgctgtgtgtttgcttttattggtctcttctactgg

SEQ ID NO: 3676 - DNA, 601 bp, Human
tcctcagttctcgcttctgttcctaaagttgactgactcagtccctgtccctccatggtgattcacacctgtcacatgtcttctcagcctgtgcaaagacaggggcagccggggacaagaagctgtgggtgggcagagaaggaactggaggggaccaagattgcttggtcacccacagcaagctcaggaggaatgcacttgcatcaggagggttccccgagagatgaggatcagacaggcaggctggcacccatgccaaggtgggtccagccctggagctcactctgaaggggccacctgyggacaggctcccagtggggaaaagattgttgttcttggtgtcaggagtctggaagaacagatttctgaaggcagaggcttaatgagtttccttttttctgggtcgacagactgtgagcacgccaggatgaaggtaaccacgccatgcatgagctcaggtaacagctggcccgggagagctttatttggatgcatacacatgcacatgtgcgtgcccctcctcactcccagcctgcgtgtgtgaccttggcaggcagcctgtgggaccccaacatcaccgtggagaccctggaggcccacc

SEQ ID NO: 3677 - DNA, 601 bp, Human
gtaactctgctctttttgacccctctagcatagctcaggaccacccctccaagccctgagtctcttctctgctggtctgacagaaccgcgttgctagaagctcgcgactcagggctgtgcttagtccatagtgatcatggcgccttgccctttttcttccccagtgatcttatgcttgatagaaaggcagttgactgtgtcctgcccatgactcagtcctttttgttctttcctcccccacacgcccccttgttctctttttgttttgctttgtttattacaaaaaggatttgaggatttaaaaaaaagaagaaatgtgaaaatagagacaaaggggaactaaagataaggaaataaggccaggtgcagtggctcccacctgtaatcccaatactttgggaggccaaggcaggagaatggcttgaagttggagttcgagactacagtaagccatgatggcaccactgcacccactctgggggacagagcgagaccctgtctctaaaaaagaaaataaaaattgaaaaataaataaagtacattaatgacataaaatatgccaggcacagtggttcacgcctataatcccagcagtttggga

SEQ ID NO: 3678 - DNA, 601 bp, Human
ctgttttcaaaagtcgcatgccctaatgcacgggaggctgcagccacgtgctcaccagaaggcaaggcgcaggcatggagccaggctggaaggagaacccagcctcccaaggaggaggcaaggtgtctcttcttagaccagcaactcaagtgtctcttgtagatggtttcattaagttcaacctggatctagagtgcctggtgcagggccaacatcattaaagccctcaagggacgtcagttgtgtttcttgtgatgactgggaagggttaagaatgctattttccctttttcctctgttytcattgcagaaccaattccgggtaagcttggatctctctccgacagcactgcagccctcaggggacattccccagtggccacttgagaagtccctgcctcagccaggcagacaaggctgaaccgaggccagcccggggtggggggtgagaccatggtttgtcgtggtggggccagagaggacagagcctggggctggggagcagggctgggggcctcagggtgggcagggcaggccccgccgcatcacgctgttctgctcaccgcagactacatgcccctgtgggtgtactggttcatca

SEQ ID NO: 3679 - DNA, 601 bp, Human
aggaggcaaggtgtctcttcttagaccagcaactcaagtgtctcttgtagatggtttcattaagttcaacctggatctagagtgcctggtgcagggccaacatcattaaagccctcaagggacgtcagttgtgtttcttgtgatgactgggaagggttaagaatgctattttccctttttcctctgttctcattgcagaaccaattccgggtaagcttggatctctctccgacagcactgcagccctcaggggacattccccagtggccacttgagaagtccctgcctcagccaggcagasaaggctgaaccgaggccagcccggggtggggggtgagaccatggtttgtcgtggtggggccagagaggacagagcctggggctggggagcagggctgggggcctcagggtgggcagggcaggccccgccgcatcacgctgttctgctcaccgcagactacatgcccctgtgggtgtactggttcatcacgggcatctccatcctgctggtgggctccgtcatcctgctcatcgtctgcatgacctggaggctagctggtaagcgctggggctctggctgtcctggagtcaggctctaata

SEQ ID NO: 3680 - DNA, 601 bp, Human
gtctcttcttagaccagcaactcaagtgtctcttgtagatggtttcattaagttcaacctggatctagagtgcctggtgcagggccaacatcattaaagccctcaagggacgtcagttgtgtttcttgtgatgactgggaagggttaagaatgctattttccctttttcctctgttctcattgcagaaccaattccgggtaagcttggatctctctccgacagcactgcagccctcaggggacattccccagtggccacttgagaagtccctgcctcagccaggcagacaaggctgaaccraggccagcccggggtggggggtgagaccatggtttgtcgtggtggggccagagaggacagagcctggggctggggagcagggctgggggcctcagggtgggcagggcaggccccgccgcatcacgctgttctgctcaccgcagactacatgcccctgtgggtgtactggttcatcacgggcatctccatcctgctggtgggctccgtcatcctgctcatcgtctgcatgacctggaggctagctggtaagcgctggggctctggctgtcctggagtcaggctctaataccagcaccacca

SEQ ID NO: 3681 - DNA, 601 bp, Human
agcaactcaagtgtctcttgtagatggtttcattaagttcaacctggatctagagtgcctggtgcagggccaacatcattaaagccctcaagggacgtcagttgtgtttcttgtgatgactgggaagggttaagaatgctattttccctttttcctctgttctcattgcagaaccaattccgggtaagcttggatctctctccgacagcactgcagccctcaggggacattccccagtggccacttgagaagtccctgcctcagccaggcagacaaggctgaaccgaggccagcccggggtggggggtgagaccatggtttgtcgtggtggggccagagaggacagagcctggggctggggagcagggctgggggcctcagggtgggcagggcaggccccgccgcatcacgctgttctgctcaccgcagactacatgcccctgtgggtgtactggttcatcacgggcatctccatcctgctggtgggctccgtcatcctgctcatcgtctgcatgacctggaggctagctggtaagcgctggggctctggctgtcctggagtcaggctctaataccagcaccaccactcactaccaaggca

SEQ ID NO: 3682 - DNA, 601 bp, Human
actcaagtgtctcttgtagatggtttcattaagttcaacctggatctagagtgcctggtgcagggccaacatcattaaagccctcaagggacgtcagttgtgtttcttgtgatgactgggaagggttaagaatgctattttccctttttcctctgttctcattgcagaaccaattccgggtaagcttggatctctctccgacagcactgcagccctcaggggacattccccagtggccacttgagaagtccctgcctcagccaggcagacaaggctgaaccgaggccagcccggggtgggsggtgagaccatggtttgtcgtggtggggccagagaggacagagcctggggctggggagcagggctgggggcctcagggtgggcagggcaggccccgccgcatcacgctgttctgctcaccgcagactacatgcccctgtgggtgtactggttcatcacgggcatctccatcctgctggtgggctccgtcatcctgctcatcgtctgcatgacctggaggctagctggtaagcgctggggctctggctgtcctggagtcaggctctaataccagcaccaccactcactaccaaggcaaatc

SEQ ID NO: 3683 - DNA, 601 bp, Human
agatggtttcattaagttcaacctggatctagagtgcctggtgcagggccaacatcattaaagccctcaagggacgtcagttgtgtttcttgtgatgactgggaagggttaagaatgctattttccctttttcctctgttctcattgcagaaccaattccgggtaagcttggatctctctccgacagcactgcagccctcaggggacattccccagtggccacttgagaagtccctgcctcagccaggcagacaaggctgaaccgaggccagcccggggtggggggtgagaccatggtttrtcgtggtggggccagagaggacagagcctggggctggggagcagggctgggggcctcagggtgggcagggcaggccccgccgcatcacgctgttctgctcaccgcagactacatgcccctgtgggtgtactggttcatcacgggcatctccatcctgctggtgggctccgtcatcctgctcatcgtctgcatgacctggaggctagctggtaagcgctggggctctggctgtcctggagtcaggctctaataccagcaccaccactcactaccaaggcaaatcgctttattctcagagcc

SEQ ID NO: 3684 - DNA, 601 bp, Human
aatagtgagggtcagcatcgggtgatagagaaggctccggctgccctgagccacaggggtggaccccagccccacctcattagccttgtagtcacaggccagttacttaatacaccatggattcacttttctgtaaaatgtactgataatgcctccctctaagggtgtgacgaaggttaaatgagtagctgaggaaggtgcttgctggtggggattagtacataccagtgtcttctcccacctgcagccctctgctggccaagtcctaagccgggagaacacaggccttccggttggggcytcagcccttgcctgccccaccatgaccctaggctgctccttccgtcatctgggaagctgtttccacccttccctaggctcgtcaggattaggtgttaatcattattaattattatgtggtagaaagaaaaccagccaggcatgggaggacctatgggaggttccaataacattcagtagcatctcggccagtgctccacaggcggtgcagctctctaaaggtttggggctgggcggcggcggcgcttttggtttcctttctgctgttgcgcttctgttttccgaagtgtcctgcaccaca

SEQ ID NO: 3685 - DNA, 601 bp, Human
gttccaataacattcagtagcatctcggccagtgctccacaggcggtgcagctctctaaaggtttggggctgggcggcggcggcgcttttggtttcctttctgctgttgcgcttctgttttccgaagtgtcctgcaccacagggtgaaggcaagaggagcctcgctgttatttggctgtcttgtgacagttctggggaagagctgaaagggttaggattgagattaaggttctaagtcgtttgctcagtcatctgtggatctcaatcctcccagctgtcactaaggagttaacccccgcaragcagttttttcatcacatctctgaggggaacaattgcttaagtatgtgggttccccttcctcacctcaaaaataccaggaggaaatgttgcaagcagcctggtggggctgcttctggaaagaagtgtggtaagatgcatgtcttctgtaaagacacttctggggaagagcttttcctcatgtggagtcagtttggggtggccaaatttcagggagacagggcagaccaggaccgtaatgaggaaccagaatggacaccaccccctgccccccggcactgggggtcccagctggatcagt

SEQ ID NO: 3686 - DNA, 601 bp, Human
caacagagcttggtgcctctttttcttttcttaattaaagtataggctaaagaccagctaggaacgttgagagattctttttcccacaaggcagcagactgatttttttcaggcagccaaaggtggaatagtaacatctgggtttttccaacaggcctcagttgggtttctcagcttagggagggagccaagctctgtgtcctggtccaggcccctcctgggctggcaggcacagagctgccctgggccctggggtgagggtcagcatgtgtggtcttgtttccttagatggcctgcctgyggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggct

SEQ ID NO: 3687 - DNA, 601 bp, Human
cacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagcyttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcggacatttgggataccaagataaattgcatgcggca

SEQ ID NO: 3688 - DNA, 601 bp, Human
gggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcggrcatttgggataccaagataaattgcatgcggcatggccccagccatgaaggaacttaaccgctagtgccgaggacacattaaacgaacaggatgggccgggcacggtggctcacgcctgtaatcccagcacattgggaggccgaggcaggtggatcactctgaggtcaggagtttgagccagcctggccaacatggtgaaaccccatctccactaaaaatagaaaaattagccgggcatggtgacacatgcctgtagtcctagctacttgggaggctgaggcaggagaattgcttgaatc

SEQ ID NO: 3689 - DNA, 601 bp, Human
tctgcatccaattttcctaaatcagtagttattttgttctcatcttctaccaaacttaattgaatccatatatctattgggtacatctgtagaatatgattgttttgatccctctttgaagtcaatagattttgtaaagttctacatcaactgaaaataataataaaaaaatagttagaaagttgtgttagaaacttggatacctaccggtctggtgtgtacggacacaggtacctcgaaggtcgtcactggatagccacagtcagaaacgctgtagggatctgaactgcttgaggaacamttggagatagagtcacaggccacaaaggtgttatcgagaggcagttcttggatgatgtggtgcttcgaattcaggggagtttcaggctgaatttggaaggcaggctgtggagaggcagatttgtagtgtcgggccaaatcagggctgtcgggcttgaaagtagtaggtgtagttacccaattgtactttcccattgtttgctcttctagatcaataggaaggtctagtgtgactctgtttccatcactgtcaacatcatctgccttagtttcttcaatagtgacaaaattaagcagcaag

SEQ ID NO: 3690 - DNA, 601 bp, Human
gtagcattggtcaccgactcattcacgaacagattgacaattacaacactgaagagagaatcaggctgtcctaagtcattagctttgaccaacactctgtgtaaaccaaggtctgtaacatcacatttctccatcaatgttatgttgcctgtttcttggtcgattgcaaacagatctcttgtgtttcctcctacaatgctgtaacgaacctctgcattcatgccagtgtcattgtcaacagcaattacctgaaagaccactgtgcctggattagtggacggtagaaccaattcataagaayagttggaaggagggacaatgaaaactggtttgttgtcattgacatcaaccacatttatggttactttggcacttgaagaacgtgatactctaccaccatcctcagcctttacatagaaagtgtaagattcttgtttttctctatcaaatgaaatatttggtcggatgacaccagtttgtgaatcaatggtgaagtcatcattctcatctaaaatggagagcgtaactgcagaattgtctccataatcaggatcagttacagtgattagtcctactgtaccatgccttggaaggttttctg

SEQ ID NO: 3691 - DNA, 601 bp, Human
ccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcrgtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaag

SEQ ID NO: 3692 - DNA, 601 bp, Human
atccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcaytgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaaga

SEQ ID NO: 3693 - DNA, 601 bp, Human
tgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacawgcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttcca

SEQ ID NO: 3694 - DNA, 601 bp, Human
cccctgccactctcccctgtgctggtcagggcccccacggggatgttgggtggggtctgggatgtggagggacagaggcggggactgagtcagggcatggctgggaaccccccaggtgtgcgatgtgtgtgcaaatacgtgtatgtgcatgagattgtacaagcgtgggtgagtctgagtgagacaggcagagaatagctgggcatatgtcgtttctccaggtgtcaatgtgtgcaaatatttggcttctaatggagggattagatacacttgcttgacgtgtggccatgcaacgcttgcmgtgagcttgcaggtgtgtctgtgactttaacacctcggacttctgatgggggagtgccgttctgtgtgagagtgtgacccagtgggtgagtgggtgatgggttgtgaatgttgacagtgtttgttcggatgtcaggggcagcatgtgtgagaatttgagcacgtgggagggtcataaaagctgggaccatttggcgggtggctgaagggggttgcctggacacggtgtttcacattcctggagtcccaggggacttatattcagagtggatgcctaagattccatgaccatgtggatgtg

SEQ ID NO: 3695 - DNA, 601 bp, Human
acgggcttggatgaaggacccccattcccactcttcctaggtcagaaccctcattttccagactcctcggaggcctgtttcagcctctgtttcctcttgcctccaatctccttctctccccatccctgcccgccctctctctgtcccactttctgtgccgggtctttccaggcctccatctgtgtccaagtctctttctctctctctctctctttctctcattctctctctctcttctcaatctctctctctctccacccgccttccccaacccatcaccccagcccccatctctaattgyctgttttgtggctaggctgtcattaagagaaatctgggttgcagtcccctggggctgagatctgggctcccaggctctgctgaccacaagagtcacttccccacggaacaatcatcccagctgccccatctcagcctggggcccagggcaggattgagaccgacgacctcacccagcctggaggctctcccctgacccgcaccctaacctctctgcagaggaaagagggtcttccctcaactaccactcatttacattaagaaagtccttcccggcatccaactcaaagctctcctgctt

SEQ ID NO: 3696 - DNA, 601 bp, Human
catcccagctaaggaaaggacttgtctggcccaacagttcctaatctaggccatgctaccagccccaccccagcaggcagcccagccagtgctaagtggaaccacatggcttgggcaggggcgggtgggggcttcccctgggccccgagcccctgtctgattcccccatcccccaaccctcagcaaactgtcccactgaccccctgccccagcctcttggcgggagctggattctccagaatctgccatgacctcacccctgggggcggctctgctgatctcaccacggggagctggggcrggggggctaagacgttggggaggcacgggcttggatgaaggacccccattcccactcttcctaggtcagaaccctcattttccagactcctcggaggcctgtttcagcctctgtttcctcttgcctccaatctccttctctccccatccctgcccgccctctctctgtcccactttctgtgccgggtctttccaggcctccatctgtgtccaagtctctttctctctctctctctctttctctcattctctctctctcttctcaatctctctctctctccacccgccttccccaacccat

SEQ ID NO: 3697 - DNA, 601 bp, Human
ttcccccacctcctccctctctctaacctcctcctttgaccaccatcacccacaacctcttccttttgactacagccattttggatctcctccctctgaccatctgcctctgaccatgcccactaacttctttttctggttaccccctctgaccttctgatcttcttctgcctgaccccagcctattccctctgatctcctttttctgtctgatcccaaactcctccttctgaatttcccctttgacctcttccctctgactttcacctctaacctcttccctctgaccctcctctatgamcttcctctctcagactttgccctctgacctcctccctctgaatgtctcctctgatctcctctcctgactttcccctctgacctcctccctctgactttcccctttgacctcttccttctgactttcccctctaacctcctccctctgactctcccctatgacctcctccctctgagcctcccctctgatctctcctctgactttcccctctgacctcctccctctgacattcccctctgacctcctccctctgacattcccttctgatcaactccctctgacctcctccctctgactacc

SEQ ID NO: 3698 - DNA, 601 bp, Human
agtgtgttttcttcccccacctcctccctctctctaacctcctcctttgaccaccatcacccacaacctcttccttttgactacagccattttggatctcctccctctgaccatctgcctctgaccatgcccactaacttctttttctggttaccccctctgaccttctgatcttcttctgcctgaccccagcctattccctctgatctcctttttctgtctgatcccaaactcctccttctgaatttcccctttgacctcttccctctgactttcacctctaacctcttccctctgaccmtcctctatgaacttcctctctcagactttgccctctgacctcctccctctgaatgtctcctctgatctcctctcctgactttcccctctgacctcctccctctgactttcccctttgacctcttccttctgactttcccctctaacctcctccctctgactctcccctatgacctcctccctctgagcctcccctctgatctctcctctgactttcccctctgacctcctccctctgacattcccctctgacctcctccctctgacattcccttctgatcaactccctctgacctcctcc

SEQ ID NO: 3699 - DNA, 601 bp, Human
gttgactctgtttttttttttccccttggtttttggtgagaaaaaaagttgacctagttctgggatgaatcaaaacttcctggcctaagccccagagtggaacggtccccctctccctgctctcccgcgcaggctccctagggctatatcccaggcctggagcccccttgccaggggaaacccacgtggagaggaggggcttccagtgtgttttcttcccccacctcctccctctctctaacctcctcctttgaccaccatcacccacaacctcttccttttgactacagccattttggayctcctccctctgaccatctgcctctgaccatgcccactaacttctttttctggttaccccctctgaccttctgatcttcttctgcctgaccccagcctattccctctgatctcctttttctgtctgatcccaaactcctccttctgaatttcccctttgacctcttccctctgactttcacctctaacctcttccctctgaccctcctctatgaacttcctctctcagactttgccctctgacctcctccctctgaatgtctcctctgatctcctctcctgactttcccctctgacctcc

SEQ ID NO: 3700 - DNA, 601 bp, Human
agcagcttgttgactctgtttttttttttccccttggtttttggtgagaaaaaaagttgacctagttctgggatgaatcaaaacttcctggcctaagccccagagtggaacggtccccctctccctgctctcccgcgcaggctccctagggctatatcccaggcctggagcccccttgccaggggaaacccacgtggagaggaggggcttccagtgtgttttcttcccccacctcctccctctctctaacctcctcctttgaccaccatcacccacaacctcttccttttgactacagccrttttggatctcctccctctgaccatctgcctctgaccatgcccactaacttctttttctggttaccccctctgaccttctgatcttcttctgcctgaccccagcctattccctctgatctcctttttctgtctgatcccaaactcctccttctgaatttcccctttgacctcttccctctgactttcacctctaacctcttccctctgaccctcctctatgaacttcctctctcagactttgccctctgacctcctccctctgaatgtctcctctgatctcctctcctgactttcccctc

SEQ ID NO: 3701 - DNA, 601 bp, Human
ggtggggaacagctagaataagcccaggactccaggatagaggctcagggtttttttagggggctcagcctctccctccctcccaccatgtttgtggctcaggaagaaggagccggcctgggcccccagcaccccccgcctcctcaccaccccacagatgttccgacctcagcagcttgttgactctgtttttttttttccccttggtttttggtgagaaaaaaagttgacctagttctgggatgaatcaaaacttcctggcctaagccccagagtggaacggtccccctctccctgctcycccgcgcaggctccctagggctatatcccaggcctggagcccccttgccaggggaaacccacgtggagaggaggggcttccagtgtgttttcttcccccacctcctccctctctctaacctcctcctttgaccaccatcacccacaacctcttccttttgactacagccattttggatctcctccctctgaccatctgcctctgaccatgcccactaacttctttttctggttaccccctctgaccttctgatcttcttctgcctgaccccagcctattccctctgatctcctttttctg

SEQ ID NO: 3702 - DNA, 601 bp, Human
agagttcccacgtggggatgccgagcgtgctggcctggccaattctgaatgcccggtcaccctctggagtcctctggggacagaagccaggcccctcggggaccccagcctggcctccctgcacacccagggccttcaggacatccacaggatctgcagcagagagaagccgggggtgtcaggcagaggtggggaacagctagaataagcccaggactccaggatagaggctcagggtttttttagggggctcagcctctccctccctcccaccatgtttgtggctcaggaagaaggagcyggcctgggcccccagcaccccccgcctcctcaccaccccacagatgttccgacctcagcagcttgttgactctgtttttttttttccccttggtttttggtgagaaaaaaagttgacctagttctgggatgaatcaaaacttcctggcctaagccccagagtggaacggtccccctctccctgctctcccgcgcaggctccctagggctatatcccaggcctggagcccccttgccaggggaaacccacgtggagaggaggggcttccagtgtgttttcttcccccacctcctccctctc

SEQ ID NO: 3703 - DNA, 601 bp, Human
acccaggcctcctactccaactcacctggaaagagttcccacgtggggatgccgagcgtgctggcctggccaattctgaatgcccggtcaccctctggagtcctctggggacagaagccaggcccctcggggaccccagcctggcctccctgcacacccagggccttcaggacatccacaggatctgcagcagagagaagccgggggtgtcaggcagaggtggggaacagctagaataagcccaggactccaggatagaggctcagggtttttttagggggctcagcctctccctccctcmcaccatgtttgtggctcaggaagaaggagccggcctgggcccccagcaccccccgcctcctcaccaccccacagatgttccgacctcagcagcttgttgactctgtttttttttttccccttggtttttggtgagaaaaaaagttgacctagttctgggatgaatcaaaacttcctggcctaagccccagagtggaacggtccccctctccctgctctcccgcgcaggctccctagggctatatcccaggcctggagcccccttgccaggggaaacccacgtggagaggaggggcttcca

SEQ ID NO: 3704 - DNA, 601 bp, Human
ggcctcagtgcgggtgcttctcaccccaccccttatccacggacccccgcccactctccccatgctcacctgccatctgtgaggttgacctgctgggggagggggcggaaggggtcacctaggagacccagcgctggccccagtgccaggcccaactgccgggcacccctttcatcataaatggacagcaggacagactgattggctggctgtccccgcaaggtgatcagcaaggagaagttctcaggaaagtggccttctgggtgggcagagggaacaaggcagctcagagggcccagcrgtgcctccctccggggaggtacccaggcctcctactccaactcacctggaaagagttcccacgtggggatgccgagcgtgctggcctggccaattctgaatgcccggtcaccctctggagtcctctggggacagaagccaggcccctcggggaccccagcctggcctccctgcacacccagggccttcaggacatccacaggatctgcagcagagagaagccgggggtgtcaggcagaggtggggaacagctagaataagcccaggactccaggatagaggctcagggtttttttagggg

SEQ ID NO: 3705 - DNA, 601 bp, Human
acgctgcaacggtgcacgaaagcatgaactcgcttcccttagcttcctggggatagattgaagcttgacatcttccttctttaatatcctctccagattcaggctgtagacaaaacatcccaccctctgcctcagtttcccccatcactgaactcctacctcgaaagtcttttccccaaggtcctgggtccccagcacagtgagtccagctatgctgatgaagcgggggccatggcccaaaacagggggctgagcttcacagtcagctaccagggtcaccatctcaccatctatgctgackgccacacggtgccacctgcaaggggacggcctcagtgcgggtgcttctcaccccaccccttatccacggacccccgcccactctccccatgctcacctgccatctgtgaggttgacctgctgggggagggggcggaaggggtcacctaggagacccagcgctggccccagtgccaggcccaactgccgggcacccctttcatcataaatggacagcaggacagactgattggctggctgtccccgcaaggtgatcagcaaggagaagttctcaggaaagtggccttctgggtgggcagag

SEQ ID NO: 3706 - DNA, 601 bp, Human
caactggatcttcccacaacaagccaagtaggcatcgtcacaatttatggtcttggccaggcgcggtggctcatacctgtaatcccagcactttgggaggccaaggcgggtggatcacttgaggccaggagttcaggaccagcttggccaacgtgtcaaaaccttgtctctactaaaaattcaaaaattagctgggcgtggtggcacacacctgtaatctcagctacttgggaggctgagaatcgcttgaacccatgaggtggaggttgcagtgagctgagatcaagccactgcactccarcctgggtgacagagcaaggctccatctcaaaaaaaaaaaaaaattattgtcttgtggctctgcaatctcacaatcacacgctgcaacggtgcacgaaagcatgaactcgcttcccttagcttcctggggatagattgaagcttgacatcttccttctttaatatcctctccagattcaggctgtagacaaaacatcccaccctctgcctcagtttcccccatcactgaactcctacctcgaaagtcttttccccaaggtcctgggtccccagcacagtgagtccagctatgctgatgaag

SEQ ID NO: 3707 - DNA, 601 bp, Human
gatcccaaccacaagccacatcccacacatctgccccactagaggtgcatcagttccttcaccggttcaagtgattctcagcctcccaagtagctgagattacaggcgtgtgccaccacgcccagttaatttttgaatttttagtaaagacaaggttttgccatgttggccaggctggtcccgaactcctggcctcaagtgatccacccgccttggcctcccaaagtgctgggattacaggtatgagccaccgcgcccggccaagaccataaattgtgacgatgcctacttggcttgttgygggaagagctggtactggggataaggaggaacatgagatagatcaggtccctggcctcccagaggtgacacacatcacggtcacacacagctaacaaaggtctccacacccagaacacatatcacacaaccacacaacacagctgcctgctggctcccaaagtcataaccgcccccacacaatcacacactatcacagcaaccagcaccatctcaggtcacagtctcagacacacgacaccaccagatctttccacaacaagccaagtaggcgctgtcacaatttatggtcttgtggctc

SEQ ID NO: 3708 - DNA, 601 bp, Human
tgtcccctccctctagtgccccaggactggagattgagggggtcagagatgggagagatcataagatgggacccacccccagcctgttatcagtcaccctgacagtcatcagtcagctgagagaagtcagagctcatggatccgagaccagagaaaaagatcatagatgagggaccagagattagtagagatgggagactagaagtcaagcaccaagaccagaagtcagacagtcaagaccggaagtcaggtggtcaaaaccggaagtgagaggtctcagggcccttacctggttctctgsggagtcaggaggtggacttgaggtccaaatttccttgttctttttcctgcccttccccttgcgacctcgccctttcttcctcccttttcccttccccttccgccgaggacgaggggtttctggttcaccctggggagcctgggagaagggttccagtcaggtctagagcatcccaccagcagagaccccatcattcaggtcacctggggtgaggctggctcatggcccgtgggtcctcactcagccctgtgacctggagtcaacgttattcatgtaacctggggtcaagggtggctcagg

SEQ ID NO: 3709 - DNA, 601 bp, Human
aatgattccccactatccagcaatccctatcagggaagccaaataatgcccccaattaatgactctcccaatgaataactgtccccagtgaccccaagcagggaaccccaaacaatgacacactaactaatgaacacgtcattcaacccagccaatgatccccccttaaacagtagccctcatcaagaactcccttaaaatcaggaacttatctgggtctgtcccctccctctagtgccccaggactggagattgagggggtcagagatgggagagatcataagatgggacccacccccascctgttatcagtcaccctgacagtcatcagtcagctgagagaagtcagagctcatggatccgagaccagagaaaaagatcatagatgagggaccagagattagtagagatgggagactagaagtcaagcaccaagaccagaagtcagacagtcaagaccggaagtcaggtggtcaaaaccggaagtgagaggtctcagggcccttacctggttctctgcggagtcaggaggtggacttgaggtccaaatttccttgttctttttcctgcccttccccttgcgacctcgccctttcttcct

SEQ ID NO: 3710 - DNA, 601 bp, Human
tgactctccaactaataacccccatcggtgacccctaatcaattattcctctaaccagtgatgctccaacagtgaatacccataaatgagcgcaacaaaagcgtcctaaccaatgacccccaaatagtaattccacccatcaatgacttcctaactaataattccctcagggactcccaaaccaattaccccatctgcgaccccctgaaaatcactcttccaacttgtggccccaatgagtgaccccactatgacttccagtcagtgaccacccaccaacaaccccccagtcattgacccyaaactagggacatcagtaacaccaataatggtttctatccatgaccttccactgtgatccccagctaggtgcagcccaaacactgacctcaattaatatctccctcaatgattccccactatccagcaatccctatcagggaagccaaataatgcccccaattaatgactctcccaatgaataactgtccccagtgaccccaagcagggaaccccaaacaatgacacactaactaatgaacacgtcattcaacccagccaatgatccccccttaaacagtagccctcatcaagaactccc

SEQ ID NO: 3711 - DNA, 601 bp, Human
agtgacatctcttggctattagcactaattagtgactctccaactaataacccccatcggtgacccctaatcaattattcctctaaccagtgatgctccaacagtgaatacccataaatgagcgcaacaaaagcgtcctaaccaatgacccccaaatagtaattccacccatcaatgacttcctaactaataattccctcagggactcccaaaccaattaccccatctgcgaccccctgaaaatcactcttccaacttgtggccccaatgagtgaccccactatgacttccagtcagtgamcacccaccaacaaccccccagtcattgaccccaaactagggacatcagtaacaccaataatggtttctatccatgaccttccactgtgatccccagctaggtgcagcccaaacactgacctcaattaatatctccctcaatgattccccactatccagcaatccctatcagggaagccaaataatgcccccaattaatgactctcccaatgaataactgtccccagtgaccccaagcagggaaccccaaacaatgacacactaactaatgaacacgtcattcaacccagccaatgatccc

SEQ ID NO: 3712 - DNA, 601 bp, Human
gtctcactttgttgcccaggctggagtgcagtggcacgatcttggctcattgcagcctctgcctcccgggttcaagcaattctcctgcctcagccttcccagtggctgggatcacaggcgcgcgccaccgctcccagctaattttttgtatttttagtagacatgggatttcaccacgttggtcaggctagtctcaatctcctgacctcaaatgatctgcccacctaggtctcccaaagtgttcggattacaggcgggagccactgcgccctgcctaaataaataaattttaaaaaaattwtaataggaatcccactctcttgcacctaaccccagccacctagaaactcacaggaaagatctggaactgagtccgagatggatattctgctgcccggaagtcagggcccatggtggaatcatctccttcttcatcctccctggctgccttggtctccagggtccccagctcggttccactgtcagggtccaagctcccctgagaacgttaggaaagaccaaagttttccctgacctccttattttctgccacccccgtaacccttggggtctcccctcttccatccccatccaacctcta

SEQ ID NO: 3713 - DNA, 601 bp, Human
cctgaacttaagataaaagtttttttaaaaaaagaaaaaattaaattaaataatttttttaaattgttcggttttttttttcaagatggagtctcactttgttgcccaggctggagtgcagtggcacgatcttggctcattgcagcctctgcctcccgggttcaagcaattctcctgcctcagccttcccagtggctgggatcacaggcgcgcgccaccgctcccagctaattttttgtatttttagtagacatgggatttcaccacgttggtcaggctagtctcaatctcctgacctcamatgatctgcccacctaggtctcccaaagtgttcggattacaggcgggagccactgcgccctgcctaaataaataaattttaaaaaaattttaataggaatcccactctcttgcacctaaccccagccacctagaaactcacaggaaagatctggaactgagtccgagatggatattctgctgcccggaagtcagggcccatggtggaatcatctccttcttcatcctccctggctgccttggtctccagggtccccagctcggttccactgtcagggtccaagctcccctgagaacgtta

SEQ ID NO: 3714 - DNA, 601 bp, Human
aatggagcatgtcccaaagtggtccacttctctgcgtccctcccatcttcctccaggtcacgtcccgactgcagattgcgggcttccctgctgcccctctggctccccctactgtccatgtgccattcagcagccagagagctcttttttttttttttttttttttttttttttaagagatgggtctcactgttgcccaggctggcctcaaactcctggcctcaagcgatcctcccgcctcagccgcccaaagcattgggattacagccgtgagccactgcccccggcccagggggagctyttaaagctccaagtcagatcatgttccttcacaagtgctcaagtggcatctcctggtgcttggagtaaaagccaagcgcctctctctagtcacagagtcaactattagcacagtgcctgacacaagcaggtgcagaagtcaaaagagagactggcctttcgtggctccaggtagaaatcccttctaagacctcaagatgtgagaaaagtaagtaaataaaataacacaggaacagaagaccatataccacatgttctcacttataagtgggagctaaatgagaacacatggacacataga

SEQ ID NO: 3715 - DNA, 601 bp, Human
acccgggctgcagtgcagtggtgtgatcatggctccctgaagcctccacctcctgggctcaagcgatcctcctgcttcagctgggaccagaggcacgaaccaccacgttcgattaattttttgtatattttgtaaagatagggtctcgctatgttacccaggcttgtcccaaactcttgggctcaggtgatcttcccgcctcaacctaccaaattgctgagattataggtgtgagccaccatacctggcctcagttacctcttgatctctaccctcttctcttctccctgcccttaacataaaaaaaaagcctaaaatttgtactgacttaagatggtgcttcggaacaacagtccaccatcttcttggtttgctgtctcttggaataaacctgcttttccttccaccaattctcgtctctcttgttttcctttcaaacatcaagccaccgagcttgggttcggttacatcgaatgcgtatccatctttctccaagaccaaaatggagcatgtcccaaagtggtccacttctctgcgtccctcccatcttcctccaggtcacgtcccgactgcagattgcgggcttccctgctgcccctct

SEQ ID NO: 3716 - DNA, 601 bp, Human
tgctgcaagctccgcctcccgggttcacgccattctgcctcagcctcccgagaagctgggactacaggcgcccgccaccacgcccagctaattttttgtattttttagtacagacagcgtttcaccatgttagccaggatggtctcaatctcctgacctcgtgatcagccctcctcggcctcccaaagtgctgggattacaggcgtgagccaccgcgcctggcccaagcctcttttcttttctctagagaaaggtcttgctctgccacccgggctgcagtgcagtggtgtgatcatggctycctgaagcctccacctcctgggctcaagcgatcctcctgcttcagctgggaccagaggcacgaaccaccacgttcgattaattttttgtatattttgtaaagatagggtctcgctatgttacccaggcttgtcccaaactcttgggctcaggtgatcttcccgcctcaacctaccaaattgctgagattataggtgtgagccaccatacctggcctcagttacctcttgatctctaccctcttctcttctccctgcccttaacataaaaaaaaagcctaaaatttgtactgacttaagat

SEQ ID NO: 3717 - DNA, 601 bp, Human
caggtgcacacagcaccatgcccagctattttttattttatttttttgtagagacagggtcttgctatgttgcccaggctgaactcaaactgggagccactgcacctggccttttttcttttctttttttcttttttcttttttttttttttttgagacagagtctccctctcgcgcccaggctgaagtgcagtggcgtggtctcggcttgctgcaagctccgcctcccgggttcacgccattctgcctcagcctcccgagaagctgggactacaggcgcccgccaccacgcccagctaattttttgtattttttagtacagacagcgtttcaccatgttagccaggatggtctcaatctcctgacctcgtgatcagccctcctcggcctcccaaagtgctgggattacaggcgtgagccaccgcgcctggcccaagcctcttttcttttctctagagaaaggtcttgctctgccacccgggctgcagtgcagtggtgtgatcatggctccctgaagcctccacctcctgggctcaagcgatcctcctgcttcagctgggaccagaggcacgaaccaccacgttcgattaattttttgtat

SEQ ID NO: 3718 - DNA, 601 bp, Human
cttttttcttttttttcagagtcactctattgcccaggcaggcttttccttttttctctctcttttttccttccttccttccttccttccttccttccttccttctcttgcttgcttgctttgcttggcattttttttttgacacagggtcactctattgcccaggctagaatgcaggggtacaatcatggctcactgcaacctcgatctcctcagactcaggtgatcctccctcctcagcctcctgagtagctgggaccacaggtgcacacagcaccatgcccagctattttttattttwtttttttgtagagacagggtcttgctatgttgcccaggctgaactcaaactgggagccactgcacctggccttttttcttttctttttttcttttttcttttttttttttttttgagacagagtctccctctcgcgcccaggctgaagtgcagtggcgtggtctcggcttgctgcaagctccgcctcccgggttcacgccattctgcctcagcctcccgagaagctgggactacaggcgcccgccaccacgcccagctaattttttgtattttttagtacagacagcgtttcaccatgtt

SEQ ID NO: 3719 - DNA, 601 bp, Human
ctaatttttgtatttttagtagagaccaggtttcaccatgttggttaggctggtctcgaactcctgacttaggtgatccacccgcctcatcctcccaaagtgctgggattacaggcgtgagccaccatgcttggctccttccttccttcctttctttcttttctttctttctttctttctctttctttttctttctctttctttctctttttctttcttctttcttttttcttttttttcagagtcactctattgcccaggcaggcttttccttttttctctctcttttttccttccttccttccttccttccttccttccttccttctcttgcttgcttgctttgcttggcattttttttttgacacagggtcactctattgcccaggctagaatgcaggggtacaatcatggctcactgcaacctcgatctcctcagactcaggtgatcctccctcctcagcctcctgagtagctgggaccacaggtgcacacagcaccatgcccagctattttttattttatttttttgtagagacagggtcttgctatgttgcccaggctgaactcaaactgggagccactgcacctggcctttttt

SEQ ID NO: 3720 - DNA, 601 bp, Human
gcccttcagttatctgatcacacacacttgcacacacacacacacacacacacacggagtccaccctcagagccccttctcctctactgtaaccaatatgcactgagaagctcagccccccgcatccaccgggcaatgccatgccaaggtgaatgaagagcgtgaaatccagagactgctgcccaatactgatcctgcatctgcctcttactaactgagtgatctaactaagttgggaaacttagtcaacccctatggccacttacaggtaaccggtcaacctgtaaagtcagtggatgartgacgcctgtgtatatatcatgcaaagatgaatgaattaaaacaatgcttggcacacaacaagcactccaggtaacaaggtagcaagggcaagttagttacaactatgtgtctatgcgcctcccctgtggaacacctaggcttttcctttctccctttctttctttccttcttctttttctttcttctttttttttttttaaatggagtcttgctctgtcccccaggctggagtgcagtggtgtgatctcagctcactgcaccttctacctcctgggttctagcgattctcctgcctcag

SEQ ID NO: 3721 - DNA, 601 bp, Human
gctctccttttgctcctttctctccagcaccctggggtggggtcaggggagatggagagaaaagagatgtgaacttggacataagcccttcagttatctgatcacacacacttgcacacacacacacacacacacacacggagtccaccctcagagccccttctcctctactgtaaccaatatgcactgagaagctcagccccccgcatccaccgggcaatgccatgccaaggtgaatgaagagcgtgaaatccagagactgctgcccaatactgatcctgcatctgcctcttactaactragtgatctaactaagttgggaaacttagtcaacccctatggccacttacaggtaaccggtcaacctgtaaagtcagtggatgaatgacgcctgtgtatatatcatgcaaagatgaatgaattaaaacaatgcttggcacacaacaagcactccaggtaacaaggtagcaagggcaagttagttacaactatgtgtctatgcgcctcccctgtggaacacctaggcttttcctttctccctttctttctttccttcttctttttctttcttctttttttttttttaaatggagtcttgctc

SEQ ID NO: 3722 - DNA, 601 bp, Human
actggaagaaggaaacacagccatgacttacttggggtcctggggctcctggaggtccctcaaactgctgcccctgaagggagaagtgagtgtcggtgaccgctgtcatcatgaagcctctcaaccccctcacaatccagacccctcaccttttcaatcactgcgggctctccttttgctcctttctctccagcaccctggggtggggtcaggggagatggagagaaaagagatgtgaacttggacataagcccttcagttatctgatcacacacacttgcacacacacacacacacacayacacggagtccaccctcagagccccttctcctctactgtaaccaatatgcactgagaagctcagccccccgcatccaccgggcaatgccatgccaaggtgaatgaagagcgtgaaatccagagactgctgcccaatactgatcctgcatctgcctcttactaactgagtgatctaactaagttgggaaacttagtcaacccctatggccacttacaggtaaccggtcaacctgtaaagtcagtggatgaatgacgcctgtgtatatatcatgcaaagatgaatgaattaaaacaatgctt

SEQ ID NO: 3723 - DNA, 601 bp, Human
ggccaggcaacattacaccccaactcctcactccaggggattaaacacccctcagctggaagggaaagactggaagaaggaaacacagccatgacttacttggggtcctggggctcctggaggtccctcaaactgctgcccctgaagggagaagtgagtgtcggtgaccgctgtcatcatgaagcctctcaaccccctcacaatccagacccctcaccttttcaatcactgcgggctctccttttgctcctttctctccagcaccctggggtggggtcaggggagatggagagaaaagagrtgtgaacttggacataagcccttcagttatctgatcacacacacttgcacacacacacacacacacacacacggagtccaccctcagagccccttctcctctactgtaaccaatatgcactgagaagctcagccccccgcatccaccgggcaatgccatgccaaggtgaatgaagagcgtgaaatccagagactgctgcccaatactgatcctgcatctgcctcttactaactgagtgatctaactaagttgggaaacttagtcaacccctatggccacttacaggtaaccggtcaacct

SEQ ID NO: 3724 - DNA, 601 bp, Human
accctccacttggccaggcaacattacaccccaactcctcactccaggggattaaacacccctcagctggaagggaaagactggaagaaggaaacacagccatgacttacttggggtcctggggctcctggaggtccctcaaactgctgcccctgaagggagaagtgagtgtcggtgaccgctgtcatcatgaagcctctcaaccccctcacaatccagacccctcaccttttcaatcactgcgggctctccttttgctcctttctctccagcaccctggggtggggtcaggggagatggrgagaaaagagatgtgaacttggacataagcccttcagttatctgatcacacacacttgcacacacacacacacacacacacacggagtccaccctcagagccccttctcctctactgtaaccaatatgcactgagaagctcagccccccgcatccaccgggcaatgccatgccaaggtgaatgaagagcgtgaaatccagagactgctgcccaatactgatcctgcatctgcctcttactaactgagtgatctaactaagttgggaaacttagtcaacccctatggccacttacaggtaa

SEQ ID NO: 3725 - DNA, 601 bp, Human
gagagagagcgaggacaggggaggcacagaaggatgagtcagaaagagagagagagggagagatggagagagacacagaatcaaagagggatcatggcaaggaaagagagagaagtagagagaagtggaaaggaaaagacagagatggaacagagacaaagagaaggggagagagggatggagaaggatgggggcagatggagagacatacagagacagaaacagagagacagagagagatagacagagacagaaaagccagtgaaagacagacagagatggagaaatagagagagaggcraacatagagagatggacggagggagagggacagagaccaacagagagagacagaagagagacagagacagagtcacaacaggagaaagacagagataaaagacactcagaaacagagacaggcaaaagaagaaaagcaaagagtaggccccagcaacacaaggtgaaccagagaaatagttcacagatgggagacagagaacagaagaggtcagtgccagccccgggatggtgttcccgagtgccacaccctcatatctatgttcagactgtcacgctcccagccccaaacctcactcct

SEQ ID NO: 3726 - DNA, 601 bp, Human
cactccatctccttcttaccggcatcatgatcacagtgcccggtgggcctcggatcccatcaatgccggggattcctgggaggccagcagggccctgagagagggatgggggaagagaggtggagacagggagagagggagagagagagcgaggacaggggaggcacagaaggatgagtcagaaagagagagagagggagagatggagagagacacagaatcaaagagggatcatggcaaggaaagagagagaagtagagagaagtggaaaggaaaagacagagatggaacagagacaaasagaaggggagagagggatggagaaggatgggggcagatggagagacatacagagacagaaacagagagacagagagagatagacagagacagaaaagccagtgaaagacagacagagatggagaaatagagagagaggcgaacatagagagatggacggagggagagggacagagaccaacagagagagacagaagagagacagagacagagtcacaacaggagaaagacagagataaaagacactcagaaacagagacaggcaaaagaagaaaagcaaagagtaggccccagcaacaca

SEQ ID NO: 3727 - DNA, 601 bp, Human
tcaggactccactccccaaggctgggccactccatctccttcttaccggcatcatgatcacagtgcccggtgggcctcggatcccatcaatgccggggattcctgggaggccagcagggccctgagagagggatgggggaagagaggtggagacagggagagagggagagagagagcgaggacaggggaggcacagaaggatgagtcagaaagagagagagagggagagatggagagagacacagaatcaaagagggatcatggcaaggaaagagagagaagtagagagaagtggaaaggraaagacagagatggaacagagacaaagagaaggggagagagggatggagaaggatgggggcagatggagagacatacagagacagaaacagagagacagagagagatagacagagacagaaaagccagtgaaagacagacagagatggagaaatagagagagaggcgaacatagagagatggacggagggagagggacagagaccaacagagagagacagaagagagacagagacagagtcacaacaggagaaagacagagataaaagacactcagaaacagagacaggcaaaagaagaa

SEQ ID NO: 3728 - DNA, 601 bp, Human
agggtatccccagcccctttggcactttccccatccagcactgtatcttgtggtcctgggggaaggctattcccatcctatcctgccctatctccacaagtctcacctgtggcccttctgctccctcctctcctttcagacctggatgcccggggagacccttgggggaggagagatggaggagtgtgggtagatgattcttcactaatgcatgcaccgccccctccacgcagtcgccttactcaccacagggcctgggcgcccagtgagccccactggaccaggggggcctttcatagasagctggaaagacagaggagtcagagcttggggcctcccacaagacccccaacattccccacagaggcatcttcaggagaaaaataacccccttctcctgcccagcccctccttacgccgaggctctatcactctctggggttcctcccactatgtccacacctcccactcacctgagtctgctgcagaactgcctgagcctgggcctgctggaatgagactggggggcctttaaaggagccgcctgcaaactggaactgggaggaatttagtggtgagggaagcccccaggagaggcccc

SEQ ID NO: 3729 - DNA, 601 bp, Human
cggcctcccaaagttctgggattccagatgtgagccaccattctctaggaaagtcatcaattgcaagggtatccccagcccctttggcactttccccatccagcactgtatcttgtggtcctgggggaaggctattcccatcctatcctgccctatctccacaagtctcacctgtggcccttctgctccctcctctcctttcagacctggatgcccggggagacccttgggggaggagagatggaggagtgtgggtagatgattcttcactaatgcatgcaccgccccctccacgcagtcrccttactcaccacagggcctgggcgcccagtgagccccactggaccaggggggcctttcatagagagctggaaagacagaggagtcagagcttggggcctcccacaagacccccaacattccccacagaggcatcttcaggagaaaaataacccccttctcctgcccagcccctccttacgccgaggctctatcactctctggggttcctcccactatgtccacacctcccactcacctgagtctgctgcagaactgcctgagcctgggcctgctggaatgagactggggggcctttaaa

SEQ ID NO: 3730 - DNA, 601 bp, Human
cagcctcctgagtagctgggaccacaggtgcatgccaccaggcctggctaattttttatatttttggtagagatggtgggggtttcaccctgttgctcaggctagtctcaaactcctgaatgcaagcgatccacccacctcagcctcccaaactgctgggattacaggcatgagccaccatgccaaggctaagatattattttttttaatttatttatgtattttagagctgaggtcttgctctcttgcccaggctggagtgcagtggcatgatcatggctcaatgcagcttcgaattccwggctcaagcaatcctcccacctcagcctcccaagtagctgggactacaagtgcacaccaccacacctggctaattttttatttgtattttgtgtagagaccgggttttgccatgttgcacaagctggtctcaaactcctgggctcaagccatcctttcacctcagcctcccaaagtgctgggattagagataccagttgctatgccatggctgattttattttattttatttttttgagatggcgtcttgctctgttgcccaggctggagttacatatatgttttacatatatatatata

SEQ ID NO: 3731 - DNA, 601 bp, Human
cataagcctgacagctcccaccaagtcttatctcagcccccatcacctaccttaggtccagtgtcccctgggaggccccgagctccatctgctccagggcggccctatggagaaagtaagcccaagagtcaaggatgagccttccctgtacccctccaccaaattaggaacccaacttcatcatcaacatcaagattttttttttgacagggtctccttctgtcactcaggttggagtgcagtggcacgttctcagctcactgcaacctcagcctcctgagtagctgggaccacaggtgcrtgccaccaggcctggctaattttttatatttttggtagagatggtgggggtttcaccctgttgctcaggctagtctcaaactcctgaatgcaagcgatccacccacctcagcctcccaaactgctgggattacaggcatgagccaccatgccaaggctaagatattattttttttaatttatttatgtattttagagctgaggtcttgctctcttgcccaggctggagtgcagtggcatgatcatggctcaatgcagcttcgaattcctggctcaagcaatcctcccacctcagcctccc

SEQ ID NO: 3732 - DNA, 601 bp, Human
tctgtgtggccatgtgagctctaggggtcctatgagtcctggggccctgggagtcctgactccctcccctgcaccaagcaaggggcccagggatccctgatactcaccggctccccagcctggccagtgggccctggaggtccctctgctccctgtggaaaagcgtcattacttgggaacaggaaggtacaaccctcggagagccacctcccctcatctgggcagccccttccagggggtctcggaattagaccaggatccctgggaacctgcagactaagttcatgggattccattcagrcccctgactccaatcctagacctgcaagtctcacctcctcaccccacaatttgtccctagctctcaagctggccactgagacctccagatcttcctctctgattctcactcaggcttccaaacttactttccaaaccaggccctaactctcttccaaacttaccctctcaccatcctctcctgggggaccgggttgccccacatggccaaagtcaccctggagagggaacagaggggagttcagagtggaagggtgtgggcggagagaccagccccctgggaaggcagatggggtgtgag

SEQ ID NO: 3733 - DNA, 601 bp, Human
tctctactaaaaatacaaaaattagccaggtgtgctggtgggtccctgtagtcccagctactcaggaggctgaagcatgagaatcacctgaacccaggagccggaggttgcagagagctgagatctcgccaccgcactccagcctgggcgacagagcgagaccctaatctcaaaacaaacaaaaagacagacagggatgcagagagccagtgacactcaccgggcgacccgtggggccaggagagcctctggggccaagcagtcctcgtggaccctgcaagggagcaggcgaattatttcyacatcacctctgtgtggccatgtgagctctaggggtcctatgagtcctggggccctgggagtcctgactccctcccctgcaccaagcaaggggcccagggatccctgatactcaccggctccccagcctggccagtgggccctggaggtccctctgctccctgtggaaaagcgtcattacttgggaacaggaaggtacaaccctcggagagccacctcccctcatctgggcagccccttccagggggtctcggaattagaccaggatccctgggaacctgcagactaagttcatgggatt

SEQ ID NO: 3734 - DNA, 601 bp, Human
gtgagtgtggaggttgggaagcctggtcacggtctaaggtcttaactgaccactcccatgccccattattgggaaagacagttcaaacctgggacccatggtttccctgctgtcccggagggcctggttctcctggaggaccctggggagaaagtggggtttcagtgaagctaagaggggtcatggtgttggggcgttagtgaaattgacttggggggggtcagtcatggaagggaatagggatgtggacaatcggggtcagagtgtcagaagggtcagaggtcaaagggcacagggcacrtaccacattgcctttggcaccaggagcaccatcaattccagtcacaccctaggggaaaagaggatgtgagaccaagacagagcaacaagctgggagcctgagtctgagacaccgagagatgcaggtggaaaggtgagcagggccgggcactgtggctcatgcttgtaatcccagcattttgggaggctgaggcaggtggatcacctgaggtcgggagtttaagaccagcctggccaacattgtgaaaccccgtctttactaaaaacacaaaaattagccaggcatgtaatctcagctact

SEQ ID NO: 3735 - DNA, 601 bp, Human
aggtggagctgtcactcaccttctccccaggagtgccaatgagtccctggggaccggggagtccctggagacagaaaaagaagatgagagaaggcataagaaagaagcggtgagtgtggaggttgggaagcctggtcacggtctaaggtcttaactgaccactcccatgccccattattgggaaagacagttcaaacctgggacccatggtttccctgctgtcccggagggcctggttctcctggaggaccctggggagaaagtggggtttcagtgaagctaagaggggtcatggtgttgrggcgttagtgaaattgacttggggggggtcagtcatggaagggaatagggatgtggacaatcggggtcagagtgtcagaagggtcagaggtcaaagggcacagggcacataccacattgcctttggcaccaggagcaccatcaattccagtcacaccctaggggaaaagaggatgtgagaccaagacagagcaacaagctgggagcctgagtctgagacaccgagagatgcaggtggaaaggtgagcagggccgggcactgtggctcatgcttgtaatcccagcattttgggaggctgag

SEQ ID NO: 3736 - DNA, 601 bp, Human
cactgcactccagcctgggcgacagagtgagaccctgtccacaccccccaaaaaaagatatgtgcagaaagaagtgtgtctgccagggaaggcggaagcagatgtgccagggaacaaagatgagacccacagggcctgtgcctcttggtaatatcttctgtgacaggcttctgtgggctctctgtatcctgacaatatcccttatgtgagctagccttggtgggtttctgtttcttgcaaccaatccttccccaacaaggacactttgtatctccgggctggcttagggaatgttgcagtytatcactatccagagctaacagaggggtcttggtgggaagattttcctggcaacagagttgaaggaagaagacttgaggaggtcgcggtaggtggagctgtcactcaccttctccccaggagtgccaatgagtccctggggaccggggagtccctggagacagaaaaagaagatgagagaaggcataagaaagaagcggtgagtgtggaggttgggaagcctggtcacggtctaaggtcttaactgaccactcccatgccccattattgggaaagacagttcaaacctgggacccatggt

SEQ ID NO: 3737 - DNA, 601 bp, Human
aacacaaagaataaatacttgaggggatggatactacatgacatgattcttatgcgcatgcctgtatcaaaacatctcatgtactccataagtatatacctactatgtacccacaaagataataaataaaattaattttttttttgaggtggagtctcgctctgtcgcccaggctggagtgcagtggcaagatctcggctcactgcaagctccgcctcccaggttcatgccattctcctgactcagcctcccgagtagctgggactacaggcgcgcgccaccacgcccggctaattttttkgtatttttagtagagacagggtttcaccatgttagccaggatggtctcgatctcctgacctcgtgatccccccatctcagcctcccaaagtgctaggattacaggtgtgaaccaccgcacctgaccaataaaattaaattaaaacagtgcaagagacatgttgaaatagaagcttcacagccacacccctttctttaaaaatgcccagccgggcatgatggctctcgcctgtaatcccagcattttggggggccaaggcagatgaactgcatgagcccaggagttcaagaccagcctggg

SEQ ID NO: 3738 - DNA, 601 bp, Human
aaatagtataactggattgtttgtaacacaaagaataaatacttgaggggatggatactacatgacatgattcttatgcgcatgcctgtatcaaaacatctcatgtactccataagtatatacctactatgtacccacaaagataataaataaaattaattttttttttgaggtggagtctcgctctgtcgcccaggctggagtgcagtggcaagatctcggctcactgcaagctccgcctcccaggttcatgccattctcctgactcagcctcccgagtagctgggactacaggcgcgcrccaccacgcccggctaattttttggtatttttagtagagacagggtttcaccatgttagccaggatggtctcgatctcctgacctcgtgatccccccatctcagcctcccaaagtgctaggattacaggtgtgaaccaccgcacctgaccaataaaattaaattaaaacagtgcaagagacatgttgaaatagaagcttcacagccacacccctttctttaaaaatgcccagccgggcatgatggctctcgcctgtaatcccagcattttggggggccaaggcagatgaactgcatgagc

SEQ ID NO: 3739 - DNA, 601 bp, Human
agctggtaaatcactcatacctgcaagcgtatcacctaccttcactccccgaggtccaggatagcccggagggcctgccgaccctggtggaccctgggaggaaaataaggtcagtgccattctagacagtcccttccacattctaagagccctcatctctctcctctgtggcccctgactgcaggccctgcctcccgaccctcgtccccaacccagcctaacctcctggtcactcacctgagcccctttctctcccgtggggccctcatgtcctgggtgaccctggggaagaaacattctmagttgtcagagaccaaaacttgccattccaattcccaaggctcccctttctccttcctccttttcccagctcatggttctcaccagagggccatcggatcctgggaggcctggaattcctgggtttccagggggaccctgaaagaagatgaacagcaggggagagacagaggtgctcagagccctggagcaccactaggatctacgcagacatgcagccgcctcaaggttaagaaataagcagacctcactggccaggaaatctatcccagctctgcccaaacttgctgtgtgaccccag

SEQ ID NO: 3740 - DNA, 601 bp, Human
ttctaacaacaaggtgacaaccacactgtaaggctgtccttggctgtgcagctccaaaccccagtcccactacatttggcctggccaactgattcccctctccacacatccagaagtttctgatggagctgcatcgcatgcctgaacccaaagctggtaaatcactcatacctgcaagcgtatcacctaccttcactccccgaggtccaggatagcccggagggcctgccgaccctggtggaccctgggaggaaaataaggtcagtgccattctagacagtcccttccacattctaagagycctcatctctctcctctgtggcccctgactgcaggccctgcctcccgaccctcgtccccaacccagcctaacctcctggtcactcacctgagcccctttctctcccgtggggccctcatgtcctgggtgaccctggggaagaaacattctcagttgtcagagaccaaaacttgccattccaattcccaaggctcccctttctccttcctccttttcccagctcatggttctcaccagagggccatcggatcctgggaggcctggaattcctgggtttccagggggaccctgaaagaagat

SEQ ID NO: 3741 - DNA, 601 bp, Human
tgcagtgagtggagatcgctccactgcactccagcctgggcgacaaagcgagactctgtctcaaaaaaaaaaaaaaaaaaaaaaaaagaaagtaaagaaaagaaaaggaaaaaggaaaagagaaaagaaagaaatgtgtttggcctctaatgggcttagctgttctaacaacaaggtgacaaccacactgtaaggctgtccttggctgtgcagctccaaaccccagtcccactacatttggcctggccaactgattcccctctccacacatccagaagtttctgatggagctgcatcgcaygcctgaacccaaagctggtaaatcactcatacctgcaagcgtatcacctaccttcactccccgaggtccaggatagcccggagggcctgccgaccctggtggaccctgggaggaaaataaggtcagtgccattctagacagtcccttccacattctaagagccctcatctctctcctctgtggcccctgactgcaggccctgcctcccgaccctcgtccccaacccagcctaacctcctggtcactcacctgagcccctttctctcccgtggggccctcatgtcctgggtgaccctgggg

SEQ ID NO: 3742 - DNA, 601 bp, Human
aggttgcagtgagtggagatcgctccactgcactccagcctgggcgacaaagcgagactctgtctcaaaaaaaaaaaaaaaaaaaaaaaaagaaagtaaagaaaagaaaaggaaaaaggaaaagagaaaagaaagaaatgtgtttggcctctaatgggcttagctgttctaacaacaaggtgacaaccacactgtaaggctgtccttggctgtgcagctccaaaccccagtcccactacatttggcctggccaactgattcccctctccacacatccagaagtttctgatggagctgcatygcatgcctgaacccaaagctggtaaatcactcatacctgcaagcgtatcacctaccttcactccccgaggtccaggatagcccggagggcctgccgaccctggtggaccctgggaggaaaataaggtcagtgccattctagacagtcccttccacattctaagagccctcatctctctcctctgtggcccctgactgcaggccctgcctcccgaccctcgtccccaacccagcctaacctcctggtcactcacctgagcccctttctctcccgtggggccctcatgtcctgggtgaccct

SEQ ID NO: 3743 - DNA, 601 bp, Human
ggcttaacccagcatactgtgcttatgtgattctgagcttgggttagaacacaaccctcgggccaggcacagtggctcatgcctgtaatcccagcactttgggaagccaaggagggtggatcacctgaggtcaggagttcgagaccagcctggccaacatggtgaaaccctgtctctaataaaaatacaaaaattacccaggagtggtggtgcatgcctgcagtcccagctactcaggaagctgaggcagtagaatcgcttgaatccgggaggaggcagaggttgcagtgagtggagatcrctccactgcactccagcctgggcgacaaagcgagactctgtctcaaaaaaaaaaaaaaaaaaaaaaaaagaaagtaaagaaaagaaaaggaaaaaggaaaagagaaaagaaagaaatgtgtttggcctctaatgggcttagctgttctaacaacaaggtgacaaccacactgtaaggctgtccttggctgtgcagctccaaaccccagtcccactacatttggcctggccaactgattcccctctccacacatccagaagtttctgatggagctgcatcgcatgcctgaacccaaagctg

SEQ ID NO: 3744 - DNA, 601 bp, Human
ctctaatgcccctgcacctctatttagccaggttgcagctcttggcttaacccagcatactgtgcttatgtgattctgagcttgggttagaacacaaccctcgggccaggcacagtggctcatgcctgtaatcccagcactttgggaagccaaggagggtggatcacctgaggtcaggagttcgagaccagcctggccaacatggtgaaaccctgtctctaataaaaatacaaaaattacccaggagtggtggtgcatgcctgcagtcccagctactcaggaagctgaggcagtagaatckcttgaatccgggaggaggcagaggttgcagtgagtggagatcgctccactgcactccagcctgggcgacaaagcgagactctgtctcaaaaaaaaaaaaaaaaaaaaaaaaagaaagtaaagaaaagaaaaggaaaaaggaaaagagaaaagaaagaaatgtgtttggcctctaatgggcttagctgttctaacaacaaggtgacaaccacactgtaaggctgtccttggctgtgcagctccaaaccccagtcccactacatttggcctggccaactgattcccctctccacacatccag

SEQ ID NO: 3745 - DNA, 601 bp, Human
gcctggtgggatacgcctatagtcctagctattcaggaggctaaagtgaggggattacttgagcacgggagttcaaggctgcagtgagccatcattatgctgctatattccagcctgggcaacagagaagaccctgtctctaaaaaataaaacatttagggccgggtgtggtggctcatgcctgtaatcccagcactttgagaggccgaggcggccggatcacctgaggtcaggcgttcaagaccagcctgaccaacatggagaaatcctgtctctattaaaaatacaaaaattagccagrcgtggtggcacatgcctgtaataccactactcgagaggctgaggcgggagaatcgcttgaacctgggaggcagaggttgcggtgagcccaggtggcatcattgcactctagcctgggcaacaagagcagaaccaggtctcaaaaacaaaaacaaaaaaagattaaaaatgtaattatgcttggctacaatgtaactctgagggtgatgcttgccagactctgtgcctgctacagtatagccaattccttgattatagtgtgtctaagcttgtctaatgcacacatgttcaggtaaattac

SEQ ID NO: 3746 - DNA, 601 bp, Human
aataataataataatcaaatgaaaaaactgccaagcctggtgggatacgcctatagtcctagctattcaggaggctaaagtgaggggattacttgagcacgggagttcaaggctgcagtgagccatcattatgctgctatattccagcctgggcaacagagaagaccctgtctctaaaaaataaaacatttagggccgggtgtggtggctcatgcctgtaatcccagcactttgagaggccgaggcggccggatcacctgaggtcaggcgttcaagaccagcctgaccaacatggagaaaycctgtctctattaaaaatacaaaaattagccagacgtggtggcacatgcctgtaataccactactcgagaggctgaggcgggagaatcgcttgaacctgggaggcagaggttgcggtgagcccaggtggcatcattgcactctagcctgggcaacaagagcagaaccaggtctcaaaaacaaaaacaaaaaaagattaaaaatgtaattatgcttggctacaatgtaactctgagggtgatgcttgccagactctgtgcctgctacagtatagccaattccttgattatagtgtgtctaa

SEQ ID NO: 3747 - DNA, 601 bp, Human
ggtggtactgcactccagcgtgggtaacagagtgagaccctgtctcaagaataataataataataatcaaatgaaaaaactgccaagcctggtgggatacgcctatagtcctagctattcaggaggctaaagtgaggggattacttgagcacgggagttcaaggctgcagtgagccatcattatgctgctatattccagcctgggcaacagagaagaccctgtctctaaaaaataaaacatttagggccgggtgtggtggctcatgcctgtaatcccagcactttgagaggccgaggcggscggatcacctgaggtcaggcgttcaagaccagcctgaccaacatggagaaatcctgtctctattaaaaatacaaaaattagccagacgtggtggcacatgcctgtaataccactactcgagaggctgaggcgggagaatcgcttgaacctgggaggcagaggttgcggtgagcccaggtggcatcattgcactctagcctgggcaacaagagcagaaccaggtctcaaaaacaaaaacaaaaaaagattaaaaatgtaattatgcttggctacaatgtaactctgagggtgatgcttgcc

SEQ ID NO: 3748 - DNA, 601 bp, Human
tgatgagttccttctctcctcaccttctcgcctttctccccctggaggccccggttgcctgaagtgccctggaaaataaaaaaaaaaagctctcaagcctcttccctgcttaagaagtgacccagactcagtcccctgctctaaagcagccaggatagtcccaagaggaggctaggcagaagctgggaggggcagcttcagaagaaatgatctttccccagaggcccctccctccccactggaggcctctcaaggtcatctgtgcgggggtgtgcagggaaggccaaatttccaagtaagygattcccatctcctggagacgctttgtccacagttccttctggcaggagaaagaggatgaacattccaggcccggacctcattttaaaggcaaaggaatgttccccattgtgccagctacaaggcgactctgtgcttggcaacaagatgacctctgtgcttggctatggagagagcgcttagttcaagtctggatgctgctcacaccaaactctgaaaactgcacttggctacaacatctctgagctcagcgggctacaatgaaattgcgcttggatacaatacagcccatgtggttagt

SEQ ID NO: 3749 - DNA, 601 bp, Human
cctttgagccccacatcgcccttgaagcctgggaagccgtcctctccctgggtgggagagacagaggccagaagtgagggcctcggggaagggacacaaccaggaccccatgattgggactccctctcctctgatgagttccttctctcctcaccttctcgcctttctccccctggaggccccggttgcctgaagtgccctggaaaataaaaaaaaaaagctctcaagcctcttccctgcttaagaagtgacccagactcagtcccctgctctaaagcagccaggatagtcccaagaggakgctaggcagaagctgggaggggcagcttcagaagaaatgatctttccccagaggcccctccctccccactggaggcctctcaaggtcatctgtgcgggggtgtgcagggaaggccaaatttccaagtaagcgattcccatctcctggagacgctttgtccacagttccttctggcaggagaaagaggatgaacattccaggcccggacctcattttaaaggcaaaggaatgttccccattgtgccagctacaaggcgactctgtgcttggcaacaagatgacctctgtgcttggctatgg

SEQ ID NO: 3750 - DNA, 601 bp, Human
tgctctgtctagccccagctcatcccctccctatcttccccgagcccccagacccacaccacccctcatctggagctggtcttacctgatcacctttgagccccacatcgcccttgaagcctgggaagccgtcctctccctgggtgggagagacagaggccagaagtgagggcctcggggaagggacacaaccaggaccccatgattgggactccctctcctctgatgagttccttctctcctcaccttctcgcctttctccccctggaggccccggttgcctgaagtgccctggaaaataaaaaaaaaaagctctcaagcctcttccctgcttaagaagtgacccagactcagtcccctgctctaaagcagccaggatagtcccaagaggaggctaggcagaagctgggaggggcagcttcagaagaaatgatctttccccagaggcccctccctccccactggaggcctctcaaggtcatctgtgcgggggtgtgcagggaaggccaaatttccaagtaagcgattcccatctcctggagacgctttgtccacagttccttctggcaggagaaagaggatgaacattccaggcccggac

SEQ ID NO: 3751 - DNA, 601 bp, Human
cccacattttacattctctcagtgacccttggggtgggcagctcatcccccaagaccacagcctggacccccagatgttagtctctgaatcctgcccatatccatctccaccccccacccccagcttcctaccttaggtccagggcgtcctggataacctgggaggcctggcaccccaagcttgccctgcagaaaggttatgggacaaaggtcagaaattgcaacctggaggtcagaggcggaaaggtcaggctggctggggcatggtgaatgggctaatgggatgggagttggggaaacraggttcaagtccttgctcctgcctgctaggggcatgtccttgggcaggtcattcagccattccaagtctcagttttccttgtctgtaaaatgggatgaaaatgcctattgcatgtggtggttatggatatgaacacataagttgcatgcattaaattgctctgtaatgctgagctgaggaattaaagatgacaaggttggtagcaacctcctgaggtcgaaggtataataaaagggcaaagggcagagggaaaagattggggacaccttgactgtgggaggctagagggtggagagtcat

SEQ ID NO: 3752 - DNA, 601 bp, Human
caaagcccacattttacattctctcagtgacccttggggtgggcagctcatcccccaagaccacagcctggacccccagatgttagtctctgaatcctgcccatatccatctccaccccccacccccagcttcctaccttaggtccagggcgtcctggataacctgggaggcctggcaccccaagcttgccctgcagaaaggttatgggacaaaggtcagaaattgcaacctggaggtcagaggcggaaaggtcaggctggctggggcatggtgaatgggctaatgggatgggagttgggraaacaaggttcaagtccttgctcctgcctgctaggggcatgtccttgggcaggtcattcagccattccaagtctcagttttccttgtctgtaaaatgggatgaaaatgcctattgcatgtggtggttatggatatgaacacataagttgcatgcattaaattgctctgtaatgctgagctgaggaattaaagatgacaaggttggtagcaacctcctgaggtcgaaggtataataaaagggcaaagggcagagggaaaagattggggacaccttgactgtgggaggctagagggtggaga

SEQ ID NO: 3753 - DNA, 601 bp, Human
tgcgtctgccgcccaaagtgttgggattacagccatgagccactgcgcccagccacatctggctaatttttgtatgttttcatagggaccacgttttgccacgttgcccagtctggtctcgaactcctgggctcaagcaatcctctcacctcagcctctcagggtgctgggattatagccaagagccactatgcctggccaaagcccacattttacattctctcagtgacccttggggtgggcagctcatcccccaagaccacagcctggacccccagatgttagtctctgaatcctgccyatatccatctccaccccccacccccagcttcctaccttaggtccagggcgtcctggataacctgggaggcctggcaccccaagcttgccctgcagaaaggttatgggacaaaggtcagaaattgcaacctggaggtcagaggcggaaaggtcaggctggctggggcatggtgaatgggctaatgggatgggagttggggaaacaaggttcaagtccttgctcctgcctgctaggggcatgtccttgggcaggtcattcagccattccaagtctcagttttccttgtctgtaaaatgggat

SEQ ID NO: 3754 - DNA, 601 bp, Human
tatcaacattattataatcaaattgatgaggtggaaattactgggatgtctgtttcaccgcagagaaaacaggctcaagaaactttcccaagatcacatagcgggtaagagggcatttgaccccaagtctgtctgatgtcaaagctcactttttaaaaaaatttttgagacagagtccccctctgtcacccacgctggggtgcagtggctcgatcatagctcactgcaggctcaatctccttgggctcaggtgatcctcccatctcagcctcccaagtagctgggaccacatctggctaattttttttttttttttttttttttgagatggaatcttgctttgtcaccaggctggagttcagtggtgagatcttggctcactgcaacctctgcctcctggggtcaaacaattctcctgtctcagcctcttgggtagctgggattacaggtgcatgctactatgcccagctaatttttttgtatttttggtagtgacagggttttaccatgttggccaggctggtctcaaactcctgacctcaagtgatccgcctgcctctgcctcccaaagcgttgggattacaggtgtgagccactgccc

SEQ ID NO: 3755 - DNA, 601 bp, Human
caatgtaaagggaaatcactgaaaaaataaaaaaaaaaaaccactgtcaaatccaacgtaggcaagataactatcagctcaacagcgcaaaaatgtgaaactctaggaggattctgcactcaattatcttcccaaatgtctattttttttttcttttgagacagagtctcactctgttgcccagggtggagtaagtggcacgatctcagctcactgcatcctctgcttcccgggctcaagcaattctcctgcctcagcctccatgtacctgggattacaggcacccgccactgcacccagytaattcttgtatttttagtagagatggggttctgccatgttggccaggctggtggtgaactctcgacctcaggtgatccactcgcctcggcctcccaaagtgctgggattacagccatgagccactgcgcccagccccaaatgtctttaggttcctgctctactctagagaaacagaactcatcagtgatataatatgggaatagtttaggcagaaaaatgaatctcatcagtgtcctcacccatcaaaacattggcaaacaaatgttatgttttcatataagtacgtttttgcataagt

SEQ ID NO: 3756 - DNA, 601 bp, Human
aaaaagaagaaagaaagaaggaaagaaagagaaaaaagaaggaaaagaaaagaaaaaagagggggacgcagtgagggagggagggaagaaaggaaggaaggaagaaaggaggaaggaaggaaggagaataaagttgtccatcaaaactaagcttcaaagtttttttctcaatcgttaaaaagaaaaaaaaaatctaagttaaaggaaaaggagtcaatgtaaagggaaatcactgaaaaaataaaaaaaaaaaaccactgtcaaatccaacgtaggcaagataactatcagctcaacagcrcaaaaatgtgaaactctaggaggattctgcactcaattatcttcccaaatgtctattttttttttcttttgagacagagtctcactctgttgcccagggtggagtaagtggcacgatctcagctcactgcatcctctgcttcccgggctcaagcaattctcctgcctcagcctccatgtacctgggattacaggcacccgccactgcacccagctaattcttgtatttttagtagagatggggttctgccatgttggccaggctggtggtgaactctcgacctcaggtgatccactcgcc

SEQ ID NO: 3757 - DNA, 601 bp, Human
aaagaaagaaagaaagaaagaaagaaagaaagaaagaaagaaagaaagaaagagagagagagagaaagaaagaaagaagagagagagagaaagaaagacagacagaaagaaagaaagaaaaaagaagaaagaaagaaggaaagaaagagaaaaaagaaggaaaagaaaagaaaaaagagggggacgcagtgagggagggagggaagaaaggaaggaaggaagaaaggaggaaggaaggaaggagaataaagttgtccatcaaaactaagcttcaaagtttttttctcaatcgttaaaaagaaaaaaaaaatctaagttaaaggaaaaggagtcaatgtaaagggaaatcactgaaaaaataaaaaaaaaaaaccactgtcaaatccaacgtaggcaagataactatcagctcaacagcgcaaaaatgtgaaactctaggaggattctgcactcaattatcttcccaaatgtctattttttttttcttttgagacagagtctcactctgttgcccagggtggagtaagtggcacgatctcagctcactgcatcctctgcttcccgggctcaagcaattctcctgcctcagcctccatgtacc

SEQ ID NO: 3758 - DNA, 601 bp, Human
ggtcatgactcaccgacttccctttctctcctatgggtcccaggggaccgggaaatccaatagatccctgagtggagagaattagaaagaagacatgagggtgaggagtgagtggtgggtggaattggcccctcataccatcctttgaggcatttccaggtcactgattccagaagcttccttggtctctacagccccagcctcctacaaggcagccctcttctctcctctcccctcctctcctcccttctcatttcactgcagccctttgcactggctgctgtctttggctgaaatgctygtctcctaggcctccacaaagtcagccactcctgaccatttagatctcattcagatgtcacctccttagaatgcctttctaccaccatcctggcttccacattgcccaagtcaccctctgtctgtcacattatgctattttgttttcccaagaacacttgcgttgaaatgacccttattgacttatttattcaatgcctgttttcccccactgtgacatagctcattggtcttattccccactgcctggcacacggtgagtgctttttaatatttgttaactgactccagtccatgctgg

SEQ ID NO: 3759 - DNA, 601 bp, Human
ttcagctgaggactttgtcttggtaagcacagcagtatacatacactcatgtacgtacatacaatgttcattaacactgttacaatacacacatagcaacacaaatacaatacatgcatgtatacccatcactcagtgtgcacagaaacacacacatgtgtatacacatgtcctttcacgcatatgtacaagcttcttgcacacatttatgcccaccatcatgcaaagtgcacgcagattcatgcccttgttcacccaggcacaggcctgcaggctgcggcattcaaaccctgtctcatckatattgaaagatacatgaaacacatatacatgtgcttacagtcatattcatgataataccatgtgtaatcacctacatgtgtcatgcattgcatataatagcatgtgtgcacacaaatgttccaggcatagacacaaacacccagggtccacccatcatcagacacaaccacacatgctgttcccctcagacaagttctcccctctcccttacccccggtcatgactcaccgacttccctttctctcctatgggtcccaggggaccgggaaatccaatagatccctgagtggagagaatt

SEQ ID NO: 3760 - DNA, 601 bp, Human
atggcatgcatttggcaatccacagcctgaagatgacacagaactcatcatgcaatacatctcttgcacacatgtatacccactgtaaacacatgaaggcctggattcagctgaggactttgtcttggtaagcacagcagtatacatacactcatgtacgtacatacaatgttcattaacactgttacaatacacacatagcaacacaaatacaatacatgcatgtatacccatcactcagtgtgcacagaaacacacacatgtgtatacacatgtcctttcacgcatatgtacaagcttsttgcacacatttatgcccaccatcatgcaaagtgcacgcagattcatgcccttgttcacccaggcacaggcctgcaggctgcggcattcaaaccctgtctcatcgatattgaaagatacatgaaacacatatacatgtgcttacagtcatattcatgataataccatgtgtaatcacctacatgtgtcatgcattgcatataatagcatgtgtgcacacaaatgttccaggcatagacacaaacacccagggtccacccatcatcagacacaaccacacatgctgttcccctcagacaag

SEQ ID NO: 3761 - DNA, 601 bp, Human
caaatacaacttatactcaaaaccacacaaagatctcaaacacacaattacaactatgattgcatctacagagtacaaacgtgcaagcatgtttgcccacaagacatatattgatcacagctgtgcagtatgcatacatgattgcatgtaatcatggcatgcatttggcaatccacagcctgaagatgacacagaactcatcatgcaatacatctcttgcacacatgtatacccactgtaaacacatgaaggcctggattcagctgaggactttgtcttggtaagcacagcagtatacatrcactcatgtacgtacatacaatgttcattaacactgttacaatacacacatagcaacacaaatacaatacatgcatgtatacccatcactcagtgtgcacagaaacacacacatgtgtatacacatgtcctttcacgcatatgtacaagcttcttgcacacatttatgcccaccatcatgcaaagtgcacgcagattcatgcccttgttcacccaggcacaggcctgcaggctgcggcattcaaaccctgtctcatcgatattgaaagatacatgaaacacatatacatgtgcttacagt

SEQ ID NO: 3762 - DNA, 601 bp, Human
cccagtcacagacccagaaagctgtctgccacatatttattcacaagcttttcagtcatacacatacacacaaatacaacttatactcaaaaccacacaaagatctcaaacacacaattacaactatgattgcatctacagagtacaaacgtgcaagcatgtttgcccacaagacatatattgatcacagctgtgcagtatgcatacatgattgcatgtaatcatggcatgcatttggcaatccacagcctgaagatgacacagaactcatcatgcaatacatctcttgcacacatgtatrcccactgtaaacacatgaaggcctggattcagctgaggactttgtcttggtaagcacagcagtatacatacactcatgtacgtacatacaatgttcattaacactgttacaatacacacatagcaacacaaatacaatacatgcatgtatacccatcactcagtgtgcacagaaacacacacatgtgtatacacatgtcctttcacgcatatgtacaagcttcttgcacacatttatgcccaccatcatgcaaagtgcacgcagattcatgcccttgttcacccaggcacaggcctgcag

SEQ ID NO: 3763 - DNA, 601 bp, Human
aaactaaggcacagagtggttaagtgacttgcccaaggtcacacagtaggtgagtggcagagccaggacttgaactcatggctctctgacttcacaggctgtgctccttctttttttcttttcttaaagatggagtcttgctctgtcacccaagctggagtgcagtggtgtgattagctcacttcagcttccaactcctgggctcaagcaattctctcatctcagcttccagcataggtgggactacaggcgtgcaccaccacacccaattaagctgtgctcttaccactgcattataatrtctcttcatctcttgggtttgtcctccactcagaatctctctctctctctcacacacacacacattcacacacacacacacacacacacactcaccttttctccagggatcccaggggctccatcctggcccacatcgccctaggacagagtgaatgagactcaggccccagaacaaactcaactgggaagaatttggagggactggctgagcctggggcatggggggccttgattgcccacccatcccataccttggggcctggttgccctgtggcacccggttgccccctctctccac

SEQ ID NO: 3764 - DNA, 601 bp, Human
agtgcttactgcatgccaggcatgggcagggcattctccacaagtcagtcattttattcaccactgtagccctttgggttggagactgaggttactcccattttacagaggagaaaactaaggcacagagtggttaagtgacttgcccaaggtcacacagtaggtgagtggcagagccaggacttgaactcatggctctctgacttcacaggctgtgctccttctttttttcttttcttaaagatggagtcttgctctgtcacccaagctggagtgcagtggtgtgattagctcacttcascttccaactcctgggctcaagcaattctctcatctcagcttccagcataggtgggactacaggcgtgcaccaccacacccaattaagctgtgctcttaccactgcattataatgtctcttcatctcttgggtttgtcctccactcagaatctctctctctctctcacacacacacacattcacacacacacacacacacacacactcaccttttctccagggatcccaggggctccatcctggcccacatcgccctaggacagagtgaatgagactcaggccccagaacaaactcaactg

SEQ ID NO: 3765 - DNA, 601 bp, Human
aaagttggggcacagatacagggcttcctcccttcccacatcctccacccacccaacccccaatgagggtgacctcactcacaggggggccctttggcccagggaatcctggagggccttgcagaccagggaggccctgaaatggaaacagaaatcatgatctcatcccccctgcctccctgcccactccctgagccccacataatgacaacaggatcgagcacatattgagtgcttactgcatgccaggcatgggcagggcattctccacaagtcagtcattttattcaccactgtagcyctttgggttggagactgaggttactcccattttacagaggagaaaactaaggcacagagtggttaagtgacttgcccaaggtcacacagtaggtgagtggcagagccaggacttgaactcatggctctctgacttcacaggctgtgctccttctttttttcttttcttaaagatggagtcttgctctgtcacccaagctggagtgcagtggtgtgattagctcacttcagcttccaactcctgggctcaagcaattctctcatctcagcttccagcataggtgggactacaggcgtgcac

SEQ ID NO: 3766 - DNA, 601 bp, Human
tctcaaaaagaaaaaaaaaaaaaaggatcaggaatcaaaggttgaggggttactcaccagttctcctctctgtccagggtgccctggtcgcccatctttaccttggtgaccctgggggatgaggtgggaaaaagttggggcacagatacagggcttcctcccttcccacatcctccacccacccaacccccaatgagggtgacctcactcacaggggggccctttggcccagggaatcctggagggccttgcagaccagggaggccctgaaatggaaacagaaatcatgatctcatccccyctgcctccctgcccactccctgagccccacataatgacaacaggatcgagcacatattgagtgcttactgcatgccaggcatgggcagggcattctccacaagtcagtcattttattcaccactgtagccctttgggttggagactgaggttactcccattttacagaggagaaaactaaggcacagagtggttaagtgacttgcccaaggtcacacagtaggtgagtggcagagccaggacttgaactcatggctctctgacttcacaggctgtgctccttctttttttcttttcttaa

SEQ ID NO: 3767 - DNA, 601 bp, Human
ccactcgggaggctgaggcaggagaattgcttgaacctgggaggcaaaggttgcagtgagccgagattgccccactgcactctagcccaggtgacagagtgagactctgtctcaaaaagaaaaaaaaaaaaaaggatcaggaatcaaaggttgaggggttactcaccagttctcctctctgtccagggtgccctggtcgcccatctttaccttggtgaccctgggggatgaggtgggaaaaagttggggcacagatacagggcttcctcccttcccacatcctccacccacccaacccccratgagggtgacctcactcacaggggggccctttggcccagggaatcctggagggccttgcagaccagggaggccctgaaatggaaacagaaatcatgatctcatcccccctgcctccctgcccactccctgagccccacataatgacaacaggatcgagcacatattgagtgcttactgcatgccaggcatgggcagggcattctccacaagtcagtcattttattcaccactgtagccctttgggttggagactgaggttactcccattttacagaggagaaaactaaggcacagagtg

SEQ ID NO: 3768 - DNA, 601 bp, Human
atggagtccactctgacctgagggcctaagacaccagctggtccaggcgggcctgtctgaccttggaagccctagagagaaaaattaaatgtgggggcggtgttacatggggaagggatggaggagcaggagacagggaaggcctgataggatcaggaatctggccggtccggtggctcacgcctgtaatcccagcactttgggaggcagaggcaggtgggtcacttgaagccaggagtttgagagcagcctggtcaacatgatgaagccccgtctctactaaaaatacaaaaattagccrggcgtggtggcacgcgcctgtagtgccactcgggaggctgaggcaggagaattgcttgaacctgggaggcaaaggttgcagtgagccgagattgccccactgcactctagcccaggtgacagagtgagactctgtctcaaaaagaaaaaaaaaaaaaaggatcaggaatcaaaggttgaggggttactcaccagttctcctctctgtccagggtgccctggtcgcccatctttaccttggtgaccctgggggatgaggtgggaaaaagttggggcacagatacagggcttcctcccttcc

SEQ ID NO: 3769 - DNA, 601 bp, Human
aggtcccacttctcctgtctttccctggtgaggaagaaggctcctgttgagtgggggtggcctaggggagtcgctcaggagtccagctttcccctaaatatcccccaactggtacaaaacaagggaggtttatggagtccactctgacctgagggcctaagacaccagctggtccaggcgggcctgtctgaccttggaagccctagagagaaaaattaaatgtgggggcggtgttacatggggaagggatggaggagcaggagacagggaaggcctgataggatcaggaatctggccggtccggtggctcacgcctgtaatcccagcactttgggaggcagaggcaggtgggtcacttgaagccaggagtttgagagcagcctggtcaacatgatgaagccccgtctctactaaaaatacaaaaattagccgggcgtggtggcacgcgcctgtagtgccactcgggaggctgaggcaggagaattgcttgaacctgggaggcaaaggttgcagtgagccgagattgccccactgcactctagcccaggtgacagagtgagactctgtctcaaaaagaaaaaaaaaaaaaaggatcaggaat

SEQ ID NO: 3770 - DNA, 601 bp, Human
tccctcccctgacccccccatcctttccttctctaagggacatgcaggagggtctccaaagatactcaccgggtccccagggccccctttggggccgggaaagcccctgagtccagctggcccttctttcccaaggggtcctggtggtcccagttccccctacaggagtgcaaaggagggaagtcaagctccagggaggggatgtctccctccaatctgtgactcagggccccctcccccatgagactgattctgagtccttggttgatcttggatgttcaaccaagatctccagtggacagtgtctcaccttggccccctctctgccttccaggccaggaagaccttgttcaccaggaggtccaggggggcctggaggccccctttcacctagaggtcccacttctcctgtctttccctggtgaggaagaaggctcctgttgagtgggggtggcctaggggagtcgctcaggagtccagctttcccctaaatatcccccaactggtacaaaacaagggaggtttatggagtccactctgacctgagggcctaagacaccagctggtccaggcgggcctgtctgaccttggaagccctaga

SEQ ID NO: 3771 - DNA, 601 bp, Human
tgaccttggctcattgcaacctccacctcccaggttcaagcgattctcctgcctcagcctctagagtagctgggattacaggcatctgcctccatgcctggctaatttttgtatttttagtagagacggggttccaccatgttggccaggctgatcttgaactcctgacctcaagtgatctgcctgcctcagcctccatcatgggttttatcatgacaatgtcaagcttccaagacaccttgagtcccctccaccctgcccccacccagcacatggggttatacttacattggcccccacrggccctggggggcccttatcaccctttaagccagtaggtccctgaaggaggagataattcacagttaagagactcccaaaggtgtccccaggtcctgtcttcctctgtggggagctcacagtccccacctctctcctgggactggacactgagctttgaggggtctgccttccccagttccctccaccattttttttgctttcatcatttcccgcaccccaaatgctattccccatccctcccctgacccccccatcctttccttctctaagggacatgcaggagggtctccaaagatac

SEQ ID NO: 3772 - DNA, 601 bp, Human
tgggatgaaggacccagcttccattcacccccatcctcccctggacccttcctctctgtgaacccctcaccttgtccccttcctcgccagaaggcccagcagctccagggggtcccagaggccccaggggccctgggatcccatctttgccagtggggccaggggggccacgttctccctgttgtggggaatggaaagggggatgtcagggcaggaatgtcctgcaggagccatgtcctgggatgtggcagggccagaccctgaggaggccctaggaatgggatgggcaagtcacttaccsgggaccccttcttgcctgcagggccaacggggccttcgctgccactttggccaggaagtccaatgcctcctgctgggcccaaaggaccgcgctcaccaggggagccctgagaacaggggtgatgaatcaggtataataccagtagtagctgtcctttatggagggtttttaagccaccaggcactgagttctgaggttaccaggattgtatctaacctgttcccctcctgcagcagccagagggtgcctgtgagcacctgaggggcagggcatattcttctcctgctcaagaacactcca

SEQ ID NO: 3773 - DNA, 601 bp, Human
attgagaagaagacatgattgggttggggttgactccgaatttgggattgggttcatactgggtgtttgtactgaggggaagacatggttgggttgggattgaatcagattctgagggtgagttcatattgagtgtcggtattgaggggacaacatggttgggttgggattgactccgattcttggattgagttcacattgggtgtcagtactgagggaagatcagggttgggtttgaggtttggattaagtcagtgtgcttccactgtcgtttgctcccactatccctcccttcaaggayccagagaaggactgaaaagatgggggcactcaccgggggacctgggtgtcctgcaggaccccgtatccctggttgtccaggtgggccctgggagaacaggaaacagaatcaaaaattccctcaggtttaagattagagagggcactggagctatcaatcactgcctcccacaccccctttatgagaacaacttcccctaccaggcagcaacagctacatccccccaaatcctgtcttctcagccaccaacagatgggatcagacagacgtctgtcctaagcccagccctggccacaagtt

SEQ ID NO: 3774 - DNA, 601 bp, Human
ggtattgagggaaagacatggttgggttgggactgggcaggattctggagttgagttcacattgggtgctggtattgagggggaacacatggttgggttgggattgaatcagattctggggttgagttcacattgggtgtcagcattgaggggaagacatggttggattgggattgagacaaattctagggttgagttcatattgggtgtcggtattgagggaaatacatggttgggttgggattgggccagattctggggttgagttcccattgggtgttggcattgaggggaagacacrgttgggtcgggattgaatcagattctgggggtgagttcatattgggtgtcggtattgaggggaagacatggttgggttgggattgaatcagattctggggttgagttcacattgggtgtcagcattgaggggaagacatggttcgactgggattgagccaaattctggggttgagttcacattgggtgttggcattgaggggaagacatagttgggttgagattgggccaaattctggggttgagttcacattggatgttggtattgagaagaagacatgattgggttggggttgactcc

SEQ ID NO: 3775 - DNA, 601 bp, Human
agactggggctgaagtgggggttcagagctgggtttaggttggaatttagtctgattttaaggttgagtgtatattggacatcgatatagaggggcagatcaaagttgagcatgaggttgagattgaaccagattctggggttgagtccatattggatgttggcattgaggggaagacatggttggagttgagattgagccaaattctgggggtgagttcatattggattttggtattgagggaaagacatggttgggttgggactgggcaggattctggagttgagttcacattgggtgytggtattgagggggaacacatggttgggttgggattgaatcagattctggggttgagttcacattgggtgtcagcattgaggggaagacatggttggattgggattgagacaaattctagggttgagttcatattgggtgtcggtattgagggaaatacatggttgggttgggattgggccagattctggggttgagttcccattgggtgttggcattgaggggaagacacggttgggtcgggattgaatcagattctgggggtgagttcatattgggtgtcggtattgaggggaagaca

SEQ ID NO: 3776 - DNA, 601 bp, Human
actcatgactcagatttgagccctcacctatcccctgggtcatgtagtcttgtgtagtgtgcaacctgcagaactgtacatagcagccctatctgagaacttccaggtgtccttcctcaaggtaatcagggacggccacaggacaggggtgagtggatgatcttgcactgtccagaggtcaaagtggcccaagatgcccaggggtcaggggttccctgagttgggtgcagggaccacatcacacagtcactcaccgggatgcctggggctcctggaggccctgggtctccagcgtcccctsgctcaccctgcaggaggcaaagtgagagtggggagaggtcccatcctagcagacagggaggggctccccagaatgtccctgcccaataggactagatttatctcttccccccgtgcagcccctgccttccctcactcaccttctcacccacggcgcctggctgaccaactcctccaggcagccctggagtgccctggagagacagcaaggggtaagagtgggactgtggaatcccaacatcctcttcttaggaaatggttgtccccatctctgagccttcctggccccccaagagttctc

SEQ ID NO: 3777 - DNA, 601 bp, Human
aatgtctcccttgggcccctttacagaaagaggtcagaggtcagagtggcctggactctccagggatcaaggattagcatacttggattcaggcattggggtggtctgggacttttctggggtcagggttcagagtagcctaggttgtccaagggtcaaaggtcagaaggagctaggacttaagacagtgaaaggtctggatggtctaggtgcccattggtcatgtgcaaggttggcctagcccatgtgctgcccttgagtgaattagaagaggggccccatctgggcaactcatcctcargtcaggactcatgactcagatttgagccctcacctatcccctgggtcatgtagtcttgtgtagtgtgcaacctgcagaactgtacatagcagccctatctgagaacttccaggtgtccttcctcaaggtaatcagggacggccacaggacaggggtgagtggatgatcttgcactgtccagaggtcaaagtggcccaagatgcccaggggtcaggggttccctgagttgggtgcagggaccacatcacacagtcactcaccgggatgcctggggctcctggaggccctgggtctccagcg

SEQ ID NO: 3778 - DNA, 601 bp, Human
tgcctgggggtccagcagctccagatgggcctgagtcccccttttcaccaatgtctcccttgggcccctttacagaaagaggtcagaggtcagagtggcctggactctccagggatcaaggattagcatacttggattcaggcattggggtggtctgggacttttctggggtcagggttcagagtagcctaggttgtccaagggtcaaaggtcagaaggagctaggacttaagacagtgaaaggtctggatggtctaggtgcccattggtcatgtgcaaggttggcctagcccatgtgctrcccttgagtgaattagaagaggggccccatctgggcaactcatcctcaagtcaggactcatgactcagatttgagccctcacctatcccctgggtcatgtagtcttgtgtagtgtgcaacctgcagaactgtacatagcagccctatctgagaacttccaggtgtccttcctcaaggtaatcagggacggccacaggacaggggtgagtggatgatcttgcactgtccagaggtcaaagtggcccaagatgcccaggggtcaggggttccctgagttgggtgcagggaccacatcacaca

SEQ ID NO: 3779 - DNA, 601 bp, Human
ccacttccccccaggactcaccacgctccctttggctccatcctctccagggggacctttcttgcctgggggtccagcagctccagatgggcctgagtcccccttttcaccaatgtctcccttgggcccctttacagaaagaggtcagaggtcagagtggcctggactctccagggatcaaggattagcatacttggattcaggcattggggtggtctgggacttttctggggtcagggttcagagtagcctaggttgtccaagggtcaaaggtcagaaggagctaggacttaagacagtkaaaggtctggatggtctaggtgcccattggtcatgtgcaaggttggcctagcccatgtgctgcccttgagtgaattagaagaggggccccatctgggcaactcatcctcaagtcaggactcatgactcagatttgagccctcacctatcccctgggtcatgtagtcttgtgtagtgtgcaacctgcagaactgtacatagcagccctatctgagaacttccaggtgtccttcctcaaggtaatcagggacggccacaggacaggggtgagtggatgatcttgcactgtccagaggtcaaa

SEQ ID NO: 3780 - DNA, 601 bp, Human
ctagaagtctgggagagttttggccgagcgcggtggctcatgcctgtaatcccagcactttgggaggctgaggcatgctgatcacgaggtcaggagatcgagaccatcctggccaacatagtgaacacccatctctactaaaaatacaaaaattagctgggtgtggtggcgcgtgcctgtagtcctggctacttgggaggctgaggcagaagaatcgcttgaacccggaagacggaggttgcagtgagctgagatcgtgccactgcactccagcctggtgacagagcaagactccatctcaaaaaaaaaaaaagtttgggagagcttcaagtacattcaagtgccccctcccatgtctgcccccacttccccccaggactcaccacgctccctttggctccatcctctccagggggacctttcttgcctgggggtccagcagctccagatgggcctgagtcccccttttcaccaatgtctcccttgggcccctttacagaaagaggtcagaggtcagagtggcctggactctccagggatcaaggattagcatacttggattcaggcattggggtggtctgggacttttctggggtcaggg

SEQ ID NO: 3781 - DNA, 601 bp, Human
attaattcactcattcatacattcatccactcattcattaatccatccatccacccattcattcattcatccgtgttctgggggttactcatgagatcagtaaattagaggatgcaatccctggctagaagtctgggagagttttggccgagcgcggtggctcatgcctgtaatcccagcactttgggaggctgaggcatgctgatcacgaggtcaggagatcgagaccatcctggccaacatagtgaacacccatctctactaaaaatacaaaaattagctgggtgtggtggcgcgtgcytgtagtcctggctacttgggaggctgaggcagaagaatcgcttgaacccggaagacggaggttgcagtgagctgagatcgtgccactgcactccagcctggtgacagagcaagactccatctcaaaaaaaaaaaaagtttgggagagcttcaagtacattcaagtgccccctcccatgtctgcccccacttccccccaggactcaccacgctccctttggctccatcctctccagggggacctttcttgcctgggggtccagcagctccagatgggcctgagtcccccttttcaccaatg

SEQ ID NO: 3782 - DNA, 601 bp, Human
tcacgtattcatccatccactgagttattcacttgtccattcattaattcactcattcatacattcatccactcattcattaatccatccatccacccattcattcattcatccgtgttctgggggttactcatgagatcagtaaattagaggatgcaatccctggctagaagtctgggagagttttggccgagcgcggtggctcatgcctgtaatcccagcactttgggaggctgaggcatgctgatcacgaggtcaggagatcgagaccatcctggccaacatagtgaacacccatctstactaaaaatacaaaaattagctgggtgtggtggcgcgtgcctgtagtcctggctacttgggaggctgaggcagaagaatcgcttgaacccggaagacggaggttgcagtgagctgagatcgtgccactgcactccagcctggtgacagagcaagactccatctcaaaaaaaaaaaaagtttgggagagcttcaagtacattcaagtgccccctcccatgtctgcccccacttccccccaggactcaccacgctccctttggctccatcctctccagggggacctttcttgcctgggggt

SEQ ID NO: 3783 - DNA, 601 bp, Human
tccctcgttcatccattcattcactcgttcatccattcactcactcgttcatccattcactcatttattcatccatttattcattcacgtattcatccatccactgagttattcacttgtccattcattaattcactcattcatacattcatccactcattcattaatccatccatccacccattcattcattcatccgtgttctgggggttactcatgagatcagtaaattagaggatgcaatccctggctagaagtctgggagagttttggccgagcgcggtggctcatgcctgtaatcccagcactttgggaggctgaggcatgctgatcacgaggtcaggagatcgagaccatcctggccaacatagtgaacacccatctctactaaaaatacaaaaattagctgggtgtggtggcgcgtgcctgtagtcctggctacttgggaggctgaggcagaagaatcgcttgaacccggaagacggaggttgcagtgagctgagatcgtgccactgcactccagcctggtgacagagcaagactccatctcaaaaaaaaaaaaagtttgggagagcttcaagtacattcaagtgccccctcc

SEQ ID NO: 3784 - DNA, 601 bp, Human
ttaattcactcattcacccattcattccctcgttcatccattcattcactcgttcatccattcactcactcgttcatccattcactcatttattcatccatttattcattcacgtattcatccatccactgagttattcacttgtccattcattaattcactcattcatacattcatccactcattcattaatccatccatccacccattcattcattcatccgtgttctgggggttactcatgagatcagtaaattagaggatgcaatccctggctagaagtctgggagagttttggccragcgcggtggctcatgcctgtaatcccagcactttgggaggctgaggcatgctgatcacgaggtcaggagatcgagaccatcctggccaacatagtgaacacccatctctactaaaaatacaaaaattagctgggtgtggtggcgcgtgcctgtagtcctggctacttgggaggctgaggcagaagaatcgcttgaacccggaagacggaggttgcagtgagctgagatcgtgccactgcactccagcctggtgacagagcaagactccatctcaaaaaaaaaaaaagtttgggagagct

SEQ ID NO: 3785 - DNA, 601 bp, Human
attaattcactcattcacccattcattccctcgttcatccattcattcactcgttcatccattcactcactcgttcatccattcactcatttattcatccatttattcattcacgtattcatccatccactgagttattcacttgtccattcattaattcactcattcatacattcatccactcattcattaatccatccatccacccattcattcattcatccgtgttctgggggttactcatgagatcagtaaattagaggatgcaatccctggctagaagtctgggagagttttggcmgagcgcggtggctcatgcctgtaatcccagcactttgggaggctgaggcatgctgatcacgaggtcaggagatcgagaccatcctggccaacatagtgaacacccatctctactaaaaatacaaaaattagctgggtgtggtggcgcgtgcctgtagtcctggctacttgggaggctgaggcagaagaatcgcttgaacccggaagacggaggttgcagtgagctgagatcgtgccactgcactccagcctggtgacagagcaagactccatctcaaaaaaaaaaaaagtttgggagagc

SEQ ID NO: 3786 - DNA, 601 bp, Human
tcagtcattttgttcacttgcgcctctgtccattcattcatgcatccattcactcattcactcactcatttgtccattcggccactcattcattcatccattcattcatattcatgcatccattaatttacttattcatccattaatttactcattcatccattcattcactcatttattcgtgcacatttattcattcacatattcatatatccactgatttattcatttttccattaattcactcattcacccattcattccctcgttcatccattcattcactcgttcatccattcaytcactcgttcatccattcactcatttattcatccatttattcattcacgtattcatccatccactgagttattcacttgtccattcattaattcactcattcatacattcatccactcattcattaatccatccatccacccattcattcattcatccgtgttctgggggttactcatgagatcagtaaattagaggatgcaatccctggctagaagtctgggagagttttggccgagcgcggtggctcatgcctgtaatcccagcactttgggaggctgaggcatgctgatcacgaggt

SEQ ID NO: 3787 - DNA, 601 bp, Human
ggggcccagggtggcccagagagccaatgggaccagggggaccctaggaaaaggacatcgggtcagtattggtggggtacaccctattgccctgacacatcccccagacaagccttcaatcctaccaaaggaagaccccgaaccctagacaagcctccagttcccccacagagagaccccaaaccccagacgcagcctccaacttgccagttcccagatacatccccctattttccccacacacaccctcattaatccagacccacgtttcccagaccccacacccacagtctctcaaccsaccccctccttcaaatgcattcttcccgctcaggtcaggacactcacagggtctcccttgggaccagggggtccctgcacgcctggcaacccctgatctcctttctcaccagcttctcccggggggccaatgagaccgatcaatccaatgtggccctgaaggacaaaagaggcacagacaggggaggacgtgggaggattcagggaggtttttctcctagagccttagggtgatgagtttgggagcagaggatgcaccaatctcccagccccccagccagggagggagggaaagagggga

SEQ ID NO: 3788 - DNA, 601 bp, Human
ctgtagggtacagacagggagagctgaggtcctggcctggaccaccacagtgacctcatcccacaaaagattccctgcatactcaccgccacacctgggggcccagggtggcccagagagccaatgggaccagggggaccctaggaaaaggacatcgggtcagtattggtggggtacaccctattgccctgacacatcccccagacaagccttcaatcctaccaaaggaagaccccgaaccctagacaagcctccagttcccccacagagagaccccaaaccccagacgcagcctccaacytgccagttcccagatacatccccctattttccccacacacaccctcattaatccagacccacgtttcccagaccccacacccacagtctctcaaccgaccccctccttcaaatgcattcttcccgctcaggtcaggacactcacagggtctcccttgggaccagggggtccctgcacgcctggcaacccctgatctcctttctcaccagcttctcccggggggccaatgagaccgatcaatccaatgtggccctgaaggacaaaagaggcacagacaggggaggacgtgggaggattcag

SEQ ID NO: 3789 - DNA, 601 bp, Human
gtgtaagcccacggaagcagggtgtactcaccggagacccttttgagcctttctgtcctagagggccctgtagggtacagacagggagagctgaggtcctggcctggaccaccacagtgacctcatcccacaaaagattccctgcatactcaccgccacacctgggggcccagggtggcccagagagccaatgggaccagggggaccctaggaaaaggacatcgggtcagtattggtggggtacaccctattgccctgacacatcccccagacaagccttcaatcctaccaaaggaagacsccgaaccctagacaagcctccagttcccccacagagagaccccaaaccccagacgcagcctccaacttgccagttcccagatacatccccctattttccccacacacaccctcattaatccagacccacgtttcccagaccccacacccacagtctctcaaccgaccccctccttcaaatgcattcttcccgctcaggtcaggacactcacagggtctcccttgggaccagggggtccctgcacgcctggcaacccctgatctcctttctcaccagcttctcccggggggccaatgagac

SEQ ID NO: 3790 - DNA, 601 bp, Human
gagacgtggagggttctggtgcagtgaagggggtggggagctgggatgtgtaagcccacggaagcagggtgtactcaccggagacccttttgagcctttctgtcctagagggccctgtagggtacagacagggagagctgaggtcctggcctggaccaccacagtgacctcatcccacaaaagattccctgcatactcaccgccacacctgggggcccagggtggcccagagagccaatgggaccagggggaccctaggaaaaggacatcgggtcagtattggtggggtacaccctattgycctgacacatcccccagacaagccttcaatcctaccaaaggaagaccccgaaccctagacaagcctccagttcccccacagagagaccccaaaccccagacgcagcctccaacttgccagttcccagatacatccccctattttccccacacacaccctcattaatccagacccacgtttcccagaccccacacccacagtctctcaaccgaccccctccttcaaatgcattcttcccgctcaggtcaggacactcacagggtctcccttgggaccagggggtccctgcacgcctggcaa

SEQ ID NO: 3791 - DNA, 601 bp, Human
cttttcatgttttaatgtctctgaaatcagcttcttaacatctttggcaagtcatagtttacttggcagaactgttttctttcctagcagtttgtaaaataatggtacatcttataattgatggcattttggatctgatgaaatacaaccgtaggtgttgaataaatatttgtcgaacgcacgattgcatgaataaataaataaatgaaggcagagacgtggagggttctggtgcagtgaagggggtggggagctgggatgtgtaagcccacggaagcagggtgtactcaccggagacccytttgagcctttctgtcctagagggccctgtagggtacagacagggagagctgaggtcctggcctggaccaccacagtgacctcatcccacaaaagattccctgcatactcaccgccacacctgggggcccagggtggcccagagagccaatgggaccagggggaccctaggaaaaggacatcgggtcagtattggtggggtacaccctattgccctgacacatcccccagacaagccttcaatcctaccaaaggaagaccccgaaccctagacaagcctccagttcccccacagagagac

SEQ ID NO: 3792 - DNA, 601 bp, Human
actcactcacacactcacacacacacatacagccttggggaagagacatgcagttttcagcattaggcatcagacacaaattttcttttcatgttttaatgtctctgaaatcagcttcttaacatctttggcaagtcatagtttacttggcagaactgttttctttcctagcagtttgtaaaataatggtacatcttataattgatggcattttggatctgatgaaatacaaccgtaggtgttgaataaatatttgtcgaacgcacgattgcatgaataaataaataaatgaaggcagagrcgtggagggttctggtgcagtgaagggggtggggagctgggatgtgtaagcccacggaagcagggtgtactcaccggagacccttttgagcctttctgtcctagagggccctgtagggtacagacagggagagctgaggtcctggcctggaccaccacagtgacctcatcccacaaaagattccctgcatactcaccgccacacctgggggcccagggtggcccagagagccaatgggaccagggggaccctaggaaaaggacatcgggtcagtattggtggggtacaccctattgccct

SEQ ID NO: 3793 - DNA, 601 bp, Human
gagaagccaagttgtaagaggacaaaagagaaagcgcaagaatagcagagacagggagagagagcagggagagagacagaagatgaaatagtggcgccagtatagacagagacagataagggagatggacagagacagggagggagagatggggtccaagagacaagacccaggtcagagcccccatgggtgtccccccaagtcccccctcccaggccagaccttccttggggttttacagggaactaccctcttcacctacatcctctgaacacctagtgtgtgcctggcccagtgctgsgcacggaaggaccctctggggacacccagacatagtccttgctctccccccaggttttggtgtccattcccccgccccccggggaactcaccggggggcctggtgggcctgcaggtccagtgtctccacgggggcccatggacccctgtagggagaagtcacttggagaatgaaccctgtctatggagacccttcccaccaacatacacacaaacacacacacacactcacacacacactcacacacacacagtctcacacactcacatacacactcactcacacactcacacacacaca

SEQ ID NO: 3794 - DNA, 601 bp, Human
gagacaggcagagatgaagaggcagacagacacaaatgagaaagaggagggagagagataaacaaggggcagagatagagaaaggagagataagcagacagggagagacacacaggaaagagagagacagattcagagatggggagaagccaagttgtaagaggacaaaagagaaagcgcaagaatagcagagacagggagagagagcagggagagagacagaagatgaaatagtggcgccagtatagacagagacagataagggagatggacagagacagggagggagagatggggtccragagacaagacccaggtcagagcccccatgggtgtccccccaagtcccccctcccaggccagaccttccttggggttttacagggaactaccctcttcacctacatcctctgaacacctagtgtgtgcctggcccagtgctgcgcacggaaggaccctctggggacacccagacatagtccttgctctccccccaggttttggtgtccattcccccgccccccggggaactcaccggggggcctggtgggcctgcaggtccagtgtctccacgggggcccatggacccctgtagggagaa

SEQ ID NO: 3795 - DNA, 601 bp, Human
cagggtgggtgagtccggatgggacccgacggaccccaaccccccccacacccccactccgcccatccaagtggcggggggaccggacctcaccatcaggcaggtgcgggtggttgcggtgcagctcgtggcacacgaggcccgggcgctccgcagtgccgggaggacgccgcagctgctccagctccaagctcagcgatgtgagcgaggccagcacctcctccaggccgccctccacgactggaagcgggactgggacgaagcgccggcgcctgcgcagcccatgcagctcggcaggggsaccctgggcgtaggggatggggacggagaagagaggggagatgggggagggagagagagggagaaagagagacaggcagagatgaagaggcagacagacacaaatgagaaagaggagggagagagataaacaaggggcagagatagagaaaggagagataagcagacagggagagacacacaggaaagagagagacagattcagagatggggagaagccaagttgtaagaggacaaaagagaaagcgcaagaatagcagagacagggagagagagcagggagagagacagaagatgaaat

SEQ ID NO: 3796 - DNA, 601 bp, Human
acttggcatacagtaagtgctcaataaatgccggttgaaggaaggataacgtcccagacaaggtggttgtgggtgtggggagcaggggacagcacttcctgggggaggcgatgagaggtttgggttactcacgatctcaaacttcttgtcgggatagaggcaggtctctcctcccgccgtgaagttgcaaaaaaccctgaacgagtcccgcgcgcagccctggttggggtcaatccagtattcccctgccgcagagccaggcagggtgggtgagtccggatgggacccgacggaccccaamcccccccacacccccactccgcccatccaagtggcggggggaccggacctcaccatcaggcaggtgcgggtggttgcggtgcagctcgtggcacacgaggcccgggcgctccgcagtgccgggaggacgccgcagctgctccagctccaagctcagcgatgtgagcgaggccagcacctcctccaggccgccctccacgactggaagcgggactgggacgaagcgccggcgcctgcgcagcccatgcagctcggcaggggcaccctgggcgtaggggatggggacggagaagagagggga

SEQ ID NO: 3797 - DNA, 601 bp, Human
tccgcctaccttggcctcccaaagtgctggaattacaggccactgtacccagccatgtggctttttcttcttcaaattcaccagaccctgtcttgactgagcctttgcatatgcctttccctctccctggaacacttgtccttgtccttcctagcttgctaacacagtgcattctttaggcttcagatgagctgtgatctctactaggaagccttctggtctttccaacactgcctctaaatttccaccatgccctgtgcttcccctatcctggcaccatcattctgtatggcaattgackgcctgttacacatctgatgctgctgccaccccacctccagcttgcgatccctaggaaggtagaggaaagcctatcctcttcatctcacctctcagaacccacccctcaaacccccctgctggttcccatcaattttcatgtcactccccatctcggcctcggtgactcaccttcttccctcgacggaatgtgctataccagcctccaggcttttccttggaccaggaggccaatttcacctggaagagaaaagggagggtcactgtagctgacgcccttggtgccatctagatctcatct

SEQ ID NO: 3798 - DNA, 601 bp, Human
tgcctcagcctcctgagtagctgggattacaggcacacatcaccatgtctggctaattttttgtatttttagcagagatggggttttacaatgttggccaggctggtcttgaactcctgacctcaggtgatccgcctaccttggcctcccaaagtgctggaattacaggccactgtacccagccatgtggctttttcttcttcaaattcaccagaccctgtcttgactgagcctttgcatatgcctttccctctccctggaacacttgtccttgtccttcctagcttgctaacacagtgcwttctttaggcttcagatgagctgtgatctctactaggaagccttctggtctttccaacactgcctctaaatttccaccatgccctgtgcttcccctatcctggcaccatcattctgtatggcaattgactgcctgttacacatctgatgctgctgccaccccacctccagcttgcgatccctaggaaggtagaggaaagcctatcctcttcatctcacctctcagaacccacccctcaaacccccctgctggttcccatcaattttcatgtcactccccatctcggcctcggtgactcac

SEQ ID NO: 3799 - DNA, 601 bp, Human
gattttcctgcctcagcctcctgagtagctgggattacaggcacacatcaccatgtctggctaattttttgtatttttagcagagatggggttttacaatgttggccaggctggtcttgaactcctgacctcaggtgatccgcctaccttggcctcccaaagtgctggaattacaggccactgtacccagccatgtggctttttcttcttcaaattcaccagaccctgtcttgactgagcctttgcatatgcctttccctctccctggaacacttgtccttgtccttcctagcttgctaamacagtgcattctttaggcttcagatgagctgtgatctctactaggaagccttctggtctttccaacactgcctctaaatttccaccatgccctgtgcttcccctatcctggcaccatcattctgtatggcaattgactgcctgttacacatctgatgctgctgccaccccacctccagcttgcgatccctaggaaggtagaggaaagcctatcctcttcatctcacctctcagaacccacccctcaaacccccctgctggttcccatcaattttcatgtcactccccatctcggcctcgg

SEQ ID NO: 3800 - DNA, 601 bp, Human
attttgaagagctaatctgaaaaaaatacaaaatatcttaataatgctttttttttttttgagacggaatctcgctctgttgcccaggctggagtgcagtggcacggttttggctcactgcaacctcttcctccagggctcaagtgattttcctgcctcagcctcctgagtagctgggattacaggcacacatcaccatgtctggctaattttttgtatttttagcagagatggggttttacaatgttggccaggctggtcttgaactcctgacctcaggtgatccgcctaccttggcctyccaaagtgctggaattacaggccactgtacccagccatgtggctttttcttcttcaaattcaccagaccctgtcttgactgagcctttgcatatgcctttccctctccctggaacacttgtccttgtccttcctagcttgctaacacagtgcattctttaggcttcagatgagctgtgatctctactaggaagccttctggtctttccaacactgcctctaaatttccaccatgccctgtgcttcccctatcctggcaccatcattctgtatggcaattgactgcctgttacacatctga

SEQ ID NO: 3801 - DNA, 601 bp, Human
catgtcaccatctctgaggaggtcccaccagccacctagagatccctggcagaatcccaagagtcacctgaacatccactctgtccacctctccatccagtaggcctccatgcccactccatctgacctcccaaattctgattgcttcatccaccaatccagggttttaacacactcatccccacccagaagacacaactctgcctccactcttgtgagtcgctggatctacagagctcactgtccctgataccagatttctgccctgtccaatatggcagccacatgtctaatagccacrtggcttttgagcacttgaaatgtggctgatttgaaggagggatttttttttactttatttaattttttttccttttttggggggtaagggttgggatcttgctctttcgcgcaagttggggtgcactggcacaatcctggctcattccagcctccatctcctgagctcaagtcatcctcccatctcagcctcccaagtagctgggactataggtgcacaccaccatgcctggctgggactttttttttttttaacttcatttaatttttttttttttttttgagacggagtcttgctctg

SEQ ID NO: 3802 - DNA, 601 bp, Human
ctggttgaaagacagctcctctccattggtgccaaggaagcgggcggagtggctgtagtcacccgtggcttcgtccagccaggcagctgcattctggcaggagtaggtgaagttctggcgagctgtggcactcagcagtttcaggaagttcagctgcacgacattcactggggacccgtcggcgtccacgtaggagaactggtgagaggagggcaaggcagaggatgaggggctccatgagcctctttctgcagaagccaccccccggaatctccatccactggcagacaagccacccccyccatgtcaccatctctgaggaggtcccaccagccacctagagatccctggcagaatcccaagagtcacctgaacatccactctgtccacctctccatccagtaggcctccatgcccactccatctgacctcccaaattctgattgcttcatccaccaatccagggttttaacacactcatccccacccagaagacacaactctgcctccactcttgtgagtcgctggatctacagagctcactgtccctgataccagatttctgccctgtccaatatggcagccacatgtctaatagcca

SEQ ID NO: 3803 - DNA, 601 bp, Human
ccatcctgggggacgctgacagtggctgctgtcgtctggttgaaagacagctcctctccattggtgccaaggaagcgggcggagtggctgtagtcacccgtggcttcgtccagccaggcagctgcattctggcaggagtaggtgaagttctggcgagctgtggcactcagcagtttcaggaagttcagctgcacgacattcactggggacccgtcggcgtccacgtaggagaactggtgagaggagggcaaggcagaggatgaggggctccatgagcctctttctgcagaagccacccccyggaatctccatccactggcagacaagccaccccccccatgtcaccatctctgaggaggtcccaccagccacctagagatccctggcagaatcccaagagtcacctgaacatccactctgtccacctctccatccagtaggcctccatgcccactccatctgacctcccaaattctgattgcttcatccaccaatccagggttttaacacactcatccccacccagaagacacaactctgcctccactcttgtgagtcgctggatctacagagctcactgtccctgataccagatttctgc

SEQ ID NO: 3804 - DNA, 601 bp, Human
ttctggggctccctcatggtccctcccaccccggacactctcagctgctgaagcagacggggcccagttcaaacccaaacttttggttcgtctggccaaagtcagtggccgccacatcccacaggggcagaaatcccgctcgagaagagctgaattcgaaaagggtcttcgtctgtcctttccggagctgtccccagagaagacagagacggtgagttaccgggaaggtggccgacatcttgcctcccctctctagctggccactgccccaccctcttacccggcagccatcctgggggaygctgacagtggctgctgtcgtctggttgaaagacagctcctctccattggtgccaaggaagcgggcggagtggctgtagtcacccgtggcttcgtccagccaggcagctgcattctggcaggagtaggtgaagttctggcgagctgtggcactcagcagtttcaggaagttcagctgcacgacattcactggggacccgtcggcgtccacgtaggagaactggtgagaggagggcaaggcagaggatgaggggctccatgagcctctttctgcagaagccaccccccggaatctccatcc

SEQ ID NO: 3805 - DNA, 601 bp, Human
ttgttcatcagctctgagttagaagctcattgcatgggggttcaaggggtggggaggtgaggcttgggtggggagggaggggagaaagagccagactgcagtatgccacctggaatggggtgagaggaggctggacccttgggccagggaaccccagcccccagcaccctggaaaggagaaggaatgactgtccgtgatgagcgaagtcacatcccattggctccatagtcacaggtaacgaaaaatacggtggcttcaaagcctcagcaccaaatgcaccccattctggggctccctcayggtccctcccaccccggacactctcagctgctgaagcagacggggcccagttcaaacccaaacttttggttcgtctggccaaagtcagtggccgccacatcccacaggggcagaaatcccgctcgagaagagctgaattcgaaaagggtcttcgtctgtcctttccggagctgtccccagagaagacagagacggtgagttaccgggaaggtggccgacatcttgcctcccctctctagctggccactgccccaccctcttacccggcagccatcctgggggacgctgacagtggctgct

SEQ ID NO: 3806 - DNA, 601 bp, Human
caaaaaaatttaaaaaagaaatacacagagacagaaacacagttcatcagtttattctcagatttgagatgcaaattatgccctatggcctggcggtggggggccaggcttgggctggaatctctcatcatatcccagccttccctaaggaggaagcagatgaaatctacaacaggggggactttcccttttaatacagacccaggtataaatagggcagcaccattaggatcctgattcacccccccaacatcttggtccccaaaccacctggcatggcaaggtgagcctggggaggtgrggggcagggggaggggatttgcagagctgggctgaggcaggaaaagaaacacaacccagtcaagggaagtccctcttccctctgtagtccgacctcagtcctttcaccgtggaagtagaaaggatcaaagggggtgggggtaggggtcccagcctgggatcaggagacatccagtgcttaactctggggaggggtagcaccaaaaggtgtgaagggcagcgacggaggagtgaggaggcaggcattgggggtgggggggcttttgttcatcagctctgagttagaagctcattgcatggg

SEQ ID NO: 3807 - DNA, 601 bp, Human
gactctaagtgcttggttcttcttttatttttcttcctctttccgcaaccctttgagttcccacttttattgcatttgcttgcatttgtttcaaggctgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatytgaaacagattttctgaagaaagcagaagctctcttcccattatgacttcggaaatcacttatgctgaagtgaggttcaaaaatgaattcaagtcctcaggcatcaacacagcctcttctgcaggtaaagatcattttctaggggtcagagtgaatgacgaggtgaaggatgaggagagggtttatgaataaggcataggtgttttcagttgctggttgtctgattgagtatgtctgggaaacacaagagtcccagaagattgagtggcctgcagatacgcattacggggtgtacatttg

SEQ ID NO: 3808 - DNA, 601 bp, Human
aggggtcaggactatagttacgctttctaaaatacctctgtgaaggtgtggagagcacttagggaaattttttctccttaaaaactttatataatttctttattacacaagtattaatgttcattgtagaaaaaattaaccagaggtacacagatatttgaattataattactcttatcatctagagaaaatcataatttgcaatttagtgaatatccttccacatacaaatacatataatgtgcatatgtattttactaaaaatgtaatcatattatataatactgaatttttttccccyatcatttgacaaaatatcataactcgaagaaagtgattcctaaccatgagatggtaactaaaaagactgactttattctaaacatgtgatgaggaatgattataaagatttatttgctatagcattatttaaagttggaaaccattatttaaatatatgatgaaatactatgcaaccataataaggagtgttaaagaagaaaatataatggtatgaaaaatgttcatgatatagtgtaaaggaaaataataggtcagaaatcagtatttatggtatgtcaatcgtgggaaaatttgcata

SEQ ID NO: 3809 - DNA, 601 bp, Human
aaagatttatttgctatagcattatttaaagttggaaaccattatttaaatatatgatgaaatactatgcaaccataataaggagtgttaaagaagaaaatataatggtatgaaaaatgttcatgatatagtgtaaaggaaaataataggtcagaaatcagtatttatggtatgtcaatcgtgggaaaatttgcatatgtgtatatatacattcaaaaaattgctagaaagatatataccaaaatattatggtatattataagttatatggcataacagttatcctcaattgtaggaattygtacttttatgtattttttaaagtttctacagtgaatattattatatcctttctattcctattctcatgtgatttcaaatgtcataccgttagtaactgtgtgtcatccaagaaaagagagagaaagaggaggaggaagaagaggaagtaaagaccaaacttattactgataaaactaatttggcttcttcttcagcttccaaggagaggactgcccctcacaaaagtaataccggattccccaagctgctttgtgcctcactgttgatatttttcctgctattggcaatctcattcttt

SEQ ID NO: 3810 - DNA, 601 bp, Human
tgctagaaagatatataccaaaatattatggtatattataagttatatggcataacagttatcctcaattgtaggaattcgtacttttatgtattttttaaagtttctacagtgaatattattatatcctttctattcctattctcatgtgatttcaaatgtcataccgttagtaactgtgtgtcatccaagaaaagagagagaaagaggaggaggaagaagaggaagtaaagaccaaacttattactgataaaactaatttggcttcttcttcagcttccaaggagaggactgcccctcwcaaaagtaataccggattccccaagctgctttgtgcctcactgttgatatttttcctgctattggcaatctcattctttattgcttttgtcagtaagtatgccaactgaaccaataagcaatatctgctgtccatgaacagagggtatcctttaaaaactgacttttgaaaatgagcttatccagaaatctgaaatgaaattttctctggggagacataattcatgggaatccactgtgaattttgctctttatttggatttagttactgtcctgtaaaaataatggaatcccttctcat

SEQ ID NO: 3811 - DNA, 601 bp, Human
ttgaatgataaaggaggtagaggcttgatgaatattcagttctgggaaataagggacccagagaagtaaagtatggctccaatattctgactttgtaaactcagaaatcattaagtttttcaaagaggtagacaatataggatcagtagcaggtttgggttggaagatggtgatttaagttttgggcatgttgagttttatatggctgtgagaacctcaaatggatgtgtctactgggagacacatttgtctggatttagggagagaggtctgagctttggaagtccttcacatagaggtrgcaggtgatgccatgggaatatatgatatcactcacggagataacttagtatgagaaagacggataaggatggaactctgggaaatgttacattttaaaaaaggtggatggaggaaacggagctcataaaagagtgtaagaagcagcagcaagaaaggtaagacaaaaacaacaaagagtagtgtcccaagagctaaggggaaaggcaactggggtcaagcctttaaggaagtcaaataggaagaggactaagtaaccctaggatattactgaggatccattttagggatggttttagtg

SEQ ID NO: 3812 - DNA, 601 bp, Human
cagaaatcattaagtttttcaaagaggtagacaatataggatcagtagcaggtttgggttggaagatggtgatttaagttttgggcatgttgagttttatatggctgtgagaacctcaaatggatgtgtctactgggagacacatttgtctggatttagggagagaggtctgagctttggaagtccttcacatagaggtagcaggtgatgccatgggaatatatgatatcactcacggagataacttagtatgagaaagacggataaggatggaactctgggaaatgttacattttaaaaraggtggatggaggaaacggagctcataaaagagtgtaagaagcagcagcaagaaaggtaagacaaaaacaacaaagagtagtgtcccaagagctaaggggaaaggcaactggggtcaagcctttaaggaagtcaaataggaagaggactaagtaaccctaggatattactgaggatccattttagggatggttttagtgaaatagtggaagtaaaacccagactatgatgggtcaaggagcaaatgaaaggtagggaggaaagacaaaaagttcaatttctttttttttttttttgagat

SEQ ID NO: 3813 - DNA, 601 bp, Human
ctgaggatccattttagggatggttttagtgaaatagtggaagtaaaacccagactatgatgggtcaaggagcaaatgaaaggtagggaggaaagacaaaaagttcaatttctttttttttttttttgagatggagtcttgctccgtcacccaggctggagtgcagtggcgcaatctcagctcaccgcaacctccgcctcccaggttcaagcaattctccttcctcagcttcccgagtagctgggattacaggcacctgccgctgcgcccagctgatttttgtactttgagtagagacgasgtttcaccatcttcgccaggctagtctcgaactcctgacctgcctcgacctcccaaagtgctgggattacaggcgtgagccactgtgcccggccaaaagttcagtttctagagggagaggtgggttagttttaaactgggagaaacatgagagcgttggtgtgctgaggagtaagagccagttgggatggagagagtaatggagagaagaggaagaaaataatgccctcttgatccatgtggggttctttttaaaattctccattcttcaaggtaacccagaactcctcagaattaattt

SEQ ID NO: 3814 - DNA, 601 bp, Human
tagggatggttttagtgaaatagtggaagtaaaacccagactatgatgggtcaaggagcaaatgaaaggtagggaggaaagacaaaaagttcaatttctttttttttttttttgagatggagtcttgctccgtcacccaggctggagtgcagtggcgcaatctcagctcaccgcaacctccgcctcccaggttcaagcaattctccttcctcagcttcccgagtagctgggattacaggcacctgccgctgcgcccagctgatttttgtactttgagtagagacgaggtttcaccatcttsgccaggctagtctcgaactcctgacctgcctcgacctcccaaagtgctgggattacaggcgtgagccactgtgcccggccaaaagttcagtttctagagggagaggtgggttagttttaaactgggagaaacatgagagcgttggtgtgctgaggagtaagagccagttgggatggagagagtaatggagagaagaggaagaaaataatgccctcttgatccatgtggggttctttttaaaattctccattcttcaaggtaacccagaactcctcagaattaatttgcccctctcccatc

SEQ ID NO: 3815 - DNA, 601 bp, Human
atgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacakggagagaacatgagtctctcttaatttttatctggttgctaaagaattatttaccaataaaattatatgatgtggtgtctccttctgtctggttttctcttcatccctactatactgatatataattgtatatatatactgacatatatatatattatattttatatatatattataatatatatatatacactgacaaataaaattgtatatatttaaggtttacactgtggtgatttgacatacatatatattgtaaaatgattaccgtaatcaagttacttaacccacacccattat

SEQ ID NO: 3816 - DNA, 601 bp, Human
caccccaacctggagacggaagaagatcctgactctaaacaaacataaaaaccttccaggtcaggctgggtgcggtagctcatgcctataatcccagcactttgggaggccgaggcaggcagatcacacgaggccgggagtttaagatcagcctgaccgacatggagaaactctgtctctattaaaaatacaaaattagccaggcatggtggcacatacctgtaatcccagctactcgagagactgaaggcaagagaattgcttgaacccgggaggcggaggttgcagtgagctgaaatcrcaccactgcactccagcgtgggcaacaagagcaaaaccccatttcaaaaaaaaaaatcttcccggtcatcaaaaacaaggaaagtctgagaaactgtcacagccaagaggagctaaggggccaggacaactaaatgtcatgtgggatgctgggagagaaaaaggacatgaggtaaaaactaaggaaacctgaatagacttgtgttaagaataatatatccataccggttgattaactgtaaccaatgtaatatactaacatttctttttttttttttttgagacgagtttcactcttgtt

SEQ ID NO: 3817 - DNA, 601 bp, Human
cccttgctcttggacctcccagcctctagaactgtaagcaatagggttctgttgtttataaattgcccagtctaaggtattcggctatagcagcctgaatcacaatacagaccaacgcgctggtgaacacacaaggccttactgaccatgggctcctccttcctcaaagcccagtcagactcccatctgcagatcctcgctcaacatgcccataatgtagccacagccccagcttgctctgctatgatgtgcagaccaccttaaataaaagagctcactccaagcctccacatctatgaaytgggacaaaggccctcagaaacagttttctgaacttccttctaggaagttcctttctaaagacttcctctccaggacagcctgcaggagccatgggagcccactagcaccaggcgccagtgctgtctccattggcaaagcaagggtggtcagtgccactcagcaaataatccacagcaagcagcaggccagggagactggccagctgtcagccttcccattgtaggcagcacaggcagaatgggtgccaaaaccacatcaccaccagttactgcagtgcacacatgtgtgcatgtttcac

SEQ ID NO: 3818 - DNA, 601 bp, Human
cagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctggtggctctctcaatccagcagaatgatctgactgaggacaccaggaagcaggtgttgggaacgcagctctgcacgcggcacctactcccaccctaccaccatgggaacagcgggcacagacgcctctcctgcgggaaggcagagcccttgcgwtggagcctctatctggcctatcctgttgcagctgctctgctctgagtgccagtgtcacccaaatccatatattaagacctaagtcccaaggggatggcactgggaggggggccttggggaggtgatcaagtcacgacggctccactctcatgaatgggagtagggcccttagaaaacaggcttgagggagcttgcctgccccttccaccttctgtatgaagatgcaagaggcactgcctgagtcaaagggccctcgccagatgcccaatctgctggccccttgctcttggacctcccagc

SEQ ID NO: 3819 - DNA, 601 bp, Human
agcagcttggcctcaccagagaaaacaggaagggacagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctggtggctctctcaatccagcagaatgatctgactgaggacaccaggaagcaggtgttgggaacgcagctctgcacgcggcacctactcccaccctaccaccatgggaacagcgggcacrgacgcctctcctgcgggaaggcagagcccttgcgttggagcctctatctggcctatcctgttgcagctgctctgctctgagtgccagtgtcacccaaatccatatattaagacctaagtcccaaggggatggcactgggaggggggccttggggaggtgatcaagtcacgacggctccactctcatgaatgggagtagggcccttagaaaacaggcttgagggagcttgcctgccccttccaccttctgtatgaagatgcaagaggcactgcctgagtcaaagggccctcgccagatgcc

SEQ ID NO: 3820 - DNA, 601 bp, Human
gcactccagcctgggtgacagagtgagactccatctcaaaaaaaaaaaaagaaaaaacgaaaagactaattctagtcatagcagcttggcctcaccagagaaaacaggaagggacagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctggtggctctctcaatccagcagaatgatctgactgaggasaccaggaagcaggtgttgggaacgcagctctgcacgcggcacctactcccaccctaccaccatgggaacagcgggcacagacgcctctcctgcgggaaggcagagcccttgcgttggagcctctatctggcctatcctgttgcagctgctctgctctgagtgccagtgtcacccaaatccatatattaagacctaagtcccaaggggatggcactgggaggggggccttggggaggtgatcaagtcacgacggctccactctcatgaatgggagtagggcccttagaaaacaggcttgag

SEQ ID NO: 3821 - DNA, 601 bp, Human
aggaggcagagactgcagtgaactgagattgcgccactgcactccagcctgggtgacagagtgagactccatctcaaaaaaaaaaaaagaaaaaacgaaaagactaattctagtcatagcagcttggcctcaccagagaaaacaggaagggacagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctgrtggctctctcaatccagcagaatgatctgactgaggacaccaggaagcaggtgttgggaacgcagctctgcacgcggcacctactcccaccctaccaccatgggaacagcgggcacagacgcctctcctgcgggaaggcagagcccttgcgttggagcctctatctggcctatcctgttgcagctgctctgctctgagtgccagtgtcacccaaatccatatattaagacctaagtcccaaggggatggcactgggaggggggccttggggaggtgatcaagtcacgacggctccactct

SEQ ID NO: 3822 - DNA, 601 bp, Human
ggcctgtgcagctgaggagcacaatgtccccttttatttaatttgaatgcatttacatttaaactgccacatgcagctggtggccgctacacaggacagcagaccaacctcgagagaaatacaacaaaagacgtaacgtgggggtcaagtcacagttagggtgggttttttgtttgttgttgttgttgttgttgtttttgagatggagtgtcgctctgtcgcgcaggctggagtgcggtggcgtgatctcagctcactgcaacctctgcctcccgggttcaagtgattctcccgcctcagyctcccgagtagctgggatgacaggtaccaccaccacgcccagctaatttttgtatttttagtagagacggggtttcaccgtgttagccaggatggtctccatctcctgacctcgtgatccacccgcctcggcctcccaaagtactggggttacaggcgtgagccaccgcacccgacctagtgttttcatcttacagatgaggagactgaagtaagtgctttgcccagagctggaaaagggcgaccgctggaggttcccaggctgttggtctgagtccaaatgtgttgctctgcctcacag

SEQ ID NO: 3823 - DNA, 601 bp, Human
gtagaaacccactccaaactggccgatgatcttgctgctggcctcagcctggttctgcagagcatccaggaaggcctgtggggcagaggccagttagtgaggcagcctcccctccagagagcagacactcccaacaccgtggctcttctgcgagcaccgctaagaccccttcatcctgaaaacagccacaccgagtacttttccaccccattctacacgtgaagagctaagtcacagagaggtgacacattagccctaggacaaccagctggcagcagtgggacaagtgtgttttccattwgattcccaaagctcacagtcctgcctgtcccagacaggtggaggcctgtgggtcacacctgggggtggggaaagagcagcttgaataagctctttcccttgaataagctccttccataggaaggccaggagtgaggagaggctccaaactggcttccatattcaagtctcctggactctacactttgtgggaaaaagagtagaaatcacgcgcatgcgtctgtaagcaccgcacagcacttcatttttctactataatactgccaaaggtcctaaggccaaagtcaagtaaaatacacac

SEQ ID NO: 3824 - DNA, 601 bp, Human
aggcaaggaaaggaaaagccaggtggatgtgacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggtctggggcackgtgggggactggcccagctccaaatcgggtgccagatgcccaggggcaaaaacaaaggccagggggacaggcgccccctaagaagagcagaaaaccatctccgaagcacaggaggggggaatcccccggcagggccatgttgatgccttggcctaagtttactctgagccccgctcccatggaattaaacaggaatgttagttttgggagagtggggagtcaagctgagcacagtgcacacactgtggagcagaaatggcatcacggagggaggacgcctcggctggctggaagcggctc

SEQ ID NO: 3825 - DNA, 601 bp, Human
gaactaaggcaggcaaggaaaggaaaagccaggtggatgtgacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggyctggggcacggtgggggactggcccagctccaaatcgggtgccagatgcccaggggcaaaaacaaaggccagggggacaggcgccccctaagaagagcagaaaaccatctccgaagcacaggaggggggaatcccccggcagggccatgttgatgccttggcctaagtttactctgagccccgctcccatggaattaaacaggaatgttagttttgggagagtggggagtcaagctgagcacagtgcacacactgtggagcagaaatggcatcacggagggaggacgcctcggctggctg

SEQ ID NO: 3826 - DNA, 601 bp, Human
agcccccctcccagtcccgcagcggctcggcccttcacggctctgcctgtgcaccctacgtgcaggtagaaccagggaaaatgcctgctgacctggtggcctccaggccacacatggatcccagagtgagcctgggcccgggctcccgctcacctcgcacccgggcctcgctggaaaactccttgcagtcggatttcaggtggatgatgatttttgtcccggttctaactcccgaagcttcggcgatttcaaacactccagaactaaggcaggcaaggaaaggaaaagccaggtggatgtkacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggtctggggcacggtgggggactggcccagctccaaatcgggt

SEQ ID NO: 3827 - DNA, 601 bp, Human
cgatgctacgcagccctggcgggcagcccccctcccagtcccgcagcggctcggcccttcacggctctgcctgtgcaccctacgtgcaggtagaaccagggaaaatgcctgctgacctggtggcctccaggccacacatggatcccagagtgagcctgggcccgggctcccgctcacctcgcacccgggcctcgctggaaaactccttgcagtcggatttcaggtggatgatgatttttgtcccggttctaactcccgaagcttcggcgatttcaaacactccagaactaaggcaggcaargaaaggaaaagccaggtggatgtgacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggtctggggcacggtgggg

SEQ ID NO: 3828 - DNA, 601 bp, Human
gaggccccggctgctgcgagactgcaatgtcagcttgtggctggaacatggctttctgggctgactcctgggggtactcagggcctccctgagtgtccagcaggacacaaagagggaaggccacgcccacatcctgggacaggactgcgccaaacccccaggtgcactaaaggccaagggccacgcagaggaaggaggaggaggtccgcctcagccaggccagcttcctcccagtcccagcaggagctcgatgctacgcagccctggcgggcagcccccctcccagtcccgcagcggctcrgcccttcacggctctgcctgtgcaccctacgtgcaggtagaaccagggaaaatgcctgctgacctggtggcctccaggccacacatggatcccagagtgagcctgggcccgggctcccgctcacctcgcacccgggcctcgctggaaaactccttgcagtcggatttcaggtggatgatgatttttgtcccggttctaactcccgaagcttcggcgatttcaaacactccagaactaaggcaggcaaggaaaggaaaagccaggtggatgtgacactgggacataccctgcatgggactc

SEQ ID NO: 3829 - DNA, 601 bp, Human
gtacttcgttaccacatctggaagggacaaaagaaaaaccacactgcatctacaatgcttgtggaaacgcaagctttgcagcagctccaggatgagcgccagcctgctgggaagggtcctccatgctgtgtacacttcacaggtacagaaacagggcacagtggggacacctgtcctccccccagtctcacgggggcagcagcggagcccacgtgagaaccagagctgtggaggccccggctgctgcgagactgcaatgtcagcttgtggctggaacatggctttctgggctgactcctgrgggtactcagggcctccctgagtgtccagcaggacacaaagagggaaggccacgcccacatcctgggacaggactgcgccaaacccccaggtgcactaaaggccaagggccacgcagaggaaggaggaggaggtccgcctcagccaggccagcttcctcccagtcccagcaggagctcgatgctacgcagccctggcgggcagcccccctcccagtcccgcagcggctcggcccttcacggctctgcctgtgcaccctacgtgcaggtagaaccagggaaaatgcctgctgacctggtgg

SEQ ID NO: 3830 - DNA, 601 bp, Human
tgcaggcctgagccagtgcagcgcctggccctggacaggctcctgggacagacgggcggtggtctcaggcgtagacccctctccagccccaccgctgggctatgccgggtagtgcaggggagacacacaaggctctggggcaggagctcctcaggacaacatgtcaggaggaccagccgggacctgagggggcctgtgggagaggatgacgctgcccagcaggggcgagctgacgaatacagtgtgggccgtgagagcgatgacgacccacgctgcaccgcagctgagccgcgagggggawgtcagtcactgaggacagcatgccgtgtgactccatccaggagaaacgtctggaacaggcagcacaatggacagaaaggagaccgtggctgctgggactgggggaggggcagtggggaaagggctgctttttggggtgatgggatgttctggaattgatgcggggtggctgcacagctctgtggctgcactgaacaccatggctgcacactgatgtggtgagccagctgggatgggcgttacgcctcagtgaaccctgacccctgaccccggctgcccggtgcacaggggcagggctgtg

SEQ ID NO: 3831 - DNA, 601 bp, Human
accctcctcagcctcccaaagtgctgggataacaggcgtgagccaccacacccagcactacctatgtttttcatgccctcacactgccatgttaatcatgtgacatctgcagagctgatgccacaggggacaacagagtcaccctgagggccgtgggactgccacagtgcctcaccatgtcgggcacgtagaagatgctgcggatgttgagcggtgcgtccgtcttatagtgcagggtgtagcggggcttgtcgtgagcctgcgcgacgtagcggtagaactcctcatgttgccactcacsgacatccttggggtccatcatccagatggcctggaaacggagatcggcggggagggcgtcgtgttcaccacgcacgtcttctccaccaccgtgcaggcctgagccagtgcagcgcctggccctggacaggctcctgggacagacgggcggtggtctcaggcgtagacccctctccagccccaccgctgggctatgccgggtagtgcaggggagacacacaaggctctggggcaggagctcctcaggacaacatgtcaggaggaccagccgggacctgagggggcctgtgggagaggatga

SEQ ID NO: 3832 - DNA, 601 bp, Human
ccagcccagggacattgtacctggaacctcccctcctgtggccactcctgggcagggtgatggggatggacaaggtggggacaactccagcaccagcaataataatccgggagtcagccccaagccctctcttcactgaagtgaactgaaacattgggcagatcaccagtaacccacaggcgcactcgaagtgcacagggtcagtacaccaaagagcacgactctaacgaccacagaacagtcgctgctgtggggcggggatgcatcctgttgaggtcagcacaactgctgccctgtggtyatgtcggcagcaagtcggggtcctgctgtcagaagccagcacggctgtgtggggaaacaagcactgaggcccccttttcattgattatataacatctctttagtcagcaaggaaaataccttttatatagttatatcttccgaccaagtaaccccacccctagtattctatcctaaggaaatacagctgcaggtaaagatttcagaacaggccaggcgcggtggctcacacctgtaatcccagaactttgggaggccgaggcaggcagatcacaaggtcaggagatcaagaccatcccgg

SEQ ID NO: 3833 - DNA, 601 bp, Human
tagcttcaaaatacctataacatctgttaattacaaagggaaggacatccttgtttgttggaaatgcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgggcactaccagtgggccagcatgccygccacagccaggaatgcagctcccttactgagcaggaccacccctctgtgactcagtttccacaactatgagtgaggactcacggctcccctcacaggatgaaacacgtgtttatgcaggctcagcacagttctcagtggagaagaaatactcaggaaacacattcaggatggggagaggaacgcagccgcctcggcccgcagggacgccaggagctccctctccacagggcctggcccctgcctccacttcatccgtgagcttcccagatgaggccagacgtgtcctcagttcagtggg

SEQ ID NO: 3834 - DNA, 601 bp, Human
tttcatgaagaatgtgacatttacatagcttcaaaatacctataacatctgttaattacaaagggaaggacatccttgtttgttggaaatgcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgrgcactaccagtgggccagcatgcctgccacagccaggaatgcagctcccttactgagcaggaccacccctctgtgactcagtttccacaactatgagtgaggactcacggctcccctcacaggatgaaacacgtgtttatgcaggctcagcacagttctcagtggagaagaaatactcaggaaacacattcaggatggggagaggaacgcagccgcctcggcccgcagggacgccaggagctccctctccacagggcctggcccctgcctccacttcatccgtgagcttcccagatgagg

SEQ ID NO: 3835 - DNA, 601 bp, Human
ggattacaggagtgagccattgcgcccagcctaatttttctattttttaagtagagacggggttttaccatgttggctaggctggtctcgaactcctgacctcaggtgatctgcctgcctcggcctcccaaagtgctgggattacaggcgtgagccaccgcgcccggccaacacataaatattttaagtaaataaatgaatgtattgagagtttcatgaagaatgtgacatttacatagcttcaaaatacctataacatctgttaattacaaagggaaggacatccttgtttgttggaaaygcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgggcactaccagtgggccagcatgcctgccacagccaggaatgcagctcccttactgagcaggaccacccctctgtgactcagtttccaca

SEQ ID NO: 3836 - DNA, 601 bp, Human
gtaactcctgacctcgtgatccacccgcctcggcctcccaaagtgctgggattacaggagtgagccattgcgcccagcctaatttttctattttttaagtagagacggggttttaccatgttggctaggctggtctcgaactcctgacctcaggtgatctgcctgcctcggcctcccaaagtgctgggattacaggcgtgagccaccgcgcccggccaacacataaatattttaagtaaataaatgaatgtattgagagtttcatgaagaatgtgacatttacatagcttcaaaatacctrtaacatctgttaattacaaagggaaggacatccttgtttgttggaaatgcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgggcactaccagtgggccagcatgcctgccacagccaggaatg

SEQ ID NO: 3837 - DNA, 601 bp, Human
tctggtcaatgaagaatttgatcagcctctgctgtaaaacgtcccggagtttcctacagaaaagaaatgcatttaatacatacaagcagcctctatgaaatacaaatggccagagggtacgaaaaaatgttcagccccgctaagaatcaaagaagtgaaaacaacaaggtaccgttattggccaaactgaaaaagactgagcagaaagacagaaaccctgggcagtggccggacaggaggcagcagggtggagggcagacaccccctggaggcagtaggagaaccgatgcccccagagacaagatacccacgcccggaaaacccttccaacctttgagccagttgttccaattataggaactgcaccttaggaaacatgtgagcacaccaagatttatgtaccaggattttcactgtggcacataaaatataacaattatgaacaacctcatgttcaagaatataggctaaaattatgtaatgctaaatggccataaaaaaaaaaaactgcatcttttaataatcctcaatgacatgagaaagttagctgtgttgaaagaaaacccagaaaaatcccaatgtgggtaaattacagtacgtc

SEQ ID NO: 3838 - DNA, 601 bp, Human
gggatgaaatgttctggggttacagtggaggcagccacaccacactgtgaatgcactaaatgccactgaattttacgtgttaaaaggtgaattctgtgaatctgatgctatgtaagttgtatctcaataaaaaatggacaaaaaatgtttatggaacaaatgtttcgtttttcagccatccactattggattaactgaacgactggcccctgtagcatagtatttggagactgatatccagtacatgatgaatagtccctcaacagacactgagaccacccacttccccacccacgggatyggagtccttggcttgtcccacctgtctgtggctccccagcccccaacatcctctgaggggagacagtgtgtgcacgccctcttcctgccactccctgggctgcaccttcacacagcagtgaggctgagcccttcagagcacagcacagcactggtgggagggtaaggatgtgcctggaaggtgccagaggcccagaagcctggccttccatttcctgaccctggtggcagcagcagcagcagccagggtacccagctgcaccgtcgccacatcaggggacacctccaccagcttcctcag

SEQ ID NO: 3839 - DNA, 601 bp, Human
tgtgagctcctgagggctggggtagcatgtcccttgtttggaacccccacgtcctcagccattgcagctcccactcaggatgctggtttttcagttctcagttcacacctgctctggagcagggctgggagaaagacacggccttcctgcctcagcggcactcccgagcaacacgtgccgagcagggacccacagggtctccacctgacaccaagggcttctgctgctgctggaaggacacccaacgggccaggtactgggagccaccagctggccagcctgttagggacactgcggccargtggtggtccatccccgggaaagcctcaccttcacgttggtgacacgcgaccccagcacatttctcatccaggccatgagctcctccgtctccttctctgataggcactcggcggctgcggaagagcaggcgacagggagctcaggcctgcatcccaactccccggcttccatgggggccacgcagcatgcttccagctcccacctcctctcccaccaggatggagacacaagctagcaagatgcttttcatctaaaagtaaaacctcaaaggatgcttcaggttgcctgaggcccatac

SEQ ID NO: 3840 - DNA, 601 bp, Human
cttacggctcagccactgtcagggctggggggttctcggtgcaccctggaagcagctcccaccaccggggccacagagaaacccacacaagccccagacacgtggacaagaatactcagagcagcctggctctccacaacttctgaccaagaaccaccggaggcccagcagagcagaacggagcagtctgctgtgccgaggtgggtttctgcagcggacattattcggctatgaaaatgaacttgtggcagcccctctgcatgggcaaccctcatgccaagtgagcaacgtgagacttcarcaaacaccaagatccacgtacaaagctcaaaacaggcaaaactgagcatgtccaggacacgcacaggtggcaaagccataaagcaaaacgaggacatggtcacaggctgggatgtggctaacctcccaggtgacacctggggatggtaaggggctggccaggttccatttcacatgggtgcagcctaaactgcatacagctccttatagttacccacatgtccacaggcctcacgcacttttcttctgtgtcacattccacaacaaaagaacaccacacacaggattctggggaatccca

SEQ ID NO: 3841 - DNA, 601 bp, Human
tatggttgtaaaatgacaaaagaaaaaaactagacatgtactaaagaacaaaacaaaaactggctgggggtggtagcccacacttgtaatcccagcacttcgggaggctaaggcaggtggattgtttgaggccaggaggtagaagttgcagtgagctgagattgccccactgcactccaacctgggggacagagtgagaccctgtctcaaaaattaaaatactacttaggctacattgtggggggggtggtaagtctatggattttgatttcctttttgctgttttctatttttggtaacwtgtttatgtaacttcattttttaaaaaattgctacattcaaaatttcccccaaaaaagaaacttcatatacaagttagttcatatacaagttagaaaatgaaattttaaaataccccataagacacatcaaagaataattctttaaaaatggtaccagaaccctacagagaatgtaaggtaccaaaggatgttaaagacctaaatagatcacattcatgggtgcaaagaagtgatactgtaaaaagaaagaaactcaaaagatacctaaaggcaggtgaaaagacatttacaacagataa

SEQ ID NO: 3842 - DNA, 601 bp, Human
ccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggaggctaaggcaggtggattgtttgaggccaggaggtagaagttgcagtgagctgagattgccccactgcactccaacctgggggacagagtgagaccctgtctcaaaaattaaaatactacttaggctacattgtggggggggtggtaagtctatggattttgatttcctttttgctgttttctatttttggtaacatgtttatgtaacttcattttttaaaaaattgctacattcaaaatttcccccaaaaaagaaacttcatatacaagttagttcatatacaagttagaaaatgaaattttaaaataccccataagacacatcaaagaataattctttaaaaatggtaccagaaccctacagagaatgtaaggtaccaaaggatgttaaagacctaaatagatcacattcatgggtgcaaagaagtgatactg

SEQ ID NO: 3843 - DNA, 601 bp, Human
agccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgggaggccaaggctgcagtgagctctgatggcgccactggtacactccagcctaggtgacagagcaagaccctgtctccaaaagtgaagtggcaacagacagaaacgagcacttctgcagctatctcacaaaactagtttgscaccaaaactagttaaagtgacctggtgtccgcctcactgagctgctccagcagaggcacaggcattctgcatactggcgctgctgtgcactgacagccataagccaagtcagcctttccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggaggctaaggcaggtgga

SEQ ID NO: 3844 - DNA, 601 bp, Human
tgcagaaatacaaaagccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgggaggccaaggctgcagtgagctctgatggcgccactggtacactccagcctaggtgacagagcaagaccctgtctccaaaagtgaagtggcaacagacagaaacgagcacttctgcagctatctcmcaaaactagtttggcaccaaaactagttaaagtgacctggtgtccgcctcactgagctgctccagcagaggcacaggcattctgcatactggcgctgctgtgcactgacagccataagccaagtcagcctttccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggagg

SEQ ID NO: 3845 - DNA, 601 bp, Human
cccaagctagagtgaaatggcatgatcttggctcaccgcagcctcctggtttcaagaggttctcttgcctcagcctcccaagtaactgggattacaggcacccaccaccacccccagctagtttttgtatttttagtagagatgaggtctcgaactcctgacctcaagtgatccacccgcctaggcctcccaaaatgttgggattacaggcgtgaggcaccgcacccaacctaacagaggaaacacttcaaatgcacatcctcacatttctagtctacgtagctggaaaaaaaggacattyttaatatgctaatgtggaggtcacctagttaccctaagggagaaaagcaaggcaaggacccactgcacagcaagttcccccttggaagcccacgggcgcagctgcccacaaatgcacataatctctgcagaaatacaaaagccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgg

SEQ ID NO: 3846 - DNA, 601 bp, Human
caggaagagaggacccatcctgccacaggacccagaaaaaaagcccaacacacactcgggttaagaaatacctttaaatttaggtaaataaagctcaaggaggtggggctgtcatctgtggtgtcagtccttctggccccctggctgtcagtgtcgctccagggccttgacaagcagctcattcaagcggcccaccatggccctagggtcgtcaacaagtccagcagcaatcatggcgttctcgtatatctgaaaggcaagaggagaaacccattatgaggggcatggggcaccttttcatttttttttttttgagacagagtctcactgttgccgaggctggagtgcagaggcacgatctcggctcactgcaacctcaggtgatccccccgcctcccaaagtgctgggattacaggcgtgagccaccacgcctggccatttttccgtttttaaaacagaatttggctgggcacggtggctcacgaggtcaggagattgagaccatcctggccaagatggtgaaaaccccatctctactaaaatacaaaattagccaggcgcatgcctgtagtcccagctactcgggaggctgaggcaggg

SEQ ID NO: 3847 - DNA, 601 bp, Human
cagatggacatgaacaaagccaggatcaacccgaagatgcccagcagtacagccaggcagatcaccgtcagcatcgacatgctcaaagccccaggcttgcgggctgagtccctcaggtggtccacactggtgacaaacatgaccctcaacagggctcgggtctgtaagggggggcttccctggtcctctactactatctccagctcccactcactcccaatgaggctgctggcattggtgacattgacgaacagctgccccgtatgagggttgaggatgaagaggtgggcttcatttccaytgcggatgctgtagaggggctctccatttgcccccgagtctgcatctcttgccacaatggttgtcaaaaggaatggccgggagctgtgagtggccagtggaggtgtgtcagtgcccgctgggcccaagccattgggagtctcgatgggcaccagcaggtggcctgtggaggcattcacaagcacggagaggctggcttttccatcgctgagcacaggctggaccacctctggggcattatcattggcatccaagaggctgacccacacagagacactggatgcaagcatgggttgcccgc

SEQ ID NO: 3848 - DNA, 601 bp, Human
caggatctgacggggccctgattctttctcaggggacactttgccattgagatgtcgctgccgtctcagggttgcagaggaggctggtggcctctgtggggcttcctcactgccctggtctccagccagcctccctgtggggctgcctgcaaccttcagaggcctggaacgtggctggcctgtggcaggctggggctcgggaaggttcaggttctcccgggaggcattcctctgcctgggatggttgaaaaggaggttgaccgtgtcttgcagcacctctcggctctccgccggtgctccytggttgccttgattacgcagcgtcctgtacagggtcggggtgaggtggaagggggcctgcaggcaggggtcccagcctgcttccatcatcgcctccttgtccacatctttgtgggactgcccgacttcacaaggctcacctgcctgacccctgagcacaggcacgaggtggatgtctgccttctgaatgtgtttctggggcctcttgggctgctggcggtaggtggactcggcctcccgacagttgtaggccctgttgtccttcttttctgtccggcagatggacatgaacaaagccagg

SEQ ID NO: 3849 - DNA, 601 bp, Human
tctgaactccaatctgcctaactgctaagttctaaggtaatttccactgccccatccgcaggcccagccggaaagctctggggtctcagacaaattatttgcaacacctgggtttgggtgcaatgatgcctatgctggccttcttcatagggaagttgcccagatgagatgaaggcaggcaaatagtggagatggagaagtgctttgaggaagtaatagtaataatttgctgagtactgactacatgtcagatggacactgttctacaggcattaagagcattcactcattttattttcargcaaacttagaagatgggtggtgttaacatagacatcttcaacagagatgttaacttcctctgtggttcagagctaggaagaagtggagccaggatttgaacccaggtaaccttgcccaaagcttatactcttaatcactacctttgctgtgtgtctacttgtgaggcaccataaatgccttataggaattaattgatcaaatcctctggacaactctacaaggtagatacccttactatcatctctaatttacagataagacaactaaggcccagagacagtaaggaatttgcctagga

SEQ ID NO: 3850 - DNA, 601 bp, Human
aatggtttgaaaaagttaaaaatcctctgcaaaagcaaggagtttgcactgttattcctagaaacactgcttcctcctcctgggtccatccccattcctcccttaggaggtccaccatgcccctctgtgcagcttgaggtaggaagtgtcaacctcagaggagagttggaagaggagatggccaggactggggtttcactgtgacttgggagactcggggtcttattgcctgcctcagggaagatcccacctcccagcccaggcccagaagccctcctaagatacctgccaccctttgctyaagtgacagctgccttttcatgacatgactccctacatgccaagccctatgctgagcactgtcattcagggtcacttcacagttacagcccagactcgaatcagtcagactcaggttcaaatcctaaatatgtccctgccccagttcccatcagtgtggccttgaggaattacttaagcattctgagaaaattactcagtttcctcaacagtaaaaaaagtgcatattaatgagacccaggtcatatggtgggttacgaggtttaaatgagcttattaataaatcccatgataaacagtg

SEQ ID NO: 3851 - DNA, 601 bp, Human
cacgcccacacagccatgtctttagtggggagccttcatattatgtttatgggtcaagagaaagagaggtgacagttacagatataaaggcaatttacagcacctctgtaattgggacaaatacagtctcagggatgaggtcatttccttggtgactactgtattgatggtatttatcaatacagctagttagtcctacaggacttctaggtcctgtaaatactatcaatacagtcacctcacgaccaaaactcccagggtgggaggatggatgctgtctgctgcaccctcccaggggacyggtgtctgacttgtgctcacccttcctcactcacagaggctgcagtgatgaggggcggccagtaggggccttgagatgcctgtgggggctacgtgctgcttacctgctgcctcctggcttggccaagtacttatttcctcggtggtttggtttgggctggaattggccctgatgcagcaaggacagcagctgggagatttgctacaagacaggaaaaatctgttgactccacacaattccgactcagcacacttcctcgccggatgtttccctcaatgccggtgctttctttttatagtc

SEQ ID NO: 3852 - DNA, 601 bp, Human
taattatttcatttaacttcacaaacctttgaggtcaagagtattattcccatttgatggatgaggaaactgaagctgaaagaagttaagtcacacatctgctaggcaaccaaacctcaatttgatgccaggtctgatgactttgaagcctatgatggcaccaccctaccctctctctgaagagctggcccttcctccccctggatactccaggtgcccagctggggcctctggaattcccaggctacctaaggtctgcactgttaccacctggccccagatcctcaaatcctcctcaacrtcatctctcaagctgctggaaccctggcctagagtcaggctggggaggggctgcctgtccaagggctgtcccaggagagggactggggtagtggcggtggcaagtcagcctggtggctgggaattcaaaaaactggcccctacatttgcaatgccacagtcacccttcttttcccatccctttaacagaaaatcctgtttcaagaaaccagtcccaggcctgatggtagagaccaagccagaggaaagaaattataagtcttggagttaagaaacagtgtcttaaaaaaattaaaaaaaa

SEQ ID NO: 3853 - DNA, 601 bp, Human
gggtcaggggcgctcagccggtccagggccagacctgtgggggaaggaggggacacagtgagggccaggctccgggaagggccaggcgggtgagggtggggcaatgagcagggcaagggcagtggacaaaggagggaagggaaatggcaggggacagacagagtggccagacggggacaggaaggaagaggccctgacagggaagctccctgggtaggaaagcagtcgactgacacacccgggcgaaccaagtggggaagcagcaggaggaggagaaggcctagaagtagaaatttgccgwtttctgaagaatttcccaatctgggcgtgtgtttccagtctcagtgtcttctatatttcatccaggatttttacccctcagggcgccttctcccctcagggctccactagctgaggatggagggaaaatcccttttctttgccaaggctggagttcctgacttagcgctgccttttttggttcccatccataataatagggaccacatattaggtacttacgtgatgagcaatttacataattatttcatttaacttcacaaacctttgaggtcaagagtattattcccatttgatggat

SEQ ID NO: 3854 - DNA, 601 bp, Human
gctgagaagcagattagttggtaacatagtgataggggaacaggggtaagagcacacatgtctgctatttgtgtacctgttactgtgtaccaaggtgccccactcctgtccaggcccagtgtgacggtcttgccagggattggatgacaaataaaccccactctattactcttcccttctccctcttgacaggtgcaaacaggagaatgaatcactgcttttcctttattgataggtcagagagcatttcctggcacccccagggtacagccccctgactcctgctacccaagaaggccaycctttcctgcctgtgatactccgtggcatctgttctgccagaggactgaccctttgtgctccacatatgttttgccaggaaacacttatctcagccacaaaccgtccctgtcctccaaaagactcagagctgcttacaaggggctgctttggtcagtcagctgttagtcctggggctcttgcctcctctgtgggggtagcatcagtcaccctaaagttctcaggccgccgctagctagtgagttacaagattttagaaaccagctcttgtccacagatcctcaggcccctggttcttgga

SEQ ID NO: 3855 - DNA, 601 bp, Human; identical to SEQ ID NO: 1523

SEQ ID NO: 3856 - DNA, 601 bp, Human
cctccgggcgtgtttgctgggaccccggcaggtggcacgctttgctgagcttcacgtgtgtgtttggggctggggtggcgttcagggtcaccgcagcgctgctgtgggtttgcagggagcgtagttccaggatggtctaggcctttcccaaactcacggtgcaccccgtctcccccgcagactggcgcgccccgcacaagttggaaagccactttccatgtgtcctgcatgactttcccagcaaggcgggggcgctccttaggagatacttttacatgcctttgaaaaaaaaaaaaaaaaagatgggggtgggggcgggaattaaccaaacacctgttcgctggactagatcagctgagaaaacaagtctgagtgatgtgcccagcccccaaagtactcggccgcacccgagacccgctcggctcctgcgttgggcgggcacagccaaggggttaaagcaaaatgtccgatctgagcctggactttgcaaacaaggtttgtaagggacaaccccccaccgtagcggtaaacctcccaggagaaagaggagaccggcactactggcctctccttttatttcttaaacagtgtttggttccca

SEQ ID NO: 3857 - DNA, 601 bp, Human
tgtttgctgggaccccggcaggtggcacgctttgctgagcttcacgtgtgtgtttggggctggggtggcgttcagggtcaccgcagcgctgctgtgggtttgcagggagcgtagttccaggatggtctaggcctttcccaaactcacggtgcaccccgtctcccccgcagactggcgcgccccgcacaagttggaaagccactttccatgtgtcctgcatgactttcccagcaaggcgggggcgctccttaggagatacttttacatgcctttgaaaaaaaaaaaaaaaaagatgggggtsggggcgggaattaaccaaacacctgttcgctggactagatcagctgagaaaacaagtctgagtgatgtgcccagcccccaaagtactcggccgcacccgagacccgctcggctcctgcgttgggcgggcacagccaaggggttaaagcaaaatgtccgatctgagcctggactttgcaaacaaggtttgtaagggacaaccccccaccgtagcggtaaacctcccaggagaaagaggagaccggcactactggcctctccttttatttcttaaacagtgtttggttcccacatgatcggc

SEQ ID NO: 3858 - DNA, 601 bp, Human
ggatggtctaggcctttcccaaactcacggtgcaccccgtctcccccgcagactggcgcgccccgcacaagttggaaagccactttccatgtgtcctgcatgactttcccagcaaggcgggggcgctccttaggagatacttttacatgcctttgaaaaaaaaaaaaaaaaagatgggggtgggggcgggaattaaccaaacacctgttcgctggactagatcagctgagaaaacaagtctgagtgatgtgcccagcccccaaagtactcggccgcacccgagacccgctcggctcctgckttgggcgggcacagccaaggggttaaagcaaaatgtccgatctgagcctggactttgcaaacaaggtttgtaagggacaaccccccaccgtagcggtaaacctcccaggagaaagaggagaccggcactactggcctctccttttatttcttaaacagtgtttggttcccacatgatcggctatttaagccggagagggtattttggcgcttagtcgccttaatcgctatggggttgcattcttcatctgtgctactgaaaaataggctgtagcaacaaaaggtctcccctccccaccca

SEQ ID NO: 3859 - DNA, 601 bp, Human
tgggccagcagagggaattcattctcctgggcattctctctctgcaccagagccccactgaaaccggtggcttccttgaaatacttgttcaagcaaaaagtgtgaagggaaagtactgggacaagaaatatcctggcagtggagatttgcgaaacgtgactttgccaggaatctgtgtcgtgaaggttagcagcatgcttgctaaaacttgttactgctgctgggcttctctggtattagagctgaggcaactcctcccgaggtaaggataagcctgcaatggggtctgatgccttctagraaagctcttcttagcagctgacagaggggagaggccccgtataaggagactgtatgtttcctagagtccaaaggcagtgaccacactttaaagaggctgtggtttatgtcacgtgctgcccacctccatgcttttgtaaagctttattccagcttcaggaatagcattggtcttcccaggagaaccagcacacacaggccatagcacaggtcagttgtcaacctttgacagtaaagaatgtgggtgtaaatggcagagccagtaagactgagaaaacttctggaccagcttcctaaactc

SEQ ID NO: 3860 - DNA, 601 bp, Human
taaaaagcagtaattgtgtacctactgtgtgtcaggtaccttacaaggtgtcttaaacattctgtgattctaagattgcctgagagtaaagccaaaggtggttgtttttgggtaatgatattttaaactcagtcatatttatgaaacccatgttcaaagcaacttaactttaataggtcttaattagacttataacaaaagtgagtttaatgaacagaggactttgaggaaggagaagtaaaatatcagatgcatgggacggtcagataaaagcacgatcatagaagacctatcataaatktttgtagttcaaattttctatagtgcctttaactattcagtcacattttaaactccagttatgacttttgcagaataatattgtgtcagagagccccaaaacatgtcgggtgttcctaaagctttggagactataaaattgaagtagataccataaacttcatccaggttttcaggctgtatattaaagaagtttcggactccaaaagattactcaatggtcagccaagttggtccgccgagtgactgaggtcagggtctgagcaccttggactctttaatttctcttaggtagttaaga

SEQ ID NO: 3861 - DNA, 601 bp, Human
gcataggtcagggctatctatttaaatattggtgcctggactcttactattgactctattccagctggccttggaacaagttctgggtccgtccttctttgcctgcctccaccccattcccttctgaaaaagcccagtgaagtgtggctgtagctagccaagaatcagagctgtattcaggatgtgtacctaagcacttgcttccttgcatttattcactcggagtgccatgtggcccagggccatcttccagggattgctgggtcaccttgaatgctaagagtagagaaaaagccaaaaygggcagcgagacttacaggaagtcttaggactctgcaagaaagcagaaataggcaagtttaattttaacacaggctggtgtgagaccaagtaatgacagggttggggaaaaaaagggtcaaagtatttatatggtataaataatttgttggggaagtcaggataaatgcttatataaaaggattcctttattataaagaagtggttattctgtgttctcagttatatagactctcttagcataacaatatattgagatttaatttaagctttcataaccaaatagtaccagaattatggc

SEQ ID NO: 3862 - DNA, 601 bp, Human
aatcagagctgtattcaggatgtgtacctaagcacttgcttccttgcatttattcactcggagtgccatgtggcccagggccatcttccagggattgctgggtcaccttgaatgctaagagtagagaaaaagccaaaacgggcagcgagacttacaggaagtcttaggactctgcaagaaagcagaaataggcaagtttaattttaacacaggctggtgtgagaccaagtaatgacagggttggggaaaaaaagggtcaaagtatttatatggtataaataatttgttggggaagtcaggwtaaatgcttatataaaaggattcctttattataaagaagtggttattctgtgttctcagttatatagactctcttagcataacaatatattgagatttaatttaagctttcataaccaaatagtaccagaattatggcgcatggtttcctgaagacctcggctcaacatattactgtggacagtgaggccagtgaattatttggtattttcaagagggacagtgagacaaaacagaaaatactgttgtaagcttagatgacagggtcaattgtgcctgaaacactgatttagtgctgaat

SEQ ID NO: 3863 - DNA, 601 bp, Human
aagtaatgacagggttggggaaaaaaagggtcaaagtatttatatggtataaataatttgttggggaagtcaggataaatgcttatataaaaggattcctttattataaagaagtggttattctgtgttctcagttatatagactctcttagcataacaatatattgagatttaatttaagctttcataaccaaatagtaccagaattatggcgcatggtttcctgaagacctcggctcaacatattactgtggacagtgaggccagtgaattatttggtattttcaagagggacagtgaracaaaacagaaaatactgttgtaagcttagatgacagggtcaattgtgcctgaaacactgatttagtgctgaatcagcccattttaagaatataatcatagcttaagaaccagtttaaaatttccccatcctacactaaagcaatgtctttaactcctttggatgtctgtagcacattgtgtctgacaattctgatgttttgtgctaaactgtgatccactatctttaggacatgatctaatctctcccaactggattgtaggttatgtgagggcaggggtcttacattcatttctttgc

SEQ ID NO: 3864 - DNA, 601 bp, Human
cactgatttagtgctgaatcagcccattttaagaatataatcatagcttaagaaccagtttaaaatttccccatcctacactaaagcaatgtctttaactcctttggatgtctgtagcacattgtgtctgacaattctgatgttttgtgctaaactgtgatccactatctttaggacatgatctaatctctcccaactggattgtaggttatgtgagggcaggggtcttacattcatttctttgcctgctagcacctagcatatgccttgcaaatacaatagagactgatattatacactsagtttaacctgtgacatcaactcttcctgctgagggtggagagagggagaaatccctttctttaaccctttgcccttccttgctcaggccttggtgtcttctgcctctgaggaaacggaatctgtaagcttagcaaagaaacgcacaagacgttaattcttggtttttgatttttcaaaggcggggggttccagctaagggattttcatgagtgtttgtaaatttcacctggcttttgccctaaaggcagactttagaacctaaccccagaaatacaggctgacctacactgcagtgggt

SEQ ID NO: 3865 - DNA, 601 bp, Human
atatatttaactctttcggtaggatggtgggaaggctgcttacctgctccgggggtgagcctaggagccatagcatgggatctggggatctgtgtagcacccccgctggctcctgggaggatggtaaagattacgtactgcagcagtgggaagtggacgtagtctcagcccccggtgcccatcttccctttctgggcttgggtacaactctggaatcaaataactttatatctggaaggaagcttaggggttctgaaacctggctggtcttcagggtaactacttgggcaaccttttatamaagtgtgattctcagcccagcctagatctgttacgtcagtttccataagtgtgctccaagaagctgttcttaaagtcttcttcgtttgagtcagactagcttttctcctttacacagaaggcagagtgtaatgtagtgactaagagcagagcctagagccaggtaggatcaaacccttttctgccattgactagctatgattttgtgcaggattcctaaccttcctaggccttcctgccttcagctgtgaagctagtatcctcgcacattagaatagtcctggtccagagtgagcatttt

SEQ ID NO: 3866 - DNA, 601 bp, Human
atatctggaaggaagcttaggggttctgaaacctggctggtcttcagggtaactacttgggcaaccttttataaaagtgtgattctcagcccagcctagatctgttacgtcagtttccataagtgtgctccaagaagctgttcttaaagtcttcttcgtttgagtcagactagcttttctcctttacacagaaggcagagtgtaatgtagtgactaagagcagagcctagagccaggtaggatcaaacccttttctgccattgactagctatgattttgtgcaggattcctaaccttcctrggccttcctgccttcagctgtgaagctagtatcctcgcacattagaatagtcctggtccagagtgagcattttgtgtttgttaaatagatgaggaaaccaaggctgtaagaggtgcagtggtggcggcatgtctagcaaacttggtcttcaatctgcatcttccctgcttcccggcctgtgctgtgtatgtgctttctccttttaggtttggttttcatcacgtttaaaggtttggttttcatcacattctccctttcttccattccactctccagttgaaaagtgcatctcagaagagc

SEQ ID NO: 3867 - DNA, 601 bp, Human
agggtttgataaccaccatcaaatctgctatctggcttttctgcttagataaacaaggcaagacgatctcaaaccagcataccgattccgaggttggcatgtttgtagaagactgttctcaggccgcagtgtggcagcagaccctccccagttcagccccatgccagattccaacgttggatcccactgtcgcttcatctcatcctaaattggcagaaagactgtttagaaaactaagtctctaaaaccaattaaatggtaaagaagactgttctgaattagggggaatgggatgaagtaycactaaacgcaagtcacaaagggcaaaaactcatgacatggagccgtgggtatctgcttgcatgtttatttgccaagcggctagtatattttgcatgtcatacaatctgaaacttacttttttgaaaagccatttcagatatagtataagaaaagcctttgagagaaacatgctttctaagcctgggagtacagaaataaaaataaactttgcaataatttgaaaggggcacactggttagttgaagagtaaggaagcacccagtaatgcctctttacccaagagctctgtttgctttgc

SEQ ID NO: 3868 - DNA, 601 bp, Human
agacagagtctcactctgtttgcccaagctggagtgtagcgatgcgatttcagctcactgcagccttgacctccttgggcttaggcaatcctcccacctctgcctccccagtagctgggactgcaagtgtgcagcaccacacccagcaatttttttgtgtttttagtagagtcagaatgctaccatgttggccaggctggtctcgaactcctggattcaggcaatcagcctggcttggcctcccaaagtgttgagattacaagcgtgagccaccatgcccagccccaagagttttcaaaaraggaagagttcaaagaggctcagaaatgatcaagtggacatacagagacataattttaggaaagggatattattaatatttgccagtgagtcctcgttactgctggtgagactaggcccaggtaccgacttaaggcgatactttgaaaaagttgagaggtggcttaaagacctgggtgatgaatgaagaagacctccatgactttacaagtgcaaagagagatgggtctgggcactgctgggccttttagaggctcaaggacagtggccttggggaaggctgaaggagacacctattgaa

SEQ ID NO: 3869 - DNA, 601 bp, Human
ttttgagttcttacaagactcattttaggtgtggagagagctcttcccatgtgggtctgcagctctagaattgggtagtgccttggatggcacagtcctggtgtatcctgcaggctgagtggacaggagggcgttgactgggtgtgtgtgatacagggtggaagccagctccgagaacgcagcaggagagccaaggctgtgcttcctgttcctgctggcctggttgatttgtctttgtaatcctagtcaatgcatccagcgtctcagtgcatatattgaataaaaaatgacgaatggcctygttgaattgtcaggagtgtagaaaatgaggctcaatcagcactttgggttctaaaatactgtcgtttttcaatctcttctttcaagattattggtatagaccttgagggaaatctgagttcaaaaggaaatagaatatctttggaattttgcaaaagtgtgagtcatcaggacttgagcatacattcccctggtgtgctgcaaatcagatatgaaacatcttcctgaggtggcatggtggtggtataaaagcttcattatagtacagaatgaagtgtgtacttatataaaacacaagtct

SEQ ID NO: 3870 - DNA, 601 bp, Human
tctctaattatggttttggtctgccagtttgttatggagcagaaaagaagatgtaagctttctggaggtagtagctgctacaggcatacactatattatctcagcaatagcaagtccaagtaggactgattcagtatacacaaagaagtattagttgctaaaatattgaaataactttcattctggttggtgcacgttgagtatcccaaatatgaacaaccaaaatctgaaatgctccaaagctggaaactttttgagtgtttttgagtgcctgccaacatgacatgcaagagaaacattmattggagcatttcggattttggatttttagatttgggatgctcagtaagtattaatgcaaatattccaaaatccccgccccccgccccccgccaaaaaaaaccaaaaacccaaaacacttgtagtcccaagcatttcagaaaaatgatactcaacctgtaaatagctttgccccaaacccccctgagtttctttctctacttccctggccagttttcacataggaacccccctaatcgccacgtatttcccccccacaacccagcaataaaggggaaatgccctcataagcgaggagccc

SEQ ID NO: 3871 - DNA, 601 bp, Human
agaccatcctggctaacacggtgaaaccccgtctctacaaaaaatacaaaaaattagccgggcatggtggtgggcgcctgtagtcccagctactcgggaagctgaggcaggagaatggcctgaacccgggaggcggagcttgcagtgagctgagattgcgccactgctctccagtctgggcgacagagtgagactccgtcttttttaaaaaaaaaaaaaagaaaaaaaaaagcctgaaagacctcttttggttttgctttttgctttgtctttgtcttcccggcctctaaaaatctgggtrgctggtctgaggtgttgggacccaggacttgctctcttattgctccaccactggagcctcaacctcaaactcaaggtggtggcacctacattccaggcagctgaagaaaggagcaaagaacagagccaaaggcacatgcatgccatcttctaaggaaaattattggaagcagcagtgtgatgctttgtcacacgtcctattcagcagaactgagttgtgtggcacatccagctaaagagggaggttcagttgagtagtagttattcagggtggccttatgcccagctaaaaagtctttta

SEQ ID NO: 3872 - DNA, 601 bp, Human
tgggcgcctgtagtcccagctactcgggaagctgaggcaggagaatggcctgaacccgggaggcggagcttgcagtgagctgagattgcgccactgctctccagtctgggcgacagagtgagactccgtcttttttaaaaaaaaaaaaaagaaaaaaaaaagcctgaaagacctcttttggttttgctttttgctttgtctttgtcttcccggcctctaaaaatctgggtagctggtctgaggtgttgggacccaggacttgctctcttattgctccaccactggagcctcaacctcaaaytcaaggtggtggcacctacattccaggcagctgaagaaaggagcaaagaacagagccaaaggcacatgcatgccatcttctaaggaaaattattggaagcagcagtgtgatgctttgtcacacgtcctattcagcagaactgagttgtgtggcacatccagctaaagagggaggttcagttgagtagtagttattcagggtggccttatgcccagctaaaaagtcttttactatgggaaagaggagaactgatgttgggtgacagccagcactctctggcagagctactaagcctgttgt

SEQ ID NO: 3873 - DNA, 601 bp, Human
gtgccgagcactgtgcaaaggtcagggatggaaatggtgagctcacaatccaagtgtgtacagtttcctagacttggtttcttgaaaggaaaactcactagagattggactccaaatcacaaatgtcatttggcaactgataagtcgggtatctggtaattcagaagcacaggaaatgattaaatgccacatttgacaagatctggcagctgccttgtgaaactgaaagaacaggattgcctggagacaattatcagaacttggactttcatttttccttgctgcagtagacagtgttttrttgtggctctttaagagatgtcttagtggtatgaattgcttggtcagctgaaaacttttcacctaatttaattttatttttaatttttttgagacagagtctcactctgttgcccaggctggagtgcagtggcgcaatcttggcttagtgcaacctccaccacccaggtccaagcgattcttgtgccttggcctctgaagtagctgggattacaggtgtgcaccaccgtgcccggctaatttttgtatttttagtagagatggggtttcgccatgtgggccaggttggtctcaaactcct

SEQ ID NO: 3874 - DNA, 601 bp, Human
ttggcaactgataagtcgggtatctggtaattcagaagcacaggaaatgattaaatgccacatttgacaagatctggcagctgccttgtgaaactgaaagaacaggattgcctggagacaattatcagaacttggactttcatttttccttgctgcagtagacagtgttttattgtggctctttaagagatgtcttagtggtatgaattgcttggtcagctgaaaacttttcacctaatttaattttatttttaatttttttgagacagagtctcactctgttgcccaggctggagtgcartggcgcaatcttggcttagtgcaacctccaccacccaggtccaagcgattcttgtgccttggcctctgaagtagctgggattacaggtgtgcaccaccgtgcccggctaatttttgtatttttagtagagatggggtttcgccatgtgggccaggttggtctcaaactcctgacctcaagtgatctccctgcctgagcctcccaaagtgctgggattataggtgtgaggcaccacgcctagccaaattttatttttatttttatttatttattttttattttgtgagatggagtctcact

SEQ ID NO: 3875 - DNA, 601 bp, Human
gaagattgtgaagattattacatcaggtgaatgtaggggtgatttagagaaagctggtagctaggctgttcaaggaagggcctctgtgagaaaggggatggttggctgggtgtggtggttcacgcctataatcccagcactttgggaggttgggagtttgagaccagcctgaccagcatggagaaaccccgtctctactaaaaatacaaaattagcccggcatggtggcacatgcctgtaatccaggctacctgggaggctgaggcgggagaattgcttgaacccgggaggcagaggttgyagtgagccgaaatcatgccactgcactccagcctgggcaatgagagtgaaacttcctctccaaaaaaaaaaaaaaaaaaaaagagagagaagaggatggtggagttagccctgaggaatgtgaaggatgcaaccagcgaagatctgagtcaagagtgttcggaaccaaaggaagcgactgcggttactctgagatggaaatgaggctgctatgttcaaaggacagaaacggagtcagtgtggcaggagtgcacaccttagagggtgcagctggagaggcagagaaagggccactcaccat

SEQ ID NO: 3876 - DNA, 601 bp, Human
acatcaggtgaatgtaggggtgatttagagaaagctggtagctaggctgttcaaggaagggcctctgtgagaaaggggatggttggctgggtgtggtggttcacgcctataatcccagcactttgggaggttgggagtttgagaccagcctgaccagcatggagaaaccccgtctctactaaaaatacaaaattagcccggcatggtggcacatgcctgtaatccaggctacctgggaggctgaggcgggagaattgcttgaacccgggaggcagaggttgtagtgagccgaaatcatgcyactgcactccagcctgggcaatgagagtgaaacttcctctccaaaaaaaaaaaaaaaaaaaaagagagagaagaggatggtggagttagccctgaggaatgtgaaggatgcaaccagcgaagatctgagtcaagagtgttcggaaccaaaggaagcgactgcggttactctgagatggaaatgaggctgctatgttcaaaggacagaaacggagtcagtgtggcaggagtgcacaccttagagggtgcagctggagaggcagagaaagggccactcaccatgggccttgtagaatgtggc

SEQ ID NO: 3877 - DNA, 601 bp, Human
gcaggtggatcacttgaagccaggagtttgagaccagcctggccaacatggcggaaccccatttctactaaatatatatatattttgtatgtatgtgtatatatatataaaatatatatataatttatgtatttatataatatacaaatatatttatatatttatatacaaatatatatttatattatatataaattatataaatttaaataaatataaatatatttatcttgtatatataaatatattttgtgtgtgtgtatatatatacacacacaaaaattagctggacgtgggggcrcattcctgtaattccagcttcttgggaggctgaggcatgagaatcacttcaacctgggaggcggagggtgccgtaagccaagattgcaccactgcactccagcctgggtgacagagtgagactctgtctcaaaagaaaaaaatttttaaataaaaatagggaaggaggccgggcacggtggtgtaatcccagcactttgggaggccaaggccggtagatcagttgaggtcaggagttcaagacaagactggccaacatggtgaaaccctgtctctactaaaaatacaaaaattagcctgg

SEQ ID NO: 3878 - DNA, 601 bp, Human
cgtaagccaagattgcaccactgcactccagcctgggtgacagagtgagactctgtctcaaaagaaaaaaatttttaaataaaaatagggaaggaggccgggcacggtggtgtaatcccagcactttgggaggccaaggccggtagatcagttgaggtcaggagttcaagacaagactggccaacatggtgaaaccctgtctctactaaaaatacaaaaattagcctggtgtggtggtgggcacctgtaatcccagctactcgggaggctgaggcaggagaatcacttgatcccaggaggsagaggttgcagtgagccaagatcgcaccactgcacttcagcctgggcaacagagcgagactatcttaaaaaaaaaaaaaaaagggaatgcttatggcaagcctggctgggggagaagctgagttctattttgaatgtgttaaatatgagatgttaagtggaaatgtttactaggcaattgaatatctgagtatggagttaggagagaggctggggctgaaaagaggtgttttgagagttatcagtgaatggatggtgtttccagccacaggatgagagcgcagctagagatgaggaaaag

SEQ ID NO: 3879 - DNA, 601 bp, Human
ggagaatcacttgatcccaggaggcagaggttgcagtgagccaagatcgcaccactgcacttcagcctgggcaacagagcgagactatcttaaaaaaaaaaaaaaaagggaatgcttatggcaagcctggctgggggagaagctgagttctattttgaatgtgttaaatatgagatgttaagtggaaatgtttactaggcaattgaatatctgagtatggagttaggagagaggctggggctgaaaagaggtgttttgagagttatcagtgaatggatggtgtttccagccacaggatgaragcgcagctagagatgaggaaaaggtctaagagctggtggaagagaggagcaaccagcaaacttgaggagaaactggcaagtatcgactgacttgtacatccatctaccttgctgtcgtgatcgacccttatgtttgtgttttgcctgaaggtggccactttcactgtctgctgcgagctcctgcaaactcctaataatccgagggacagaggggagtggtggtgtactgttctagtatctacttttatgattcaaaaacctgttctttttgaaatcacatggtacttaaagatatttat

SEQ ID NO: 3880 - DNA, 601 bp, Human
tgtgtaaattacctggcttgttcattacaaataaccattggatgtcctgtaagtgctaggcactgagctggatgctaggtgatgcaacagtgacaaggacaggtgtggcccctgcccccatggagctgaccttctggggagggagaaggacagtgagcaaatggtctcacacacagtcgtataatcactaactgtggccattgctgtgcaggaaaggcaaatgataattataagagatgggacctgaactagcctggaaagtgggaagttttttttttgttttgttttgttttttttttttgagatggagtctcactcttgcccaggctggagtgcggtggtgccatctcggctcactgcaacctctgcctcctgagttcaagtgattctcctgcctcagcctcccgagtagctaggactacaggtgcgtgccaccgtgcccacctgatttttgtatttttagtagagatggggtttcactatgttggccaggatggtctcaatctcctgacctcgtgatccacctgcctcggggaaggtttttaagcagagacatgaaggggtgagtaggaggatgcctgaaggagagaagaagaaactg

SEQ ID NO: 3881 - DNA, 601 bp, Human
attggatgtcctgtaagtgctaggcactgagctggatgctaggtgatgcaacagtgacaaggacaggtgtggcccctgcccccatggagctgaccttctggggagggagaaggacagtgagcaaatggtctcacacacagtcgtataatcactaactgtggccattgctgtgcaggaaaggcaaatgataattataagagatgggacctgaactagcctggaaagtgggaagttttttttttgttttgttttgttttttttttttgagatggagtctcactcttgcccaggctggagtgcrgtggtgccatctcggctcactgcaacctctgcctcctgagttcaagtgattctcctgcctcagcctcccgagtagctaggactacaggtgcgtgccaccgtgcccacctgatttttgtatttttagtagagatggggtttcactatgttggccaggatggtctcaatctcctgacctcgtgatccacctgcctcggggaaggtttttaagcagagacatgaaggggtgagtaggaggatgcctgaaggagagaagaagaaactgtgcaaaggtcctgagccaggagagtggtggtggttg

SEQ ID NO: 3882 - DNA, 601 bp, Human
aaggggtgagtaggaggatgcctgaaggagagaagaagaaactgtgcaaaggtcctgagccaggagagtggtggtggttggaggggtgtgaaagaagcccactgcagttcaaagagtagagagtgatggagagggttaacccagaatgtgccctttggaaatacctaacctgaaatacttttacctaagccattgttaggatctgagttcttggtgtctgagcacaactgaatgtgaataagaggctgtttggatttcctgctgtggatggcaggatgctattcacaaagaagcctatgtyctgaccctccagacctgctgctacattaggttaaatggcaaaggggcattaggttgcagaaggaatcaacgttgcttatcaactgatgttaaaatcagggaagtatcctggattatccaaatgggcccagtggttcttgtaatgtggaagagggagacttgaagatgctcgcccgctggctttacagatgaaagaaggaaccatgagtcagggaaagttttcctgttgggcactaggcttagtacctgagtgacgaaataatctgtacagcaaaccccggtgacacgagttgtgctgcat

SEQ ID NO: 3883 - DNA, 601 bp, Human
gaggagagtaaagactaagcagtcgaggcaggccaccaggtttgctgagggcagccaggaagtggtagagggtgtggacattccctgttaatcactggcccttagagagcaggcacttccccctgcagccagaggagagacagtacttctgtcagtggatacctggagggtcaagctgcgggaaaggagagggactcttacaaggccagtgagctttgaccagatgagcttaccctcaggtatcctgatcacgtggagactggccatatggcttcccagaccaaaataactcacctgtgcmtgtgaaaccataccagggccagatgcagctgcactgttgagatttgaagtgtggtgctgttgaattcaagctgctgcatcagtcaggtttctttgccagctttctatccgagcctggggtgaccatatcattcatcttccaaactaggacacgtttaatgaaagggagtggagtgaatgttcaatctttagacaacaggtatgatccaggactgtcctggggaaacctggacatatggccagcctagctaaggctagaagcgttaaccattccattggatggtctgatgacccaaaatgg

SEQ ID NO: 3884 - DNA, 601 bp, Human
ccattggatggtctgatgacccaaaatggctaagtacaacatagcctgtgtgtggaagggcctcagcacccccaggaagagagggattgtcccaggtgcccttgctagcatatgtctgtgcccatagcatagacagctctctgatgtaggggtctagaataggtgttttctttataatccaaatacaaagcaatatttatttttaccccaaaattattctccttgtatttgaacattacaaaattgttctcttatgagagctgcccttctgactactttattttggaatgacacagtcatytgttctaaacaccttggctaatctaaaaggacctcaatccattttagttgtgaatgctgatagaggttaactttggttttaaataaaaataaataatttaaagaaggaggcaggtcactgtggtggctcacacctataatcctaacactttgggaggttgagttggggagatcacttgaggtcaggagttcaagaccagcctggccaacatggtgaaaccccatttctactaaaaatacaaaaattagccaggcttggtggcgggcacctgtagtgcgagctactgaggaggctgaagca

SEQ ID NO: 3885 - DNA, 601 bp, Human
ggctaatctaaaaggacctcaatccattttagttgtgaatgctgatagaggttaactttggttttaaataaaaataaataatttaaagaaggaggcaggtcactgtggtggctcacacctataatcctaacactttgggaggttgagttggggagatcacttgaggtcaggagttcaagaccagcctggccaacatggtgaaaccccatttctactaaaaatacaaaaattagccaggcttggtggcgggcacctgtagtgcgagctactgaggaggctgaagcaggagaatcgattgaaycttgggaggtggaggttgaagtgagccgagatcacaacactgcacttcagcctgggtgacagagcgagattctgtctccaaaaaaaaaaaaaaaaaaaagaagcaaagaaatttagttcacattcaatactcattcctcaggatttagcatcgtaattgcaagtactggatgttacaaactttaaaacatcctggaaatgttctagaaaactgggttaggcattgctctctgatgaagtaatatcaaagaaacatacagagtttgattaaaattgcttgatgaaatacaaataaaattat

SEQ ID NO: 3886 - DNA, 601 bp, Human
tcactgtggtggctcacacctataatcctaacactttgggaggttgagttggggagatcacttgaggtcaggagttcaagaccagcctggccaacatggtgaaaccccatttctactaaaaatacaaaaattagccaggcttggtggcgggcacctgtagtgcgagctactgaggaggctgaagcaggagaatcgattgaaccttgggaggtggaggttgaagtgagccgagatcacaacactgcacttcagcctgggtgacagagcgagattctgtctccaaaaaaaaaaaaaaaaaaaagaagcaaagaaatttagttcacattcaatactcattcctcaggatttagcatcgtaattgcaagtactggatgttacaaactttaaaacatcctggaaatgttctagaaaactgggttaggcattgctctctgatgaagtaatatcaaagaaacatacagagtttgattaaaattgcttgatgaaatacaaataaaattatttttaaatgaatgtttagtatgtgtgattttaaatgtttgtataaatttaaacgatcaaatgtcagttgactttcatctgcgttcataaagcttaaata

SEQ ID NO: 3887 - DNA, 601 bp, Human
tacatagtatgtgaggagtggtagtcatgataagagagacgttgtggtaacagctggggaaaggcatcccccttcaaactgggggggaagctaggctgggatgaaaatctgatgcaagaaatgattgtattttgacttgtggttccagatggcaaactaggtatatggttttgcttcctggctcctcaaggctccctaatagtttagagattatgaagaagcagaaagcagatgggatctgggcttatgaccttagcaggggaaggagccaagtctagagttcatcatgtgcccctcccckccccccaaccaagagtgatcaggtaaagcagggactaggagagaggagtgggtctggaagtgaaggaccacacaggggtccacagagaccaggtgattccatcgttccctacctctgtctggagtaggggctgctggcacttaacaccctggctgtggggaaaataccaaacccatagcactttctggggacaggcagataggggaatgttgacatgtacacgttttacagagcttaaattgattacaatgcacaaaaataatgaattcttttttttttttttgagaccatctttctcta

SEQ ID NO: 3888 - DNA, 601 bp, Human
aaatctgatgcaagaaatgattgtattttgacttgtggttccagatggcaaactaggtatatggttttgcttcctggctcctcaaggctccctaatagtttagagattatgaagaagcagaaagcagatgggatctgggcttatgaccttagcaggggaaggagccaagtctagagttcatcatgtgcccctccccgccccccaaccaagagtgatcaggtaaagcagggactaggagagaggagtgggtctggaagtgaaggaccacacaggggtccacagagaccaggtgattccatcrttccctacctctgtctggagtaggggctgctggcacttaacaccctggctgtggggaaaataccaaacccatagcactttctggggacaggcagataggggaatgttgacatgtacacgttttacagagcttaaattgattacaatgcacaaaaataatgaattcttttttttttttttgagaccatctttctctatcactcaggctggagtgcagtagtacaatctcggctcctgaaacctccatctccggggtgcaggcaattcttatgtctcagcctcccagatagctgggattaca

SEQ ID NO: 3889 - DNA, 601 bp, Human
agaaagcagatgggatctgggcttatgaccttagcaggggaaggagccaagtctagagttcatcatgtgcccctccccgccccccaaccaagagtgatcaggtaaagcagggactaggagagaggagtgggtctggaagtgaaggaccacacaggggtccacagagaccaggtgattccatcgttccctacctctgtctggagtaggggctgctggcacttaacaccctggctgtggggaaaataccaaacccatagcactttctggggacaggcagataggggaatgttgacatgtacaygttttacagagcttaaattgattacaatgcacaaaaataatgaattcttttttttttttttgagaccatctttctctatcactcaggctggagtgcagtagtacaatctcggctcctgaaacctccatctccggggtgcaggcaattcttatgtctcagcctcccagatagctgggattacaggcgtgagccaccgcacccggccaagaatgaagtctttatagaagtagattaggccaagtcatgacactagaaataaaaaaaatgcctaaaactagggcttctagtgtgaatgctggg

SEQ ID NO: 3890 - DNA, 601 bp, Human
gccccccaaccaagagtgatcaggtaaagcagggactaggagagaggagtgggtctggaagtgaaggaccacacaggggtccacagagaccaggtgattccatcgttccctacctctgtctggagtaggggctgctggcacttaacaccctggctgtggggaaaataccaaacccatagcactttctggggacaggcagataggggaatgttgacatgtacacgttttacagagcttaaattgattacaatgcacaaaaataatgaattcttttttttttttttgagaccatctttctctrtcactcaggctggagtgcagtagtacaatctcggctcctgaaacctccatctccggggtgcaggcaattcttatgtctcagcctcccagatagctgggattacaggcgtgagccaccgcacccggccaagaatgaagtctttatagaagtagattaggccaagtcatgacactagaaataaaaaaaatgcctaaaactagggcttctagtgtgaatgctgggaccccaagaattaagctgtcctcattctggcatttgaagagtggtttgcagtctgataactagctggctacccactca

SEQ ID NO: 3891 - DNA, 601 bp, Human
ggacaggcagataggggaatgttgacatgtacacgttttacagagcttaaattgattacaatgcacaaaaataatgaattcttttttttttttttgagaccatctttctctatcactcaggctggagtgcagtagtacaatctcggctcctgaaacctccatctccggggtgcaggcaattcttatgtctcagcctcccagatagctgggattacaggcgtgagccaccgcacccggccaagaatgaagtctttatagaagtagattaggccaagtcatgacactagaaataaaaaaaatscctaaaactagggcttctagtgtgaatgctgggaccccaagaattaagctgtcctcattctggcatttgaagagtggtttgcagtctgataactagctggctacccactcagcctaaagcgaatccctggagtcagcagccccacccaggactccctttcagaattcctgctcagggtgagagcgagccagaaatggacctttttatacaacatcagaacaaaagagaacagggattatcaggcatgtgatgagagctagcagcataaaaggcaatggccgaagcaaaccaacagaaaaa

SEQ ID NO: 3892 - DNA, 601 bp, Human
aacttctaggcaaaatgcttagaattttgggaacatgttaaacccacagaataagattaggatctgttatgtaaaaggcacagtcagaacaaagagctcttgaagactgcaaatgtgactactgaaattaaaaatgtcagtataaataccagaaaatacagttgaaaaatctcagaaccacagagaaggagggaaaatgagagaaagggtagattaacccaggaggttcaccacctgactagttaacagaggtttcagaaagaggacagaaaacatacaaatgaaacgatccacacacaayaaaaagagtttccaggaaattcatgtcctaagtctgtggagtgaaagaggtcccacataggctcaccatcatgctgttgagaatgccttgggtaaagtagagaacgtggtggagcacggtggttcacgcactttgggagactgaggtagctggggcctcaaggtaggcggatcccttgaggccaggagttcaagaccagcctggtcaacatggcaaaaccccatctctaataaaagtacaaaaagtagccaggcgtgatggcacatgcctgtaatcccagctacttgggtggctgaggca

SEQ ID NO: 3893 - DNA, 601 bp, Human
gaaaatacagttgaaaaatctcagaaccacagagaaggagggaaaatgagagaaagggtagattaacccaggaggttcaccacctgactagttaacagaggtttcagaaagaggacagaaaacatacaaatgaaacgatccacacacaataaaaagagtttccaggaaattcatgtcctaagtctgtggagtgaaagaggtcccacataggctcaccatcatgctgttgagaatgccttgggtaaagtagagaacgtggtggagcacggtggttcacgcactttgggagactgaggtagcyggggcctcaaggtaggcggatcccttgaggccaggagttcaagaccagcctggtcaacatggcaaaaccccatctctaataaaagtacaaaaagtagccaggcgtgatggcacatgcctgtaatcccagctacttgggtggctgaggcatgagaagcacttgaacccgggaggcaaaggttgcagtaggtagagatcatgccactgcactccagcctgggcaacagagagagactgtctcaaaaaaaagaagttacccttttgagagtcagactaacaccagaatttccactggcaacac

SEQ ID NO: 3894 - DNA, 601 bp, Human
gttgaaaaatctcagaaccacagagaaggagggaaaatgagagaaagggtagattaacccaggaggttcaccacctgactagttaacagaggtttcagaaagaggacagaaaacatacaaatgaaacgatccacacacaataaaaagagtttccaggaaattcatgtcctaagtctgtggagtgaaagaggtcccacataggctcaccatcatgctgttgagaatgccttgggtaaagtagagaacgtggtggagcacggtggttcacgcactttgggagactgaggtagctggggcctcraggtaggcggatcccttgaggccaggagttcaagaccagcctggtcaacatggcaaaaccccatctctaataaaagtacaaaaagtagccaggcgtgatggcacatgcctgtaatcccagctacttgggtggctgaggcatgagaagcacttgaacccgggaggcaaaggttgcagtaggtagagatcatgccactgcactccagcctgggcaacagagagagactgtctcaaaaaaaagaagttacccttttgagagtcagactaacaccagaatttccactggcaacactggatacta

SEQ ID NO: 3895 - DNA, 601 bp, Human
aaccacagagaaggagggaaaatgagagaaagggtagattaacccaggaggttcaccacctgactagttaacagaggtttcagaaagaggacagaaaacatacaaatgaaacgatccacacacaataaaaagagtttccaggaaattcatgtcctaagtctgtggagtgaaagaggtcccacataggctcaccatcatgctgttgagaatgccttgggtaaagtagagaacgtggtggagcacggtggttcacgcactttgggagactgaggtagctggggcctcaaggtaggcggatccyttgaggccaggagttcaagaccagcctggtcaacatggcaaaaccccatctctaataaaagtacaaaaagtagccaggcgtgatggcacatgcctgtaatcccagctacttgggtggctgaggcatgagaagcacttgaacccgggaggcaaaggttgcagtaggtagagatcatgccactgcactccagcctgggcaacagagagagactgtctcaaaaaaaagaagttacccttttgagagtcagactaacaccagaatttccactggcaacactggatactagaattaattacagca

SEQ ID NO: 3896 - DNA, 601 bp, Human
agaatgccttgggtaaagtagagaacgtggtggagcacggtggttcacgcactttgggagactgaggtagctggggcctcaaggtaggcggatcccttgaggccaggagttcaagaccagcctggtcaacatggcaaaaccccatctctaataaaagtacaaaaagtagccaggcgtgatggcacatgcctgtaatcccagctacttgggtggctgaggcatgagaagcacttgaacccgggaggcaaaggttgcagtaggtagagatcatgccactgcactccagcctgggcaacagagrgagactgtctcaaaaaaaagaagttacccttttgagagtcagactaacaccagaatttccactggcaacactggatactagaattaattacagcagtgccatcaaggttctgaagaaaatgtttttcaacctggagttttacacccaaactatcaagagtgagagcagcataaagacatttttgtatatgcagagtcacactcagtttacctgtcatatgctattaggacagtatttaagaaagtaattcaaacaagggggaacatcagatcccagatcaaatccagttaccccaggata

SEQ ID NO: 3897 - DNA, 601 bp, Human
tgggagactgaggtagctggggcctcaaggtaggcggatcccttgaggccaggagttcaagaccagcctggtcaacatggcaaaaccccatctctaataaaagtacaaaaagtagccaggcgtgatggcacatgcctgtaatcccagctacttgggtggctgaggcatgagaagcacttgaacccgggaggcaaaggttgcagtaggtagagatcatgccactgcactccagcctgggcaacagagagagactgtctcaaaaaaaagaagttacccttttgagagtcagactaacaccagmatttccactggcaacactggatactagaattaattacagcagtgccatcaaggttctgaagaaaatgtttttcaacctggagttttacacccaaactatcaagagtgagagcagcataaagacatttttgtatatgcagagtcacactcagtttacctgtcatatgctattaggacagtatttaagaaagtaattcaaacaagggggaacatcagatcccagatcaaatccagttaccccaggatagccatgaagggctgttccagcatgatcctgtgtagcaggcccggcagaacatca

SEQ ID NO: 3898 - DNA, 601 bp, Human
ccccatctctaataaaagtacaaaaagtagccaggcgtgatggcacatgcctgtaatcccagctacttgggtggctgaggcatgagaagcacttgaacccgggaggcaaaggttgcagtaggtagagatcatgccactgcactccagcctgggcaacagagagagactgtctcaaaaaaaagaagttacccttttgagagtcagactaacaccagaatttccactggcaacactggatactagaattaattacagcagtgccatcaaggttctgaagaaaatgtttttcaacctggagttytacacccaaactatcaagagtgagagcagcataaagacatttttgtatatgcagagtcacactcagtttacctgtcatatgctattaggacagtatttaagaaagtaattcaaacaagggggaacatcagatcccagatcaaatccagttaccccaggatagccatgaagggctgttccagcatgatcctgtgtagcaggcccggcagaacatcaggtctacattgctgcagaaaggtccaggggctctgagaagggagtgtgagccaagatgagatcctgatttaacgcgggtatggct

SEQ ID NO: 3899 - DNA, 601 bp, Human
tagccatgaagggctgttccagcatgatcctgtgtagcaggcccggcagaacatcaggtctacattgctgcagaaaggtccaggggctctgagaagggagtgtgagccaagatgagatcctgatttaacgcgggtatggcttgggagcttagagaagattgaggcttggataaaggtgaacaatagaagaaaaaagaaaggcaatgagaaaagccaaggaaagcaagagtcatggtccaaatgtgaagtacacaaagcaattgatagaatgtaagaatagcaagtctgtttgaccttaatrctaggaacagtttcttttgaggctgagggcttctgatactgctcccagacagaaaaaggaaaatcagaatacagtttggttcagcactgagtaatacttatttggctatgtaaaagaatagatgactgaattgtggttaaaagtcaaaatgtaagtggtaataggtcctgtaagtgtaaaggtgtagctggtagatagcaagacatggagaaactaagaggaaagtttggaaggaagaatccaaatgctcatagctttgtctcactaactagggaatcaagatttctgtcaaaagttgaa

SEQ ID NO: 3900 - DNA, 601 bp, Human
gaacagtttcttttgaggctgagggcttctgatactgctcccagacagaaaaaggaaaatcagaatacagtttggttcagcactgagtaatacttatttggctatgtaaaagaatagatgactgaattgtggttaaaagtcaaaatgtaagtggtaataggtcctgtaagtgtaaaggtgtagctggtagatagcaagacatggagaaactaagaggaaagtttggaaggaagaatccaaatgctcatagctttgtctcactaactagggaatcaagatttctgtcaaaagttgaagggaraatagaggtttaaatctttaaaactcagagtagcaaatagaggaactaaatctagttattaaacataggatgggaggtggcagtttgttctttccttttcatattatggggccaacagttattgcctaaagctgataaatcaatacatatataataatccagaattatggagaagtaaatccagaatgaaaagtaagaggtttgtccggagtgtggggcttgggatgagtttggaatctgttgctttctaccgttaagtcttttattttttgatttcctatcatttgtacttattacttt

SEQ ID NO: 3901 - DNA, 601 bp, Human
tcagcactgagtaatacttatttggctatgtaaaagaatagatgactgaattgtggttaaaagtcaaaatgtaagtggtaataggtcctgtaagtgtaaaggtgtagctggtagatagcaagacatggagaaactaagaggaaagtttggaaggaagaatccaaatgctcatagctttgtctcactaactagggaatcaagatttctgtcaaaagttgaagggaaaatagaggtttaaatctttaaaactcagagtagcaaatagaggaactaaatctagttattaaacataggatgggargtggcagtttgttctttccttttcatattatggggccaacagttattgcctaaagctgataaatcaatacatatataataatccagaattatggagaagtaaatccagaatgaaaagtaagaggtttgtccggagtgtggggcttgggatgagtttggaatctgttgctttctaccgttaagtcttttattttttgatttcctatcatttgtacttattactttagcaaaaattaaattctgagtttgaaaatgggttaaatgtaaaggtgacacaattgccacataatgctactttcta

SEQ ID NO: 3902 - DNA, 601 bp, Human
tgaattgtggttaaaagtcaaaatgtaagtggtaataggtcctgtaagtgtaaaggtgtagctggtagatagcaagacatggagaaactaagaggaaagtttggaaggaagaatccaaatgctcatagctttgtctcactaactagggaatcaagatttctgtcaaaagttgaagggaaaatagaggtttaaatctttaaaactcagagtagcaaatagaggaactaaatctagttattaaacataggatgggaggtggcagtttgttctttccttttcatattatggggccaacagttaktgcctaaagctgataaatcaatacatatataataatccagaattatggagaagtaaatccagaatgaaaagtaagaggtttgtccggagtgtggggcttgggatgagtttggaatctgttgctttctaccgttaagtcttttattttttgatttcctatcatttgtacttattactttagcaaaaattaaattctgagtttgaaaatgggttaaatgtaaaggtgacacaattgccacataatgctactttctaactttttaggtcttaatttggacaaactaagcaggctgtgttttaa

SEQ ID NO: 3903 - DNA, 601 bp, Human
atccaaatgctcatagctttgtctcactaactagggaatcaagatttctgtcaaaagttgaagggaaaatagaggtttaaatctttaaaactcagagtagcaaatagaggaactaaatctagttattaaacataggatgggaggtggcagtttgttctttccttttcatattatggggccaacagttattgcctaaagctgataaatcaatacatatataataatccagaattatggagaagtaaatccagaatgaaaagtaagaggtttgtccggagtgtggggcttgggatgagtttgraatctgttgctttctaccgttaagtcttttattttttgatttcctatcatttgtacttattactttagcaaaaattaaattctgagtttgaaaatgggttaaatgtaaaggtgacacaattgccacataatgctactttctaactttttaggtcttaatttggacaaactaagcaggctgtgttttaaattaagcaataatagtgttcttgttctaatggtgcaatatttcatgtttcctctgaccagcttgcatagctaggggcagaatctttaatccttgaggaaatgaattattgcc

SEQ ID NO: 3904 - DNA, 601 bp, Human
aggatgggaggtggcagtttgttctttccttttcatattatggggccaacagttattgcctaaagctgataaatcaatacatatataataatccagaattatggagaagtaaatccagaatgaaaagtaagaggtttgtccggagtgtggggcttgggatgagtttggaatctgttgctttctaccgttaagtcttttattttttgatttcctatcatttgtacttattactttagcaaaaattaaattctgagtttgaaaatgggttaaatgtaaaggtgacacaattgccacataatgytactttctaactttttaggtcttaatttggacaaactaagcaggctgtgttttaaattaagcaataatagtgttcttgttctaatggtgcaatatttcatgtttcctctgaccagcttgcatagctaggggcagaatctttaatccttgaggaaatgaattattgccaaagacagtgaagcaaagctgccattgttcttggagttttaaaagtgtcccagtgtttagaacttttgatttgaagtatttatgcaaaagtataccagctctctttgggggagaacttgaatatatgaaacgg

SEQ ID NO: 3905 - DNA, 601 bp, Human
gtgcaatatttcatgtttcctctgaccagcttgcatagctaggggcagaatctttaatccttgaggaaatgaattattgccaaagacagtgaagcaaagctgccattgttcttggagttttaaaagtgtcccagtgtttagaacttttgatttgaagtatttatgcaaaagtataccagctctctttgggggagaacttgaatatatgaaacggatgtggcttacttgaagaattttgaaataaccttgtgttcatagcatgatagtgagtcctgagtctctgtgcccagagctctgattrgactccaaagacctgaatttatatcatattcccagttactgttatacttatatcgttagatttttacattccattttagtatctcagtgtttatttcttatcgttaaagatgattttgtggttttgagttttgccttttaagtgtgggtttctgatatgctgaaatcccaaggcagtttttatttcggtgcagctttaaaattcagtggaggtcattgtccactggccggttttgaaatgatcttagttcacacccagattcttgccctttgtttagtttttcttgccttgaccgcatat

SEQ ID NO: 3906 - DNA, 601 bp, Human
atcatattcccagttactgttatacttatatcgttagatttttacattccattttagtatctcagtgtttatttcttatcgttaaagatgattttgtggttttgagttttgccttttaagtgtgggtttctgatatgctgaaatcccaaggcagtttttatttcggtgcagctttaaaattcagtggaggtcattgtccactggccggttttgaaatgatcttagttcacacccagattcttgccctttgtttagtttttcttgccttgaccgcatatgggaatagacctctcaggctctrctctgttaatttctatcacctccctacaaaggccctaactcatatcccttggtccctgtggctctgaaggtcgagttgtcacatagctctttcctccttcaaacgtactgggatggtcagtaatgagtgctgcagctgccctggtcctaggagttgctgtgagcatcctggtagtgcccagagagtacctgcttttcacactgaaccatctgggtggcctgggcccagtttttggcatttaagggccttggagggaaagggaagaaagctggaatttgagcataaattggattttgtgtg

SEQ ID NO: 3907 - DNA, 601 bp, Human
ttcttgccctttgtttagtttttcttgccttgaccgcatatgggaatagacctctcaggctctgctctgttaatttctatcacctccctacaaaggccctaactcatatcccttggtccctgtggctctgaaggtcgagttgtcacatagctctttcctccttcaaacgtactgggatggtcagtaatgagtgctgcagctgccctggtcctaggagttgctgtgagcatcctggtagtgcccagagagtacctgcttttcacactgaaccatctgggtggcctgggcccagtttttggcrtttaagggccttggagggaaagggaagaaagctggaatttgagcataaattggattttgtgtgggctgagggtcctcctaggtgtagactgtccctcctggacctgtacccactctgctagctcaggagccaaccatgtcctgaacagcttagaccagcacccagaccctaaatgacctagattaggaagtagataggttgttctctgctgtcattgtttggacacagctctatttaccttatttattgttcctgctaggcacagcctcagctaatgggctgtgatctcctgcctttaag

SEQ ID NO: 3908 - DNA, 601 bp, Human
ttaggaagtagataggttgttctctgctgtcattgtttggacacagctctatttaccttatttattgttcctgctaggcacagcctcagctaatgggctgtgatctcctgcctttaaggctggttccaggcgaattaagagcctttgcttgtttcccaaaccagggagggcagctttaccttgaggatgaaggcgcctccagttgctgaatgtggttggggttactgtgttctctcatcaaggtgtagctttaccttacctttcggtgatgggttctgccaccttatcgcggtgggtcccrggagaccgggcgcaactggagcaggggcgccctctgctgctgggtgtcagctcttcctcccacggctgcccaggggatttgcaaggggcggtggaacactcctgcttcctccatcccctgtgggaccacctgaggtggaggaaggacagtgccaggaccatgtgcaggctgagctcgcccagaggcggtgcaacagctaacgttattctctgtgggtacatttctcttgtcgtttgcaggtctcttttcgaatctgttgtcctttttccccaaaccagcctgctgcccccatcctgccat

SEQ ID NO: 3909 - DNA, 601 bp, Human
ccctctgctgctgggtgtcagctcttcctcccacggctgcccaggggatttgcaaggggcggtggaacactcctgcttcctccatcccctgtgggaccacctgaggtggaggaaggacagtgccaggaccatgtgcaggctgagctcgcccagaggcggtgcaacagctaacgttattctctgtgggtacatttctcttgtcgtttgcaggtctcttttcgaatctgttgtcctttttccccaaaccagcctgctgcccccatcctgccatgtggtctgctgtcatctgcagtagccgccrcatgtaagacacgaggacctcttctgcaagagcttggtgtgggcatttgtgaaattttgtcaccacagcccctgtaaccagccaacaaattcgagttaaatgcctattctttgtcccacacgtattagttacagagagtggagaacaagtggcagatagaggctgagggaagccaacccactctgagggactgggcatgtaaatgggacaacctccacagctttttaaaccacaggacacccaaaagcagctgtaccctgcaggacacagcaggctacagaagcctggggttcagagggt

SEQ ID NO: 3910 - DNA, 601 bp, Human
ttcctcccacggctgcccaggggatttgcaaggggcggtggaacactcctgcttcctccatcccctgtgggaccacctgaggtggaggaaggacagtgccaggaccatgtgcaggctgagctcgcccagaggcggtgcaacagctaacgttattctctgtgggtacatttctcttgtcgtttgcaggtctcttttcgaatctgttgtcctttttccccaaaccagcctgctgcccccatcctgccatgtggtctgctgtcatctgcagtagccgccgcatgtaagacacgaggacctcttytgcaagagcttggtgtgggcatttgtgaaattttgtcaccacagcccctgtaaccagccaacaaattcgagttaaatgcctattctttgtcccacacgtattagttacagagagtggagaacaagtggcagatagaggctgagggaagccaacccactctgagggactgggcatgtaaatgggacaacctccacagctttttaaaccacaggacacccaaaagcagctgtaccctgcaggacacagcaggctacagaagcctggggttcagagggtctctgacccttcgtcctttagcgc

SEQ ID NO: 3911 - DNA, 601 bp, Human
actggagggaaaaaaaaaaagaattggaaagaggccaaggctgcaagtgaataattcagtcgagttgtatcttacttaccattaggttctctcaattagtatataaactgaaaatctaagatatagtcagaattacccttgaaaactacctcaggaaggcacagtgttagaaactgacatattattgcttattacatttagtgtggccattttttccttccattgtcacaagtatttggtttcttctcttgagtttcatatgatatccctggcatcataggggcttagaggttgtattctwtgaagagggtgtcttttaaacaccagatcatacccagcaagaaatgctgatactatgagagacaggcctattttcctcgttttggtatcccctctttggcttcccctgtttagttgtgtttgtgcgttttgcatgaaccagccataggactctacatttgttctcactcactgcctaagctgttgaagaattagtggactcctagacaaagaataatcccactatctcctagttctgactgatttaactgttaaacgtatattaaattcaaatctccaaattgtctctgtttcatcaaca

SEQ ID NO: 3912 - DNA, 601 bp, Human; identical to SEQ ID NO: 1099

SEQ ID NO: 3913 - DNA, 601 bp, Human; identical to SEQ ID NO: 1100

SEQ ID NO: 3914 - DNA, 601 bp, Human; identical to SEQ ID NO: 1101

SEQ ID NO: 3915 - DNA, 601 bp, Human; identical to SEQ ID NO: 1102

SEQ ID NO: 3916 - DNA, 601 bp, Human; identical to SEQ ID NO: 1103

SEQ ID NO: 3917 - DNA, 601 bp, Human; identical to SEQ ID NO: 1104

SEQ ID NO: 3918 - DNA, 601 bp, Human; identical to SEQ ID NO: 1105

SEQ ID NO: 3919 - DNA, 601 bp, Human; identical to SEQ ID NO: 1106

SEQ ID NO: 3920 - DNA, 601 bp, Human; identical to SEQ ID NO: 1107

SEQ ID NO: 3921 - DNA, 601 bp, Human; identical to SEQ ID NO: 1108

SEQ ID NO: 3922 - DNA, 601 bp, Human; identical to SEQ ID NO: 1109

SEQ ID NO: 3923 - DNA, 601 bp, Human; identical to SEQ ID NO: 1110

SEQ ID NO: 3924 - DNA, 601 bp, Human; identical to SEQ ID NO: 1111

SEQ ID NO: 3925 - DNA, 601 bp, Human; identical to SEQ ID NO: 1112

SEQ ID NO: 3926 - DNA, 601 bp, Human; identical to SEQ ID NO: 1113

SEQ ID NO: 3927 - DNA, 601 bp, Human; identical to SEQ ID NO: 1114

SEQ ID NO: 3928 - DNA, 601 bp, Human; identical to SEQ ID NO: 1115

SEQ ID NO: 3929 - DNA, 601 bp, Human; identical to SEQ ID NO: 1116

SEQ ID NO: 3930 - DNA, 601 bp, Human; identical to SEQ ID NO: 1117

SEQ ID NO: 3931 - DNA, 601 bp, Human; identical to SEQ ID NO: 1118

SEQ ID NO: 3932 - DNA, 601 bp, Human; identical to SEQ ID NO: 1119

SEQ ID NO: 3933 - DNA, 601 bp, Human; identical to SEQ ID NO: 1120

SEQ ID NO: 3934 - DNA, 601 bp, Human; identical to SEQ ID NO: 1121

SEQ ID NO: 3935 - DNA, 601 bp, Human; identical to SEQ ID NO: 1122

SEQ ID NO: 3936 - DNA, 601 bp, Human; identical to SEQ ID NO: 1123

SEQ ID NO: 3937 - DNA, 601 bp, Human; identical to SEQ ID NO: 1124

SEQ ID NO: 3938 - DNA, 601 bp, Human; identical to SEQ ID NO: 1125

SEQ ID NO: 3939 - DNA, 601 bp, Human; identical to SEQ ID NO: 1126

SEQ ID NO: 3940 - DNA, 601 bp, Human; identical to SEQ ID NO: 1127

SEQ ID NO: 3941 - DNA, 601 bp, Human; identical to SEQ ID NO: 1128

SEQ ID NO: 3942 - DNA, 601 bp, Human; identical to SEQ ID NO: 1129

SEQ ID NO: 3943 - DNA, 601 bp, Human; identical to SEQ ID NO: 1130

SEQ ID NO: 3944 - DNA, 601 bp, Human; identical to SEQ ID NO: 1131

SEQ ID NO: 3945 - DNA, 601 bp, Human; identical to SEQ ID NO: 1132

SEQ ID NO: 3946 - DNA, 601 bp, Human; identical to SEQ ID NO: 1133

SEQ ID NO: 3947 - DNA, 601 bp, Human; identical to SEQ ID NO: 1134

SEQ ID NO: 3948 - DNA, 601 bp, Human; identical to SEQ ID NO: 1135

SEQ ID NO: 3949 - DNA, 601 bp, Human; identical to SEQ ID NO: 1136

SEQ ID NO: 3950 - DNA, 601 bp, Human; identical to SEQ ID NO: 1137

SEQ ID NO: 3951 - DNA, 601 bp, Human; identical to SEQ ID NO: 1138

SEQ ID NO: 3952 - DNA, 601 bp, Human; identical to SEQ ID NO: 1139

SEQ ID NO: 3953 - DNA, 601 bp, Human; identical to SEQ ID NO: 1140

SEQ ID NO: 3954 - DNA, 601 bp, Human; identical to SEQ ID NO: 1141

SEQ ID NO: 3955 - DNA, 601 bp, Human; identical to SEQ ID NO: 1142

SEQ ID NO: 3956 - DNA, 601 bp, Human; identical to SEQ ID NO: 1143

SEQ ID NO: 3957 - DNA, 601 bp, Human; identical to SEQ ID NO: 1144

SEQ ID NO: 3958 - DNA, 601 bp, Human; identical to SEQ ID NO: 3085

SEQ ID NO: 3959 - DNA, 601 bp, Human; identical to SEQ ID NO: 3086

SEQ ID NO: 3960 - DNA, 601 bp, Human; identical to SEQ ID NO: 3087

SEQ ID NO: 3961 - DNA, 601 bp, Human; identical to SEQ ID NO: 3088

SEQ ID NO: 3962 - DNA, 601 bp, Human; identical to SEQ ID NO: 3089

SEQ ID NO: 3963 - DNA, 601 bp, Human; identical to SEQ ID NO: 3090

SEQ ID NO: 3964 - DNA, 601 bp, Human; identical to SEQ ID NO: 3091

SEQ ID NO: 3965 - DNA, 601 bp, Human; identical to SEQ ID NO: 3092

SEQ ID NO: 3966 - DNA, 601 bp, Human; identical to SEQ ID NO: 3093

SEQ ID NO: 3967 - DNA, 601 bp, Human; identical to SEQ ID NO: 3094

SEQ ID NO: 3968 - DNA, 601 bp, Human; identical to SEQ ID NO: 3095

SEQ ID NO: 3969 - DNA, 601 bp, Human; identical to SEQ ID NO: 3096

SEQ ID NO: 3970 - DNA, 601 bp, Human; identical to SEQ ID NO: 3097

SEQ ID NO: 3971 - DNA, 601 bp, Human; identical to SEQ ID NO: 3098

SEQ ID NO: 3972 - DNA, 601 bp, Human; identical to SEQ ID NO: 3099

SEQ ID NO: 3973 - DNA, 601 bp, Human; identical to SEQ ID NO: 3100

SEQ ID NO: 3974 - DNA, 601 bp, Human
gcctgggtgacagagtaaaactttgtctctaaaaaacagaaatatccctctttatccttgatagtattttttaggcctttattagttttttcatgttacatcttttagattattttctttttaatctatctgtgactatatttaaagtcaattcttgttttttccttttcctttttgtgggtaacggggtctcactatgttgcccaggcagatctcaaactcctgggctcaagctgtcctcccacctctgccaccctaagtgttgagattacaggcatgagccactgcacccagccttaargtgaattgttataggcaacaacacagtggggtcttttattttattttttatttgtttatgagacagactcgctctgttgcctacgctggagtgcagtggtgcagtcttgactcactgcagcctggacttcccaggctcaagcaatcctcccacctcagactcctgagtagctgggactacaggcacatgccaccaagcctggctaagtttgttagttttttatagagacaaggtctcactatgttgcccagtctgatctcgaacacctagccacaagcaattctcctgccttgtcttccc

SEQ ID NO: 3975 - DNA, 601 bp, Human
ctgggctcaagctgtcctcccacctctgccaccctaagtgttgagattacaggcatgagccactgcacccagccttaaagtgaattgttataggcaacaacacagtggggtcttttattttattttttatttgtttatgagacagactcgctctgttgcctacgctggagtgcagtggtgcagtcttgactcactgcagcctggacttcccaggctcaagcaatcctcccacctcagactcctgagtagctgggactacaggcacatgccaccaagcctggctaagtttgttagttttttrtagagacaaggtctcactatgttgcccagtctgatctcgaacacctagccacaagcaattctcctgccttgtcttcccagagtgctgggattacaggtgtggaccactgaacccagcaggtcttgctttttttttgagatggaggtgtgagccaccacatccagccaggttttctctttttttttttttttgagacggagtcttgctctgtcgcccaggctggagtgcagtggcacgatcttggctcactgcaagctccgcctcctgggttcacaccattctcctgcctcagcctcgcga

SEQ ID NO: 3976 - DNA, 601 bp, Human
ggtgcagtcttgactcactgcagcctggacttcccaggctcaagcaatcctcccacctcagactcctgagtagctgggactacaggcacatgccaccaagcctggctaagtttgttagttttttatagagacaaggtctcactatgttgcccagtctgatctcgaacacctagccacaagcaattctcctgccttgtcttcccagagtgctgggattacaggtgtggaccactgaacccagcaggtcttgctttttttttgagatggaggtgtgagccaccacatccagccaggttttctytttttttttttttttgagacggagtcttgctctgtcgcccaggctggagtgcagtggcacgatcttggctcactgcaagctccgcctcctgggttcacaccattctcctgcctcagcctcgcgagtagctgggactacaggcaccccgccaccacacctggctaattttttgtatttttagtagagacggggtttcaccgtgttagccaggatggtctcgatctcctgacctcatgatccacctgccttggcctcccaaagtgctgggattacaggcgtaagccaccacgcctggccagg

SEQ ID NO: 3977 - DNA, 601 bp, Human
cactgcagcctggacttcccaggctcaagcaatcctcccacctcagactcctgagtagctgggactacaggcacatgccaccaagcctggctaagtttgttagttttttatagagacaaggtctcactatgttgcccagtctgatctcgaacacctagccacaagcaattctcctgccttgtcttcccagagtgctgggattacaggtgtggaccactgaacccagcaggtcttgctttttttttgagatggaggtgtgagccaccacatccagccaggttttctctttttttttttttttgagacggagtcttgctctgtcgcccaggctggagtgcagtggcacgatcttggctcactgcaagctccgcctcctgggttcacaccattctcctgcctcagcctcgcgagtagctgggactacaggcaccccgccaccacacctggctaattttttgtatttttagtagagacggggtttcaccgtgttagccaggatggtctcgatctcctgacctcatgatccacctgccttggcctcccaaagtgctgggattacaggcgtaagccaccacgcctggccaggtcttgctttttaaga

SEQ ID NO: 3978 - DNA, 601 bp, Human
tgcccagtctgatctcgaacacctagccacaagcaattctcctgccttgtcttcccagagtgctgggattacaggtgtggaccactgaacccagcaggtcttgctttttttttgagatggaggtgtgagccaccacatccagccaggttttctctttttttttttttttgagacggagtcttgctctgtcgcccaggctggagtgcagtggcacgatcttggctcactgcaagctccgcctcctgggttcacaccattctcctgcctcagcctcgcgagtagctgggactacaggcaccccgccaccacacctggctaattttttgtatttttagtagagacggggtttcaccgtgttagccaggatggtctcgatctcctgacctcatgatccacctgccttggcctcccaaagtgctgggattacaggcgtaagccaccacgcctggccaggtcttgctttttaagagtctgacaataactgctttctaattggaatgtttagaacgtttaaatttaatgcaattatgaatatggttggatttaaacctattttaccatttgctttctatttatttcatcacttctttgtttctttttc

SEQ ID NO: 3979 - DNA, 601 bp, Human
accacatccagccaggttttctctttttttttttttttgagacggagtcttgctctgtcgcccaggctggagtgcagtggcacgatcttggctcactgcaagctccgcctcctgggttcacaccattctcctgcctcagcctcgcgagtagctgggactacaggcaccccgccaccacacctggctaattttttgtatttttagtagagacggggtttcaccgtgttagccaggatggtctcgatctcctgacctcatgatccacctgccttggcctcccaaagtgctgggattacaggcrtaagccaccacgcctggccaggtcttgctttttaagagtctgacaataactgctttctaattggaatgtttagaacgtttaaatttaatgcaattatgaatatggttggatttaaacctattttaccatttgctttctatttatttcatcacttctttgtttctttttcttttcctgacttcctagggtttagggtttttttttttttcttttttctaccccctccttgagtatttttttttgtactccattttatttctgtcagcttattagctattaatccttattttacctttttac

SEQ ID NO: 3980 - DNA, 601 bp, Human
ggttttctctttttttttttttttgagacggagtcttgctctgtcgcccaggctggagtgcagtggcacgatcttggctcactgcaagctccgcctcctgggttcacaccattctcctgcctcagcctcgcgagtagctgggactacaggcaccccgccaccacacctggctaattttttgtatttttagtagagacggggtttcaccgtgttagccaggatggtctcgatctcctgacctcatgatccacctgccttggcctcccaaagtgctgggattacaggcgtaagccaccacgcytggccaggtcttgctttttaagagtctgacaataactgctttctaattggaatgtttagaacgtttaaatttaatgcaattatgaatatggttggatttaaacctattttaccatttgctttctatttatttcatcacttctttgtttctttttcttttcctgacttcctagggtttagggtttttttttttttcttttttctaccccctccttgagtatttttttttgtactccattttatttctgtcagcttattagctattaatccttattttacctttttactacttgctctagag

SEQ ID NO: 3981 - DNA, 601 bp, Human; identical to SEQ ID NO: 3101

SEQ ID NO: 3982 - DNA, 601 bp, Human; identical to SEQ ID NO: 3102

SEQ ID NO: 3983 - DNA, 601 bp, Human; identical to SEQ ID NO: 3103

SEQ ID NO: 3984 - DNA, 601 bp, Human; identical to SEQ ID NO: 3104

SEQ ID NO: 3985 - DNA, 601 bp, Human; identical to SEQ ID NO: 3105

SEQ ID NO: 3986 - DNA, 601 bp, Human; identical to SEQ ID NO: 3106

SEQ ID NO: 3987 - DNA, 601 bp, Human; identical to SEQ ID NO: 3107

SEQ ID NO: 3988 - DNA, 601 bp, Human; identical to SEQ ID NO: 3108

SEQ ID NO: 3989 - DNA, 601 bp, Human; identical to SEQ ID NO: 3109

SEQ ID NO: 3990 - DNA, 601 bp, Human; identical to SEQ ID NO: 3110

SEQ ID NO: 3991 - DNA, 601 bp, Human; identical to SEQ ID NO: 3111

SEQ ID NO: 3992 - DNA, 601 bp, Human
tggtgcgcctgggttgacagccattggtcaggtgcctgcagagtacagggcgccatactgggaactggaactataaataaatactctggggaccctaatatccagagacctaacccatctacgggaggaacaaggcttgaagttagggaactgtctagcaaagctgcttgcacaactgctaagtgtacggaattccaggaaaaagaaaaattgcttccagttggggtgtccttcatggaaaaggcatttgggcagccctgtgggggtagcaggagcattccaggtggtggaaagggcctgmgccaaggtccttaagtgggacagggtacggtgtgtggccggaatggagggtctgtgtaataggacagtgagaaaagatgccagaagcggggatgggactctgctgtgcgtggcgtgggagccaagctctgactttcactgcacagtgaagcaactgtaagtcaggagcagaagcacggcctggctccagggagggctgaagagagacacttgctgttcatatttgtctgcagtctctcgttctcttccttcctctctctctcttctgtatacacctgcctcacagacagctcttctccag

SEQ ID NO: 3993 - DNA, 601 bp, Human
cctaacccatctacgggaggaacaaggcttgaagttagggaactgtctagcaaagctgcttgcacaactgctaagtgtacggaattccaggaaaaagaaaaattgcttccagttggggtgtccttcatggaaaaggcatttgggcagccctgtgggggtagcaggagcattccaggtggtggaaagggcctgagccaaggtccttaagtgggacagggtacggtgtgtggccggaatggagggtctgtgtaataggacagtgagaaaagatgccagaagcggggatgggactctgctgtgygtggcgtgggagccaagctctgactttcactgcacagtgaagcaactgtaagtcaggagcagaagcacggcctggctccagggagggctgaagagagacacttgctgttcatatttgtctgcagtctctcgttctcttccttcctctctctctcttctgtatacacctgcctcacagacagctcttctccagagatagacagctctgggctccattgactagttcttttaaaaagaaagaaaacacatccttcaaatttctgtccctcactggtgttttagtggatgcaatgtggtatag

SEQ ID NO: 3994 - DNA, 601 bp, Human
aaaaagaaaaattgcttccagttggggtgtccttcatggaaaaggcatttgggcagccctgtgggggtagcaggagcattccaggtggtggaaagggcctgagccaaggtccttaagtgggacagggtacggtgtgtggccggaatggagggtctgtgtaataggacagtgagaaaagatgccagaagcggggatgggactctgctgtgcgtggcgtgggagccaagctctgactttcactgcacagtgaagcaactgtaagtcaggagcagaagcacggcctggctccagggagggctgragagagacacttgctgttcatatttgtctgcagtctctcgttctcttccttcctctctctctcttctgtatacacctgcctcacagacagctcttctccagagatagacagctctgggctccattgactagttcttttaaaaagaaagaaaacacatccttcaaatttctgtccctcactggtgttttagtggatgcaatgtggtatagtgaggggagggaaggccacagaggtggccagaggacctggatttgcaggcagcatcgcacttactgtctctgcagtcgggctttgaggctg

SEQ ID NO: 3995 - DNA, 601 bp, Human
tgggcagccctgtgggggtagcaggagcattccaggtggtggaaagggcctgagccaaggtccttaagtgggacagggtacggtgtgtggccggaatggagggtctgtgtaataggacagtgagaaaagatgccagaagcggggatgggactctgctgtgcgtggcgtgggagccaagctctgactttcactgcacagtgaagcaactgtaagtcaggagcagaagcacggcctggctccagggagggctgaagagagacacttgctgttcatatttgtctgcagtctctcgttctcttcyttcctctctctctcttctgtatacacctgcctcacagacagctcttctccagagatagacagctctgggctccattgactagttcttttaaaaagaaagaaaacacatccttcaaatttctgtccctcactggtgttttagtggatgcaatgtggtatagtgaggggagggaaggccacagaggtggccagaggacctggatttgcaggcagcatcgcacttactgtctctgcagtcgggctttgaggctgcctgggcctgggttccctcatttccacaaaggcaggactgggtgagcct

SEQ ID NO: 3996 - DNA, 601 bp, Human
cttactgtctctgcagtcgggctttgaggctgcctgggcctgggttccctcatttccacaaaggcaggactgggtgagccttctcaaagtaagtccatgccaccttccagaatgtaagtgtctgtccaaagcccagttcgatttagccttccataactatcctcagacagggaggaggcttctgcacacctggcctgttcctagctcagtgctggagcacaggatgcgggggctatttgatacatatgtgttgactgaacaaaagaatgcatgaatgaaggaaagaacggtcagctctgcytggaaggtagtggcaagctgagaccaaccatagcaatggttccagatgcttggggttagcacctcaaaacccagatgactgatttccccacagaaatcattacacgagaaaccatcaataattgcatttccctgggagtttccttttggttagccgttctcgctgcctaggcttcatgcaggtttcccatgaccgccagcctggaggaatgcccataggaaagacagcagcaacttaagagttggtcagggtaaatgttaacacgtaatttcatagacaggatgtgtatttcattacaga

SEQ ID NO: 3997 - DNA, 601 bp, Human
ggtaaatgttaacacgtaatttcatagacaggatgtgtatttcattacagagtcttttttcctgagcgtttgcggttttgacttgtggttgtagaacagctgctcagtttaacccctttatcttttgcttgccagaagccactttcatcatgccactcttccagaggctacaaagttgtgttctttgtgccaggcactgtgccggtggctcacaagtattccttcatcccatactcaacgacagcttacaaggttggcaggatgaacctgcttttgagaggctgggttattggcccaaggwcgcacagctaatgagtgctaaggtgagattgaaagcaggctgtgcttgtaagttcaaagcccactttctctgtcaggcactcagtagtgttcactgaggcacagaattgaatacaatcttccatttcttcctcttaaccttcaccttgtgggtagagaatagtggcctattggaggtatcccttatttatttatttatttatttatattttgagagagttttgctctgtcgcccaggctggagtgcagtggtgcgatctcagctcactgcaacctccgcctcccgagttcaagcaattct

SEQ ID NO: 3998 - DNA, 601 bp, Human
catttcttcctcttaaccttcaccttgtgggtagagaatagtggcctattggaggtatcccttatttatttatttatttatttatattttgagagagttttgctctgtcgcccaggctggagtgcagtggtgcgatctcagctcactgcaacctccgcctcccgagttcaagcaattcttgtgcctcagcctcccgagtcattgggattacaggcgcccaccactacacccagccgatttttgttttttgtttttttgacacagaaagacactgtcgcccaggctacagtgcagtggcatratctcggctcactgcaacatccacctcccaggtttgagcgattcttctgcctcagcctcccaagtagctgggactagcaggcatgcaccatgatgcccagctaatttttgttatttttagtagagatggggtttcaccatattggccaggctgatctggaactcctgacctcaagtgttctgcccacctcggcctcccaaagtgctgggattacaggtgtgagccaccgcacctggccaatttttttatttttatttttattttgagacaaggtctcactctgtcatccagattggagtg

SEQ ID NO: 3999 - DNA, 601 bp, Human
tgctagttttaaagaatgggcagtggccccacgcctgtaatcctagcattttgggaggctgaggcaagggaatcacttaagcccaggagttcaagaccagtctgggcaacatggcaaaaccctgtctctacaaaaaatacaaaaattagccaggtgtggtggcgcatgtctctagtctgagctactgaggaggccgaagtgggaggatctcttgcgcccaagaggtcaacactgcactgagccctgagcatgctgctgcatgacagagtgagaccctgtctcaaaaaacaaacaaacaaamaaaaaaacgaatgagaggtttgaaattagggatgactattggagaggaatttgttggacaagacaagatatgtcttagtaatatcctaagaagatcccgaacacttttttttttttgctttatttaaaatgttatgtaattctataaattttttttttcttagagacggagtctcgctctgtcacccaggctggagtgcaggggcgcaatctctgctcactgcagcttctgcctcctgggttctagcagctctcctgtctcagcctcccgagtagctgggactacaggcgcacgcctcca

SEQ ID NO: 4000 - DNA, 601 bp, Human
tgggcagtggccccacgcctgtaatcctagcattttgggaggctgaggcaagggaatcacttaagcccaggagttcaagaccagtctgggcaacatggcaaaaccctgtctctacaaaaaatacaaaaattagccaggtgtggtggcgcatgtctctagtctgagctactgaggaggccgaagtgggaggatctcttgcgcccaagaggtcaacactgcactgagccctgagcatgctgctgcatgacagagtgagaccctgtctcaaaaaacaaacaaacaaaaaaaaaaacgaatgagrggtttgaaattagggatgactattggagaggaatttgttggacaagacaagatatgtcttagtaatatcctaagaagatcccgaacacttttttttttttgctttatttaaaatgttatgtaattctataaattttttttttcttagagacggagtctcgctctgtcacccaggctggagtgcaggggcgcaatctctgctcactgcagcttctgcctcctgggttctagcagctctcctgtctcagcctcccgagtagctgggactacaggcgcacgcctccatgcctggctaattttt

SEQ ID NO: 4001 - DNA, 601 bp, Human; identical to SEQ ID NO: 3671

SEQ ID NO: 4002 - DNA, 601 bp, Human; identical to SEQ ID NO: 3672

SEQ ID NO: 4003 - DNA, 601 bp, Human; identical to SEQ ID NO: 3673

SEQ ID NO: 4004 - DNA, 601 bp, Human; identical to SEQ ID NO: 3674

SEQ ID NO: 4005 - DNA, 601 bp, Human; identical to SEQ ID NO: 3675

SEQ ID NO: 4006 - DNA, 601 bp, Human; identical to SEQ ID NO: 3676

SEQ ID NO: 4007 - DNA, 601 bp, Human; identical to SEQ ID NO: 3677

SEQ ID NO: 4008 - DNA, 601 bp, Human; identical to SEQ ID NO: 3678

SEQ ID NO: 4009 - DNA, 601 bp, Human; identical to SEQ ID NO: 3679

SEQ ID NO: 4010 - DNA, 601 bp, Human; identical to SEQ ID NO: 3680

SEQ ID NO: 4011 - DNA, 601 bp, Human; identical to SEQ ID NO: 3681

SEQ ID NO: 4012 - DNA, 601 bp, Human; identical to SEQ ID NO: 3682

SEQ ID NO: 4013 - DNA, 601 bp, Human; identical to SEQ ID NO: 3683

SEQ ID NO: 4014 - DNA, 601 bp, Human; identical to SEQ ID NO: 3684

SEQ ID NO: 4015 - DNA, 601 bp, Human; identical to SEQ ID NO: 3685

SEQ ID NO: 4016 - DNA, 601 bp, Human; identical to SEQ ID NO: 3686

SEQ ID NO: 4017 - DNA, 601 bp, Human; identical to SEQ ID NO: 3687

SEQ ID NO: 4018 - DNA, 601 bp, Human; identical to SEQ ID NO: 3688

SEQ ID NO: 4019 - DNA, 601 bp, Human; identical to SEQ ID NO: 3260

SEQ ID NO: 4020 - DNA, 601 bp, Human; identical to SEQ ID NO: 3261

SEQ ID NO: 4021 - DNA, 601 bp, Human; identical to SEQ ID NO: 3262

SEQ ID NO: 4022 - DNA, 601 bp, Human; identical to SEQ ID NO: 3263

SEQ ID NO: 4023 - DNA, 601 bp, Human; identical to SEQ ID NO: 3264

SEQ ID NO: 4024 - DNA, 601 bp, Human; identical to SEQ ID NO: 3265

SEQ ID NO: 4025 - DNA, 601 bp, Human; identical to SEQ ID NO: 2512

SEQ ID NO: 4026 - DNA, 601 bp, Human; identical to SEQ ID NO: 2513

SEQ ID NO: 4027 - DNA, 601 bp, Human; identical to SEQ ID NO: 2514

SEQ ID NO: 4028 - DNA, 601 bp, Human; identical to SEQ ID NO: 2515

SEQ ID NO: 4029 - DNA, 601 bp, Human; identical to SEQ ID NO: 2516

SEQ ID NO: 4030 - DNA, 601 bp, Human; identical to SEQ ID NO: 2517

SEQ ID NO: 4031 - DNA, 601 bp, Human; identical to SEQ ID NO: 2518

SEQ ID NO: 4032 - DNA, 601 bp, Human; identical to SEQ ID NO: 2519

SEQ ID NO: 4033 - DNA, 601 bp, Human; identical to SEQ ID NO: 2520

SEQ ID NO: 4034 - DNA, 601 bp, Human; identical to SEQ ID NO: 2521

SEQ ID NO: 4035 - DNA, 601 bp, Human; identical to SEQ ID NO: 2522

SEQ ID NO: 4036 - DNA, 601 bp, Human; identical to SEQ ID NO: 2523

SEQ ID NO: 4037 - DNA, 601 bp, Human; identical to SEQ ID NO: 2524

SEQ ID NO: 4038 - DNA, 601 bp, Human; identical to SEQ ID NO: 2525

SEQ ID NO: 4039 - DNA, 601 bp, Human; identical to SEQ ID NO: 2526

SEQ ID NO: 4040 - DNA, 601 bp, Human; identical to SEQ ID NO: 2527

SEQ ID NO: 4041 - DNA, 601 bp, Human; identical to SEQ ID NO: 2528

SEQ ID NO: 4042 - DNA, 601 bp, Human; identical to SEQ ID NO: 2529

SEQ ID NO: 4043 - DNA, 601 bp, Human; identical to SEQ ID NO: 2530

SEQ ID NO: 4044 - DNA, 601 bp, Human; identical to SEQ ID NO: 2531

SEQ ID NO: 4045 - DNA, 601 bp, Human; identical to SEQ ID NO: 2532

SEQ ID NO: 4046 - DNA, 601 bp, Human; identical to SEQ ID NO: 2533

SEQ ID NO: 4047 - DNA, 601 bp, Human; identical to SEQ ID NO: 2534

SEQ ID NO: 4048 - DNA, 601 bp, Human; identical to SEQ ID NO: 2535

SEQ ID NO: 4049 - DNA, 601 bp, Human; identical to SEQ ID NO: 2536

SEQ ID NO: 4050 - DNA, 601 bp, Human; identical to SEQ ID NO: 2537

SEQ ID NO: 4051 - DNA, 601 bp, Human; identical to SEQ ID NO: 2538

SEQ ID NO: 4052 - DNA, 601 bp, Human; identical to SEQ ID NO: 2539

SEQ ID NO: 4053 - DNA, 601 bp, Human; identical to SEQ ID NO: 2540

SEQ ID NO: 4054 - DNA, 601 bp, Human; identical to SEQ ID NO: 2541

SEQ ID NO: 4055 - DNA, 601 bp, Human; identical to SEQ ID NO: 2542

SEQ ID NO: 4056 - DNA, 601 bp, Human; identical to SEQ ID NO: 2543

SEQ ID NO: 4057 - DNA, 601 bp, Human; identical to SEQ ID NO: 2544

SEQ ID NO: 4058 - DNA, 601 bp, Human; identical to SEQ ID NO: 2545

SEQ ID NO: 4059 - DNA, 601 bp, Human; identical to SEQ ID NO: 2301

SEQ ID NO: 4060 - DNA, 601 bp, Human; identical to SEQ ID NO: 2302

SEQ ID NO: 4061 - DNA, 601 bp, Human; identical to SEQ ID NO: 2303

SEQ ID NO: 4062 - DNA, 601 bp, Human
accctgtggagtcccacccacaaccagcacactgtgacccactgcacaaacctctagcccacagctcacttcctcctttaagaagagaagagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaaggtaagagagccctaatggcrgcttgcacgctatagagttcctaagttctctctttctctattttcttttctgcctgctttacatctgctgttacctttctactgagataaaaaccactgtttagatccaaattttttttgcaagctggtaaatttatattaatatctcatggctagagttttgaagtaaaagctacaggatgtctgtgtgtgtgtgtgtgtgtgtgtgtgtgtgtgtgtgtgtggtgtgtgtgtgtttaaaagcctttatgatagatttctataattttatgtttaattggcagtgaacccattttaatt

SEQ ID NO: 4063 - DNA, 601 bp, Human
ccccttgtgggcactccattggttttatggcgcctctactttctggagtttgtgtaaaacaaaaatattatggtctttgtgcacatttacatcaaggtaagagagccctaatggcagcttgcacgctatagagttcctaagttctctctttctctattttcttttctgcctgctttacatctgctgttacctttctactgagataaaaaccactgtttagatccaaattttttttgcaagctggtaaatttatattaatatctcatggctagagttttgaagtaaaagctacaggatgtcggtgtgtgtgtgtgtgtgtgtgtgtgtgtgtgtgtgtgtggtgtgtgtgtgtttaaaagcctttatgatagatttctataattttatgtttaattggcagtgaacccattttaatttccctctaacacaccagacttcttcctctgtactttgagatgtaagttttgctgattttttctcctaaaaagtgtttcctgtaacatggaaatttagggttatttagctgacaactgcctggggtaaggaaacaggttatgaagagtttgaaagggttgggcgtggtggctcacacttgtattcc

SEQ ID NO: 4064 - DNA, 601 bp, Human
gctgattttttctcctaaaaagtgtttcctgtaacatggaaatttagggttatttagctgacaactgcctggggtaaggaaacaggttatgaagagtttgaaagggttgggcgtggtggctcacacttgtattcccagcactttgggaagctgaggtaggtgactcatgtgagatcaggagttcaagaccagcctggccaacatggtgaatccctgtctctactaaaaatgcaaaacttagccaggcagtagtggcacactcgtaatcccagctacttgggagactgagacaggagaatcrcttcagcatgggagatgtaggttgcagtgagctgggatcatgccactgcattccagtctgggtgacagagtgagcccctgcctcaaaaaaaaaaaaaaagaaaaaaagaaaaaaagaaaaaaaaagagtttgaaagtttgagatagaaaaaaagaggttttttgaatctataagatgtactactatcagcatgcctaatgcgtccatgaatctgtgtgtggtgtacataatgtttcactactaaaaatatacaaaagagctctaattaattggcttaaagagaataaaagtgcttaaatc

SEQ ID NO: 4065 - DNA, 601 bp, Human
aaaaaaagagtttgaaagtttgagatagaaaaaaagaggttttttgaatctataagatgtactactatcagcatgcctaatgcgtccatgaatctgtgtgtggtgtacataatgtttcactactaaaaatatacaaaagagctctaattaattggcttaaagagaataaaagtgcttaaatcaaatactttatcaggacaagatgcttcttcaagttcacttaagtaaaatctttaataaataagctggctttaaaattattggtaaaataagattagaaatgtcttaagaattgttagcrtttttgtttgcacttattgcacaagtggttttgtgcttatccctgcagaatagtataagattttccataagggttataaaactataaacctggccgggcacggtggctcacgcctgtaaccccagcactttgggaggccgaggctggtggatcacctgaggttgggagttcaagagcagcctgacacacacaaaacaaaattataaacccagcccaaaacagaatgatctttgcttgtataatttttaataaataagccatgtaatattgttggttaaataaaaacagctaactactgag

SEQ ID NO: 4066 - DNA, 601 bp, Human
cctgcagaatagtataagattttccataagggttataaaactataaacctggccgggcacggtggctcacgcctgtaaccccagcactttgggaggccgaggctggtggatcacctgaggttgggagttcaagagcagcctgacacacacaaaacaaaattataaacccagcccaaaacagaatgatctttgcttgtataatttttaataaataagccatgtaatattgttggttaaataaaaacagctaactactgagatattggttaaaaaaaataactttatatttaaccataagttyccttacttaggtaaacacctgaaattcatagtttataacattggttaacagggaattaactttaagtgatgactgtcacagtgttcataaataatctaggtaaactattaaataagtttatcaagtaaatgcaatggaataaatgcctataaacaaacttgtcacataatttacaatctaaagttatattaaataatagatattaattgactagctgggtaatttataatttaaaaattacaggaaaacatttttaaaaaacaattcttattaaaagataaatatctgtgtttaattcaa

SEQ ID NO: 4067 - DNA, 601 bp, Human
ataagccatgtaatattgttggttaaataaaaacagctaactactgagatattggttaaaaaaaataactttatatttaaccataagtttccttacttaggtaaacacctgaaattcatagtttataacattggttaacagggaattaactttaagtgatgactgtcacagtgttcataaataatctaggtaaactattaaataagtttatcaagtaaatgcaatggaataaatgcctataaacaaacttgtcacataatttacaatctaaagttatattaaataatagatattaattgaytagctgggtaatttataatttaaaaattacaggaaaacatttttaaaaaacaattcttattaaaagataaatatctgtgtttaattcaaagcttttttaaaagttatgtataaaacaagataaatggaaacaggaaataagagatgtaaagacagttataaatataaagaggaattttggtaaaaaagatgaaaaggaaagtaattttacacaagaaagtcttatgtagtgaatttttgtcctgaaataaaataactgatagttcaagaaagagggatatttaggacaaaacaggcagtt

SEQ ID NO: 4068 - DNA, 601 bp, Human
tgtttgtgtgttcttaatttgattctcagcttgaacggtactgatgtatagaaaagctactgatttttgtagcttgatttttttatccagagactttactgaagtcacttaccaagtctacgagtcttctggaagaatcttcagggttttctgggtatatgatcgtgtcatcagcacacacagataatttcactttctcttttccaatgtggatgcactttctttctttctgttgcctgattgctctggctaggacttccagtactgtgttgaataggagtggtgagagtggacatccttrtcctgttccatttcttggggaaatgctttcacttctccccattcaattttaaggttggctgtgcgtttgtcatataaggctcttattttggggtatgtttctttcatgcctagtctgttgagggattttatcatgaagggatattggactttctcgaacgctttatctgcatctattgagatgaccatatgctttttgttcttagtttatgtcatgagtcacttttattggcttgcatatattgaaccatcctttcatccctggaatcaagccaacttgatcatgatgaattatgttttt

SEQ ID NO: 4069 - DNA, 601 bp, Human
cttgatttttttatccagagactttactgaagtcacttaccaagtctacgagtcttctggaagaatcttcagggttttctgggtatatgatcgtgtcatcagcacacacagataatttcactttctcttttccaatgtggatgcactttctttctttctgttgcctgattgctctggctaggacttccagtactgtgttgaataggagtggtgagagtggacatccttatcctgttccatttcttggggaaatgctttcacttctccccattcaattttaaggttggctgtgcgtttgtcwtataaggctcttattttggggtatgtttctttcatgcctagtctgttgagggattttatcatgaagggatattggactttctcgaacgctttatctgcatctattgagatgaccatatgctttttgttcttagtttatgtcatgagtcacttttattggcttgcatatattgaaccatcctttcatccctggaatcaagccaacttgatcatgatgaattatgtttttgatacactgttagattccgtttaatagcattttcttgaggatttttgcacctgtgttcctcaggtttcttgg

SEQ ID NO: 4070 - DNA, 601 bp, Human
gttgcctgattgctctggctaggacttccagtactgtgttgaataggagtggtgagagtggacatccttatcctgttccatttcttggggaaatgctttcacttctccccattcaattttaaggttggctgtgcgtttgtcatataaggctcttattttggggtatgtttctttcatgcctagtctgttgagggattttatcatgaagggatattggactttctcgaacgctttatctgcatctattgagatgaccatatgctttttgttcttagtttatgtcatgagtcacttttattgrcttgcatatattgaaccatcctttcatccctggaatcaagccaacttgatcatgatgaattatgtttttgatacactgttagattccgtttaatagcattttcttgaggatttttgcacctgtgttcctcaggtttcttggcctgtagttttatttttctgttggatccctgtctgattttgctatcagggtgatattggtttcatagaatgagctaggaaagaatcccatcgccttgattttttggaatactttcattatgattggcaccagctcttcgttgtgtatatggcaaatttc

SEQ ID NO: 4071 - DNA, 601 bp, Human
cctgtctgattttgctatcagggtgatattggtttcatagaatgagctaggaaagaatcccatcgccttgattttttggaatactttcattatgattggcaccagctcttcgttgtgtatatggcaaatttcgactgtgaatccatctgttcttgggcttttttgccggaagatttttagtactgattctttttggttacttgttattggtctgtttagggtttctattttttgcctgtgcgatcttaggaagttgtatgtgtctaggaattcatccatttctctaggttttctagtttaygtgcataaaggtgttcatagtagtctctgatggtcatttgtatttctgtggcgttggttgtaatgtcaactttatcatttctgattgtgcttatttaaatcttctcctttttttggttagtgtagtcagccatctctcaattttatttatactttcaaaaaaccaacgttttctttcattgattctttgtaatgtttttgtctcaatctcattctttatctgtcctttcagagtttccattgttttcagcatccatcactagcaagccagtgcgatcctttggtggtgccacaatattca

SEQ ID NO: 4072 - DNA, 601 bp, Human
agttcccggatcacaggcccctaggtggccggctggacagcgtgtgtgagtcctgaaggggctggactgggttttggctgctccggggttcagatgctggctgtgatggggagggatgggctggtccccagggcacaggcagaaccctcaggcggggcaggcagaaggctcaggtggtagagcctgcggcagatcacagacctgtggggactgggctctcagaagggctgggggctgcagctgaaatgtccaggtgggggcagggtggctgtgctgtgggcctgtcactagggagggcagsgcccctcggctggggcactggagactggcagctgtgaggcacagggcccgctcacacttccctcctgaagaagtgtcactcggttttgctctggggacacgtgaaagtgccaggcctccccacaccctccctgggcctggggcagcaggggcagaggcagaggtggcagtgactgcaaagggcttgtcaggggcctctgagcattgggctttcagagggcactgagccagggccaccgtgttcgggtgggggcaggacgggtgactggggccctgcagctggcaagccccattagcagga

SEQ ID NO: 4073 - DNA, 601 bp, Human
gatcacaggcccctaggtggccggctggacagcgtgtgtgagtcctgaaggggctggactgggttttggctgctccggggttcagatgctggctgtgatggggagggatgggctggtccccagggcacaggcagaaccctcaggcggggcaggcagaaggctcaggtggtagagcctgcggcagatcacagacctgtggggactgggctctcagaagggctgggggctgcagctgaaatgtccaggtgggggcagggtggctgtgctgtgggcctgtcactagggagggcagcgcccctckgctggggcactggagactggcagctgtgaggcacagggcccgctcacacttccctcctgaagaagtgtcactcggttttgctctggggacacgtgaaagtgccaggcctccccacaccctccctgggcctggggcagcaggggcagaggcagaggtggcagtgactgcaaagggcttgtcaggggcctctgagcattgggctttcagagggcactgagccagggccaccgtgttcgggtgggggcaggacgggtgactggggccctgcagctggcaagccccattagcaggaaggaagcc

SEQ ID NO: 4074 - DNA, 601 bp, Human
gcggggcaggcagaaggctcaggtggtagagcctgcggcagatcacagacctgtggggactgggctctcagaagggctgggggctgcagctgaaatgtccaggtgggggcagggtggctgtgctgtgggcctgtcactagggagggcagcgcccctcggctggggcactggagactggcagctgtgaggcacagggcccgctcacacttccctcctgaagaagtgtcactcggttttgctctggggacacgtgaaagtgccaggcctccccacaccctccctgggcctggggcagcagggrcagaggcagaggtggcagtgactgcaaagggcttgtcaggggcctctgagcattgggctttcagagggcactgagccagggccaccgtgttcgggtgggggcaggacgggtgactggggccctgcagctggcaagccccattagcaggaaggaagccccatttcgcaggaagcaacagaggtgggcagctgtgtggtgctcagcttggctgctcctgtgccccagctgtcatacttattctggggcccacagaggtgcctggcctcctccctccctgctaaggcagtggcagctggaccc

SEQ ID NO: 4075 - DNA, 601 bp, Human
gactgggctctcagaagggctgggggctgcagctgaaatgtccaggtgggggcagggtggctgtgctgtgggcctgtcactagggagggcagcgcccctcggctggggcactggagactggcagctgtgaggcacagggcccgctcacacttccctcctgaagaagtgtcactcggttttgctctggggacacgtgaaagtgccaggcctccccacaccctccctgggcctggggcagcaggggcagaggcagaggtggcagtgactgcaaagggcttgtcaggggcctctgagcattggrctttcagagggcactgagccagggccaccgtgttcgggtgggggcaggacgggtgactggggccctgcagctggcaagccccattagcaggaaggaagccccatttcgcaggaagcaacagaggtgggcagctgtgtggtgctcagcttggctgctcctgtgccccagctgtcatacttattctggggcccacagaggtgcctggcctcctccctccctgctaaggcagtggcagctggacccaggctgctcagggatcagaagcctgtgggattccacgtgggctccagaggcgcctct

SEQ ID NO: 4076 - DNA, 601 bp, Human
cagctgaaatgtccaggtgggggcagggtggctgtgctgtgggcctgtcactagggagggcagcgcccctcggctggggcactggagactggcagctgtgaggcacagggcccgctcacacttccctcctgaagaagtgtcactcggttttgctctggggacacgtgaaagtgccaggcctccccacaccctccctgggcctggggcagcaggggcagaggcagaggtggcagtgactgcaaagggcttgtcaggggcctctgagcattgggctttcagagggcactgagccagggccacsgtgttcgggtgggggcaggacgggtgactggggccctgcagctggcaagccccattagcaggaaggaagccccatttcgcaggaagcaacagaggtgggcagctgtgtggtgctcagcttggctgctcctgtgccccagctgtcatacttattctggggcccacagaggtgcctggcctcctccctccctgctaaggcagtggcagctggacccaggctgctcagggatcagaagcctgtgggattccacgtgggctccagaggcgcctctgcaccatctctgggaactccctgtgcctc

SEQ ID NO: 4077 - DNA, 601 bp, Human
gaaaacactgaaaaattaacccttttgctaaagaggtagaaacaagccctcccctcaacgaaattcctgaaactctcaggttaaacttcgtaacccaatcccttcactgcagacacccaataggaaagtcacatgtgcaaggatgagatgactttggtcaagctcagaccccacagggccaggaaggcctgaaggagaggaggcccatgcttccagctctcagataagagctgcttctaaggactttttaaaaaccccacaagaaacccttccatgtccttcaccccctcctgctttgacraggtttatcactagatattctttaggatgtcaggaattcagataagatgctctcgagaaaaaacttgcccagcaacggcatctcctccaatggactgacagcaactctggctttgaacctctggaatcagggaactctgtttctaagcagctctgtcagcctctctcttgttgctgataagaacttcctttacttctgtatgtcagagagctctctctatggtgcttttcctctactctcacaccacaggaatcatcctcacagaagaagacttctaggaccagatgtgtgggatttttt

SEQ ID NO: 4078 - DNA, 601 bp, Human
tgtatcacaacatcacacttccctctccggacacactgtggcttgccatgccatgcactccagattgtaatccttgcttctcactcccaaataaactcaaaatccagacaaccctggagcaacgcagccttgaattcctggggtctcttatatgcacacttttttcaaccaaacgggggtcaaaactgtagcatttgtgggatgcaagacttgtgtatatgaacggcagacttttcctatatgcaggcccagcagagacaatgtcggggctggagtacgagcaggtgttggtgcatgtagsgggtactgaaacgaattgcctgtgtatcccaagaaacaactctactgagagatcatattctctaggggtttatttttgtttttatttttattttaagttaaagcttcgggtagaacacccagtgtctccttgtccatctgaagaagatgctgctatgtggaagcacatccttgagatccacaaggagacactgggcaaggagacgagggtgccccactgtgcagaagtctccctaataaatgatctatgaacaccctggtgtttagtgcttctttctttggaatcccagcagctctgtca

SEQ ID NO: 4079 - DNA, 601 bp, Human
cgttgaataaatataactcccccccaactccccaaatcaaagctcaaatataagtcattgttcccaaagcgttgaacagggattgaggtgcagagggacggccaagtaagcaaagggcaccgaggaggcaggaaagactcagagatttgttcccggggggtggggttggacactgtagcaaaatattttaaaaaggggaagttaagaggggactatttggttgaaagaaaacccacaatccagtgtcaagaaagaagtcaacttttcttccctatttccctgcatttctcttctgtgctcrctgccacacgcagctcagcctgggcggcacagccagatgcgagatgcgtctctgctgatctgagtctgcctgcagcatggacctgggtcttccctgaagcatctccagggctggagggacgactgccatggtaaggaccccacaacgctgagctgatggacggctgaaggagggagggtgaccatgtgggaggctgtgagaaggaaggagatgcctccgctaccctcgtcaggaagggcagacacaggaaggaaccagttttatttgctgctacatcctggctctcagtgggatgaaaac

SEQ ID NO: 4080 - DNA, 601 bp, Human
tgttcccggggggtggggttggacactgtagcaaaatattttaaaaaggggaagttaagaggggactatttggttgaaagaaaacccacaatccagtgtcaagaaagaagtcaacttttcttccctatttccctgcatttctcttctgtgctcgctgccacacgcagctcagcctgggcggcacagccagatgcgagatgcgtctctgctgatctgagtctgcctgcagcatggacctgggtcttccctgaagcatctccagggctggagggacgactgccatggtaaggaccccacaacrctgagctgatggacggctgaaggagggagggtgaccatgtgggaggctgtgagaaggaaggagatgcctccgctaccctcgtcaggaagggcagacacaggaaggaaccagttttatttgctgctacatcctggctctcagtgggatgaaaacaaaccagacagacggtggctgggggtcaggaaagggcccattaccatctgaaatgatgcagagggcctagtgactgcccccacctcagccctaatggaatgagagcaagggtcctggggagggcagttccacttcctgtgtggctgc

SEQ ID NO: 4081 - DNA, 601 bp, Human; identical to SEQ ID NO: 3412

SEQ ID NO: 4082 - DNA, 601 bp, Human; identical to SEQ ID NO: 3413

SEQ ID NO: 4083 - DNA, 601 bp, Human; identical to SEQ ID NO: 3414

SEQ ID NO: 4084 - DNA, 601 bp, Human; identical to SEQ ID NO: 3415

SEQ ID NO: 4085 - DNA, 601 bp, Human; identical to SEQ ID NO: 3416

SEQ ID NO: 4086 - DNA, 601 bp, Human; identical to SEQ ID NO: 3417

SEQ ID NO: 4087 - DNA, 601 bp, Human; identical to SEQ ID NO: 3418

SEQ ID NO: 4088 - DNA, 601 bp, Human; identical to SEQ ID NO: 2025

SEQ ID NO: 4089 - DNA, 601 bp, Human; identical to SEQ ID NO: 2026

SEQ ID NO: 4090 - DNA, 601 bp, Human; identical to SEQ ID NO: 2027

SEQ ID NO: 4091 - DNA, 601 bp, Human; identical to SEQ ID NO: 2028

SEQ ID NO: 4092 - DNA, 601 bp, Human; identical to SEQ ID NO: 2029

SEQ ID NO: 4093 - DNA, 601 bp, Human; identical to SEQ ID NO: 2030

SEQ ID NO: 4094 - DNA, 601 bp, Human; identical to SEQ ID NO: 2031

SEQ ID NO: 4095 - DNA, 601 bp, Human; identical to SEQ ID NO: 2032

SEQ ID NO: 4096 - DNA, 601 bp, Human; identical to SEQ ID NO: 2033

SEQ ID NO: 4097 - DNA, 601 bp, Human; identical to SEQ ID NO: 2034

SEQ ID NO: 4098 - DNA, 601 bp, Human; identical to SEQ ID NO: 2035

SEQ ID NO: 4099 - DNA, 601 bp, Human; identical to SEQ ID NO: 2036

SEQ ID NO: 4100 - DNA, 601 bp, Human; identical to SEQ ID NO: 2037

SEQ ID NO: 4101 - DNA, 601 bp, Human; identical to SEQ ID NO: 2038

SEQ ID NO: 4102 - DNA, 601 bp, Human; identical to SEQ ID NO: 2039

SEQ ID NO: 4103 - DNA, 601 bp, Human; identical to SEQ ID NO: 2040

SEQ ID NO: 4104 - DNA, 601 bp, Human; identical to SEQ ID NO: 2041

SEQ ID NO: 4105 - DNA, 601 bp, Human; identical to SEQ ID NO: 2042

SEQ ID NO: 4106 - DNA, 601 bp, Human; identical to SEQ ID NO: 2043

SEQ ID NO: 4107 - DNA, 601 bp, Human; identical to SEQ ID NO: 2337

SEQ ID NO: 4108 - DNA, 601 bp, Human; identical to SEQ ID NO: 2338

SEQ ID NO: 4109 - DNA, 601 bp, Human; identical to SEQ ID NO: 2339

SEQ ID NO: 4110 - DNA, 601 bp, Human; identical to SEQ ID NO: 2340

SEQ ID NO: 4111 - DNA, 601 bp, Human; identical to SEQ ID NO: 2341

SEQ ID NO: 4112 - DNA, 601 bp, Human; identical to SEQ ID NO: 2342

SEQ ID NO: 4113 - DNA, 601 bp, Human; identical to SEQ ID NO: 2343

SEQ ID NO: 4114 - DNA, 601 bp, Human; identical to SEQ ID NO: 2344

SEQ ID NO: 4115 - DNA, 601 bp, Human; identical to SEQ ID NO: 2345

SEQ ID NO: 4116 - DNA, 601 bp, Human; identical to SEQ ID NO: 2346

SEQ ID NO: 4117 - DNA, 601 bp, Human; identical to SEQ ID NO: 2347

SEQ ID NO: 4118 - DNA, 601 bp, Human
aagggcctgtgttctgtcctgtatccaagtggttaaatgggcttacttagtaagttctgtcttccttttgctgacagaataatgatgcttttctttctagaggaagaacagtcagaagatgtaggtttaggggttaactccactatctacatgccaaagaaacttgaagagggtacttaaatggtatgaacgtcaatttcctcatctgtaaaatgaaagtataacacctatctggcaaggttattgtgaggatcaaaagagattacacagttgagagtgctttgctaatgatgaagcgctrtgcaatttattatttttcctcaaacttcacagtccaggtcttagtctctcgttctgactcccctggccctgctatgggattcacagtccattccataaaacgaggaccttcactatatcctgtgtttcattattaagcaatgttttacgtcttatctttacaatgaattgttagagaggagagatcacatatcatatttattcacaatttcttaccaggtaggtgatcagtaaatactaattgacggtgtagaactgccccagcattagtggagcatagacttgggagccaggccctccc

SEQ ID NO: 4119 - DNA, 601 bp, Human
gcttcctactcagtaaatctggttcccactggtgcattcttggtcctcagagtggcttagatgggtaagtccatcttcacatgttttcttagaacgtcctgagctgagtgcccttagtataagctttatggcccaccaacactttggtatgccctaattaaattctttttaaactacattgaggagcatgaagaaagttctgccccttttttgggttaggccagggtaaaatattcagtgccctgtttttgtactctaatagggcagctatacccagagagggctgtgctgaggtaagggmtactgcttcctcatttacaattaaaaaatacattatatttttgtagcttttataataaaaattacatttttattatggtttataaggcattttaagtgctttatctctttcactaatgcctatgaggcttccagaatcagaaagcctagctccatcacttgctctgtgtgtgaccttacttaaccatgttatagctttgtttcctcatctgtgaagtggggatactatcaatattattttgttgctgtgaggattaactgagatgccacataactggcacatagtaaaccatgatgaccc

SEQ ID NO: 4120 - DNA, 601 bp, Human
ctttgttacagcagccttagcaaactcatacacagtggcaagcctctattggcagttcttattgacacacacacacactgaatcaaggactgtctactctgggagggacttcatttgttcgcccttttcattttactggggatgaaacagagacccaagagaggggaacggctggacagttctcttacaaaccgagccgagatcctgacagggcccttcctgtggtgccaggtttctactgcttcctgtccctccactcctcacaagaaccagcttcctactcagtaaatctggttcccaytggtgcattcttggtcctcagagtggcttagatgggtaagtccatcttcacatgttttcttagaacgtcctgagctgagtgcccttagtataagctttatggcccaccaacactttggtatgccctaattaaattctttttaaactacattgaggagcatgaagaaagttctgccccttttttgggttaggccagggtaaaatattcagtgccctgtttttgtactctaatagggcagctatacccagagagggctgtgctgaggtaagggctactgcttcctcatttacaattaaaaaa

SEQ ID NO: 4121 - DNA, 601 bp, Human
acagccctcagagaagaacaatcctgctgacaccttgactttagacttctagcctccagaactgagagccaatacattttgattgtttaagccactcagtgtgtggtcctttgttacagcagccttagcaaactcatacacagtggcaagcctctattggcagttcttattgacacacacacacactgaatcaaggactgtctactctgggagggacttcatttgttcgcccttttcattttactggggatgaaacagagacccaagagaggggaacggctggacagttctcttacaaacygagccgagatcctgacagggcccttcctgtggtgccaggtttctactgcttcctgtccctccactcctcacaagaaccagcttcctactcagtaaatctggttcccactggtgcattcttggtcctcagagtggcttagatgggtaagtccatcttcacatgttttcttagaacgtcctgagctgagtgcccttagtataagctttatggcccaccaacactttggtatgccctaattaaattctttttaaactacattgaggagcatgaagaaagttctgccccttttttgggttaggc

SEQ ID NO: 4122 - DNA, 601 bp, Human
tcatcgaggatggcagcaagtcacacactgtccacagctgacccacatccactggcttcacatgacctagccagagtacttcatagcaccctaagaattggactttgcaataaagatgcttcattatgatagacattaacacactgaaatggcaattggaacaaggatgaatacatgacctgaacaaatgtcacctaaagaaaaagatttcaaggaacatataagtttttgcacagtttcgcttaagtgagtcctgtcaagattcagtgctcacatcacattgcattccgtctcatcacaycattaaccgctgtgaggttttcattaatgaaaatgaaaaatgtcttaaaatcactgtcctgatgacagatggcaaagcaacctctaataaaccctcggaccccaccctttcatcccaaggctggggttttcctttgtatgccctaggaaaaatgtctttgttaactgacagttgctgctttggctcgggtcccatcattttgatggatgactgcaataatggcccccaggaactggtttctctttcttccccacttccctgccccagtctgttctctatactactggagttcctctttga

SEQ ID NO: 4123 - DNA, 601 bp, Human
gctgctcagctaggagctatgtgtctcagcttcccttatagcgggtgtggcccatgaccaggctctgggctgtgcaaagtttccaggtttttcctttccaccattgtttttacgctcgctaaattgggaagaccctagagagagacctgtcttagtgcctggaacatctaagtgactctgaaacaatgggaactccctatttgaagaaatgaccttgttagaaaggggaagcctccggagctcactggcaggcgtcagccttttctttcactgagctaactcagaggtgctgagccagcgktttgctgatctgctgaaaaagatcctctcttcaagatgagcttccaggggcattcctttctagattccttcattctagcacagccatatctatttcagaatacagtcatcgaggatggcagcaagtcacacactgtccacagctgacccacatccactggcttcacatgacctagccagagtacttcatagcaccctaagaattggactttgcaataaagatgcttcattatgatagacattaacacactgaaatggcaattggaacaaggatgaatacatgacctgaacaaatgtcacc

SEQ ID NO: 4124 - DNA, 601 bp, Human
cagaagctccagctcttcttctctttgctcagtcatgtagtgaggcctctctggatggtgatgctgagaaatcaaagttgtcttggggtctagaagctcctgactccttcattcacaaagaaatgctacctgaacatttctgaaccagaggtttggaactccccctactcccgaggctcttagaggcggccgagcaggctggtcaataactcacatgccatttgggaagagtgctttgctcgagtctccaccctgggccctctccacctattgtctgtggtttaaacgtgataacttggcrgacagtcacacatccaaggaaaaagccagagggcgttttttttcttgtctctgaaagtgttgtcacagaaacacagaagcgtgtctctctctctctctctcttctcaagtcccaaaatcttattattaatattttttttagggaagatgaaaaagaaaactaaaaagaatctgagaaacaaatgcagttcacctaggagatactgcgacgttagcgtaacggtgggagcgtgccggatctccttcctgcctttcatgtggttctgtcagcaaaggctgccatcttcaagagatacattct

SEQ ID NO: 4125 - DNA, 601 bp, Human
agtgatatggtttggccacgcccccacccaaatctcaccttgaattgtaataatccccatgtgtcaagggtggggccaggtggagataattgaatcatggggtggtttcccccatgttgttctcatgggagtgaataagtctcacaagatctgatggttttataaatgggagctcccctgcacaaactctcttgcctgctgccacgtaagacatgattttgctcctcattcgccttcaaccatgattgtgaggcctctccagccatgtggaactatgagccaattaaacctctttcctttrtaaatcacccagtctcaggtatgtctttattggcaggatgagagcggactaatacaatcagtttccacaaacaaaccaaaaaaacttttttttaaaaacttacaccaataattttgtgggtttaagttctctgctgaagattgaagggtcccagggagcaaattccattgtgaaccaggcagctttcaccacctagcaggttcagactctctctttctcttcccatttctgcacaagtatcatcttcctccattctcatacagaaccatccaacccacacccagattcctggggggtctc

SEQ ID NO: 4126 - DNA, 601 bp, Human
ctccactccatactctccttcctgctgcaccctaagctgtccaccatgcctgcctagccttgatgcccaggccaatcttcctttctttgtgtcacctttcctgaccatcccagctcttgttcttccctgtcccttggactcctgcagcacctgtggtttatgtcatgtatcttagaacctgagttttggcaacatcatctttaccatgcagaccattttcagtgatggtatttggagccagatagataagttcaaattctgggtctaccacttgatagctctgtgactacagataagctaytcataccctctgtggcttcaacttcctcatctgtaaaatgagcataacaataagttcacagtgttgttctgagaaacccatatagtaatgtatggaaagtgcctagagcaatatctggaatccatcatgtggtcagtaagtgtcaattacttctgctagcctcaattctccaaatagttgctaggttctaggaggccagagaccatctcttacactactttaacagctctcttagtactcagtacataatagagtctcagtaaattcttgttgattgattggaaagacaagaaaatgagt

SEQ ID NO: 4127 - DNA, 601 bp, Human
gcctttcacacatcaagttagcccaaggaatctcactgaactgactttgcaaacaccttggttataggttctatcccctaaattaaatgttttaattttgccagataccaacttcaacagtcttatgctctgattaaaaaaaaaagttaggaggcaggcagagagttctgaatttgtataaagcatgacattttgaatcattgctgatgctggaggaaggagcagctccactctgagtgacttatggtcactgagaaccctctgtgcaggagtgtgtgtgtgtgtgtgtgtgtgtgtgtgtatgtgtgtatgtgtgtgtttgagacagattgattcattcaaggtttatgatatcgacactaggaaccactggagaaatcactctaatactaggataagaagcaaagccagtagcctgaactttgtgtttcgtcagcctatggaactgatccagcaaaccattatagtagcacttactattttgactagttcctctttcttcttctatcatagatactttgggaacttccaatacaacaactgatttgagaagaaacacccccaccatttatatcattttaaaagataatatttctttcca

SEQ ID NO: 4128 - DNA, 601 bp, Human
aggcctttcacacatcaagttagcccaaggaatctcactgaactgactttgcaaacaccttggttataggttctatcccctaaattaaatgttttaattttgccagataccaacttcaacagtcttatgctctgattaaaaaaaaaagttaggaggcaggcagagagttctgaatttgtataaagcatgacattttgaatcattgctgatgctggaggaaggagcagctccactctgagtgacttatggtcactgagaaccctctgtgcaggagtgtgtgtgtgtgtgtgtgtgtgtgtgagtatgtgtgtatgtgtgtgtttgagacagattgattcattcaaggtttatgatatcgacactaggaaccactggagaaatcactctaatactaggataagaagcaaagccagtagcctgaactttgtgtttcgtcagcctatggaactgatccagcaaaccattatagtagcacttactattttgactagttcctctttcttcttctatcatagatactttgggaacttccaatacaacaactgatttgagaagaaacacccccaccatttatatcattttaaaagataatatttctttc

SEQ ID NO: 4129 - DNA, 601 bp, Human
aacagtggggaccgagctgaagccctagggttctaagtagaatattcgcactaaggttctaaatagagtaacaccagatgttaacattaatgtgtaagggaaacttataaggatgattgtggaataagcctgcttgttgttgaacctgtgaggaatttgtggggcagaaattgaaagaaaaatagtcgggttccaaaggaaagaatcatggtggacacaatcagatgtttacagagttgaccaaagatacagacagtctcaatgaattcataaaatgcagcccacaagatccaaaggggcytccagcctgatagctggcaagaagttgccttctggatttgaaaagattctttttctccttaggcctttcacacatcaagttagcccaaggaatctcactgaactgactttgcaaacaccttggttataggttctatcccctaaattaaatgttttaattttgccagataccaacttcaacagtcttatgctctgattaaaaaaaaaagttaggaggcaggcagagagttctgaatttgtataaagcatgacattttgaatcattgctgatgctggaggaaggagcagctccactctgagt

SEQ ID NO: 4130 - DNA, 601 bp, Human
ccctaacagcccagcatacactgcccatggttttgtttctggaaaaaaaaagaagtcaaagagcaatctcaaaagtattctgagcttaaaaacatcttacatgaaagtgggataatggagcctcatgttctatttctgcattctctcccaagggagacgtttgttttcatggttttagaggtcagctttagaccactgaaaatttttgtatctgttttcttattctaatttctctcactatactttcacattcttaatttcatgaagatttttctatccaaatgctttatttttaactcarctaccacatgtctaacattaaattatcttcatctctcctaagtcaatctctctgcccagtttctccatcttaagattgctaatgtgtcctgtatccattttgggtaaagagaatataatggttccatgtgccgtccctgtgaattcacgctattctcatgagacactgggaggaagaaagatctacttatcttttttaaaaataaacataatagtgctattgttgtcctttcatgcaaataactgggttgaacccagcagacctgaactgaaaggaaagtatttagtctttcctctaaat

SEQ ID NO: 4131 - DNA, 601 bp, Human; identical to SEQ ID NO: 2348

SEQ ID NO: 4132 - DNA, 601 bp, Human; identical to SEQ ID NO: 2349

SEQ ID NO: 4133 - DNA, 601 bp, Human; identical to SEQ ID NO: 2350

SEQ ID NO: 4134 - DNA, 601 bp, Human; identical to SEQ ID NO: 2351

SEQ ID NO: 4135 - DNA, 601 bp, Human; identical to SEQ ID NO: 2352

SEQ ID NO: 4136 - DNA, 601 bp, Human; identical to SEQ ID NO: 2353

SEQ ID NO: 4137 - DNA, 601 bp, Human; identical to SEQ ID NO: 2354

SEQ ID NO: 4138 - DNA, 601 bp, Human; identical to SEQ ID NO: 2355

SEQ ID NO: 4139 - DNA, 601 bp, Human; identical to SEQ ID NO: 2356

SEQ ID NO: 4140 - DNA, 601 bp, Human; identical to SEQ ID NO: 2357

SEQ ID NO: 4141 - DNA, 601 bp, Human; identical to SEQ ID NO: 2358

SEQ ID NO: 4142 - DNA, 601 bp, Human; identical to SEQ ID NO: 2359

SEQ ID NO: 4143 - DNA, 601 bp, Human; identical to SEQ ID NO: 2360

SEQ ID NO: 4144 - DNA, 601 bp, Human; identical to SEQ ID NO: 2361

SEQ ID NO: 4145 - DNA, 601 bp, Human; identical to SEQ ID NO: 2362

SEQ ID NO: 4146 - DNA, 601 bp, Human; identical to SEQ ID NO: 2363

SEQ ID NO: 4147 - DNA, 601 bp, Human; identical to SEQ ID NO: 2364

SEQ ID NO: 4148 - DNA, 601 bp, Human; identical to SEQ ID NO: 2365

SEQ ID NO: 4149 - DNA, 601 bp, Human; identical to SEQ ID NO: 2366

SEQ ID NO: 4150 - DNA, 601 bp, Human; identical to SEQ ID NO: 2367

SEQ ID NO: 4151 - DNA, 601 bp, Human; identical to SEQ ID NO: 2368

SEQ ID NO: 4152 - DNA, 601 bp, Human; identical to SEQ ID NO: 2369

SEQ ID NO: 4153 - DNA, 601 bp, Human; identical to SEQ ID NO: 2370

SEQ ID NO: 4154 - DNA, 601 bp, Human; identical to SEQ ID NO: 2371

SEQ ID NO: 4155 - DNA, 601 bp, Human; identical to SEQ ID NO: 2372

SEQ ID NO: 4156 - DNA, 601 bp, Human; identical to SEQ ID NO: 2373

SEQ ID NO: 4157 - DNA, 601 bp, Human; identical to SEQ ID NO: 2374

SEQ ID NO: 4158 - DNA, 601 bp, Human; identical to SEQ ID NO: 2375

SEQ ID NO: 4159 - DNA, 601 bp, Human; identical to SEQ ID NO: 2376

SEQ ID NO: 4160 - DNA, 601 bp, Human; identical to SEQ ID NO: 987

SEQ ID NO: 4161 - DNA, 601 bp, Human; identical to SEQ ID NO: 988

SEQ ID NO: 4162 - DNA, 601 bp, Human; identical to SEQ ID NO: 989

SEQ ID NO: 4163 - DNA, 601 bp, Human; identical to SEQ ID NO: 990

SEQ ID NO: 4164 - DNA, 601 bp, Human; identical to SEQ ID NO: 991

SEQ ID NO: 4165 - DNA, 601 bp, Human; identical to SEQ ID NO: 992

SEQ ID NO: 4166 - DNA, 601 bp, Human
ctaatggatatcccagaatgtcacttgggttgtggacacatatgtctgccaagtaaataatgactgattttttcagagtaattcagttatgctgctccccacctgtgcctccagaaatcaacaaaagcagtaatcccagattttatttttcttaattggcctacctgcacatgttctctgacagttttaatgtcttactagcagcattttgttcagatgtcagatttatgggggctacaggtcgtacatattcctcataggaacaagtattccctggagtgctttcctgaccttgctgggrtatgataagttgcacattcccagtcaatgaacacttattggtcacgtgctgtgggtcagacttgatcacagacactgctcactagatgctcacgacaatctgtgaagtaggcattgcttccattttgctgatggagaaactgaggcttgggcaccaatatgactttcccagagtgagcaagaagtggcagatgtggaacaggaagccaggtcttctgcctctgctctctgcttccctgcttccctgcactgcctttgtagaggttcccgtttttcccaatcctggcaagggtggctgtgt

SEQ ID NO: 4167 - DNA, 601 bp, Human
ctaaaatcatgcaaagatgtcaaacgctaccactgaatggctggtcccacctctgggatttccgtgcctacctcaaatatttcattttttttttcttgaatatcatggtgtgtatgagaggaaacttacatgagtttatacattttaaaatacagattttaccaaaataattcttaaccaaatgttaccaaagccatgacttaagggcgttatatacactcagtataccttagaacactgtatatatcacacacagtgatgggcaggactcactgctacagaactattagaaatgaaaaasccgccatttccccccttttcctcttcttgcctctctgcatttctcagtcagtattacaagagcagcttgctaactggaagagtggccactgaaaaaaatggagacaagagtttaacttggggctggtgttcctggagccaaagtcatcatccgcagattggtaaccgcggatacaaggcctcttagaggccactagtggccactgggtgaactgcatgaagatggcattttaaaaatgagtgttctttccaaggtttagtcgcttagcaaatttcgtcccttagtgacttggagaaaact

SEQ ID NO: 4168 - DNA, 601 bp, Human
accaacaacataaggtttcttctggaatattacatttccagctacacataacctttcagaccaggaaggcagtggagagatttttcagaaacaccaactaagcctgcagaacagtctattagaaattgatacaaatccaaatctgaggagatcgtctcagtacctttcctggctacaactgaattcaaagggtgacattaaagatgcctaaaatcatgcaaagatgtcaaacgctaccactgaatggctggtcccacctctgggatttccgtgcctacctcaaatatttcattttttttttcttgaatatcatggtgtgtatgagaggaaacttacatgagtttatacattttaaaatacagattttaccaaaataattcttaaccaaatgttaccaaagccatgacttaagggcgttatatacactcagtataccttagaacactgtatatatcacacacagtgatgggcaggactcactgctacagaactattagaaatgaaaaagccgccatttccccccttttcctcttcttgcctctctgcatttctcagtcagtattacaagagcagcttgctaactggaagagtggccactgaa

SEQ ID NO: 4169 - DNA, 601 bp, Human
gtttagatggaaaaagtcttatcatcatccagactccgtttgccacaaacaggaaatgaatttgcttcccctgtccaagcctagttcctggcaaaatggaacagctcattgctaagccgccttttttttttttttttttttaaatacggtagctagaaacttggcagctcgctctttcaaagtgacagctttcaaactgtctacctaacacaatttagcctaattccaaacatatcggaaaatggactgttaaagaaaagaaaaaaatctccggaggagcaactgcctccctgtcctcctrctttttgtctaatatgaacaaaatgtaaattattgtctccctaggttgtaaaatattcttcagagaatgattatacctgtcacagatgggatcttgaaataagttaaatgtttaggtttatatactaggaattccctagtgaactgaattctccatgcaatttttggtaatattattattgaactataagcataaatgctatccatgagaaactggtttatttatttaaaaaaaaacaggaaaaataactctttctcacatttcttttgggtacccagaattttaacatgtccttaatta

SEQ ID NO: 4170 - DNA, 601 bp, Human
cttaatgggttgtccaaagtattggggatagaggtgaggtccccaataccactgattcaacaaaatttatttcattgcccatgagtcagccacacacaggtcaaccaagtatttggttcttataacagctgatagtatcaaagactctgaagatgactgtataaaatatgaacatagacataaaaatatcattgttcattccattgtccattttgcctaggaaatgtcccttgccatggagtgtgttccagcaagcattgatgaatctagcatattgatttttgctttgtttactgggttmacaaggcagtttagatggaaaaagtcttatcatcatccagactccgtttgccacaaacaggaaatgaatttgcttcccctgtccaagcctagttcctggcaaaatggaacagctcattgctaagccgccttttttttttttttttttttaaatacggtagctagaaacttggcagctcgctctttcaaagtgacagctttcaaactgtctacctaacacaatttagcctaattccaaacatatcggaaaatggactgttaaagaaaagaaaaaaatctccggaggagcaactgcctccct

SEQ ID NO: 4171 - DNA, 601 bp, Human
tttatgttgccactcaagacatgggtataaatgttgattaggcaactgtctaataactactaactaagtaaacgcacagcagtagatgctaaaatgtggacagataattatgacacagtgtcagacatctctgacaaaggaagtaaagagaactgaggggagtatcagggaggagcccctaacccacatttagggggtagaaaataaggaatttctctgaaggaagtgagacataagcagtgagcaaaagaggagtcagttgtccatgtggaaaggggggtggagaggaatgcttcaggcrgagaaagaaggataggtgaagactgaggcaagagagtgcatagttgcttaagaaattgaaagatgatggttggctgaaatgtactagtgggagccacggtggaagagtaaggaggagcctgctcatcacacgagccttggagaccatgcgaaggagtttgggttttaattgcatggtggatccagtgaagaatctgaaacagcaaactgacatgattagatttatatatatattgaaactgcttctggtggcagagtggaaaagggattggaaggggcaaagctggaagctgaacccagt

SEQ ID NO: 4172 - DNA, 601 bp, Human
ttacatcttttaaaataaacagtctattatttcaaatcaagatattgtcagtgtcttggatactcttaactcactgttgatttatattatgcatctgataaagcaaaacccttaaaacacattcttttttttttttttttttttttttgaggcagagtcctgctctgttgctcaggctggagttcagtggtgcaatttcagctcactgcaacttctgcctcccgggttcaagcaattctcatgtctcagcctctcaagttgctaagactacaggctcacaccaccatgcctggctaatttktttgtttttgtttttgttttagtagagatggggtttcactatattggtcaggctggtcttgaactcctgacctcaggtaatccccctgcctcagcctcccttaaaacacattctaatgttatttctagcaacaatggatcaaaattcagttgaggcccctacaagtcacccactcatgttgctatttggctatatttatttgtgcaattgttttcttctgtttagttcgatattaagactttgcatgggttaaatttcttcttattgaatttggctcactgtcccatgctcttaagatca

SEQ ID NO: 4173 - DNA, 601 bp, Human
tttcaccatgttggccaggctggtcttgaactcctgacctcaggtgatccgccggcttggctttccaaagtgctaagattataggcgtgagccatcacatccagcctatttaactgtttttaagaagttatttctagaacttttatccaacgctctgttttggaatattttccactttgtcaatttctcttttgaagtgttattttctggaattaagtacattactctagttgtggtttttctgtaaaaaaaaaaaaaagagaccattacatcttttaaaataaacagtctattatttcamatcaagatattgtcagtgtcttggatactcttaactcactgttgatttatattatgcatctgataaagcaaaacccttaaaacacattcttttttttttttttttttttttttgaggcagagtcctgctctgttgctcaggctggagttcagtggtgcaatttcagctcactgcaacttctgcctcccgggttcaagcaattctcatgtctcagcctctcaagttgctaagactacaggctcacaccaccatgcctggctaatttgtttgtttttgtttttgttttagtagagatggggt

SEQ ID NO: 4174 - DNA, 601 bp, Human
ggcactatgcctggcacatagtgggtcctaggcttactgtggctcactgcccctaaactgtgacagccatttcacagggcgtggtgctccccgggttaccctgactgcagcattacggcaagcagaaagtgcaggatgcagttttatttttacctcttctcagaaccctgttgtatacatgttcccctgaagggcactttctttccattatgctgtgagctaaagatgtttaattctctagacctctctattccaagctgcctttctcctaagtcctctggtcttattaagaccacaatcyccgtgataaaccagcccaagaatgagctggaggagcacaaatgttcctgttgaaaaggagcttagcaatcaactcctctggtcctctttcttagcacaggggctttaaaattttttttttaaaaatagctaaacaccaaagtccttagaaatgggtttcatcagttctccgtttaccagcaccaatggaaggaatatactgatattacatccttacagaatctcacagaacagcaatagcattttctcagccatctggtagaactactataccctgcatgaaacattttcatgagagccc

SEQ ID NO: 4175 - DNA, 601 bp, Human
acctttcagaatctgaattttcttattttaaaatgaggatactaataccctgagaaggtctatgaaggctcaatgagataacggtgcagtgggtctggcactatgcctggcacatagtgggtcctaggcttactgtggctcactgcccctaaactgtgacagccatttcacagggcgtggtgctccccgggttaccctgactgcagcattacggcaagcagaaagtgcaggatgcagttttatttttacctcttctcagaaccctgttgtatacatgttcccctgaagggcactttctttscattatgctgtgagctaaagatgtttaattctctagacctctctattccaagctgcctttctcctaagtcctctggtcttattaagaccacaatccccgtgataaaccagcccaagaatgagctggaggagcacaaatgttcctgttgaaaaggagcttagcaatcaactcctctggtcctctttcttagcacaggggctttaaaattttttttttaaaaatagctaaacaccaaagtccttagaaatgggtttcatcagttctccgtttaccagcaccaatggaaggaatatactgata

SEQ ID NO: 4176 - DNA, 601 bp, Human
gctagttttcgttatgttagaagcttcccatcatgtcactgcctcactctgtgactaaccaggcagaagcagggaatagccacttcaattttcttatctttccaaaggaaggaatcaaatctgacaaagcctcaaggggacattcgaaggacaaagttagccattaatctaaaattctccttttacctcaaaaagggtcaaatgcctcctccctctgtaattctaaaagtagatctcatccctcaaatgcaggaaagagagggagcaggtctggagaaaggacactaagatttccatgagrtaagtgtgattgttttcagtgacacagaaactatcctcagctttccttagctactaatgggccagttcaaaagtcaaaacctggactgtctgatgccaacattcacaggtttttcttttgatttgtggcatcaggagtgtaaacgtaaatcacatgtttcttagttgtctaactttgtatgtgtgacttaaattcatttcttcatcatagaatggagacactaatattcatttcatagcctaacatgttccacttcttacaggaatgtgacaggagacggcatgagatgacacgtatgca

SEQ ID NO: 4177 - DNA, 601 bp, Human
atgggactagatcagagcagaatcaactttcggaatgcatacttggattgcatgctaagatttacaaacattttcagcacgagaccaattaaatcatggagataaaagttagaatcataggatgccaaaaccatttgtttgaggaagaataatttagttaagcaacacattataccagttttacttttatttatatgagattttctccttgggtgggcccaagttatcaatatttggcactatacagaccagtcttagagcacagggtaattcaggggctggatgtcattccagctcctgmcactgttgacatatgacactaggaaatcacacaactgtgcctgtacccacctctctctacaatgcaacccatggtgtcaagactggagcttgcacatggcactcaccaatgacgtattccaccctgaagagatcccttctggggtcatatggacgactgaagtcaatctgcacatagaaagactgccctctgcggacaatcagcttgttgttttcatacttgtcagtgtggtggtccaccttgttagtgtcccatctctccttgaacaggtgaacgctcgtgacattaagaaactctatg

SEQ ID NO: 4178 - DNA, 601 bp, Human
atttttcacgggccatcccatgggactagatcagagcagaatcaactttcggaatgcatacttggattgcatgctaagatttacaaacattttcagcacgagaccaattaaatcatggagataaaagttagaatcataggatgccaaaaccatttgtttgaggaagaataatttagttaagcaacacattataccagttttacttttatttatatgagattttctccttgggtgggcccaagttatcaatatttggcactatacagaccagtcttagagcacagggtaattcaggggctgsatgtcattccagctcctgccactgttgacatatgacactaggaaatcacacaactgtgcctgtacccacctctctctacaatgcaacccatggtgtcaagactggagcttgcacatggcactcaccaatgacgtattccaccctgaagagatcccttctggggtcatatggacgactgaagtcaatctgcacatagaaagactgccctctgcggacaatcagcttgttgttttcatacttgtcagtgtggtggtccaccttgttagtgtcccatctctccttgaacaggtgaacgctcgt

SEQ ID NO: 4179 - DNA, 601 bp, Human
ggctgggcatggtgtctcatgcctgcaatcccagcactttgggaagctgaggtgggtggataacttgaggttaggagtgcgaaaccagcctggacaacatggtgaaactctgcctctaccaaaaatacataaaattagctgggcgtaatggtgtgcaactgtggtcccagctactctggaggctgaggcaccagaatcgcttgaacctaggaggaagaggttgcagtgagctgagatcacaccactgttccagcctgggcaacagagcaagactctgtctcaaaaaaaaaaaaaaaaaaaagggtgattaaagtacaaagtgtttagtgaagtttattggactatatttttcacgggccatcccatgggactagatcagagcagaatcaactttcggaatgcatacttggattgcatgctaagatttacaaacattttcagcacgagaccaattaaatcatggagataaaagttagaatcataggatgccaaaaccatttgtttgaggaagaataatttagttaagcaacacattataccagttttacttttatttatatgagattttctccttgggtgggcccaagttatcaatatttgg

SEQ ID NO: 4180 - DNA, 601 bp, Human
tgtttaccaaaatgtgtcaaaagttaatagctataacttaataaaagggttccatgatcaaattaatttaagaagcaccagaccaaagttaaatggtccttccccagacctttgaagctaatgtgcatcgttaatcttcaagaggaggttaaaggctgggcatggtgtctcatgcctgcaatcccagcactttgggaagctgaggtgggtggataacttgaggttaggagtgcgaaaccagcctggacaacatggtgaaactctgcctctaccaaaaatacataaaattagctgggcgtartggtgtgcaactgtggtcccagctactctggaggctgaggcaccagaatcgcttgaacctaggaggaagaggttgcagtgagctgagatcacaccactgttccagcctgggcaacagagcaagactctgtctcaaaaaaaaaaaaaaaaaaaagggtgattaaagtacaaagtgtttagtgaagtttattggactatatttttcacgggccatcccatgggactagatcagagcagaatcaactttcggaatgcatacttggattgcatgctaagatttacaaacattttcagcacgaga

SEQ ID NO: 4181 - DNA, 601 bp, Human
agctggtttatataggttgcgtgttcaggttttagtcctacattttatagttttggtcatgtgaaatttttttatgtctatttctgggtgcttagtgctggggaagataaaagttattgatttttatatatttatcttctatctagccaacttacaaagttttattaatacagtgcttttttcccttgaatctgttgggttttctacatacacaatcatagtattagcaaatatatagttttacttcttagtttccagcatttatagcagatgtatctcttacattgttcatttactaaarcctttaaagtacttctttttaaaaagggaatgatgatagcaggcatttctttctaatttctgattacagtgaaatttgttaacttttttccacttagatatcaaaagttgttgttttgatgtaagcaatctttattatcattgaggtgttttttttctaaatttttccccttaaactcttcctaaaactggatgctgaattttaccatgtacctttctgtgactgctgatttgattgcctaattttttcctttaatttgtgcataggattatatgggcagatttcctatgttgtgccacc

SEQ ID NO: 4182 - DNA, 601 bp, Human
tttttcagctccatcagaatctcataagatcacctatgcatgatctgtcattgactgaaatgttgctatgtggcacataactgtacatggttcttgctttcttctacagtgtcagagtttccagtttttagttaagtctgttaaatttcctcaaaaaattgtcttttttacattaatactcattccatctgagatttactactgtatatgggacaagatgagggtcaatttttaaactttcttccagttggagagtcagttatttctgcatcatttatgtaaaaacaaacaagcaaacagwtaaaatctcatatggtcttcttacttcatgaaaccaacaatcatattaactcatatactgaaatccatttctggattctctattatgtcctactaaatatttttcatagtatgttctgatagccgcttcagaaagaaaatactcttacttattatttctttgtatgatttccttggttatcaccaggtaattattatttcaaatgaactttaagattattttatacaagtccaaaaaaccaaaaccaaagccaaagacaactcaaaactccactgggattctaattggaaatgcattaaa

SEQ ID NO: 4183 - DNA, 601 bp, Human
ctataaacttaggctacagtacatttaaaaaaataagtaatctcactattctattatgatagctatgacatcactatgtaacaggaatttttcagctccatcagaatctcataagatcacctatgcatgatctgtcattgactgaaatgttgctatgtggcacataactgtacatggttcttgctttcttctacagtgtcagagtttccagtttttagttaagtctgttaaatttcctcaaaaaattgtcttttttacattaatactcattccatctgagatttactactgtatatgggayaagatgagggtcaatttttaaactttcttccagttggagagtcagttatttctgcatcatttatgtaaaaacaaacaagcaaacagataaaatctcatatggtcttcttacttcatgaaaccaacaatcatattaactcatatactgaaatccatttctggattctctattatgtcctactaaatatttttcatagtatgttctgatagccgcttcagaaagaaaatactcttacttattatttctttgtatgatttccttggttatcaccaggtaattattatttcaaatgaactttaa

SEQ ID NO: 4184 - DNA, 601 bp, Human
tcagtaagcaagcctgggcaatggcgggcgcccctcccccagcctctctgccgccttgcagtttgatctcagactgctgtgccagcaatcagcgagactccgtgggcgtaggaccctctgatccaggtgcgggatataatctcctgatgcgccgttttttaagcctgtcggaaaagtgcagtattggggtgggagtgaccccattttccaggtgccgtccgtcacccctttctttgactcggaaagggaactccctgaccccttgcacttcctgagtgaggcaatgcctcgccctgcttcrgctcgcgcacagtgcacgcacccactgacttgtgcccactgtgcggcactccctagtgagatgaaccccatacctcagatggaaatgcagaaatcactgtcttctgggtcgctcaggctgggagctgtagacctgagctgttcctattcggccatcttggctcctccccccgagattcttttaagtgccctttatttttaacaaagtatttattctcgtctgtttttttttttaatttatgttacattttggttcacttttaatagtaaatgatatctcaaatgtttagacatttagctg

SEQ ID NO: 4185 - DNA, 601 bp, Human
taaagatgtactggtagagattcttttttttttagtctttttttaaaaatttatttatttattattataatactttaagttttagggtacatgtgcacaatgtgcaggttagttacatgtgtatacatgtgccatggtggtgcgctgcacccactaactcgtcatccagcattaggtatatctcccaatgctatccctcccccctccccccaccccacaacaggccccagagtgtgatgttccccttcctgtgtccatgtgttctcattgttcaattcccacctgtgagtgagaatatgcrgtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggatatttgggttggttccaagtctttgctattgtgaataatgccgcaataaacatacgtgtgcatgtgtctttatagcagcatgatttatagtcctttgggtatatacccagtaatgggatggctgggtcaaatggtatttc

SEQ ID NO: 4186 - DNA, 601 bp, Human
tcagcttgcagacagcctattgtgggaccttgtgaccatataaattaatacttaaataaactcccctttatatgtatatacacacaacactcacacacacacacacacatatatatatatacacacacgtatatgtacaaacacacacacacacatatatatatcctattaggtctgtccctcaagagaacactgactaatatagtgagtgacagtaagtcaatctttgttggtaagtctcttgttataaacactcttaaagatgtactggtagagattcttttttttttagtcttttttwaaaaatttatttatttattattataatactttaagttttagggtacatgtgcacaatgtgcaggttagttacatgtgtatacatgtgccatggtggtgcgctgcacccactaactcgtcatccagcattaggtatatctcccaatgctatccctcccccctccccccaccccacaacaggccccagagtgtgatgttccccttcctgtgtccatgtgttctcattgttcaattcccacctgtgagtgagaatatgcggtgtttggttttttgttcttgcgatagtttactgagaatgatg

SEQ ID NO: 4187 - DNA, 601 bp, Human
ataaagttattttttctgtattttaaatataataatagcttgctttatgaaacagctatgtttttacctatataacaaacctgcacatttacccccgaacctaaaaaaaaagtttttttaagtatatagtgagtgtgatggttaatactgtcaacttgattggatggaaggatacaaagtattaatcctaggtgttgccaaaagagattaacatttgagtcagtgggctggggaaggcagatccacccttaatctggtgggcacaagctaatcagcttccagtgaatataaagcaggcagmaaaacttgaaaaggagagatgggcctagcctcccagcctacatctttctcccatgctggatgcttcctgcctttgaacatcagactccaagttcttcagttttgggacttggactggctctcattgctcctcagcttgcagacagcctattgtgggaccttgtgaccatataaattaatacttaaataaactcccctttatatgtatatacacacaacactcacacacacacacacacatatatatatatacacacacgtatatgtacaaacacacacacacacatatatatatcctatt

SEQ ID NO: 4188 - DNA, 601 bp, Human
gaagcttgaatctgtgagggccatcatagaattgagggaaaggtcaggagaatctccaaagcgctgacctggacacccccaggttcctgtggttgaactccagggagaaagaaacttgctcatggaccctactgtcacttcggagggctcctcagggagtgaaacctctgccgttttgagggggagacctggtaagaaatacagcttgggatttcaccctcaactgggtatcaaaaaagcaggggcccatgtcaaagtaacagcaaattaacaccagaagctgctcccaagctttcacagyctcagccacaggttagtaaaacctgtgattaccactcccctccttgcctttcatgatttgtcgaggctgcaggctcagaggtgagagagagagaaggccctgcagactcccagggcatttttcagccacacccacctcctcagattcattaacacctcccacctaacacagagatagctgtgctctgccagcaactcatgaacgcagttatcaaagcacaaagaacccctgcagcacagctcatcaagccgtggccaggtaaggcagtagctctcctgctcaccttctctactcagagcc

SEQ ID NO: 4189 - DNA, 601 bp, Human
ccatttatcctatcatttattagtgagatttttttcccccttgagtctcttactaatgtccctaacaaaatctcggtcctccaatttatcttccacacttctgctatagtaatctaaaaagtagaaaaaaatcagatcttaatactctacctaaaatgctactacagaggcttctggctgtttatagaattacatctaaacttcttatcaagtcatacaaagacatcagtgtgcttccaaaatgtcatgctccactgaacttttctatttttttttttctagaatgtatacaatttccatycccctgggtcaatttctattcgttttttgagacccgcctcaaatagcactttctggaggattctttcaactattcttgccatcagtcactccctccaaagtagcttctaagcattttgttcaaaaggttggcattgaacacagcctttcctactcagactgtcccctctggacaacaaatcctctggaggcaagggatgaacatatcttactactctaatcccaatatggtgctttgcacatacaaagtattaaataagagttcaataagcacattcaaaaagaaaataaataggcttta

SEQ ID NO: 4190 - DNA, 601 bp, Human
ctgagatggcctacaaatggcagagggccagccactggggcatattgttagtcctcagaccacagtgtgttacttcactacaggtgagtcccattttactatgcaaatacacacacacacacacacacgcacacacacattttactacttctagttatagaagtaaacataagttcctttgggggaaaaaaaggaggggaaaaatcatacaaactcatgcagcatccatttatcctatcatttattagtgagatttttttcccccttgagtctcttactaatgtccctaacaaaatctcgktcctccaatttatcttccacacttctgctatagtaatctaaaaagtagaaaaaaatcagatcttaatactctacctaaaatgctactacagaggcttctggctgtttatagaattacatctaaacttcttatcaagtcatacaaagacatcagtgtgcttccaaaatgtcatgctccactgaacttttctatttttttttttctagaatgtatacaatttccattcccctgggtcaatttctattcgttttttgagacccgcctcaaatagcactttctggaggattctttcaactattc

SEQ ID NO: 4191 - DNA, 601 bp, Human
gctcagatcctttgcccacaacctggggtaaatcacttaatccctgtgaacattggtttccatgtttttaataagttttatttctaccttccctgcctcccagtttattgtgagaataaaaaagtggtttcctatacattatctcctttaacccataaatggctgtttaaaataaatagtatagtccttatttgcaggtgaggaaacagtaatgtgatggggggtggggtaaagtgattctgtcactgctatccatggtggagctcgggttctgactgggcactgccttgagtccaagccscctctttccccaccaaaaagggcttcatttagccctttaatcacgtgagctgtcatccctgagatggcctacaaatggcagagggccagccactggggcatattgttagtcctcagaccacagtgtgttacttcactacaggtgagtcccattttactatgcaaatacacacacacacacacacacgcacacacacattttactacttctagttatagaagtaaacataagttcctttgggggaaaaaaaggaggggaaaaatcatacaaactcatgcagcatccatttatcctatcatt

SEQ ID NO: 4192 - DNA, 601 bp, Human
atgtatgcatgagagacagacagagaggaagagcaagacagaaacagacaggccgggatgaaagtaatagaaatcttaagaaagaagagaaaagatcagaaaagaggccaagatactgagaagaaagagggtgaagagggtagcaagagagaggtacagctatttatagcctgtcttatggttgtgtaatacctgtctggctctggctgctgttatagtagcattttatgaaggttatccttccttaaggaataccataagaatttagctttcctacatagttgcaatattgaaaataagsctggtaattgggtcatcttattaggaaggaactatcacgaagcagttcaaagagcttccagttattccctcattaatccttacaacatgcttctggagtaactggagggcaaagatgaagaatatttagtccatttggatcctttctttagtgggctgtaattccacttgcatgctctctttttagattagagactcaagagcaagttatcgcagtgggcacatttgttttcattaaatattttcccccacctttttcacctcttgcttcatatgctgcaagaatgtcttagaatttatg

SEQ ID NO: 4193 - DNA, 601 bp, Human
attaaaagagaaaatcaggattcatccaggtattaatcaatcattctatcaataataattttggtaataaatgggattttatagtctcaagataatttcctataaagtacttattaactataaaaggaacaaagaataactttgcaggggtaaccccaacagtcacctctgtgttgggctctgtgatgttctgcccaagacaccttcggaaatgaccgacaggcttatcctcagctgctgggagtgatgacagaaaatagtccttggtggttcaggcctccttgggagttgccttagcagragaaaactgcctcatccagggtcacacctcattccaggggtggctcacatccagtgactgatcactatggaggaacaaagccccatccctttgtcctcatctcaggagcactatgaagagctatctcagctccagagtttcacagagggtcatctgaggcctttggtgtgagtgcattgcagcctgactcccccactacctaatactgcttccttccacaggagttgatcccaacagcactccctaatcaacagcttgcatgctaatttcacagtctacttcctgggcactcaacctgtg

SEQ ID NO: 4194 - DNA, 601 bp, Human
gcaaacacagagcacactgttggcacattgtgaagactcagtaaatgacaagctcaaagataaaaaatgtatggaggacggccgggctcggtggctcacgcctgtaatcctagcaccttgggaggccaaggcaggcagatcacgaggtcaggagatcgagaccatcctggcgaacttggtgaaaccccgcctctactaaaaatacaataaattagccaggcctggtggcgggcgcctgtagtccccagctacccaggaggctgaggcaggaaaatggtatgaacccgggaggcagagcttkcagtgagccgagatcatgccactgcactccagcctgggcgacagagtgagactccgtctcaaaaaaaaaaaaaaaaaaaaaaatgtatggaggacaagagtcatgaatcaggggtcaccataggtatgacagagaggtgaaaagaatggtaagtgagatatacctaggttgaattgggaaatactgaaaggaggtaaaatactaatgagcacacctaggatctagaccttggtttctaaatactactttctattaaaatgaagtggagttctttggagaaatgtttctccttagataaat

SEQ ID NO: 4195 - DNA, 601 bp, Human
tttattaactacatgacaacaaatatggaactcaaaggactggcagaaagaatgacacacatttgcattttgtttattcatatgtatatttatgtgtggatgtttatttgcttactatagatgttcattgttccttcataagttgattaccgcttatatttaaaagcatcacttttaaaaaactgtattcaagcctagttttttgcaagtgacatagataaacaatacaagagaccacggatgtagctgaaacacagggatgtaaagaaaccgtattgaggttggaccatccttgcctaakgatgccttgtgggggaacacaattgttcttgacatctttttaaggccttagaatatattccaatcttctctcatttcctctggtcatgtgttccccactgatttgcctttaataaaggtcactgctgagtacctctttatttgtgggcttgaaggggtacaatattgccttccgtaaataacacctaattccagtgctttggaaagtggcacagtggaatttcttctaaaacatctgccactacttaaattccagagtgctttaagcatgtaccctggagtttcatactgtttgcggagt

SEQ ID NO: 4196 - DNA, 601 bp, Human
ttaattcataatactaatgccacatgagaataacagagcaagagtagtagaccgtgggggaagtcaacgactttattaactacatgacaacaaatatggaactcaaaggactggcagaaagaatgacacacatttgcattttgtttattcatatgtatatttatgtgtggatgtttatttgcttactatagatgttcattgttccttcataagttgattaccgcttatatttaaaagcatcacttttaaaaaactgtattcaagcctagttttttgcaagtgacatagataaacaatacargagaccacggatgtagctgaaacacagggatgtaaagaaaccgtattgaggttggaccatccttgcctaaggatgccttgtgggggaacacaattgttcttgacatctttttaaggccttagaatatattccaatcttctctcatttcctctggtcatgtgttccccactgatttgcctttaataaaggtcactgctgagtacctctttatttgtgggcttgaaggggtacaatattgccttccgtaaataacacctaattccagtgctttggaaagtggcacagtggaatttcttctaa

SEQ ID NO: 4197 - DNA, 601 bp, Human
ccttctaggttttacaagaaaggctcatttcgttaaaatcatggcaactgacttaaaaaataaagtgtcattagccaacaaaggaaaaagtttagctgaatgtcttccaaacaaaacaggccaactgatgacatttttgctaaaacagtcaattcctgttaataattgaatggcaacaataatgagaataaatcactggtaattctgataaagcatttgtttgtctttggagtatatatgaatgcaatatataaaagcaagtgttaaatgagtttgcattgccagagattaaagcaattaytggagaaacaaaaatcaacatagaaaacattctaaggagtatggtacagtccatctagtattaacctacaagtggatatttacaatacatactcaataaacatttatttaaacagatgtttactagtgcttatgatgagcagagtgataccacttaatctggaggagacagggtggtgaatgtgctgagatatgatacatttcctgtgctcaatgggtttataattaaatacgcaagtttagactgtaatttaattcataatactaatgccacatgagaataacagagcaagagtagtag

SEQ ID NO: 4198 - DNA, 601 bp, Human
ggatatttttagtctttaagaaaaaataaccagcagaaaatgttctacaatgtagacaaagttggttacagagcataacattacactgcagatttgttcacgttgcccattcaattccgaaggaccaggaggaacaggagtcaaagaatctggacttgtgtttcctgttgtccattcgggaataacaaccacttatagtttgtctcagcaactccacctattgacagactggctgttctcagacctattgcctgcacccctagaatcttctgtcaggttccacaggaagccatgttcccaygctcctctgctctctgacttcgaggtaggttcggccaaagagaggattggaagcaggaggaggggagatgtcagggtgtgtctcctgtgctctctctgtcttgaggtgagagtctgagtctcctccatggctccagcacctgctgatgccttctgggttctgatgggacctcctcctccatgtgcctccagctcctggtgtggtggcagttttctactgttcctaattcctgggttgcctcaccatgtcgtttgtttggcttcttagtcattcactcgcttgtgtacccaattgcctcca

SEQ ID NO: 4199 - DNA, 601 bp, Human
ttgctctgttgcccaggctggagtgcaggggtgccatctcagctcattgtaacctccaccttccaggttcaagcgattctcctgcctcagcctcccaagtagctgggactactggtgtgggccaccacacccactaatttttgtacttttagtagatagggaattttgccatgttagccaggctggtcttgaactcctgacctcaagagatccacccgccttggcctcccaatgtgctgggattacaggcgtgagccactgtgcctggccctaggcactgttttaagtgagatacagccaygaaccaaacagtcattccctctaacccaaagattccagactaagcttcaagcatgggagaacatgctgctttatgaggagtttgctccaaaagttaggacctggtgttgttaactgcgatacaaatttactccaggaagctagttttctagaaattccctaacccacatgtgtgttgcctcatttaagagaagacaggatatttttagtctttaagaaaaaataaccagcagaaaatgttctacaatgtagacaaagttggttacagagcataacattacactgcagatttgttcacgtt

SEQ ID NO: 4200 - DNA, 601 bp, Human
cattttagaaagatcagtctgtctgcaagatggaaaatggtttgagagggacaagagtggagcaaggaaaccagtcagagggtgctgaagtgctcaagggaggcatgatggtgtctttgactgactctcgggggaaggtaagtggaggggtgccagcggaagcaggaagtagacgcaacaggtatttgatgttggcattaagtaggggggcagagccataggcgaccccaggttttgttcattcttgaaagagtttttcagtgcctacaaggtgccaggcaccattttttttattttttttgtttgttttgttttgtttggagacggagtcttgctctgttgcccaggctggagtgcaggggtgccatctcagctcattgtaacctccaccttccaggttcaagcgattctcctgcctcagcctcccaagtagctgggactactggtgtgggccaccacacccactaatttttgtacttttagtagatagggaattttgccatgttagccaggctggtcttgaactcctgacctcaagagatccacccgccttggcctcccaatgtgctgggattacaggcgtgagccactgtgcctggcc

SEQ ID NO: 4201 - DNA, 601 bp, Human
tgtggcagaagaagcatttgacccagggagggtaaaaagcaaagggacctccaacgctgtgcaaaggtatgtagagtgtgtcctagggaggggatggagatggggcaggagccattgaaaagcttaagtgatctggtgagattacattttagaaagatcagtctgtctgcaagatggaaaatggtttgagagggacaagagtggagcaaggaaaccagtcagagggtgctgaagtgctcaagggaggcatgatggtgtctttgactgactctcgggggaaggtaagtggaggggtgccagyggaagcaggaagtagacgcaacaggtatttgatgttggcattaagtaggggggcagagccataggcgaccccaggttttgttcattcttgaaagagtttttcagtgcctacaaggtgccaggcaccattttttttattttttttgtttgttttgttttgtttggagacggagtcttgctctgttgcccaggctggagtgcaggggtgccatctcagctcattgtaacctccaccttccaggttcaagcgattctcctgcctcagcctcccaagtagctgggactactggtgtgggccacc

SEQ ID NO: 4202 - DNA, 601 bp, Human
agctcaggcaaacttaggaagggttggggggaaactttgtgaagacagagatggagttttgtttaactttgtatacccagcagcttgcatgatgtttggaacgtagtaggtgctcaataaatatttggcaaatggaagctaggtacttgttaaggtgtcttttctaccttgattttattttacttttctttcagtgcttcctacatcacttaaagcctcttttggagtaaacgtaaggcgtaattttgtgggatatacatgaaaccagcatcgtgctaggttttttgagtgaatcagaaakaaatcataaggctgtcacctgatgctgactacctggtccctggctttaagaagtgcaccacttagatggctaaccaaggcaggaatgtgaacatgaggacaccctgtctcaggatgatgccagtggcattcacaggaagtaagaacataacatgaacttcagagaaaatacgaacagcattgagataggagaatttctccctaagaatggcttatttctgagaaagaggactgtgaagccccttcagtgaaatgtgcatgcattttaaacattcctacagcatgccagcctcttcctggg

SEQ ID NO: 4203 - DNA, 601 bp, Human
ttggcagattacatacatatttccagatgtttcctaaagaaaagagaccttcctggccatgtttattctagctcaggcaaacttaggaagggttggggggaaactttgtgaagacagagatggagttttgtttaactttgtatacccagcagcttgcatgatgtttggaacgtagtaggtgctcaataaatatttggcaaatggaagctaggtacttgttaaggtgtcttttctaccttgattttattttacttttctttcagtgcttcctacatcacttaaagcctcttttggagtaaaygtaaggcgtaattttgtgggatatacatgaaaccagcatcgtgctaggttttttgagtgaatcagaaagaaatcataaggctgtcacctgatgctgactacctggtccctggctttaagaagtgcaccacttagatggctaaccaaggcaggaatgtgaacatgaggacaccctgtctcaggatgatgccagtggcattcacaggaagtaagaacataacatgaacttcagagaaaatacgaacagcattgagataggagaatttctccctaagaatggcttatttctgagaaagaggac

SEQ ID NO: 4204 - DNA, 601 bp, Human
gctgagaccaagtgggaataagtcaccaaataactcttagaaataccaggttaccagctacaaaaacaaaatgccaccaccaaaaaagaaacaatcaaaaaggcacagaaatcatggatgatagcaactaagaggagagaaacacaagtattcaaaagcaaatcatctctttgaggactgtagaaatccgccctttccattgctaagttgccattggcagattacatacatatttccagatgtttcctaaagaaaagagaccttcctggccatgtttattctagctcaggcaaacttaggwagggttggggggaaactttgtgaagacagagatggagttttgtttaactttgtatacccagcagcttgcatgatgtttggaacgtagtaggtgctcaataaatatttggcaaatggaagctaggtacttgttaaggtgtcttttctaccttgattttattttacttttctttcagtgcttcctacatcacttaaagcctcttttggagtaaacgtaaggcgtaattttgtgggatatacatgaaaccagcatcgtgctaggttttttgagtgaatcagaaagaaatcataaggctgtcac

SEQ ID NO: 4205 - DNA, 601 bp, Human
aggaaatattataattaccaattgcattttttcacacttatcaaaaactagtgccatcttcccaagtgatctagaaattaacatatgctcttagtttcagtgcttgcttccatttgtgaattattattgaggccacaaaactaatgtttttaaggcaaaagccgcttggaccatatgcctatattcgaatgtctcattgtccctttactgagggcctcactctccttacacagacctaccttaatccccccagctgggatgtaggaggaagaagatgaaaatctttaattccatttgtgaygttactcttttccaaccttagctacctaggcttgattgagctttgtgcacagtttcttgatattagtattcttcacaagataggaaagagaaatctagccacagctcaaattcagtgctatgtgaccctggggaaaatgtcctctcaacctttcaatgcattccacagaccagagagcccactgcacgcaaagccctgcattggtagtgcccactagaagaattcattgccttttaaaaaattaatcttttgggttagttgatggctttgaaatatttttacattaaaaatacaatgtcc

SEQ ID NO: 4206 - DNA, 601 bp, Human
tgacaggaaataagttttatttcttggggtccttacaaaacctctgtgaggaaatttttacagatgggaaactgaggcttggtgagggcgtcatgtgtgcacatcacatagctaggcagaagtggagacagaactggggacagggaagcctgttctctttgctccatgtcatgcttcctctgtggaggaaggtggagaatggcaaaagggatctagggagatgaaaggagacaagagaagaataaaactggaaagtccaaaggaatatgaggaaaagggacattgagaaaatatgctgccrtggataagagttgtgtgagccagaaatgtggatcaaaggaggtaacaactgagtgagtgaagagaaggaagaccaggtggagagaacctgcatgagggtctctctgggccaactcatttttttgtgatttgcattgggaagacttccaaagtaatgtcagacaccaaagggtgaaggctgagcaatcctgctgatacgctgatgccacgtggcccgggaacaggttatggaagcgttatcagggacagggagtggtgagattaattccaaaggaaggaaaaagaatcctgattggcaggc

SEQ ID NO: 4207 - DNA, 601 bp, Human
ctccttccaaggagaaatatgtttctaaactattcgcaaacatctgtactactagtaggtcaacctttagtttccttaaagtcgcctaaattccccacagtctcagggggtgttgaaaacataggaagtttgtagctttttattgattttatgattcatggctaaaatattcaattttaagattgcaaaagttgtttagagttgccaaggcagttcacatagtgatgcaaataaagtgacaggaaataagttttatttcttggggtccttacaaaacctctgtgaggaaatttttacagaygggaaactgaggcttggtgagggcgtcatgtgtgcacatcacatagctaggcagaagtggagacagaactggggacagggaagcctgttctctttgctccatgtcatgcttcctctgtggaggaaggtggagaatggcaaaagggatctagggagatgaaaggagacaagagaagaataaaactggaaagtccaaaggaatatgaggaaaagggacattgagaaaatatgctgccgtggataagagttgtgtgagccagaaatgtggatcaaaggaggtaacaactgagtgagtgaagag

SEQ ID NO: 4208 - DNA, 601 bp, Human
aagcccaaatctatttcaaaggccaattcatcccaaactaaaaaaccttgagctgactgatttttccatcaggagaacttgtagaagtaaaaaaagaaaaaaaaaagggttgccatttattagtaaccaaaagccttaataattccagaatcatcatggagtcacctgaaacctcccattcaatcataatttctgattttctgagttgttaatgatcaatgtaatctccattcatcctttagagcaatggttagaaaactatagtctgcgggccaaatgtagcttacctactgtttttttktttgtttgttttattttgttttgttttgagatggagtcttgcactgttgcccaggctggagtgcagtggtgcaatcttggctcactgcaagctctgcctcctgggttcatgccattctcctgcctcagcctccctagtagctgggattacaggcgcccaccatcacgcccggctaatttttgtatttttagtagagacggggtttcaccttgttagccaggatggtcttgatctcctgacctcatgatctgcccgcctaggcctcccaaagtgctgggattacaggcatgagccactgcg

SEQ ID NO: 4209 - DNA, 601 bp, Human
tgcaacctctgcctcctgggttcaagcaattttcctgcctcagcctcccaagtagctgggattacaggcacccaccaccatgcctggctaactttttgtatttttagtagagacaagtttttgccatgtagggcaggctggtctcaaactcctgacctcaggtgttcccccccgcctcagcctcccaaagtactgggattacaggtgtgagccaccatgcctggcaaattgttttttttttttaagtataacttctactagaaagtaaaggcagaaggaagaaggggtgatttcttttttsctctctggttctgaatctgaagaaaggtgaatgtcccaaggaaagtacgttacttgtgttgattgagatattgtggctaaggggaaagcaattcagctggctctaacacttctgtgtgatctcgggcaaagcactcatcccctgtcaactaaaactttgcttcttctacaaaatggagatcatggtggtcatagtttgtgatggggagggcagcttaataattggtagttatcattacttccctgttgtcctgggctttctgattcctctaagtgatccttctctgctccatctgtggga

SEQ ID NO: 4210 - DNA, 601 bp, Human
ctgactccactattaactactggtgcaacttcaggcaaatcacttacttgtcttagcttccattttcttgattctttgcagtttagtttgggaaataaaaagacaatagattttataatataatgaaagctttatgcttagcacacagtaggggctggctgagggggcactcattttttttttttttttttgagaaggactttcactcttgccacccaggctggagtgcagtggcatagtctcagctcactgcaacctctgcctcctgggttcaagcaattttcctgcctcagcctcccargtagctgggattacaggcacccaccaccatgcctggctaactttttgtatttttagtagagacaagtttttgccatgtagggcaggctggtctcaaactcctgacctcaggtgttcccccccgcctcagcctcccaaagtactgggattacaggtgtgagccaccatgcctggcaaattgttttttttttttaagtataacttctactagaaagtaaaggcagaaggaagaaggggtgatttcttttttgctctctggttctgaatctgaagaaaggtgaatgtcccaaggaaagtacgt

SEQ ID NO: 4211 - DNA, 601 bp, Human
aggcacccatctcctgtttctgctccctcttcgtgcatactcaatcttgggatgagcttgccctttttaccagaggctttgtttttctctggaacccctttcactgttgacgtgtagacatcaaaggcaatcttgccaggtaaatgggacccataattcatttattacagtggttcccagcagctgttgtcactaaatactgatttagattcagaatacgtcgtatttaaaaagatgcaagtttagtaaaaataaacttagagataaaaatctacgtgttaatgatagatttaaaaaaaaataagggatgaaaggaattttaaagctaattatgtaaggatgcactttggggaatagcaaaaaactagagaagtacatctgaaagcactctttgtacctgttatgtgctcaacctcagcttcacctttgtgctaacttccacttttgttttaaaagcttcacctttgtactaacttctacttttgttgggaacatggaaagaatgaagacaatcactagtttccactgttacactttaaattaagacttcaaagactcatattgaatttcacctatcaaatccaagttatacaaaaatagt

SEQ ID NO: 4212 - DNA, 601 bp, Human
ctgggatgtaggttcccttgttctcctgtgggtagcgacctatgagaagagagaagaaatactctgttaggttgatttcacaagccatttttgttctcactctgttatcttatagctgaagggacaggagtaatccattagaattattcttgacttgaagaaacatacaaatcaggcaagtctgcaaattactttgattgtaagcaggagaaccttcaagagcaaaacttattcacttcatttgttttctataaagcatgtagaggattccacattaagacaagcaaacagtgctccattktaacctccctaattactaatttcaaagatctttaaaagagtctttggtaggcatattgtcagagagagaacattctaaggaggtggttacataagttactgctgtgcaattctgtgaggatgcttaatcttaatgaaaataataatttacacagtgcaaaccactgagaaagattagaacttcaacactttgctattagggatataggttataccactcagaatgaatatcacatatacttgtaaatccagcacaaatttaaacattgttttctgcctaggtgccatggcatctaagtaa

SEQ ID NO: 4213 - DNA, 601 bp, Human
tagattcactttattcaagtgcttacttgacgttttcatttgcatgtctcatagacatcaccaaattaacatttctgaatgtaactcttagcttcacccccagtgcttcccctccacttcccacagttttcccagctctgaaaatggcaccgccatcaacccaattggtctaacaagaaatctagagttattcttgagtcctcccatttctttacttctcatcttgaatccctgtgcaatttttgttctaaatacaaaatagatctccaatctaaccccttctcatctccactggtaccascatgtttagtttatcatcatctttgtcctagaccacagcttccaaattggtctctggtttttgtcccaccttcctccaatcctttccatgaactgaaaacctaggggaggtccctgtacagcctctagaacaagaacgcctccagacctaagtgactttttcagaacagaggtatctggaagctgctcatcatggatacaactgaagatcaaggcagcaattagaaggttattagattgtccacctcctgagtagttatcctgaaagttaatatgtcaagcaacttaactaacccttttc

SEQ ID NO: 4214 - DNA, 601 bp, Human
caagaatcacctgcagaactttaaaaaaccccaaagcccaggctgcagtccagagcaattacatcagaatgcctgcatgggggactgaagcatccatagtttcaaagcttcccagatgattgcaacgtgcagccaaggctgtgaaccaccgtcctctctctggactgcaaactctctttcctggttcctctccgtcaccataaaataacacccactctctcttgtctttaaaaaattctcctttgaccttcgcttcaacatctaggtgctacagaaagtcttgagaaaggtgccatctccygccgtctctactttctcgcctcctgtttacaacacagcccatgaccatctccctggcttctgtctctatcactttagtgaaaccgtccttttcaagatcatcgaagacatccatatttccacactatatggccactttcctcccctatcctattcaactaatcatagcattaaacagagttgactgctgtcttgaatctatcaatgtgtctggctctgggctcttttgatctccttgcgctccactgactgctcctgctcagcctcctttgttgacttctcctttgtctcaactcttaat

SEQ ID NO: 4215 - DNA, 601 bp, Human
tctctggagagagtagatagccccacccatcacaggcccttcttcacctgttccctggattccaaccactcaaggatttcactcctgaaacttctcaaccttagctccaagaatcacctgcagaactttaaaaaaccccaaagcccaggctgcagtccagagcaattacatcagaatgcctgcatgggggactgaagcatccatagtttcaaagcttcccagatgattgcaacgtgcagccaaggctgtgaaccaccgtcctctctctggactgcaaactctctttcctggttcctctccrtcaccataaaataacacccactctctcttgtctttaaaaaattctcctttgaccttcgcttcaacatctaggtgctacagaaagtcttgagaaaggtgccatctcccgccgtctctactttctcgcctcctgtttacaacacagcccatgaccatctccctggcttctgtctctatcactttagtgaaaccgtccttttcaagatcatcgaagacatccatatttccacactatatggccactttcctcccctatcctattcaactaatcatagcattaaacagagttgactgctgtctt

SEQ ID NO: 4216 - DNA, 601 bp, Human
agcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccacagagtgcatccttcctgctctcaccctccatcccaaactgcagttaaggtctgggcattcacagrtgttgtgtgtggctgcttttgttgttgttgccaacattgaaattgaaggtgacggtcaagtttctcacttgcagcagcacaagtgtgagtaggactcctagaggcagaggcagccatgaagtcagaaatccctaaagaatttgcagagatgtttgggcctccacaggccaagtaatgaagaagattgtgctagtttgccctgtgttctggaagcagggagcaccctcccggcatgtccctgtaataagttcaccttctaccctccagatgactagctcacatcttccctatcaagcgttt

SEQ ID NO: 4217 - DNA, 601 bp, Human
attgtttcgtgattattatgaaaccagtggtccgctaagtgttgaccccgaccagcagcaacagcatctcccaggaactggttagaaatgcaaattctcaggccaggcctcagacctactcaacctgagggtgctgcacagaagtggctgaacaagccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtgstgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccacagagtgcatccttcctgctctcaccctccatcccaaactgcagttaaggtctgggcattcacagatgttgtgtgtggctgcttttgttgttgttgccaacattgaaat

SEQ ID NO: 4218 - DNA, 601 bp, Human
cccaagcaatcctcctgcctcagcttcccaagtagctgggaccgcaggctgctctgggggccatgcccagctttattgtttcgtgattattatgaaaccagtggtccgctaagtgttgaccccgaccagcagcaacagcatctcccaggaactggttagaaatgcaaattctcaggccaggcctcagacctactcaacctgagggtgctgcacagaagtggctgaacaagccctccaggtgattctgatgtgctccaagcgtggtgaccctccaggtgattctgatgtgctccaagcgtgstgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccctccaggtgattctgatgtgctccaagcgtggtgaccacagagtgcatccttcctgctctcaccctccatccc

SEQ ID NO: 4219 - DNA, 601 bp, Human
ctgtggcccaggctggagtgcagtggtacgatctcggctcactgcaacctccgcctcccaggttcaagcagttctcctgcctcagcctcctgagtagctgagattacaggcacacaccaccatgcccagctaatttttgtatgtttagtagagatggggtttcaccatgttgatcaggctgatcttgaactcctgacctcatgatctgcctgccttggtctcccgaagtgctgggattacaggcgtgagccactgggcccggccctgcctcttgagttttaaagttattgcttattgtctytctttcttcttagagacaggctggcggggctgcctcgaactcctgggcccaagcaatcctcctgcctcagcttcccaagtagctgggaccgcaggctgctctgggggccatgcccagctttattgtttcgtgattattatgaaaccagtggtccgctaagtgttgaccccgaccagcagcaacagcatctcccaggaactggttagaaatgcaaattctcaggccaggcctcagacctactcaacctgagggtgctgcacagaagtggctgaacaagccctccaggtgattctgatgtgc

SEQ ID NO: 4220 - DNA, 601 bp, Human
tgggtacagttctctctaacacccaggagaagggtttcctcccagaatggacccgaagcccggttagcaccactaaactaaaaactaagcaagcaattattctccccgcatgcacccctgccttcactgatgtggcattgctattgatccccattaatgatttagtgattaaggaggataaattgcctatgaatgcaaagcaggctgaagggccctcaggagcacagctgagcattctcctatcaataagtgctgtgcatgctgctgtaattttcagcccagcatcctgtgccacctcggrccacaatcttgttcacctggctgtcttttgacaatttctggaaacagttttccttcttatcttctgctatctttttcacttgggcgacagtctcacccctctcttttgacctactttccagttaccaggccatagcgctgaatcctttgttatgcattaacacacacacaagcataaaactgcaggggactgctgggctacagtgtatgtgcttgtgtgtgtgttggggggagcggttcatcatatcatcccctttttgggttatgctttgcgtgctaggccgggaaaccacacaataag

SEQ ID NO: 4221 - DNA, 601 bp, Human
aattcagtattgactttgaatttttctgaatgaatacataatactgtcgtactgtgcacaggtcattgtgttgtcatgggcatgggatgcgacatactatcaatatttgtggattgatggatgaatggctctagcctgagggcgtaaatgctggtctgggctcaagagtctccaagagaaggaatgtgggtcattgttactctgaggacaccagtcttggttacttactccattctgtatgaaaggggctaaaaagaccttatataaatacaaagcaaattggctaaggatgaatttaatrataaaatacaagcaggtcatatttatttatttgctgttaaaagcatccaagatattgggaacatattgatttcttcatattaaattaaattgatttatttgtttaaagaaaagtgaaaaaacacattgaataaaaaggaaatattagatgctaatttggtgtcagatgctaagagatagagaaatccacacacacatcacccacagacacactcctcccagcacaccagatatgtttttgacttttctcaagatggtaaggtctgagattacatttacaagttatctgtaatgacagggt

SEQ ID NO: 4222 - DNA, 601 bp, Human
ctgccatagtcccagtacctaattcagtattgactttgaatttttctgaatgaatacataatactgtcgtactgtgcacaggtcattgtgttgtcatgggcatgggatgcgacatactatcaatatttgtggattgatggatgaatggctctagcctgagggcgtaaatgctggtctgggctcaagagtctccaagagaaggaatgtgggtcattgttactctgaggacaccagtcttggttacttactccattctgtatgaaaggggctaaaaagaccttatataaatacaaagcaaatwggctaaggatgaatttaatgataaaatacaagcaggtcatatttatttatttgctgttaaaagcatccaagatattgggaacatattgatttcttcatattaaattaaattgatttatttgtttaaagaaaagtgaaaaaacacattgaataaaaaggaaatattagatgctaatttggtgtcagatgctaagagatagagaaatccacacacacatcacccacagacacactcctcccagcacaccagatatgtttttgacttttctcaagatggtaaggtctgagattacatttacaa

SEQ ID NO: 4223 - DNA, 601 bp, Human
cagaatcttctcggctggccatctattggttttttttcttttgttacacaatgccagatactgatggcttttgttttaaaaatataagtgcttaccttgacagagtcaggatgctccagggttagcctcagtttgtttcttaattttctataggactttgagaaatgcacgtaacatcacagaacctgctttctctcttgaaatctgagtctaataatcgtctccttgcctctcagaatggtgattatcagttcagttcagcaaacatttactgaacattgactcaattccaggcaccacraaaggctgaatgagataaggattacaccttccaaacacacaatctagggagatactgactatgagcacactttgaagcatataagagactctacaaggaaggaattgtaaaccacatgaattggtgggtgaatgtgtctctgcattagacacttccaaccatgctctttctagaaacaccttgtaaagacctttgcacctcaatcctggggtcacctacatgccattgaaaagaaggtttactgtgagctctctgggatcctttctgattacagggccacactaaatgatcctcgcttgg

SEQ ID NO: 4224 - DNA, 601 bp, Human
tgcagagcaaatgtgactccggactggtgtcaccatgatatgtttttccatcacaaagtacatcaaaaggggtggcagattctaacaggctgtgtgtgctgtggcataccaggagtaacttcctgtcggtggcaattgtgagcatattaaggaatggcatttttagagtctgagctttttattctggaaggatccaaacgcactgccttcctaaaatggtttcatatagccactccagagacgttgcttgcctatctagtaacactggaatggaatcaatctatgaagcacaagcaaatgkttcctcaatagtcagttgagtttgcttctttccttttagccccttcagtataaagtagagtagttcgccaggactggtatcctcgaaataacaatgactaacaccgcttctcttggagacccttgagcctagaccagaatttgcaccctcaggctactgccattcatccatcaattcacagatattgatagtatatctcccacagtgctcacgacagcacaatcatccgtgcgtgcatagtacaacatagtttacattccttacaaacatgctgcattacagctcacaccagcttgagaa

SEQ ID NO: 4225 - DNA, 601 bp, Human
aaagattcatgctgggagtgtgtaatcactcttagagggagtggcttgatctgcagagcaaatgtgactccggactggtgtcaccatgatatgtttttccatcacaaagtacatcaaaaggggtggcagattctaacaggctgtgtgtgctgtggcataccaggagtaacttcctgtcggtggcaattgtgagcatattaaggaatggcatttttagagtctgagctttttattctggaaggatccaaacgcactgccttcctaaaatggtttcatatagccactccagagacgttgcttkcctatctagtaacactggaatggaatcaatctatgaagcacaagcaaatggttcctcaatagtcagttgagtttgcttctttccttttagccccttcagtataaagtagagtagttcgccaggactggtatcctcgaaataacaatgactaacaccgcttctcttggagacccttgagcctagaccagaatttgcaccctcaggctactgccattcatccatcaattcacagatattgatagtatatctcccacagtgctcacgacagcacaatcatccgtgcgtgcatagtacaacata

SEQ ID NO: 4226 - DNA, 601 bp, Human
gacaactctttgatcgtaggtgacctctggcagacaaccaccattacgataaaactctgagaaaaacagattacacatggcaccattggtgagtgtgacacagcacctccatccactgcccagagcaactctgtcaccagaacagaccttcaaaatgcctcgtaaataaccacccttgcaggctgactaacaatttacaagaggcatgtagtgaagaataatgacctcatttattttactgttcctctggtgggaatagaagggtagttaaaaaagaaaagagtgggccaagaaaatttgsggtggatttcagtcaccctctgacattcccactgtcctcccgacccagagaaggtaaggatttataacaaacatgtaaaaacaaatgctgagcctactgattttagtatctgtataacctctttgtgagaaggaagatcattcatcattgcatgggctgatacattccttctgcttatttacatgctatttcaaagtcagagcaagttccatttccttggtcattaggctcaagtctggcaaagggagcccaggaattaaacaaaactatggtgctagaacagctaacctacatggtctc

SEQ ID NO: 4227 - DNA, 601 bp, Human
tagacagctcccagagtaggagcggctgcaccttggaccaactgacaactctttgatcgtaggtgacctctggcagacaaccaccattacgataaaactctgagaaaaacagattacacatggcaccattggtgagtgtgacacagcacctccatccactgcccagagcaactctgtcaccagaacagaccttcaaaatgcctcgtaaataaccacccttgcaggctgactaacaatttacaagaggcatgtagtgaagaataatgacctcatttattttactgttcctctggtgggaatrgaagggtagttaaaaaagaaaagagtgggccaagaaaatttggggtggatttcagtcaccctctgacattcccactgtcctcccgacccagagaaggtaaggatttataacaaacatgtaaaaacaaatgctgagcctactgattttagtatctgtataacctctttgtgagaaggaagatcattcatcattgcatgggctgatacattccttctgcttatttacatgctatttcaaagtcagagcaagttccatttccttggtcattaggctcaagtctggcaaagggagcccaggaat

SEQ ID NO: 4228 - DNA, 601 bp, Human
aaatgaggtacagagcaacaggttgacacaatctcttttgtggttttaaaaaacctaaattctctaggtatatatatgccatcaatacataaaatgatagcaaagtatctgtaatgatatacacagttaaagttggttttccctggggattctctaggattggaagattggtgaaaaggaaagttttcttttagccatgtaaatgtacatgtgtgtttatttgaaaagaacaatatattcaattaattgccaattaaaaatgaaaagcactgaaaatactttaaatggatgacattacaasaaaatgttaattgttagtgtctctaatttgtagatctttgagctctttttatgcttttattattttttatttctataatgagacttttccatcagataaagttattttctaaaatgtgtttccatttaagtgaagctacccatttaaaaagagattaacaagtccaacttttgtgcattagtttttctttaagagcaatatagggttgtgctcttttttattatcagagtccttcaacacaacttttttctccttctttaagtctccctgaaccctttcctttccagcacagattgaatt

SEQ ID NO: 4229 - DNA, 601 bp, Human
aaccaaacttctactcagaagttttggaactttgcatgctcattcaaaagcttatctggaaaaaacaatgtgaaagaaaacagccaggcagggcgtggtggctcatgcttgtaatcccagcactttgggaggctgaggcaggtggatcacttgaggtcagaagtttgagaccagcctggccaatacagtgaaaccccatctctactaaaaataaaaatataagccaggcatggtggtgtgtgcctgtaatcctagctactcgggaggctgaggcaggagaatcgcttgagcccaggaggcygagatagcactactgcactccaggctgggcaacagagctagaatctgtcccaaaaaaaaaaaaaaaaaaaaagagagagagagagagagaaaatagccaaaaactaatatgttgaaaaagaagaaagattgaaggacttgcccaaaggtaaattaaactttggaccccaatttatagtttcctgcatctatgccctttgccatgtaactagcagttcttccctctaaatgtggaatatcctctcttaactttaggcttattttggctaatggggtgttagcagaagcaatgttagcagaa

SEQ ID NO: 4230 - DNA, 601 bp, Human
atgattactagaatttacttgaaaatgctaaggcaaaaaataaggaaaaaagggatagataaagcaaatgtggcaaaatcttgataaccattaactctgagagtcatataagtagatattcattgtgctactctttctgcttttgagtttatctgaaaatatttataagaaaaattaactttgtcaaaagatataaaactgaaatacaaaatgaacacatacaaaatgtttccaattggatgtgaacattcagtaatgtaaagatataaattctacccaaattagtctatatgaccaatgkgaacccaaccaaacttctactcagaagttttggaactttgcatgctcattcaaaagcttatctggaaaaaacaatgtgaaagaaaacagccaggcagggcgtggtggctcatgcttgtaatcccagcactttgggaggctgaggcaggtggatcacttgaggtcagaagtttgagaccagcctggccaatacagtgaaaccccatctctactaaaaataaaaatataagccaggcatggtggtgtgtgcctgtaatcctagctactcgggaggctgaggcaggagaatcgcttgagccca

SEQ ID NO: 4231 - DNA, 601 bp, Human
gtctatttttaaaaagctacacgctaaaatatgtacaggtaaaataatatgattactagaatttacttgaaaatgctaaggcaaaaaataaggaaaaaagggatagataaagcaaatgtggcaaaatcttgataaccattaactctgagagtcatataagtagatattcattgtgctactctttctgcttttgagtttatctgaaaatatttataagaaaaattaactttgtcaaaagatataaaactgaaatacaaaatgaacacatacaaaatgtttccaattggatgtgaacattcastaatgtaaagatataaattctacccaaattagtctatatgaccaatgtgaacccaaccaaacttctactcagaagttttggaactttgcatgctcattcaaaagcttatctggaaaaaacaatgtgaaagaaaacagccaggcagggcgtggtggctcatgcttgtaatcccagcactttgggaggctgaggcaggtggatcacttgaggtcagaagtttgagaccagcctggccaatacagtgaaaccccatctctactaaaaataaaaatataagccaggcatggtggtgtgtgcctg

SEQ ID NO: 4232 - DNA, 601 bp, Human
gagctcttgttgatttgtattagctgcaataattatacacaaacacacttaaacacatacatacacacatatgtacatatgtatctatgtatactgtatatatgtctatttttaaaaagctacacgctaaaatatgtacaggtaaaataatatgattactagaatttacttgaaaatgctaaggcaaaaaataaggaaaaaagggatagataaagcaaatgtggcaaaatcttgataaccattaactctgagagtcatataagtagatattcattgtgctactctttctgcttttgagttyatctgaaaatatttataagaaaaattaactttgtcaaaagatataaaactgaaatacaaaatgaacacatacaaaatgtttccaattggatgtgaacattcagtaatgtaaagatataaattctacccaaattagtctatatgaccaatgtgaacccaaccaaacttctactcagaagttttggaactttgcatgctcattcaaaagcttatctggaaaaaacaatgtgaaagaaaacagccaggcagggcgtggtggctcatgcttgtaatcccagcactttgggaggctgaggcaggt

SEQ ID NO: 4233 - DNA, 601 bp, Human
gttctacataaaaaatgactcagtttcagccataagtttgtggcatgaagaaacagatgaagaggattactctagaggaaaagatttaagtgacataccaaccaaatttaatctacagaccttaatccaaataaactaactaaaaagataatttttggacattgggaaaattagattaaagatggttcattagataataccaaggagctcttgttgatttgtattagctgcaataattatacacaaacacacttaaacacatacatacacacatatgtacatatgtatctatgtatactgyatatatgtctatttttaaaaagctacacgctaaaatatgtacaggtaaaataatatgattactagaatttacttgaaaatgctaaggcaaaaaataaggaaaaaagggatagataaagcaaatgtggcaaaatcttgataaccattaactctgagagtcatataagtagatattcattgtgctactctttctgcttttgagtttatctgaaaatatttataagaaaaattaactttgtcaaaagatataaaactgaaatacaaaatgaacacatacaaaatgtttccaattggatgtgaa

SEQ ID NO: 4234 - DNA, 601 bp, Human
tatgtatcttctgccaggatgaatgtcctaggaagcaatggcgtgacttatgaaatatttttgccccttcctccaaaaaaaaaatgccacttggagctgaatctgacagagtctgtagatctaaccagctgcttaacagaaaatgccacagtggttaaaaaaaaatcccacagtggttagagaaaaatatttcatgacaccgggggatggaatcagcaaaattcagaatatggaaagttctacataaaaaatgactcagtttcagccataagtttgtggcatgaagaaacagatgaagagrattactctagaggaaaagatttaagtgacataccaaccaaatttaatctacagaccttaatccaaataaactaactaaaaagataatttttggacattgggaaaattagattaaagatggttcattagataataccaaggagctcttgttgatttgtattagctgcaataattatacacaaacacacttaaacacatacatacacacatatgtacatatgtatctatgtatactgtatatatgtctatttttaaaaagctacacgctaaaatatgtacaggtaaaataatatgattacta

SEQ ID NO: 4235 - DNA, 601 bp, Human
aaaaaatgccctttgtttcaccaagcatagctcatttcccaatatttttagtaatggtgaacataatcagcaccaaattcagtctgtaaatgatgacatttgttagcaaaatgctgacgaactctggctctttaagttccaagcagcagaattaaattgatatgtctcattaaacattttatgattctgttgcatcagtagtttcagaattctatgatgctgatgtacatctctaacactaattaaaatataatttccaaccttttaacattaatagaaaactagatgaattgaaaatgayttttaaaacaaatctgggacacgtgagaaggcccacgtgtcatgtctgttttgtggcccatcactggcaggagggaagcagtaggtcatctccttttaatgaaagatacttgtgaatgtgcaagtatgtgtgtgtgtccaaccagcttccctggccagtgtctttcattgcaaggacttttcttccctgtggctagaatttcaggaggatcatcctccccgtctatcatcagtctggtacttattcccaggcctggtgggagagcagcaaagcatctttaacacagacaggaccctacaa

SEQ ID NO: 4236 - DNA, 601 bp, Human
ctgtttccaaacacttgcaagtttatgcaagtttattttgtttctaaactacatttaatcagccaaatttttaaaaaatgccctttgtttcaccaagcatagctcatttcccaatatttttagtaatggtgaacataatcagcaccaaattcagtctgtaaatgatgacatttgttagcaaaatgctgacgaactctggctctttaagttccaagcagcagaattaaattgatatgtctcattaaacattttatgattctgttgcatcagtagtttcagaattctatgatgctgatgtacrtctctaacactaattaaaatataatttccaaccttttaacattaatagaaaactagatgaattgaaaatgatttttaaaacaaatctgggacacgtgagaaggcccacgtgtcatgtctgttttgtggcccatcactggcaggagggaagcagtaggtcatctccttttaatgaaagatacttgtgaatgtgcaagtatgtgtgtgtgtccaaccagcttccctggccagtgtctttcattgcaaggacttttcttccctgtggctagaatttcaggaggatcatcctccccgtctatca

SEQ ID NO: 4237 - DNA, 601 bp, Human
atgtcattcaggacatactcttctctttctttctcattgtccagatacacagcatcatctgcatcagggtttaaacatagtgactattaccaaaccagactgtttccaaacacttgcaagtttatgcaagtttattttgtttctaaactacatttaatcagccaaatttttaaaaaatgccctttgtttcaccaagcatagctcatttcccaatatttttagtaatggtgaacataatcagcaccaaattcagtctgtaaatgatgacatttgttagcaaaatgctgacgaactctggctytttaagttccaagcagcagaattaaattgatatgtctcattaaacattttatgattctgttgcatcagtagtttcagaattctatgatgctgatgtacatctctaacactaattaaaatataatttccaaccttttaacattaatagaaaactagatgaattgaaaatgatttttaaaacaaatctgggacacgtgagaaggcccacgtgtcatgtctgttttgtggcccatcactggcaggagggaagcagtaggtcatctccttttaatgaaagatacttgtgaatgtgcaagtatgt

SEQ ID NO: 4238 - DNA, 601 bp, Human; identical to SEQ ID NO: 993

SEQ ID NO: 4239 - DNA, 601 bp, Human; identical to SEQ ID NO: 994

SEQ ID NO: 4240 - DNA, 601 bp, Human; identical to SEQ ID NO: 995

SEQ ID NO: 4241 - DNA, 601 bp, Human; identical to SEQ ID NO: 996

SEQ ID NO: 4242 - DNA, 601 bp, Human; identical to SEQ ID NO: 997

SEQ ID NO: 4243 - DNA, 601 bp, Human; identical to SEQ ID NO: 998

SEQ ID NO: 4244 - DNA, 601 bp, Human; identical to SEQ ID NO: 999

SEQ ID NO: 4245 - DNA, 601 bp, Human; identical to SEQ ID NO: 1000

SEQ ID NO: 4246 - DNA, 601 bp, Human; identical to SEQ ID NO: 1001

SEQ ID NO: 4247 - DNA, 601 bp, Human; identical to SEQ ID NO: 1002

SEQ ID NO: 4248 - DNA, 601 bp, Human; identical to SEQ ID NO: 1003

SEQ ID NO: 4249 - DNA, 601 bp, Human; identical to SEQ ID NO: 1004

SEQ ID NO: 4250 - DNA, 601 bp, Human
tttcttaaattcacatgtagcttagttattaataaaataaaagccaccattcttaaaagctaaccagaaattatatttcatatcattcacagtctaatatttttatattaacaatattgatttcatttagctcaaaagaatatacaaaccaaactcaaacataacattctttcaaaaagaggatttcttagaaaacttagggaaattggtaatataagtatttctttttttcagtctttgattgtttgaaataccacccagtttaacatttcttcagaaataatctactcttcagccagaytgggtctacttctctgtaccaacatctggctctccatgttgggtacattgatataatccaggactgcatgggtcctggacatcccatttaatccacgtcctatgcctggcccacccttcccactcatgggagttctatctcctttctcagaaagttgttccactgcaagatctctgcattctcaaagttgttttaggatatcctgcagagagcggcatgaaaagtagaaaatgtctagatttgaagtcagcagaccggagttctagctgtggctttgtcactgaaagctgtccttaccct

SEQ ID NO: 4251 - DNA, 601 bp, Human
ctcaaaatgtctcaggtcaggacctctaccccttaacacccaaattctccccctccaaaaataaaaccaaaccgttttccaaatggattttctctgtctagttttaaatcttttaattgggatataaattttcaaacttagaacttcataggctttacatgattaataaaatctcagggcaatttgcattaggagtatgtgtgcttattcaataattaacagcttccgcttagccagctgccaccacagacacattaggttaactgcttcctgtctgcttctcttttgcactggcttctgytaggcagtgatttctgacttctgggtgcgtaaaagtacacacagtgtgtgagtaagcttatgctgatgagtgtgccattttagaatgcttaagaaggaattaatttaaatttaaccactgctagctgttgcttcctttcttactgcaaaattgttatggtaacttcaaagaagaaaaagagaaatcttgtgggcgaaacagtaaaaatagtgatcagatgcaagtctaatatatttgttataaacggtcatgacactttggtaaacatttcccaaattcaacattcccccaaatctttgg

SEQ ID NO: 4252 - DNA, 601 bp, Human
ctaataaagtcaaatcattcattgagaaatttaaagattttttttgtctttgttctttgtttaactgcattcagaaatttcatgatagatttccaggatttgtgaacgggagagtatctgcctgaatgaccaaagaacacttgatctttcctctgtgtcattttttaaattgatttttggaggctcagtattttagcttttaaaattattaaaacggaacagattttggaaagattcacagaggtattctaaggtttaaaggagctaatagaggtgaaagtgtttttgaaaaccattgaayattttgtgtatataaacaagggtatgacggaaatggaaatattgctcaaaatgtctcaggtcaggacctctaccccttaacacccaaattctccccctccaaaaataaaaccaaaccgttttccaaatggattttctctgtctagttttaaatcttttaattgggatataaattttcaaacttagaacttcataggctttacatgattaataaaatctcagggcaatttgcattaggagtatgtgtgcttattcaataattaacagcttccgcttagccagctgccaccacagacacatt

SEQ ID NO: 4253 - DNA, 601 bp, Human
caggaacaggcatagacaggtaaccacgccgcagtaatgccaggtggttgcacagccttcccttttccccagaaccatgctgcccttgtcacaatatgtcacggcccaccttctttgatagtctgactcagggctcagagtccatgtctggcttattcacagaaacttggggctagcaatagaatgctttattaatgccatgtgagggaagtaagtgttcggatggcacaaagttaagcattctccttagctttctctggcaattttcctggtgggaactgtcacatcagaaatgcattgraaagaaagcagcaatcaagcaatgcaatttaaagggagaagtataactgtgggcaagtttcttcattttttctaattgcttctcttttttttcttttctctcttaaatcaatctgcagtatagcttggtaaaatgcaccactcagtatttaaaggagcctaagcaaaagttagcttatgtaaggttataatatctcaggcctaatctctagatgatgagaatacaggattttggacttgctttctcctgggaaactccaatagccccaggctgtccagattgtcataacttttcctactt

SEQ ID NO: 4254 - DNA, 601 bp, Human
tggcaataacgtgttgatagtggccctctaaggtaatatgatctgagagtaaggaccatatctggtttcagctcagccacttatttgctgtgtgactttgagtgagggacaccacttccaagggcttctgcttcctcacccagaagactcttggagagtcctccccattgcacacgctggttcagcatgtgtttcgacacagatcctccactggtaatgccttgacccactggagcaaatatggatggaggtggtacatgtaggtgtgtcacagtgaataacgagcctttatctgcagtarcggcagcctttgcagaagcagctgcatctccttgggggaaattctctgcccatagttgctgccagatcctatcagtcgggaggcaggaacaggcatagacaggtaaccacgccgcagtaatgccaggtggttgcacagccttcccttttccccagaaccatgctgcccttgtcacaatatgtcacggcccaccttctttgatagtctgactcagggctcagagtccatgtctggcttattcacagaaacttggggctagcaatagaatgctttattaatgccatgtgagggaagtaagtg

SEQ ID NO: 4255 - DNA, 601 bp, Human
atctttctaaatactgggacaaaaagagggggaggaaaagatggacaaagggaaaataactttattttctgtttatctgtaggatcacagatgcatgaggatcagaagcactaaagtccatttcatctcaaaggtctacagtcattcatcttgtactgtgtcctagaaaaatccaggacctactccgaattgtggtcagtttgatttactagctgaagttcaagatttttttacaatgctaaagagtacatcgaacatcgattggttaaaaaagtttagtcatgagttagttcccaaaagkcatagtcagagcaaagtattaatggggattaatgatggcattgtggttcgatattagcaaaaggccagggttaaaaataaatgcatacatctcaagggaagctggatagtccaggatggcagcagtacaaacactgaaatttaaaaatatgtaactatattgacgtttttttctctcctcctactttcctaattttctcattaatattaccttttttcttactacaactgaatcagaataccatggatcaagtaactgtaaatgttgagatcctatggaataaacttcagttgtgtcaac

SEQ ID NO: 4256 - DNA, 601 bp, Human
atgatcaaggaataaactttagaaataaatacaaactttatatatttatttctgtctttacagttcatttgggatgactcaggtgtgaaatttctaatcaaagtgaacttttaaatgtaatctgaatatttataattaaggtttgttgcatgaagaggtttgctcaacgtgaagcttcctataagatgaccaagtaaacaattgaaagaaaatgaacaaaacatggttttatagttaaccccttgaggagctgcttggcaagatataaaagtagttatgtcattactgtctttttcatgcrtggaaagaaaaaaatctttctaaatactgggacaaaaagagggggaggaaaagatggacaaagggaaaataactttattttctgtttatctgtaggatcacagatgcatgaggatcagaagcactaaagtccatttcatctcaaaggtctacagtcattcatcttgtactgtgtcctagaaaaatccaggacctactccgaattgtggtcagtttgatttactagctgaagttcaagatttttttacaatgctaaagagtacatcgaacatcgattggttaaaaaagtttagtcatgagt

SEQ ID NO: 4257 - DNA, 601 bp, Human
aagcagacatttagattgcccatgattatcacattcgagagatgccttgtaataaatgtctgtttttctccaaaaatatggggtgaagaggcataagaaatgtaagcttaataattgagaaaccaagctgtttgaccacaaatggaaacttcattacactgctggcttttaccataagagaaaaaagataatgtctgagcagttcatcgtccccccactgcccccacctgaaagagaaggattgaatcagacaggacatgtaaaaggcattatatctgtatccaaggagctcatgtgacckggagagaggacagacagaggacaaatccaggggaaatagaacattgtgtgtgaattagtggggccaggcaactcatgacccacccccagtgctaccagcaaccttggataaagttacttaacttcctgatgcctcagtctctccacctgcactttggttatttatggaatggatttatgcaatttctcaaaagtggctatgaagatactttctgttagataaattctattttcccactggcttccaatatatctgtcaattttttaaaaatcttcaatgaacagaaatgaaaatccctgg

SEQ ID NO: 4258 - DNA, 601 bp, Human
actagaggaaagcagtaaaaaaggcagtgtggtattgtcataaggacatacatataaactaatgaaacagaaaagagagtctagaaatagatccatactcatgtagacatttgatttctgacaaagtcaccaaagcaattcaatgaagaaaatgacagtcttttcaacaaagaaactctttgcaacgaatgaaagcctttccaacagtcttttcaacaaatgctggtggaacaaatggataaatttggaaaaaataagatttgatccctacctcacacaacaccaaaaggtaactcaagayggatcatagaccacaatgtaaaagttcaaattataaagcttcaaaaataaaacataggagaaatagtggcaaacatgggcaaatagtgattcatgtgaaagtcttcatgtggaaagaacatttactggggatgactattaaagaacaatgaaaaaatttgattttataaaatttaaaaacttttgttacttaaaatatgccatttataaaatataactacaagccatagtttggggaaaatatgttctatacatatctgacaaatgagaggtatatacacagagcaactataacttaata

SEQ ID NO: 4259 - DNA, 601 bp, Human
aaagcattcaacaaaatccaacattgctttatcattaaaactctcagcaaaatcagcatacaagggacataccttaatgtaataaaagccatctatgacaaacccacagccaacataatactgaatgaggaaatgttgaaagccatttcctctgagaactggaataagacaaggagtcccactgtcaccactcctcttcaacatagtactggaagtcctagccagagcaataagttaagagaaagaaataaaggacatccaaataggtaaagaggaagtcaaactgtcactgtttgctgaygatatgattgtttaccttgaaaaccccaaggactcctccagaaagctcctaggactgataaaagaattcagcaaagtttctggatacaagattaatgtacacaaatcattagctcttctctacatcaacagtgaccaagtggagcatcaaatcaagcattcagcccccttttacacacattgtcgaacatgaagtacttcagggaatatggtacctatcataaccaaactattaatacttgaaagtgatatcaaaataattaggggctgagtcaaacaaagaacccaggaacagagactc

SEQ ID NO: 4260 - DNA, 601 bp, Human
atacttccccggccttgctagagacctagacatccaaatacaagaagcacaaacaacacccaggaaattcattgcagaaagatctttgcctaggcacattgtcattaggttatccaaagttaagacaaagaaaagaatcttaagagctgtgagacagaagcatcaggtaacctataaaagaaaacctatcagatgaacagcaaatttctcagcagaaaccctacaatctagaagggattggaaccctatcttcagcctcttcaaacaaaacaattatcagccaagaattttgtatccagcraaactaagcatcatatatgaaagaaagatacagcctttttcagacaaacaaatgctgagataattcaccattaccaagccaccactacaagaactgctaaaaggagctctaaatcttgaagcaaatcctggaaacacatcaaaacagaacttctttaaagcataaatcacacaggacctatgaaacaaaaatacaagttaaaaagcaaaaacaaaaaacaaaaaaaccaaagtacacaggcaacaaagagcatgatgaatgtaatggtacctcacatttcaacactaacattgaatgtaa

SEQ ID NO: 4261 - DNA, 601 bp, Human
tatttggggtaataattgaggaatacttccccggccttgctagagacctagacatccaaatacaagaagcacaaacaacacccaggaaattcattgcagaaagatctttgcctaggcacattgtcattaggttatccaaagttaagacaaagaaaagaatcttaagagctgtgagacagaagcatcaggtaacctataaaagaaaacctatcagatgaacagcaaatttctcagcagaaaccctacaatctagaagggattggaaccctatcttcagcctcttcaaacaaaacaattatcrgccaagaattttgtatccagcgaaactaagcatcatatatgaaagaaagatacagcctttttcagacaaacaaatgctgagataattcaccattaccaagccaccactacaagaactgctaaaaggagctctaaatcttgaagcaaatcctggaaacacatcaaaacagaacttctttaaagcataaatcacacaggacctatgaaacaaaaatacaagttaaaaagcaaaaacaaaaaacaaaaaaaccaaagtacacaggcaacaaagagcatgatgaatgtaatggtacctcacatt

SEQ ID NO: 4262 - DNA, 601 bp, Human
agcagctgcagcaagacctgcccaaggagagtctgacctcagacacgcctagcccagcccccagttgatggtcctttcctacctaccctgctagtggaagacaaagggcatataatcttgggagttctggggccctgcccaccactggttcctccccatactaccacagctactgctctctggaaagcaccacctcctggcagggagccaaccagcacaaaaatagagcattaaacaccaaagctaagaaccctaacagtgtccattgtaccccctgccacctccaccggaataggcgctrttccggtggctgagagggacccagagatggctcacatcacaggattctgtgcagacaatgcccagtgtcactccagagctgggtagacttgctgggtgggtagacccagaagagagacaatcactgcaatttggctcacaggaagccacatccataggaaaagggggagagtactacatcaagggaacatcccatgggacaaaataatctgaacaacagccttcagccctagaccttccctctgacagagcctacccagatgagaaggaactgtaatatgacaaaacaaggctcttcaac

SEQ ID NO: 4263 - DNA, 601 bp, Human
actccacatggagaaggaaatctctagctgaactttgtagcaatttgaatggggtgagaagcctcctggccaaaacttgggggagggtgcaaatccggtgtgcagactccacaggtgtggaagaaccaaacccttttcttttgcagctgggaggtgggtagaccgggtcaggttttcaaggccatcttgccctctgcctggaaatggacttagggctgttgaggggggcacggtgggagtgagactggccctttggtttgcatggcagctgggtgactcctgtgactgccagcttcccccmacttccctgacaacctgcatgactcagcagaggcagccataatcctcttaggtacacagctccagtgacctagaaatctcacccccatcccccacagcagctgcagcaagacctgcccaaggagagtctgacctcagacacgcctagcccagcccccagttgatggtcctttcctacctaccctgctagtggaagacaaagggcatataatcttgggagttctggggccctgcccaccactggttcctccccatactaccacagctactgctctctggaaagcaccacctcctggcaggg

SEQ ID NO: 4264 - DNA, 601 bp, Human
aaaagtatctgcaccttaaaagaggtagagattctggaacacaattgggaaataatacaagctgagcgtatcccccaatggaactgagatatgcctccagttgtgggggtgggttctggagtgacagatgtaggagaatcttaagggaaagagcagaccctaagcatgataccaaagattgttcatcttctaatactgtagtcctcactccaatctcttgcagagtactgaagagtagatagaatgtggtacattggcctcaaattgtagttcagaagtgagatcaaactaaccttagatkgagaagaatttcatttattacagcaaatagaacgtctagagacaagaatgatgcaagtttgagcataaatatagggaaaagaaactgcatgcagaggaagagacagaaagagagagagggagagatcatgaaaaaatatacatagaagaaaacgaaattaaggagcataagtcatttttctcacaaccttttaggagatcacagaccaaggcaacaaattgaggaccaaatcataccattacagagctaataataaattataaactgcaagaaacagaatacatattattaaaaataaaa

SEQ ID NO: 4265 - DNA, 601 bp, Human
ctaaattgccctcccataatacctacaaaattagaaaaaaatttcaaaaacccctaaaagtcattatcagcataatgcaataaacttcaaaacatggtcccaacaaaacatgaggactatggagtaaagcagagaggcaacatggctcagctcctaaccttaaccatcttaccagctagtcaacaaaaacctgagatttctaatttatattttaaattctagaaagtaataaatataatcaaaatgctgatctttttggccaggcatgtaatcccagccctttgagaggatgaggcagatrgattgcttgaggtcaggaattcaagaccagcctggccaacatggtgaaaccccatctctactaaaaatacaaaaactagctgggcatagtggcacatgcctgtagtccccgctactctggaggctgaggcaggagaatcgcttgaaccggggaggcagaggttgcagtgagctgattgtaccactgcactccagcctgggcaacagagtgagatcctgtctcaaaaaaaaaaaaaaaaaaaaaagctgatctttttattgttctgaacagaatggtggaaacacctgctgtggagaaacg

SEQ ID NO: 4266 - DNA, 601 bp, Human
ggtcttgagtcactggtggtcaagtagacaatacaagtccaggactacgtacaggaggcattattcaacttcattaaggctacactaaattgccctcccataatacctacaaaattagaaaaaaatttcaaaaacccctaaaagtcattatcagcataatgcaataaacttcaaaacatggtcccaacaaaacatgaggactatggagtaaagcagagaggcaacatggctcagctcctaaccttaaccatcttaccagctagtcaacaaaaacctgagatttctaatttatattttaaawtctagaaagtaataaatataatcaaaatgctgatctttttggccaggcatgtaatcccagccctttgagaggatgaggcagatagattgcttgaggtcaggaattcaagaccagcctggccaacatggtgaaaccccatctctactaaaaatacaaaaactagctgggcatagtggcacatgcctgtagtccccgctactctggaggctgaggcaggagaatcgcttgaaccggggaggcagaggttgcagtgagctgattgtaccactgcactccagcctgggcaacagagtgagatcc

SEQ ID NO: 4267 - DNA, 601 bp, Human
acaggtctgagttataatgcaaagacattagtaagcaatgtgaaacatatgattgaagcatgtgtgttttgattatgaaaatcacagaagagacattaaaacatggtgagcttttatgtgtttgctgcctcaccaactaacaactcagcctcatcacctgcctagacccctctttttgacttgctgtgtctagttgtagagaagtctgtcttccccgctggtttatcaattcattgggaacaaagaaaaaaaatctccgtctttctgagttttaccaagtgttagcaaagactggatgctmtgtagttgttcaataatcacttatatagtcaacaaacatataggaaatgtatatttgagtaagaataagaccttatgcctggagagagatggtcaagaaaccaatcaagtggatgtaaagattactggtattaagacagaaaaatgtagaggtagagtgggaacctgaggaagggagttatcagttagattggagggtggtggtggtgatgctggggggcctaatagagggagatgacaggcaaactggccagaaaaggccatctacatagtggaaacagttttaataaatgtgtagtgt

SEQ ID NO: 4268 - DNA, 601 bp, Human
gtgatttgtgtgcacattcgtttagaagcacaggtctgagttataatgcaaagacattagtaagcaatgtgaaacatatgattgaagcatgtgtgttttgattatgaaaatcacagaagagacattaaaacatggtgagcttttatgtgtttgctgcctcaccaactaacaactcagcctcatcacctgcctagacccctctttttgacttgctgtgtctagttgtagagaagtctgtcttccccgctggtttatcaattcattgggaacaaagaaaaaaaatctccgtctttctgagttytaccaagtgttagcaaagactggatgctatgtagttgttcaataatcacttatatagtcaacaaacatataggaaatgtatatttgagtaagaataagaccttatgcctggagagagatggtcaagaaaccaatcaagtggatgtaaagattactggtattaagacagaaaaatgtagaggtagagtgggaacctgaggaagggagttatcagttagattggagggtggtggtggtgatgctggggggcctaatagagggagatgacaggcaaactggccagaaaaggccatctacatag

SEQ ID NO: 4269 - DNA, 601 bp, Human
agcagcagacctaaagtgcaggagcaaagaccttttgtgtttacatagtaaaacaaaggccaagaggtaacagtttcaaggcatcttgccagtttttttctgggcactgctgaatctacctctcttggtgtaatgttgatcatgtttaattacagtcagaagagtttaggtggggagtccaggagcttttccaaaaactggtgccatttcaacaatgtttacattgacattacaatggtgtggagccttgctacttgaggcattcatggatcagcaatattggcattccctgggagcttgktaggaattcagaatctcaggcccctcccagaactcttgaataagaatttgcattttaacaagatcactgggtgatttgtgtgcacattcgtttagaagcacaggtctgagttataatgcaaagacattagtaagcaatgtgaaacatatgattgaagcatgtgtgttttgattatgaaaatcacagaagagacattaaaacatggtgagcttttatgtgtttgctgcctcaccaactaacaactcagcctcatcacctgcctagacccctctttttgacttgctgtgtctagttgtagag

SEQ ID NO: 4270 - DNA, 601 bp, Human
tgattgtttaaacagattaaagttttagagttttcttagaaggtatttctgtttccataaagaacctgggatgttatggtttaaatatggaagagactttagcagagaaaggcaatcttgaatatctggataaaacttgccacaccttcagactacattcatcttgtagcagcagacctaaagtgcaggagcaaagaccttttgtgtttacatagtaaaacaaaggccaagaggtaacagtttcaaggcatcttgccagtttttttctgggcactgctgaatctacctctcttggtgtaaygttgatcatgtttaattacagtcagaagagtttaggtggggagtccaggagcttttccaaaaactggtgccatttcaacaatgtttacattgacattacaatggtgtggagccttgctacttgaggcattcatggatcagcaatattggcattccctgggagcttgttaggaattcagaatctcaggcccctcccagaactcttgaataagaatttgcattttaacaagatcactgggtgatttgtgtgcacattcgtttagaagcacaggtctgagttataatgcaaagacattagtaa

SEQ ID NO: 4271 - DNA, 601 bp, Human
attaagagttaagaaaatagattcccatgggatgcttacagaggttttttgtttttgtttcttttttcttttcttttctctctctctctctctttctttctaagataaggtctcgatctgtcacacaggctggaatgcagtggcacgatcatggttcactgtagcctcgaactcttaggctcaagtgatcctcccacttcaggctcccgagtagctaggactacaggtgtatgctcggctaattaaatttattttttttgtagagccagggtctccctatgttgcccaggctagtcttgamctcctgggctcaagtgattctcctgcctcagccttccaaagagttggaattacaggcataagtcaccatgcctggcccagagcttctttttccctttgtaaaattcacttaagtattctttcttatgattgtttaaacagattaaagttttagagttttcttagaaggtatttctgtttccataaagaacctgggatgttatggtttaaatatggaagagactttagcagagaaaggcaatcttgaatatctggataaaacttgccacaccttcagactacattcatcttgtagcagcag

SEQ ID NO: 4272 - DNA, 601 bp, Human; identical to SEQ ID NO: 1005

SEQ ID NO: 4273 - DNA, 601 bp, Human; identical to SEQ ID NO: 1006

SEQ ID NO: 4274 - DNA, 601 bp, Human; identical to SEQ ID NO: 1007

SEQ ID NO: 4275 - DNA, 601 bp, Human
aatataatcaaggagaatctcatctttacattcgaaaagaaaacctatactgctgaagtcatttaaaaggttgtggttaatggtcagaagcatttgggtttattcccagctcaacagatgtatgaccgtgagcaagcctttttgggcctcagtttcctcatttgtaaatggcgatattaataacatccacctgatacaactaaaaagaactggataagatcatgcatacaccaagaccgatgcatagtaaatactaaataaatgttagctctattagtcccagggcactgacccagagaaygcttggctccaatacttctgctattaactgtaatattaatatatcaaggtagagaggaactagtataggcatatgcagcagctaaaactatgacctttttttggtggttgctattataaggaatgattgatttttatcactaggaacccaaactgtctcttcagtaacatttctaatcatttgctagaacattctttgacaatcagagttttctgcctgtgctgttgaatggtcctcaaaatagaacagaaacatcagattgagtctatcttgtggtaaatgtgtaacattactataatg

SEQ ID NO: 4276 - DNA, 601 bp, Human
tgtgtgcccctactggtgagttaatactgctgctacaactgtgatccattcctgtaacatgaagttcaggcacttctaacttttagttttgcttaaaatgaacttgtaacttcctaccatccccatttggatgcttgtataacagaaagtgttttagctttattatttgtgcatgagactcatttttggcttagaagttctacctagctcaatgcctgaccacagaggaacttatgccccaatttcctcccacacagaccttgataaaaattcttcctacttaaactcttaggattttttycgtttcttcttagtgtattgatttggacttagggggtctcaaggaaaaatggaatttccctgggatcttaagttccctctagccagcttgtaacaaagctgttcagggcagtgagagaaccccacagctggttttggggaacaatttcagctttactcccatttctatatctcaatgaaaggtgacaatataatcaaggagaatctcatctttacattcgaaaagaaaacctatactgctgaagtcatttaaaaggttgtggttaatggtcagaagcatttgggtttattcccagctcaa

SEQ ID NO: 4277 - DNA, 601 bp, Human
ggcctcagatcccactgagccctttaatccctgtgcttcatggtctgggcacgtcctgagttgtgctggtctcagccccgcagtcagtcagagcatctgatcaggcatcatgcgttgaaaacctactacaagccaggcaaaggaagggaagaggagtctcgggcagtggtctgcagtggagggtgggtgagggtcccaggccaggaagaacagtctcagggtgatgggatatttgagtaaggcaccaaaggaacaaatggtgtcaggaaaaggggaagtaatttggagcagggacctgaawgaggacagggttaccaagggcaagatctaccttcgctattttgtattaactctgtttagggcctgtggggttatttgtaggagtgcctcatagggacttatttgatgatgggaggtacctgaatcaaggagctgggaaagataactttgaactgcacttagctacaaaggctgtgtgtgtgtgtctgtgtgtctgtctgtgtgtgtgtgtgtgtgtctgtgtgtttttaaggaagagatatggagaatgccaaataactatctttttgtcatttttaacaattgcaatgagtttttgggg

SEQ ID NO: 4278 - DNA, 601 bp, Human
agattactttcattctactgatgaagaaaatgaagctcagagaggtgaagtcattttctcaaagccacacagcaagtagctgcccaagccagagcttgacataggagtgtggctgtggtgatcatgcactggctgatctgtctggggacagcccgcactaacctcctcaatccaggagagtcttagccatactcttgttttcctggaccacctataacttctaaggtgcatgggtgtttgcactggtgaggccaagtgtctgctttttctttaaaaataccccaaagtaacagaaatagcrcagtcatcttaggacactgggcatccctctttttctgaccgctttgatgtacttgggttgatggaaacatattgcctctaagaaattccagctgtgtgactaataatgaaggcaataatagcagctaacgttcattaggcacctgttatgctcggctctgtgatgagtgaagcagggaatattgttctctccactttagaggagaaaagaggcacagagaggttgtgccttgcccaaagtcacacagcttgggcagtagcagagccaagtcttggcctcagatcccactgagccctttaa

SEQ ID NO: 4279 - DNA, 601 bp, Human
agggaggtaagtatgaggccaatagctcctgagatccttgctaggaaatccatcaggccatgtgtcgccagtctacaccgcactgacctcacagaggtcagctgatgcccagcaaatcattcccacccccacctcagcccctgtttagcctccaccctcaccctcaccctcacccttcctcaccagccctatgctcaggcagcccctgcttcttaccagtgaccaataataattaaatcagcatcaggcctacctctatggtaagcactctacctggatgacctgatttaatcattatagycactccatcgggaaatggtaactactaagattactttcattctactgatgaagaaaatgaagctcagagaggtgaagtcattttctcaaagccacacagcaagtagctgcccaagccagagcttgacataggagtgtggctgtggtgatcatgcactggctgatctgtctggggacagcccgcactaacctcctcaatccaggagagtcttagccatactcttgttttcctggaccacctataacttctaaggtgcatgggtgtttgcactggtgaggccaagtgtctgctttttcttta

SEQ ID NO: 4280 - DNA, 601 bp, Human
gagtgttgaagaagaaatagatggtggaggatgagagattgttctcaggtctcctttacttggagaggagaggggccccagccacaaaccaaccaggagcggggaagacaggttgaggtgggtgtgtttgaccagagcctgtggagggaggtaagtatgaggccaatagctcctgagatccttgctaggaaatccatcaggccatgtgtcgccagtctacaccgcactgacctcacagaggtcagctgatgcccagcaaatcattcccacccccacctcagcccctgtttagcctccaccytcaccctcaccctcacccttcctcaccagccctatgctcaggcagcccctgcttcttaccagtgaccaataataattaaatcagcatcaggcctacctctatggtaagcactctacctggatgacctgatttaatcattatagtcactccatcgggaaatggtaactactaagattactttcattctactgatgaagaaaatgaagctcagagaggtgaagtcattttctcaaagccacacagcaagtagctgcccaagccagagcttgacataggagtgtggctgtggtgatcatgcac

SEQ ID NO: 4281 - DNA, 601 bp, Human
ttgaaaaatctttcttgatcctagtaagtgccaacgtctctgtcttttaaaattgtttccattttgactgtgacctttgtataatgaggtgatcaagctgagctcttccaaggtgaggccaaaccattgctgtccccctgcccctctgagtagccctgactccctcctcactgagccctcgtattctatttgctgtttggactgcagctaaacattgagcaagcgtcttcattaaactgtccagtgattcatagctgccttccccccagaggttacacataattcagaactcatcagcacrctggggacaggcggccgaaattgctccttctgggatctgctactttgcatttgcccacttggggtttcatttgctaccctgggatctaattactctgccctgctctgcccttctgaggttcctgagtccccagccctctcctgaacagctaaggagctcagaccatggcctctgttggcgtcaacagtggggccgctctgtgcaaaactgtagcccccctgaggtgaggctccctcttggaaggaaacatccttcatgcaggggacctacggtggcaaaccaggaagcagtctgtccttg

SEQ ID NO: 4282 - DNA, 601 bp, Human
aataataaaaataaataaaaataaaaataaaataatgtatagaagaacaatctcaatttcaaaaatgcacctacaatgtgtgaaacaccatatgagtactgaggacataatgagaattaggattatacactgattagggcagtgtcccaggtgtgaaagctggttaatttctgctctaaaatgtgctttgaaaaaggtttgtttatagattaagaccacccattgcagcatggagtttttatgcattaaaaattttttccaagcaattctgtttattcagtgcttgctctatgccctgcayactgttacatgctgacaaaacaacaaaaataaaatagatcagacactgctccccctgtgggtgggtgcattccggtggggaaaagctgagaggaggacaccaaccctcacccagaatcatcctatcagaccacactctctccagcaaaagaacacagggaggcttcttcatttagaaggagcgaagcctttcattgaaaaatctttcttgatcctagtaagtgccaacgtctctgtcttttaaaattgtttccattttgactgtgacctttgtataatgaggtgatcaagctgagctctt

SEQ ID NO: 4283 - DNA, 601 bp, Human
tcataggtgggaattgaacaatgagaacatatggacacaggaaggggaacataacactctgcggcctgttgtggggtggggggaggggggagggatagcactgggagatatacctaatgctggatgacgagttagtgggtgcagcgcaccagcatggcacatgtatacatatgttactaacctgcacgttgtgcacatgtaccctaaaacttaaagtataataataaaaataaataaaaataaaaataaaataatgtatagaagaacaatctcaatttcaaaaatgcacctacaatgtgtraaacaccatatgagtactgaggacataatgagaattaggattatacactgattagggcagtgtcccaggtgtgaaagctggttaatttctgctctaaaatgtgctttgaaaaaggtttgtttatagattaagaccacccattgcagcatggagtttttatgcattaaaaattttttccaagcaattctgtttattcagtgcttgctctatgccctgcacactgttacatgctgacaaaacaacaaaaataaaatagatcagacactgctccccctgtgggtgggtgcattccggtgggga

SEQ ID NO: 4284 - DNA, 601 bp, Human
ctgggattataggtgtgagccaccacgcccagtcaataaggatgtcattttaaaaagagtgggctctggggtcagcccccttgggtttgtaattcaggttctgccacttattggctgggaccttggttaagttaccgtgccactaacagtaattaccttaacatgctgttaagaggtagaagtaaattaatacatgtcagcacttaaatcagggcattgcaaaaaaaagtatttttgtgaacatgagctactcttattctttgaaggtggcaaataatgttttttccaacactattgtgtrccttcagtgtatattctcagtcctctaatgctaaggctcatggtctaactccaggtgattttcctaaaaccaacttggccagaaatatggttaacaagaaaatgtttgaaaataagcatctctgataactgtccagaattggcaactgcaatgcatcatgggatatttttacaaacccttaagcatctttaagcaatttggtctacattctgaatttttcttctctactattttacttggaattcgtttttagatcattctgctttgcagacagtgattaaaattgaagataattttaca

SEQ ID NO: 4285 - DNA, 601 bp, Human
gcccagctaatttttttgtatttttagtagagacaggttatcaccgtgttggtcaggctgttctcaaactcctgatctcaagtgatcctcctgcatcggcctcccaaagtgctgggattataggtgtgagccaccacgcccagtcaataaggatgtcattttaaaaagagtgggctctggggtcagcccccttgggtttgtaattcaggttctgccacttattggctgggaccttggttaagttaccgtgccactaacagtaattaccttaacatgctgttaagaggtagaagtaaattartacatgtcagcacttaaatcagggcattgcaaaaaaaagtatttttgtgaacatgagctactcttattctttgaaggtggcaaataatgttttttccaacactattgtgtgccttcagtgtatattctcagtcctctaatgctaaggctcatggtctaactccaggtgattttcctaaaaccaacttggccagaaatatggttaacaagaaaatgtttgaaaataagcatctctgataactgtccagaattggcaactgcaatgcatcatgggatatttttacaaacccttaagcatctt

SEQ ID NO: 4286 - DNA, 601 bp, Human
gtgtgagccacctcaccaggccgtgaagcatattttaataaggatgttaattatttttatttatttatttttgagaccaagtctcactctgtcacccaggctagaggaatacagtggcatgatcttggcttactgcaacctctgtctcccaggttcaagtgattctcctgcctcagcctcccaagtagcggggattacaggcatgcaccaccacgcccagctaatttttttgtatttttagtagagacaggttatcaccgtgttggtcaggctgttctcaaactcctgatctcaagtgatmctcctgcatcggcctcccaaagtgctgggattataggtgtgagccaccacgcccagtcaataaggatgtcattttaaaaagagtgggctctggggtcagcccccttgggtttgtaattcaggttctgccacttattggctgggaccttggttaagttaccgtgccactaacagtaattaccttaacatgctgttaagaggtagaagtaaattaatacatgtcagcacttaaatcagggcattgcaaaaaaaagtatttttgtgaacatgagctactcttattctttgaaggtggcaaata

SEQ ID NO: 4287 - DNA, 601 bp, Human
aaatgaaaattaatcccaccatgaaataccacttcacacccattaggatggctacaataataattaaaaaaaaaaaaaaaacagaaaataaaagttatttgcaagaatatgaagttggaacttttgtgtattgctagtgggaatacagaatggagtagctgctttggaaaacagtttggcacttcatcaaaagaaattaaacatagagttaccatacaacccagaaattccactctaaatatatgcccatgagaaataaaaaacatatgttcacataaaaacttttacctgaatgttcatwacaacattattcatgaaagccaaaaatggaaacaacccaaatgtacaactgatgaatggataaataaaacctggtttatccacacaatgaaatatcattcatcaatgaaagggaatgaggtactgatacatgctacaacacggacgaaccttgaacacgttacgctaagtgaaggaagccagacacaaaaggtcacatattacatgactccacttataggaaatgatcagaactggcaaatccatagagagagaaagtagattcgaggttgccagagttggagaaatggggagtgactgc

SEQ ID NO: 4288 - DNA, 601 bp, Human
aagtgaaaagagagcccatggatggtagaaaatatttacaaatcacatatatgatagagagcttatatgcagaacatataaagaatagttacaattcaacaatacaaaagtaggtcaattttaaaatgggacaaaaatatgaataaccattttgccaaagaagatatacacagggccaagaaaaacacaaaaagatgttcaacgtcattggtcattagagaaatgaaaattaatcccaccatgaaataccacttcacacccattaggatggctacaataataattaaaaaaaaaaaaaaaacagaaaataaaagttatttgcaagaatatgaagttggaacttttgtgtattgctagtgggaatacagaatggagtagctgctttggaaaacagtttggcacttcatcaaaagaaattaaacatagagttaccatacaacccagaaattccactctaaatatatgcccatgagaaataaaaaacatatgttcacataaaaacttttacctgaatgttcattacaacattattcatgaaagccaaaaatggaaacaacccaaatgtacaactgatgaatggataaataaaacctggtttatc

SEQ ID NO: 4289 - DNA, 601 bp, Human
tgtgtagtaggagtgatagtcaaaaccattaataagtgctcagacacaggcatgaaccaaatggatgttgcaacccatcggaaaggacatcaacgctaaatgcagttctaccagggcatcctggctagataccagtccagatgtcctcactcacatacacactacaggagtactgaacaaatttccatccacaaagtctttagggagtgagtccttccttagtcctgagagtacagcctttccactctcttcttaagcttccaagaacagatttcttggatatttatcaagagaattgtamagcagctttgttaatagcaatttttagaaaattaggggctgattatccagctttctttttttcttctcctttcatttttccccatggtgtgattacgtgttttattattttttttttagtgtagtacctccaaatggaacaggcagggaatgaaaccaaatttggcaaaaataaaacacaagttataaaacaaaacaaaacgaaaacaacaaaaattaaaattaaaaattttcagaaagtagatgccaccccatcacacagaccacgtttgccatcattagttagcagaaagccctttct

SEQ ID NO: 4290 - DNA, 601 bp, Human
tctttcaagaacctcaatgaatttggaagaggactctgagcattagatgggacaacagtcccagccaacactgatcgattgcagttatctgagaccctgagcagagagacccagtcaaccagtgaccaaactcctgacccacaggaattgtctgatgataagttgtgtttttttaagctgttacgttgtggtactttggtactttggtatgcagcattaaaaacatgcatacgacacacaaagagacatattacagaagggttaaggaaatgttacagatgttctgagtagttagaaaatrgatacttcttactttggtattttttctgcaacatttaaaatactgcataataaacatgtattaggttccctccgaaacactgaggactatttatttatttatgtatttattttaccaaaacccagtagagcacagtagttcaaaatctgtcttggttctggctaaggtcatatccagaggtataggagcctatggggtggtgaagagctggacagagaacacagctgagaccaacatgggcttcagggtgctatgtgtttgaagaaaataaagtggttaatttaaacaaggagtccttta

SEQ ID NO: 4291 - DNA, 601 bp, Human
gaaccttcaccaaaggcagtacttcactagaacagcagcaccatcccctgctgggggaccctacatgggacgtcatagtttatgttgtgattcagtaaatccatgtgctttgaatttgtacacgggaaataatcatacaaatgcaaagacaagtgtgttatgtaagaatgttcatcatggtgtaagaaagggaaagtggaagcatggaagcagcctaactgtccaacatgtgatcaagtattttgaaacagaatagaatgctattcagccataaaaatgcagatctatattgactaggcargaaagacatccatggcatattagtgtttcaaaatcacatgcagagcagaattttaaatgactcccactaccttttgcataattttgtataattttctcccctgagtgtaggtgaaatctataaacagaacaggctagtactcctgtgactatgttgctttatgtgtcaaggaggattttgcagaagtaattaagtttactaatctgttgactttgagttaattaaaaggtagattatcaggtgggtctggcctcatcagatgagccttttaagtctgggtctagagatcagagacagagc

SEQ ID NO: 4292 - DNA, 601 bp, Human
ccgtacagacttttcctaatttcatctactgattctccaggttggaaaataccaactgattcctgaaatgctactttttattctaaagcttctttatctagatccataagagtttttctgttttcatcttgcaattccatcatgcatttgtagagtgcataaatctactttgggagctctgttggtcttattcttctacacatctccagcactagagcagggcccagtcattaggaggtgctcagtaagtgttggctaaataaatcatgaggacatctagcaaggaagttcttattaaacytttgcttgtttgtttctctttaagattcatggttttttatgttctcggagccttcatttgaaacttaagttctcactatacagtcaaaaggtaccgtgtccctttaaagtaaaaaaattctaaatctccttgttgcctctttctatagaagcagtatagaaatcaaaataaaggcctcatttcattgagacttgtttaatcaagatgagaacaacctttgggaggataacgatggagatgacaagtgaagaacacatctctgctttatgtttcttcctgtgtgttccgtgcagtgacagc

SEQ ID NO: 4293 - DNA, 601 bp, Human
tcgattacctcccatatttatttttgtggtgcaaacatttgaaatttactctcctggcaattttgaaatatatagtatagtataattaactatagccaacatgttgtatatttgatctcaaacacttattccttccgtacagacttttcctaatttcatctactgattctccaggttggaaaataccaactgattcctgaaatgctactttttattctaaagcttctttatctagatccataagagtttttctgttttcatcttgcaattccatcatgcatttgtagagtgcataaatctmctttgggagctctgttggtcttattcttctacacatctccagcactagagcagggcccagtcattaggaggtgctcagtaagtgttggctaaataaatcatgaggacatctagcaaggaagttcttattaaacctttgcttgtttgtttctctttaagattcatggttttttatgttctcggagccttcatttgaaacttaagttctcactatacagtcaaaaggtaccgtgtccctttaaagtaaaaaaattctaaatctccttgttgcctctttctatagaagcagtatagaaatcaa

SEQ ID NO: 4294 - DNA, 601 bp, Human
attcatacgtgtcagaggatctaattttcaatatacagtagtgtcatttccctttgtgttggaaaacttcctttagcatatctttaattttttaaatagacacataataattgtataattgtatatattatagggtacaaagtgatgattttacatatatatataaaatcaaatcacattgcaggataattaagttaataacatatcgattacctcccatatttatttttgtggtgcaaacatttgaaatttactctcctggcaattttgaaatatatagtatagtataattaactatagmcaacatgttgtatatttgatctcaaacacttattccttccgtacagacttttcctaatttcatctactgattctccaggttggaaaataccaactgattcctgaaatgctactttttattctaaagcttctttatctagatccataagagtttttctgttttcatcttgcaattccatcatgcatttgtagagtgcataaatctactttgggagctctgttggtcttattcttctacacatctccagcactagagcagggcccagtcattaggaggtgctcagtaagtgttggctaaata

SEQ ID NO: 4295 - DNA, 601 bp, Human
ctggcctcaagccatcctcctgccccagtcttttaaagtgctgggattacaggcgtgagcatttttctcagatatttagcatttttgctgcaattcatacgtgtcagaggatctaattttcaatatacagtagtgtcatttccctttgtgttggaaaacttcctttagcatatctttaattttttaaatagacacataataattgtataattgtatatattatagggtacaaagtgatgattttacatatatatataaaatcaaatcacattgcaggataattaagttaataacatatcgmttacctcccatatttatttttgtggtgcaaacatttgaaatttactctcctggcaattttgaaatatatagtatagtataattaactatagccaacatgttgtatatttgatctcaaacacttattccttccgtacagacttttcctaatttcatctactgattctccaggttggaaaataccaactgattcctgaaatgctactttttattctaaagcttctttatctagatccataagagtttttctgttttcatcttgcaattccatcatgcatttgtagagtgcataaatctactt

SEQ ID NO: 4296 - DNA, 601 bp, Human
gaggagggaagaaagaggtagcttcttccttaagagtgacttagaggctggctacagtggctcacaccagtaatcccagcattttaggaggccgaggcaggagaactgcttgagcccaggagtttgaggccatcctgggcaacatggcgaaaccctgtctctattaaagttaaagaagttagctgacctgtagtctcagctacttgaggggctgagtgggaggatcacttgagcccgggagatcaaggctgcagtgagccatgattgcaccactgcactccatcctggaagacagagtgaraccctgtctaaaaaaaaaaaaaaaaaagtgatctaggttgtaagacagaagaaaagatagggcaggggctagcatgtaatgcaatgcagggaagtctgtttcggttattttcaaattaaaagagactgaggcatgttcatggaggaatggaggaaggtagagacagtgggaatataaaagggagctgaaataccaaggttgcaagaggatgaggctgagagcaacaccctggacagatgtgggaagcaaggcagggtctgcagggagagaagggtacagatgtggattagggtgaaggtg

SEQ ID NO: 4297 - DNA, 601 bp, Human
gcgtggtggcgggcacctgtagtcccagctactcgggaggctgaggcaggagaatggcgtgaacccgggaggcggagcttgcagtagtgagctgagatcaccccaccgcactccagcctggtcgacagagcgagactccatctcagaaaaaaaaaaaaagaacagtactattataattacccccagtttacaggggaggaagctgaaacccaggaaggttaagaaccttgctgaggtcacagctagttagtgatagagctctgaaatccacactcttcaacactgacctatgatataggtraggataagattgtgaaatcctttgatatcaaattaaacattcatgctttattcttaggctataaaaagccattggaataatttaagaagaagatctaaatttgcaaatctctgttcgtggaagatggatggagaggcaaggctggagattgagctgagtcctccccggctgtcccccacccctgaagaactgcaatagtggaccagaaaggcattcaggtggccagcaccatggagagggagagaagccattggggatacaacccacaggtttagggagatgtgagggactcggatgagt

SEQ ID NO: 4298 - DNA, 601 bp, Human
agaaactacaacaattatgcctgactataattctctacaatttccatctcgtgtccaacaagaagaatacgttgtcagggtgaatctctctttaccctttattaaaagtgctaagggtcatggaaaacttctcagaaatttgaatatgaccctggaagcaagagcatggaataaaatgccatcatgaattgtattattatgtccttgaaaagacctgaaattatatgacagtacagaatcaaatgagagcacattaacccctcagcactatagaaaatgttcatatagtaataaagaaagrtttaataatgtggtgaggtagttacagcagtctttgtttatgacactgatgaatttcaggttcaactaccacgggttccgtgcctagacgcccttcaatgtcagctgtttgcccatgctcccatctttctctgagtgcagcccatttttgattggttcaagagatattaatttcactatgtacccactacacaccaggcaccttggtaggtgctggagactcagagatgatcaaaacatagattcttacccataaagggtaatcttctaggagaaatgacaaacctgtaaaccaattatc

SEQ ID NO: 4299 - DNA, 601 bp, Human
ccagcctccaaatccaacaggaaggtcaggccttgtcatccatgcttcattccagcagtggtagttccttagaaaacacaagcccagaaaggttaaacttcccatcacacccaatgctccaagagatcaagaagtgacggccaggcacagtggctcatgcctgtaatcccagcaatttgggaggccaaggcaggtgagtcacaaggtcaagacatcaagaccagccttgccaacatgatgaaaccctgtctctactaaaaatacaaaaattagctgggtgtggtggcgggtgcctgtagtyccagctacttgggaggctgaggcaggagaatcgcttgaatctgggatatggaggttacagtgagctgagattgtgccactgcacttcagcctggtgacagagggagactccatctcaaaaaaaaaaaaaagtgaccccaaatcctgtgcatatgctatctacagattattagaatggattaagccaaatctgagggctcctggagatatcctggggctctagacttgggttttctgggcagattcattctcattggcatccctcaggacactcacatggctggatgtctctttccctctg

SEQ ID NO: 4300 - DNA, 601 bp, Human; identical to SEQ ID NO: 1008

SEQ ID NO: 4301 - DNA, 601 bp, Human; identical to SEQ ID NO: 1009

SEQ ID NO: 4302 - DNA, 601 bp, Human; identical to SEQ ID NO: 1010

SEQ ID NO: 4303 - DNA, 601 bp, Human
ttgtcttacctggattgctggactagtcccagagggaagtggcatgtcctgaaatttcaattcatgacccatctcttccaatgaggttagttgagagatccattagtcatataatttctctggagcagttgatacttaatgggtgcagagaactaagctaatgttagtaaagcatttacttttgggagtagggaatcccaaaacatcaaggaaagaaaaatgttaaacaagaactgcatttagcattaatagcctggaagttggaataatgcctagttacctttgtcaacacgaagcataygctatgtacctggaaaacttagaaacaacaacttttagcttactctttcatgtgttaagaggttggggagaaaaacagcactttcctccagcttcctgcttacctctgcaaaaacaaaaggtgcatcaaattggaagcagacatggccgtgcttgatggcttgaaccgaggcggggccacaccgatacatgcctgcattgcacagaggaagggcggtgtgagtttgtcatctccaattctgtccagatactgcaagattcatggcactgagggtgactctgtaaagaccagtgttcccaa

SEQ ID NO: 4304 - DNA, 601 bp, Human
tatttactggtgcaaatataccctggggaagtcctgcctctcagtctttcaagtcttcctaggccggcagcccagccttctcgtttacccaacatctcttacatttaatttgattttcagagctctccttgagtatcctttaacagcctgttctgcttccagtccctgcctagttcttctgaaatggcagagcctttgcccaggcattcccatcaaccctgtaggtgggctgtattcctctcttagagtagcctccaggctccccttcctcctttggcaactcaaccctccctccctggccacaggtgatggtgtgggatggcaggacatagattgcaaaggccagggtaagaccatggttgggtgtgtgtatgtggattttgtcttacctggattgctggactagtcccagagggaagtggcatgtcctgaaatttcaattcatgacccatctcttccaatgaggttagttgagagatccattagtcatataatttctctggagcagttgatacttaatgggtgcagagaactaagctaatgttagtaaagcatttacttttgggagtagggaatcccaaaacatcaaggaaagaaaaat

SEQ ID NO: 4305 - DNA, 601 bp, Human
ttcccaggtcgcccttccttcctagatggtgtcttgtggtctttgccatcctgcttcagttcttggcctctacttcccaactcatgcatcatatgaatgcagatctgtgctctctacatggcccacctgacaagtattgttgttatttcatgttcagtgtgtttgtgccctgtcacctggcatctagaaatacgtttcttaaagacttgaaccttagaattccccccagtacaatgcctggtgtacattaataataactatttgttcctcctggagtactagagtgcaatggttaccagtrtgcattcaggtatctgcctggcttcaaatcttagcactgctatttattagctagatggttgtgagaaagtcacttaatcactctttgcctcgattttattttctgtaaaatgggaagaattatcaattttagaaggttgctaagagcatccaatggtaggcaaagtgaaagacattatttcagtgtatttactggtgcaaatataccctggggaagtcctgcctctcagtctttcaagtcttcctaggccggcagcccagccttctcgtttacccaacatctcttacatttaatttgatt

SEQ ID NO: 4306 - DNA, 601 bp, Human
tcattttgcctaatcatccctccttcccatgtggtcccacagttctctgctcttactacctggggacacttccacaggcatcctcactgtctgttcccaggtcgcccttccttcctagatggtgtcttgtggtctttgccatcctgcttcagttcttggcctctacttcccaactcatgcatcatatgaatgcagatctgtgctctctacatggcccacctgacaagtattgttgttatttcatgttcagtgtgtttgtgccctgtcacctggcatctagaaatacgtttcttaaagactygaaccttagaattccccccagtacaatgcctggtgtacattaataataactatttgttcctcctggagtactagagtgcaatggttaccagtatgcattcaggtatctgcctggcttcaaatcttagcactgctatttattagctagatggttgtgagaaagtcacttaatcactctttgcctcgattttattttctgtaaaatgggaagaattatcaattttagaaggttgctaagagcatccaatggtaggcaaagtgaaagacattatttcagtgtatttactggtgcaaatatacc

SEQ ID NO: 4307 - DNA, 601 bp, Human
aacaccccgatctatatttaataatagcaaaaagtgtttgcatttacagctattaggcagcttgcttgtggagggaggtcctccttctccttctttgcagcaataaagtgtaataaaaagctgaaaacaaggctttgtggatttcagagtgatctcctcattaggggctctcgtagcatcataaactatcaaatgacagctgggaggtttgtggaaatcttcaaatcccaaagtgaaaacgaggggataaaattccaagtccagtaagcttggtctccaaaggcttctgtaaactgccacrgcaggtacgatgagatgaacactggtcttttgtgtgtttcaaattcctgatcttgctgtctgaattttgatgttcgttttgctttctaaatattaacatttctcagtcctgcctcctcttttcctcattattgccatttgtctagctcatgccctttccatctctggcttggagggatgaccagccctctagatgttccccacaacttcataacaacccctccaatccgtgttccacaaggctgtcagcaccttgcccaagttcccacccagtgaaaactctccctcacttacaggaggg

SEQ ID NO: 4308 - DNA, 601 bp, Human
ccctcttctttttaggctctgctttcactcatggagactaaggccctgggaacactaaaaaacagtcaatgaacatgatgcttgatcaagcctggaaatgagtaaggaatgaccaagaaagtcagcatgctgggagggaagagaaggcgagctgatgcagcaaggacgagggagagcagagagagccacagactcgaacctgagtcatatcgactcatatgacactccccatggggtcccactgcaggcacccttgagaaaagattcctcatacacttttcatcaactcaaacatctcttmaaaatggctcagcccctggagcgcagcccatgccaaagcaacaaattgtaccctctgtcagacacgcctctgcagtgggtgagaaaggagtaattataatctgcaaatcctgatgacattcataacaccccgatctatatttaataatagcaaaaagtgtttgcatttacagctattaggcagcttgcttgtggagggaggtcctccttctccttctttgcagcaataaagtgtaataaaaagctgaaaacaaggctttgtggatttcagagtgatctcctcattaggggctctcgtagc

SEQ ID NO: 4309 - DNA, 601 bp, Human
cagcaatgcggttacaagagcttctaccttcatggagctcatattctagaagggagaaatggagtacacactaaggttggaggatgaaaacaacagggcagatggtgatattttaggtgcagttgggtgagcgaaggcctctttgaagaggtgaccagagcagagacttgaatgcagagagggaacaaagcatgcaaagcattcttcctacacagagtgaaagatagtgaggggagctttcctagcaaaaggagcagtatgtctaaaagtgctgacacaagaggatgtgtggatgctttcygaagagaaaaatctcagtatggctggagggaaataaacaagggatgaagtggaagggaagccatggaatcttgtaggaatttatgttcagttttattgtaagggtggtggaactccaccagaagggttggggcaggagtgtgatgtttgtatttacatttaaagaataattctcttgctctgtggggaatagacagaaaaggagcaagagggggatcagggagatgagttaggaggagttaggaggtaactttatggagctcagtgttgtacagagctcagagggtaacgatagagattg

SEQ ID NO: 4310 - DNA, 601 bp, Human
ccactgaggctagagacgtgctcttgctttcaggaccctggacagagtttgctttggtttgtttatttgtttccaagtggagataaccttgtctgcaggctctgcagagaaaatgctgcttctcagagggcatatggaggcagtgaatgccttcctggcactggaccctagatcctgctctcagcaatgcggttacaagagcttctaccttcatggagctcatattctagaagggagaaatggagtacacactaaggttggaggatgaaaacaacagggcagatggtgatattttaggtgsagttgggtgagcgaaggcctctttgaagaggtgaccagagcagagacttgaatgcagagagggaacaaagcatgcaaagcattcttcctacacagagtgaaagatagtgaggggagctttcctagcaaaaggagcagtatgtctaaaagtgctgacacaagaggatgtgtggatgctttctgaagagaaaaatctcagtatggctggagggaaataaacaagggatgaagtggaagggaagccatggaatcttgtaggaatttatgttcagttttattgtaagggtggtggaactccacc

SEQ ID NO: 4311 - DNA, 601 bp, Human
ctgaaatgtgaagtcaggaatcaggacaggagaggacgcagcagatacctgtggaatatttgtcattttggaagctttaaatgagctgtctgagaattcgggaattccctctggaggaagccatgtaagtacaaacagcgaccccctctactttcaaatcgtagcaacaataatgataaataacttcttaataacaatccttataacagcttgtggttttccagggaaacaagcaaaatatgaaagtggctgattcctgcccccccaccttgaatatggcttcagaaattcctgtaggctraaatctcaggacagaccaacagcactgtcctttgcggagagaggagacgagaaacacctgtatggggtggcttttgtatatgtgtgttggggtgggatgtggagggaaattattctttccaagcgacattagcaagctttctttttggtttcggcctgtagtggaatggttctctattctggttgtactagggaatcatctaggagcttaaaaaagcatggaatgattggccccacccaaaatcaattgacgctctatggtagaacaatagataagttcagagtgtatggcaaggattat

SEQ ID NO: 4312 - DNA, 601 bp, Human
tgggacagcccataacctggcccttggccttcacggcacaccgcctttcccacaccaccctgcgggagcatgagccccagcttgagtggtgagatggttccacacttgcggctcagatttctgagggtgataaacggtggccctgcccctcagcagagcagccagaactcaggggtgctagccacatgttgtgaaaggctgaaatgtgaagtcaggaatcaggacaggagaggacgcagcagatacctgtggaatatttgtcattttggaagctttaaatgagctgtctgagaattcgggmattccctctggaggaagccatgtaagtacaaacagcgaccccctctactttcaaatcgtagcaacaataatgataaataacttcttaataacaatccttataacagcttgtggttttccagggaaacaagcaaaatatgaaagtggctgattcctgcccccccaccttgaatatggcttcagaaattcctgtaggctgaaatctcaggacagaccaacagcactgtcctttgcggagagaggagacgagaaacacctgtatggggtggcttttgtatatgtgtgttggggtgggatgtgg

SEQ ID NO: 4313 - DNA, 601 bp, Human
tggcatccacattttccaccacatgagtgccatctttcttagctgtaatgtaaatgaggtcgctgttgacctggaaacaggagaggagagcattagccatcatcacatgtctgctgttgccaaagtctttaactgtccatagagcagtcgtctagagatctctggagctgacatgcccctttcttcaacaacattggattcgtatcatagggccaaacaggttttgaaaatattctaaaggcgaatctagttgatttagtagtactttaaataaagattatttgaggctgagataataaaytgtctaagaagcaaccatttttctccctcctctgtccttgtgataagtcctacctctcacaggagagaagacaatgccatgccaccatgcccatcgcttgcttccctggacttcttttgggctaactgtggctatgtgacctactgccaggaggaagaggaagtctgctaggtggcttctgggaaacatttttcccctttgaaaaaggagagaggtacatggatgagtttgtccttccccttctgctttcagctgttttcaggtgttttcaggtgaagggatgcttgaagctgctgtggc

SEQ ID NO: 4314 - DNA, 601 bp, Human; identical to SEQ ID NO: 1011

SEQ ID NO: 4315 - DNA, 601 bp, Human; identical to SEQ ID NO: 1012

SEQ ID NO: 4316 - DNA, 601 bp, Human; identical to SEQ ID NO: 1013

SEQ ID NO: 4317 - DNA, 601 bp, Human; identical to SEQ ID NO: 1014

SEQ ID NO: 4318 - DNA, 601 bp, Human; identical to SEQ ID NO: 1015

SEQ ID NO: 4319 - DNA, 601 bp, Human; identical to SEQ ID NO: 1016

SEQ ID NO: 4320 - DNA, 601 bp, Human; identical to SEQ ID NO: 1017

SEQ ID NO: 4321 - DNA, 601 bp, Human; identical to SEQ ID NO: 1018

SEQ ID NO: 4322 - DNA, 601 bp, Human; identical to SEQ ID NO: 1019

SEQ ID NO: 4323 - DNA, 601 bp, Human; identical to SEQ ID NO: 1020

SEQ ID NO: 4324 - DNA, 601 bp, Human; identical to SEQ ID NO: 1021

SEQ ID NO: 4325 - DNA, 601 bp, Human; identical to SEQ ID NO: 1022

SEQ ID NO: 4326 - DNA, 601 bp, Human; identical to SEQ ID NO: 1023

SEQ ID NO: 4327 - DNA, 601 bp, Human; identical to SEQ ID NO: 1024

SEQ ID NO: 4328 - DNA, 601 bp, Human; identical to SEQ ID NO: 1025

SEQ ID NO: 4329 - DNA, 601 bp, Human; identical to SEQ ID NO: 1026

SEQ ID NO: 4330 - DNA, 601 bp, Human; identical to SEQ ID NO: 1027

SEQ ID NO: 4331 - DNA, 601 bp, Human; identical to SEQ ID NO: 1028

SEQ ID NO: 4332 - DNA, 601 bp, Human; identical to SEQ ID NO: 1029

SEQ ID NO: 4333 - DNA, 601 bp, Human; identical to SEQ ID NO: 1030

SEQ ID NO: 4334 - DNA, 601 bp, Human; identical to SEQ ID NO: 1031

SEQ ID NO: 4335 - DNA, 601 bp, Human; identical to SEQ ID NO: 1032

SEQ ID NO: 4336 - DNA, 601 bp, Human
ttgtgccctggggaattaaactgctctttaagtaaacccagaagataactaacaaataatcctgcaaattaatagtgcctaaaagatgaaagttatcagtttccttcatacatccggtttattatcagtggtgcaattaaattctattttctgctgtggtttgagcacttcacagcttgggaagcctctctcctgagaccttcacagggacaggccgtcacttcataattaggtacgcacacaggccttgctgctgtcagggaaggttcagggttgagctcataaatgaaacctgcgcaayagcccagaagggtagcaaaagctgcttccaccaagcagctgggacaggcctgcagcagggggtcccacatgtctataggaagagccagctgtgaagaacagcttcggggttagggcatcctgcaccttaagctattaacttcacgttctcatggatgatggtacctctgcagcaaccctaatccccacctctccattttgcatttgtttctccctttgcctgccaaccctgcacagcctcgttttcattcttttcaggcgtcctgtgcacacaacgccatggtgggcctgtgggccatga

SEQ ID NO: 4337 - DNA, 601 bp, Human
ataagtgttcctttttctccacaaccccacgagtaccagttattttttgactttttaattatagctattctgactggtatgagatggtatctcatggtggctttgatttgcatttctctgatgattggtgatgttgccaataaccagcatctataaggaacttgaacatgtttacaggaaaaaaaccaaacaaccccattaaaaagtgggcaagggacatgaacatagatatggccaacaagcatatgaaaaaaaaagcccatggaggctataattcttaagaaactaatgcaggaacagwaaacgtaataccgcatgttctcacttataggtgggagctaaatgaggagaacttacgaacacacagaaggaaacaaacagacactggggtctactggagtggggaggatgggaggagggagaggagcagaaaagataactactgggtaccgggcttagtacctgggtgatgtaacaatatgtacagcaaacccctgtgacacgtgtttatctacataacaaaccttcatatgtaccctcaaatctaaaataaaaatagaaagacaggaaaggaaggaaggaaggaaggagaaaaaataac

SEQ ID NO: 4338 - DNA, 601 bp, Human
cttttttacagctatggctgcattgtgtccagtctaccattgatgggcatttaggttgattccatgtgtgtgctattgtgaatagtgctgcaataaacatatatgtgcatgtatctttatgatagaatgatttatattcctttgggtatctacgcagtaatgggattgctgggtcaaatggtagttctgtgtttagctctttcaggaatggccacactgttttccacaatgattgaactagtttacactcccaccaaccgtatataagtgttcctttttctccacaaccccacgagtaccwgttattttttgactttttaattatagctattctgactggtatgagatggtatctcatggtggctttgatttgcatttctctgatgattggtgatgttgccaataaccagcatctataaggaacttgaacatgtttacaggaaaaaaaccaaacaaccccattaaaaagtgggcaagggacatgaacatagatatggccaacaagcatatgaaaaaaaaagcccatggaggctataattcttaagaaactaatgcaggaacagaaaacgtaataccgcatgttctcacttataggtgggag

SEQ ID NO: 4339 - DNA, 601 bp, Human
ggctccattcgtgttcctgcgaaggacatgacctcatccttttttacagctatggctgcattgtgtccagtctaccattgatgggcatttaggttgattccatgtgtgtgctattgtgaatagtgctgcaataaacatatatgtgcatgtatctttatgatagaatgatttatattcctttgggtatctacgcagtaatgggattgctgggtcaaatggtagttctgtgtttagctctttcaggaatggccacactgttttccacaatgattgaactagtttacactcccaccaaccgtayataagtgttcctttttctccacaaccccacgagtaccagttattttttgactttttaattatagctattctgactggtatgagatggtatctcatggtggctttgatttgcatttctctgatgattggtgatgttgccaataaccagcatctataaggaacttgaacatgtttacaggaaaaaaaccaaacaaccccattaaaaagtgggcaagggacatgaacatagatatggccaacaagcatatgaaaaaaaaagcccatggaggctataattcttaagaaactaatgcaggaacag

SEQ ID NO: 4340 - DNA, 601 bp, Human
ccacatgttcccatcttttagctcccacttataagtgagaacgtgcagtattcggttttctcttcctgtgttagtttgctaagataatggtctctggctccattcgtgttcctgcgaaggacatgacctcatccttttttacagctatggctgcattgtgtccagtctaccattgatgggcatttaggttgattccatgtgtgtgctattgtgaatagtgctgcaataaacatatatgtgcatgtatctttatgatagaatgatttatattcctttgggtatctacgcagtaatgggattrctgggtcaaatggtagttctgtgtttagctctttcaggaatggccacactgttttccacaatgattgaactagtttacactcccaccaaccgtatataagtgttcctttttctccacaaccccacgagtaccagttattttttgactttttaattatagctattctgactggtatgagatggtatctcatggtggctttgatttgcatttctctgatgattggtgatgttgccaataaccagcatctataaggaacttgaacatgtttacaggaaaaaaaccaaacaaccccattaaaaa

SEQ ID NO: 4341 - DNA, 601 bp, Human
ccttgtaggatggtatagagggttaaataagatcatagaagagaggcgtttaataatgtagtgcttaataaatcatagctgctgtcatcataatcaccaggggctggtcccaacccttatcttgactgagctgagcaggaagggctgtggtctcctctctgtctctcacataatttcaccctgtgcctggcacatttgcccacagcaaccttgaggctcagtcagttgtgtgtccatccaggctcaaagaggttgaaaaagggtgtgagcgttttcttagaatttagagaaacatatcctrtgtaattctggacctctgagccattgtggtttcgtacttttactgcatttagctccctttccaagtcctcatttttaaaaaaccttttattttaagttcaggggtacatgtgcaggtttgttatataggtaaactcatgtcatgagggttgtacagattattttgtcacaaagatattaaacctagtagccattagttatttttcctgatcctctccctcctcccacgccgcaccctgcaccctccaataggaccctgtgtgtgttgtttccctctatatatccacatgttcccatcttt

SEQ ID NO: 4342 - DNA, 601 bp, Human
acaggcttccaagtcaggaagacctgggccagaagtgtctctccttccctcaacaggcacgtgatcacgggccagttactaataaacagcaataatggcaataatagcagcaaccaacatatgtaggtgtgcactgtgactcgggcatccaatgactcataaaaaactcacaaggaccccaggaggagagttaccattgcttttgacttacagatgagaatgcagaagccaacagaggtgaaatgatctgtccaggtttacacagttatgatgttcagaaaacaagctttaaactcagatratttggttccagagcccatgttctgaccactgtgctacaaggcactgccttctctggtcctctcagttttctaatcagtaaaatagggttatagtaacgtcctccttgtaggatggtatagagggttaaataagatcatagaagagaggcgtttaataatgtagtgcttaataaatcatagctgctgtcatcataatcaccaggggctggtcccaacccttatcttgactgagctgagcaggaagggctgtggtctcctctctgtctctcacataatttcaccctgtgcctggcacattt

SEQ ID NO: 4343 - DNA, 601 bp, Human
ttgggtacttcctggagaagacaatgctttgggcaaaggctttgaagagaagggaggaagaaaaagcggctccgacttgtgggagagcagagttgacaatcatgttacattcccactctagaaactcccttgaagcctctttgttcagagagtcgatgataaagctctcatccaaaattgtagactcccctccacatagcctcaagctatctttttcaggttacccttactcatccctgctcccagcctccaccccagccaaggcacgcttctcactgctctacatactgccgtccacctyccctctagcccttgctaacattttcttcctagtatctgaaggggtctctccatccatctctactggttgaacgttatctgttcattggagaccattcatctttctacagtcttaattcttgatgtcccacaccactcaagtgtgtgtgatctctcctcccttgaatacaaaactctctgcaaagtcaatgaccacctctgctttttgtgatagttccattgtagcccagcggctgccagcacaggcttccaagtcaggaagacctgggccagaagtgtctctccttccctcaacaggcac

SEQ ID NO: 4344 - DNA, 601 bp, Human
aaactagcttttaggaaactccagttccaaggctgagttgggtacttcctggagaagacaatgctttgggcaaaggctttgaagagaagggaggaagaaaaagcggctccgacttgtgggagagcagagttgacaatcatgttacattcccactctagaaactcccttgaagcctctttgttcagagagtcgatgataaagctctcatccaaaattgtagactcccctccacatagcctcaagctatctttttcaggttacccttactcatccctgctcccagcctccaccccagccaagrcacgcttctcactgctctacatactgccgtccacctcccctctagcccttgctaacattttcttcctagtatctgaaggggtctctccatccatctctactggttgaacgttatctgttcattggagaccattcatctttctacagtcttaattcttgatgtcccacaccactcaagtgtgtgtgatctctcctcccttgaatacaaaactctctgcaaagtcaatgaccacctctgctttttgtgatagttccattgtagcccagcggctgccagcacaggcttccaagtcaggaagac

SEQ ID NO: 4345 - DNA, 601 bp, Human
gactgggagcactattgagcccaggccccatctttatcaccacagggaccagtaaaatccacgactgggtccactgggatgcacaaacaggaagccactggcctgctttggttgacggtgacttggattcagacatgtgagcccagtattgttccagattggcctagatttgatctaaaggggaatcaggtaagaacagctggaaactagcttttaggaaactccagttccaaggctgagttgggtacttcctggagaagacaatgctttgggcaaaggctttgaagagaagggaggaagwaaaagcggctccgacttgtgggagagcagagttgacaatcatgttacattcccactctagaaactcccttgaagcctctttgttcagagagtcgatgataaagctctcatccaaaattgtagactcccctccacatagcctcaagctatctttttcaggttacccttactcatccctgctcccagcctccaccccagccaaggcacgcttctcactgctctacatactgccgtccacctcccctctagcccttgctaacattttcttcctagtatctgaaggggtctctccatccatctc

SEQ ID NO: 4346 - DNA, 601 bp, Human
gggccacactcaggccactggcccacttcaggccagtggcccacatgctgccctaagcaacccccatgcattgatgggactacagaggagaaagaacatttaccaacagctactaggtctggacgtgggccatgcattctcacaaacattgctacagatgtcaatccccccagtgcagtgttttatatgtgactgtacttaatagaaggagcagtataatcatagtgtattcactttgcaaaggggatactgaagttcagagagaggatgtgtgtgtgtgtgtgtgtgtgtgtgtgtgagwgagagagagagagagagagagagaacaagcaacacatgggaaggcagagaaaaattctatgtctgattgtaatgaaattttcttttctcatcaaaatattttgatagcatggggaaagagacgtgtgctcattaaagtttaatgactgtctctctctgcctgtttccatgtgaggatcacacactctgactcacacatggtgggtgctgggaatggttgactgggagcactattgagcccaggccccatctttatcaccacagggaccagtaaaatccacgactgggtccactgggatgc

SEQ ID NO: 4347 - DNA, 601 bp, Human
gagggccacactcaggccactggcccacttcaggccagtggcccacatgctgccctaagcaacccccatgcattgatgggactacagaggagaaagaacatttaccaacagctactaggtctggacgtgggccatgcattctcacaaacattgctacagatgtcaatccccccagtgcagtgttttatatgtgactgtacttaatagaaggagcagtataatcatagtgtattcactttgcaaaggggatactgaagttcagagagaggatgtgtgtgtgtgtgtgtgtgtgtgtgtgtgwgagagagagagagagagagagagagaacaagcaacacatgggaaggcagagaaaaattctatgtctgattgtaatgaaattttcttttctcatcaaaatattttgatagcatggggaaagagacgtgtgctcattaaagtttaatgactgtctctctctgcctgtttccatgtgaggatcacacactctgactcacacatggtgggtgctgggaatggttgactgggagcactattgagcccaggccccatctttatcaccacagggaccagtaaaatccacgactgggtccactgggat

SEQ ID NO: 4348 - DNA, 601 bp, Human
gtgagggccacactcaggccactggcccacttcaggccagtggcccacatgctgccctaagcaacccccatgcattgatgggactacagaggagaaagaacatttaccaacagctactaggtctggacgtgggccatgcattctcacaaacattgctacagatgtcaatccccccagtgcagtgttttatatgtgactgtacttaatagaaggagcagtataatcatagtgtattcactttgcaaaggggatactgaagttcagagagaggatgtgtgtgtgtgtgtgtgtgtgtgtgtgwgagagagagagagagagagagagagagaacaagcaacacatgggaaggcagagaaaaattctatgtctgattgtaatgaaattttcttttctcatcaaaatattttgatagcatggggaaagagacgtgtgctcattaaagtttaatgactgtctctctctgcctgtttccatgtgaggatcacacactctgactcacacatggtgggtgctgggaatggttgactgggagcactattgagcccaggccccatctttatcaccacagggaccagtaaaatccacgactgggtccactggg

SEQ ID NO: 4349 - DNA, 601 bp, Human
ctcctgcctcaacttcctgagtagctggggttacaggcacgcaccactacagcctggctaattttttatttttagtagaaacagggtttcaccatgttggtcaggttcatcccaaactcctgacctcaagtgatccagccaccttggccttccaaagtgctgggattacaggtgtgagccactgcacccggcctctctgataatggttttgaaagctctaggcatttgctacaatttatttacagagtgggcaccaaataactatatgaagaatggatgaatgcaagagtgactaaataargagataaataaaaactagaaagtctttcagctaatggacaaaataaatacagagcaaacgcttacttttaaaaactcttggaaacagtcaattgtcctcattttaaaagctttttttttttttgaaaaatttggagacatctgtttgcttatgcttgtaactttaaaaatcacacacataaaaaatggttatgttttctcctagcaaaattgttcctagttcacatgagaaaattagttctattggtgcttcctgacatcctgcaaaggctgcaggactttttccacatgataataccac

SEQ ID NO: 4350 - DNA, 601 bp, Human
gaaaagggaacccccttttttggggggatgtggctccatgccaggctgcagggcttgatggttggcgagtgggctggactgggtcccctcactgtctccttcccacctgcagatgggcacaatctgcacaggggtgagtgctggcctggagggaagccgcccagaggaaggtccctgcctcctctccggggtcaacagtgatacttcccatggatcttgtgttatctatacaattccccaccaatcagtgctggtcatgcagatattctgcttgttgaagtcgatttctgtgggttaagcmtctttcacaggccccatgtacactgtctttgcaagaggagcaccccaggctctgtgtaagtgctggttagctcaggttaaaacagagcaactgcactcctggagctgttccaggtgggccagtgctgaaagaaagtggcgcaacctttccccatttcagaaaaatgcaacaaaaatgttctcactgttggccgggcgcagtggctcacgcctgtaatcccagcactttgggaggccaaggtgggtggatcacctgaggtcaggagttcgagaccagcctggccaacgtggtgaaaccctg

SEQ ID NO: 4351 - DNA, 601 bp, Human
tagtggggtgactcaatgtaatatcatacaacagagcatctgacacatactagcattaatgaaatatgaggtttaaagggagaacatgttgccagggtgaccctgagaacctcctcacctatagggtcttctatggagaatgacgtggattcggtttctcaggggttagagaagagagccacaaaggggagaggtgaagaagcccacctcctggttcccatccccggcctccccatgaagggtgtgggtgtgggcaggggtgaatcttggtgacgagagtgcgatggagccacagagagtrcaggaggctggagagagaacgtgctcggttgtggacatggaggggaaaatggtcagggttcagcaataattagaacacatagtctgttcccattttccaccttaatgaaaagtttgtgatatttacagcactaaatgaaactacagttaagtctcacagtgtagccagtcactgtcatgtactttgtttggggcactcattatatctcaagtggtttcccctttttttctttctttttttttttttcgagacggagtcttgctctgttgcccaggctggagtgcagtggtgtgatctcag

SEQ ID NO: 4352 - DNA, 601 bp, Human
ttagtggggtgactcaatgtaatatcatacaacagagcatctgacacatactagcattaatgaaatatgaggtttaaagggagaacatgttgccagggtgaccctgagaacctcctcacctatagggtcttctatggagaatgacgtggattcggtttctcaggggttagagaagagagccacaaaggggagaggtgaagaagcccacctcctggttcccatccccggcctccccatgaagggtgtgggtgtgggcaggggtgaatcttggtgacgagagtgcgatggagccacagagagygcaggaggctggagagagaacgtgctcggttgtggacatggaggggaaaatggtcagggttcagcaataattagaacacatagtctgttcccattttccaccttaatgaaaagtttgtgatatttacagcactaaatgaaactacagttaagtctcacagtgtagccagtcactgtcatgtactttgtttggggcactcattatatctcaagtggtttcccctttttttctttctttttttttttttcgagacggagtcttgctctgttgcccaggctggagtgcagtggtgtgatctca

SEQ ID NO: 4353 - DNA, 601 bp, Human
tagatttctatgccagagtaaaatgtgacaaggtagccttggggccttgatatatattacttgatgataataggagtcactatctaggattttctcttttaaaaatgagagatgccacttttaaaaagagaatcagtagcccaaacatactgggattacaggactggaatgtgagattggttattctcatgtgtgtctctttttaagattcaaaaaaatagcaaacatgaaatgcacagagcaaattatgttttaggtaccgcagttaccagtgactcctcattttcattctaaaatgtgyactgttctgtagctgtcctgaagagagagatggaaatgaacaccttcgatgaggagggctcactcatagacatagtttacgatcatctatcctggctaagggcacccacggtttggtcccacggccacaatcctctgtgaaagtagccacgaggggatggagagtcagctatgggagcagggctgaaggtgtcccctcctagggtcccctggggtaagcaggctttccttgctcagagtccctcaggactcataggtagatacctctgatttactccacaaataacctgaaacagtgtca

SEQ ID NO: 4354 - DNA, 601 bp, Human
aaatccaggtctttctgactctaaaacattcatcttcaaaactacatatactgtgatccctgacagaatacaggtaaaaatagaaacttttttttttgctggaatagcttctttattttctgaaatccagcaaagaatcatttgcagcatcaccttttaagttatcgctaaaccatcagttgaggacgaggattataagttgaccctgaactaaattagaaaacatctataactcacctctctctttttgactttatagagaaggaattagatttctatgccagagtaaaatgtgacaagktagccttggggccttgatatatattacttgatgataataggagtcactatctaggattttctcttttaaaaatgagagatgccacttttaaaaagagaatcagtagcccaaacatactgggattacaggactggaatgtgagattggttattctcatgtgtgtctctttttaagattcaaaaaaatagcaaacatgaaatgcacagagcaaattatgttttaggtaccgcagttaccagtgactcctcattttcattctaaaatgtgtactgttctgtagctgtcctgaagagagagatg

SEQ ID NO: 4355 - DNA, 601 bp, Human
atgattattaatcccattctgtttacgtgaaattgaaatttagaagataaataaaaagcctacagagttaggaatctggcggaagttggatataaatccaggtctttctgactctaaaacattcatcttcaaaactacatatactgtgatccctgacagaatacaggtaaaaatagaaacttttttttttgctggaatagcttctttattttctgaaatccagcaaagaatcatttgcagcatcaccttttaagttatcgctaaaccatcagttgaggacgaggattataagttgaccctraactaaattagaaaacatctataactcacctctctctttttgactttatagagaaggaattagatttctatgccagagtaaaatgtgacaaggtagccttggggccttgatatatattacttgatgataataggagtcactatctaggattttctcttttaaaaatgagagatgccacttttaaaaagagaatcagtagcccaaacatactgggattacaggactggaatgtgagattggttattctcatgtgtgtctctttttaagattcaaaaaaatagcaaacatgaaatgcacaga

SEQ ID NO: 4356 - DNA, 601 bp, Human
cttacatttatttagttagtgtttacttagtaatgcaggcattctgttcatcagtttacttacactaccttatttaatcttctctacagccctatggtcttgggggtagacatgattattaatcccattctgtttacgtgaaattgaaatttagaagataaataaaaagcctacagagttaggaatctggcggaagttggatataaatccaggtctttctgactctaaaacattcatcttcaaaactacatatactgtgatccctgacagaatacaggtaaaaatagaaacttttttttttgctggaatagcttctttattttctgaaatccagcaaagaatcatttgcagcatcaccttttaagttatcgctaaaccatcagttgaggacgaggattataagttgaccctgaactaaattagaaaacatctataactcacctctctctttttgactttatagagaaggaattagatttctatgccagagtaaaatgtgacaaggtagccttggggccttgatatatattacttgatgataataggagtcactatctaggattttctcttttaaaaatgagagatgccacttttaaaaaga

SEQ ID NO: 4357 - DNA, 601 bp, Human
ttaatgacaacaataataacaagtaacttacatttatttagttagtgtttacttagtaatgcaggcattctgttcatcagtttacttacactaccttatttaatcttctctacagccctatggtcttgggggtagacatgattattaatcccattctgtttacgtgaaattgaaatttagaagataaataaaaagcctacagagttaggaatctggcggaagttggatataaatccaggtctttctgactctaaaacattcatcttcaaaactacatatactgtgatccctgacagaatasaggtaaaaatagaaacttttttttttgctggaatagcttctttattttctgaaatccagcaaagaatcatttgcagcatcaccttttaagttatcgctaaaccatcagttgaggacgaggattataagttgaccctgaactaaattagaaaacatctataactcacctctctctttttgactttatagagaaggaattagatttctatgccagagtaaaatgtgacaaggtagccttggggccttgatatatattacttgatgataataggagtcactatctaggattttctcttttaaa

SEQ ID NO: 4358 - DNA, 601 bp, Human
cagcaacacgtgatcctgactctggttaatgacaacaataataacaagtaacttacatttatttagttagtgtttacttagtaatgcaggcattctgttcatcagtttacttacactaccttatttaatcttctctacagccctatggtcttgggggtagacatgattattaatcccattctgtttacgtgaaattgaaatttagaagataaataaaaagcctacagagttaggaatctggcggaagttggatataaatccaggtctttctgactctaaaacattcatcttcaaaactacmtatactgtgatccctgacagaatacaggtaaaaatagaaacttttttttttgctggaatagcttctttattttctgaaatccagcaaagaatcatttgcagcatcaccttttaagttatcgctaaaccatcagttgaggacgaggattataagttgaccctgaactaaattagaaaacatctataactcacctctctctttttgactttatagagaaggaattagatttctatgccagagtaaaatgtgacaaggtagccttggggccttgatatatattacttgatgataataggagtc

SEQ ID NO: 4359 - DNA, 601 bp, Human
ggggccatagccgttgctcagcaacacgtgatcctgactctggttaatgacaacaataataacaagtaacttacatttatttagttagtgtttacttagtaatgcaggcattctgttcatcagtttacttacactaccttatttaatcttctctacagccctatggtcttgggggtagacatgattattaatcccattctgtttacgtgaaattgaaatttagaagataaataaaaagcctacagagttaggaatctggcggaagttggatataaatccaggtctttctgactctaaaacwttcatcttcaaaactacatatactgtgatccctgacagaatacaggtaaaaatagaaacttttttttttgctggaatagcttctttattttctgaaatccagcaaagaatcatttgcagcatcaccttttaagttatcgctaaaccatcagttgaggacgaggattataagttgaccctgaactaaattagaaaacatctataactcacctctctctttttgactttatagagaaggaattagatttctatgccagagtaaaatgtgacaaggtagccttggggccttgatatatattac

SEQ ID NO: 4360 - DNA, 601 bp, Human
ttagagaaggttagttcaagaagaaacttttatgtgtatttgctttagagaagagtattcattacttgggccagagaaaagaataaagcatatgtcttacttggtgacgtcaaatgcttttgcatatacttgatggccttaagtttttctcaatattctattgaaaatatctctctctgttttaaaaaaatcaacccgtagtatgctttttcaagttacatatcacttactgatattgacattcctgtcctttatactaattcatgataatgagctgctactctgattctttggtaaacargaaagttactaacacacacatactctctttctcttatataaactttttggaaagaaattacttttttagaaatcacaagatatcttccactaagcatatgctttaaaaatacataactgtattcaaaattgaaactgaaatgaaggaaaaagtttgagaaagagtaacaataagtgaggttggcaatttgaaatacatgatttattagcacacctaacagctcttatttcaagtactttcaatcatgtattgcacgtatttctggaaactgtatttttccctcccccttggcctgtgatc

SEQ ID NO: 4361 - DNA, 601 bp, Human
atgtaaaaacctacccaatgctcgacatcactgtgttctgcttgggaaatgtaactggaggtgtctccctctccttgcttcttttgaggaaaatgctgccaacacatagtgttttcacgttatgtgttgatttcagtgatgcaccatgctatggtacctacaaaatgctgagaacaatgactatttggggagaaaatatctgtttgcatcacattattttaggaatctgcaaagctcccttttccttattgctgaaagcataattccatatctgcatagtcatattttcatttcattttcrcagtcatatttttcattttcttgctctcataaaaccttaaataaagggagccttcaggcaatttagagaaggttagttcaagaagaaacttttatgtgtatttgctttagagaagagtattcattacttgggccagagaaaagaataaagcatatgtcttacttggtgacgtcaaatgcttttgcatatacttgatggccttaagtttttctcaatattctattgaaaatatctctctctgttttaaaaaaatcaacccgtagtatgctttttcaagttacatatcacttactgatattg

SEQ ID NO: 4362 - DNA, 601 bp, Human
aggagaagcccttctctggttgtagtgtgtttcttttgcaattaacaaagaccagtgtcccttttctgacacttgtctcctgcaccgagaatgtaaacttcctgtccctgactactgatgataatgagccttagacactcaaaccaaactaaatgtaaaaacctacccaatgctcgacatcactgtgttctgcttgggaaatgtaactggaggtgtctccctctccttgcttcttttgaggaaaatgctgccaacacatagtgttttcacgttatgtgttgatttcagtgatgcaccatgytatggtacctacaaaatgctgagaacaatgactatttggggagaaaatatctgtttgcatcacattattttaggaatctgcaaagctcccttttccttattgctgaaagcataattccatatctgcatagtcatattttcatttcattttcacagtcatatttttcattttcttgctctcataaaaccttaaataaagggagccttcaggcaatttagagaaggttagttcaagaagaaacttttatgtgtatttgctttagagaagagtattcattacttgggccagagaaaagaataa

SEQ ID NO: 4363 - DNA, 601 bp, Human
tgtaattagatgctggcatgggtgtatcaattctgcccagatttccctgatgctggagtggggagcagggagaaggatggggaggggtgagaggagaagcccttctctggttgtagtgtgtttcttttgcaattaacaaagaccagtgtcccttttctgacacttgtctcctgcaccgagaatgtaaacttcctgtccctgactactgatgataatgagccttagacactcaaaccaaactaaatgtaaaaacctacccaatgctcgacatcactgtgttctgcttgggaaatgtaactgraggtgtctccctctccttgcttcttttgaggaaaatgctgccaacacatagtgttttcacgttatgtgttgatttcagtgatgcaccatgctatggtacctacaaaatgctgagaacaatgactatttggggagaaaatatctgtttgcatcacattattttaggaatctgcaaagctcccttttccttattgctgaaagcataattccatatctgcatagtcatattttcatttcattttcacagtcatatttttcattttcttgctctcataaaaccttaaataaagggagccttcag

SEQ ID NO: 4364 - DNA, 601 bp, Human
taatcagtttgcttccagtattgtctctgtaattagatgctggcatgggtgtatcaattctgcccagatttccctgatgctggagtggggagcagggagaaggatggggaggggtgagaggagaagcccttctctggttgtagtgtgtttcttttgcaattaacaaagaccagtgtcccttttctgacacttgtctcctgcaccgagaatgtaaacttcctgtccctgactactgatgataatgagccttagacactcaaaccaaactaaatgtaaaaacctacccaatgctcgacatcastgtgttctgcttgggaaatgtaactggaggtgtctccctctccttgcttcttttgaggaaaatgctgccaacacatagtgttttcacgttatgtgttgatttcagtgatgcaccatgctatggtacctacaaaatgctgagaacaatgactatttggggagaaaatatctgtttgcatcacattattttaggaatctgcaaagctcccttttccttattgctgaaagcataattccatatctgcatagtcatattttcatttcattttcacagtcatatttttcattttcttgctctcat

SEQ ID NO: 4365 - DNA, 601 bp, Human
aagccccttcaaaagtatatctgatagtagctactgacctttcctctacacagacatacacagtgacaaatacaagatatatacaatatgggcatgtatttttaggggatgcactatagacctatgaagtccatacatggttttctaggggcccatgaaccctagattaagaacccttcccataccagtagactggctctacatgaagcctcctacgctgtggaaagtgaaatacacccttccaggtcactgatgacagtgagaaggaatgcttagtatttgagaaactggcccatgcaaytgggccatcatagataggcttcagatctgaatatgttcaggacattaaaccttctcaggtaatttcatatgtcatgcctaatcagtttgcttccagtattgtctctgtaattagatgctggcatgggtgtatcaattctgcccagatttccctgatgctggagtggggagcagggagaaggatggggaggggtgagaggagaagcccttctctggttgtagtgtgtttcttttgcaattaacaaagaccagtgtcccttttctgacacttgtctcctgcaccgagaatgtaaacttcctg

SEQ ID NO: 4366 - DNA, 601 bp, Human
agatggagctgccacagagacattattggcaaaagtgtttgctatgatcactatattctttctggaaaaaatattttggagccatctgtcttctccatggtatgctatataaggatgggcataagccccttcaaaagtatatctgatagtagctactgacctttcctctacacagacatacacagtgacaaatacaagatatatacaatatgggcatgtatttttaggggatgcactatagacctatgaagtccatacatggttttctaggggcccatgaaccctagattaagaacccttyccataccagtagactggctctacatgaagcctcctacgctgtggaaagtgaaatacacccttccaggtcactgatgacagtgagaaggaatgcttagtatttgagaaactggcccatgcaattgggccatcatagataggcttcagatctgaatatgttcaggacattaaaccttctcaggtaatttcatatgtcatgcctaatcagtttgcttccagtattgtctctgtaattagatgctggcatgggtgtatcaattctgcccagatttccctgatgctggagtggggagcagggaga

SEQ ID NO: 4367 - DNA, 601 bp, Human
tacaaaagctctctaaactgaagaagatggagctgccacagagacattattggcaaaagtgtttgctatgatcactatattctttctggaaaaaatattttggagccatctgtcttctccatggtatgctatataaggatgggcataagccccttcaaaagtatatctgatagtagctactgacctttcctctacacagacatacacagtgacaaatacaagatatatacaatatgggcatgtatttttaggggatgcactatagacctatgaagtccatacatggttttctaggggcccrtgaaccctagattaagaacccttcccataccagtagactggctctacatgaagcctcctacgctgtggaaagtgaaatacacccttccaggtcactgatgacagtgagaaggaatgcttagtatttgagaaactggcccatgcaattgggccatcatagataggcttcagatctgaatatgttcaggacattaaaccttctcaggtaatttcatatgtcatgcctaatcagtttgcttccagtattgtctctgtaattagatgctggcatgggtgtatcaattctgcccagatttccctg

SEQ ID NO: 4368 - DNA, 601 bp, Human
aaaacatctttggatttaaaaaatacaaaataaagatagcatttacaaaagctctctaaactgaagaagatggagctgccacagagacattattggcaaaagtgtttgctatgatcactatattctttctggaaaaaatattttggagccatctgtcttctccatggtatgctatataaggatgggcataagccccttcaaaagtatatctgatagtagctactgacctttcctctacacagacatacacagtgacaaatacaagatatatacaatatgggcatgtatttttaggggatgyactatagacctatgaagtccatacatggttttctaggggcccatgaaccctagattaagaacccttcccataccagtagactggctctacatgaagcctcctacgctgtggaaagtgaaatacacccttccaggtcactgatgacagtgagaaggaatgcttagtatttgagaaactggcccatgcaattgggccatcatagataggcttcagatctgaatatgttcaggacattaaaccttctcaggtaatttcatatgtcatgcctaatcagtttgcttccagtattgtctctgtaat

SEQ ID NO: 4369 - DNA, 601 bp, Human
tcctgcattaagaaacatttcaaaaacatctttggatttaaaaaatacaaaataaagatagcatttacaaaagctctctaaactgaagaagatggagctgccacagagacattattggcaaaagtgtttgctatgatcactatattctttctggaaaaaatattttggagccatctgtcttctccatggtatgctatataaggatgggcataagccccttcaaaagtatatctgatagtagctactgacctttcctctacacagacatacacagtgacaaatacaagatatatacaatatrggcatgtatttttaggggatgcactatagacctatgaagtccatacatggttttctaggggcccatgaaccctagattaagaacccttcccataccagtagactggctctacatgaagcctcctacgctgtggaaagtgaaatacacccttccaggtcactgatgacagtgagaaggaatgcttagtatttgagaaactggcccatgcaattgggccatcatagataggcttcagatctgaatatgttcaggacattaaaccttctcaggtaatttcatatgtcatgcctaatcagtttg

SEQ ID NO: 4370 - DNA, 601 bp, Human
cactggtatagacaaaacatgtggaagacagactgaatttttcactttcttcccagaggccctgcctcaatcaatttagatattgaaggtgtagcaatacatcagaatactttacatggtgtccctgatttcattctcaagtgtgtccaatatattttttcctgcattaagaaacatttcaaaaacatctttggatttaaaaaatacaaaataaagatagcatttacaaaagctctctaaactgaagaagatggagctgccacagagacattattggcaaaagtgtttgctatgatcactwtattctttctggaaaaaatattttggagccatctgtcttctccatggtatgctatataaggatgggcataagccccttcaaaagtatatctgatagtagctactgacctttcctctacacagacatacacagtgacaaatacaagatatatacaatatgggcatgtatttttaggggatgcactatagacctatgaagtccatacatggttttctaggggcccatgaaccctagattaagaacccttcccataccagtagactggctctacatgaagcctcctacgctgtggaaagtgaa

SEQ ID NO: 4371 - DNA, 601 bp, Human
gtcagaggagctggaaaagccaacaactcagcaataacaagacaaccaaaactgtttcgtactgacgtccaaaaaaaaaaaaaaaaaacggcagtcagaaagtaagggagattttcaaaccggtgggagcaacattggatttgaagccacactgacaagactgagaatggataaggcctaatggggaggagactggttcaatgacaggcaaactagaacatgaaccagaagttacttttaggctggctggcacatggggtgtggagagagaagcctggtttgaaggctgtggcaaaaacastaatcatgatctagatcagggcttctcagcatcaacactactgacatatcgggctggatgcatctttgttgcagagctgtcctgtgccaggtacgatgttaagcaacatccctggtgtctacccactgcatgccaggagcagccccgcaccccagccatcacaaccaaaagtgtctccagcaattgccaaatattccttagtaagcaaaattgccctccagttggaaaccactggtatagacaaaacatgtggaagacagactgaatttttcactttcttcccagaggccctgcctcaat

SEQ ID NO: 4372 - DNA, 601 bp, Human
tttcagccaactccctaaactttgttacatttaaatccgcatctcctggagggcagtggtggagagctggattcaggggaactaggagaggggcagacgatggtcatggtagcaacaacagcaggtgcacctagacagcatggatcgtgtgccaggcagggagtccagcactttaaccagcaatcctcagtctggtaatgggtggatcctgtaattcatttatttgaggcacccctgttgattacaaagaaccagccccagctgacaaccataattcacatatattctcacataagcctcrcaacacaagggctatatttgtatcagctcgatcagactataataatagttattcccttaagaagaaggaggttttctagggcaggatcactggtgccaggcatttcattttataaaagagaaaactgtggttcaggaaaataggtaacttgaatgaggatttgaagctgccaaatgaccaaggtgggattgaagttaaagtctgtctaactggagatcttgaactctaagatagagtgctactctgaggtcagaggagctggaaaagccaacaactcagcaataacaagacaaccaaaac

SEQ ID NO: 4373 - DNA, 601 bp, Human
cttatgctacagtcaagaataaaatcttcctgatctgatcattacacactgtatgcatgaattgaaaaatcacatgtaccccataaatatgtacaattattatatatcgattaaaagaagaatacactcttatggctttactcatcaagccatgctttgtgactaaatttatggctatgggatttcttaagtctataagaaaaacgaaactttcagccaactccctaaactttgttacatttaaatccgcatctcctggagggcagtggtggagagctggattcaggggaactaggagagrggcagacgatggtcatggtagcaacaacagcaggtgcacctagacagcatggatcgtgtgccaggcagggagtccagcactttaaccagcaatcctcagtctggtaatgggtggatcctgtaattcatttatttgaggcacccctgttgattacaaagaaccagccccagctgacaaccataattcacatatattctcacataagcctcacaacacaagggctatatttgtatcagctcgatcagactataataatagttattcccttaagaagaaggaggttttctagggcaggatcac

SEQ ID NO: 4374 - DNA, 601 bp, Human
gagaagaggacccttgcttacttatgctacagtcaagaataaaatcttcctgatctgatcattacacactgtatgcatgaattgaaaaatcacatgtaccccataaatatgtacaattattatatatcgattaaaagaagaatacactcttatggctttactcatcaagccatgctttgtgactaaatttatggctatgggatttcttaagtctataagaaaaacgaaactttcagccaactccctaaactttgttacatttaaatccgcatctcctggagggcagtggtggagagctggrttcaggggaactaggagaggggcagacgatggtcatggtagcaacaacagcaggtgcacctagacagcatggatcgtgtgccaggcagggagtccagcactttaaccagcaatcctcagtctggtaatgggtggatcctgtaattcatttatttgaggcacccctgttgattacaaagaaccagccccagctgacaaccataattcacatatattctcacataagcctcacaacacaagggctatatttgtatcagctcgatcagactataataatagttattcccttaagaagaaggag

SEQ ID NO: 4375 - DNA, 601 bp, Human
ctcataaaacggcaaacatattgcaaggcacatggcaaaggcccaatgcattacagttgatgctttttagggtagcaatgctctgggtagtttgtcttattcaccttatatttcagcccacttttaactccaatacttagtacttcaataccaatgtccagtaaatatttattaaattaagtcaatggctcaaaaatggaatttactggatgtctggatcttccatatgacaacacagccattactattccatgtttctttagccactatataatatgggagaaaatatatggaaatgagscgtttttaagaatggacgtaaagaggaaggacattgcccagagaagaggacccttgcttacttatgctacagtcaagaataaaatcttcctgatctgatcattacacactgtatgcatgaattgaaaaatcacatgtaccccataaatatgtacaattattatatatcgattaaaagaagaatacactcttatggctttactcatcaagccatgctttgtgactaaatttatggctatgggatttcttaagtctataagaaaaacgaaactttcagccaactccctaaactttgttacat

SEQ ID NO: 4376 - DNA, 601 bp, Human
aataatagttcttcccttgcaagaaaggtttggaatgaaaaatgctcataaaacggcaaacatattgcaaggcacatggcaaaggcccaatgcattacagttgatgctttttagggtagcaatgctctgggtagtttgtcttattcaccttatatttcagcccacttttaactccaatacttagtacttcaataccaatgtccagtaaatatttattaaattaagtcaatggctcaaaaatggaatttactggatgtctggatcttccatatgacaacacagccattactattccatgttyctttagccactatataatatgggagaaaatatatggaaatgaggcgtttttaagaatggacgtaaagaggaaggacattgcccagagaagaggacccttgcttacttatgctacagtcaagaataaaatcttcctgatctgatcattacacactgtatgcatgaattgaaaaatcacatgtaccccataaatatgtacaattattatatatcgattaaaagaagaatacactcttatggctttactcatcaagccatgctttgtgactaaatttatggctatgggatttcttaagtctat

SEQ ID NO: 4377 - DNA, 601 bp, Human
aggagctatgtataccaaatgaatggatctgtataagctctaagtaacttgggaataagataagaataatagttcttcccttgcaagaaaggtttggaatgaaaaatgctcataaaacggcaaacatattgcaaggcacatggcaaaggcccaatgcattacagttgatgctttttagggtagcaatgctctgggtagtttgtcttattcaccttatatttcagcccacttttaactccaatacttagtacttcaataccaatgtccagtaaatatttattaaattaagtcaatggctcaraaatggaatttactggatgtctggatcttccatatgacaacacagccattactattccatgtttctttagccactatataatatgggagaaaatatatggaaatgaggcgtttttaagaatggacgtaaagaggaaggacattgcccagagaagaggacccttgcttacttatgctacagtcaagaataaaatcttcctgatctgatcattacacactgtatgcatgaattgaaaaatcacatgtaccccataaatatgtacaattattatatatcgattaaaagaagaatacactctta

SEQ ID NO: 4378 - DNA, 601 bp, Human
atttggaagaacaccacaggagacagccagagctcagtgccaggttcaacacttattaacagtggggactcaggtgatttaggctttctgagactcagttttcttgtctttaaaatgggctgacacttttatggggcgatctatgtagaatgctcttattattactataccttaagctgtgtttactgtatgccacacactttagaaccatatgcttttccaacataaacgcaatgtgccgcaaaatgccaggtggctataagacttgtttgtttgtttaggagctatgtataccaaatgratggatctgtataagctctaagtaacttgggaataagataagaataatagttcttcccttgcaagaaaggtttggaatgaaaaatgctcataaaacggcaaacatattgcaaggcacatggcaaaggcccaatgcattacagttgatgctttttagggtagcaatgctctgggtagtttgtcttattcaccttatatttcagcccacttttaactccaatacttagtacttcaataccaatgtccagtaaatatttattaaattaagtcaatggctcaaaaatggaatttactggatgtc

SEQ ID NO: 4379 - DNA, 601 bp, Human
aggagatttttcttctacagccacagtaccagagtccaggaaaataaaaggttatttgttggtgagttgatctattatgactctcagaagtatcaggtatttggaagaacaccacaggagacagccagagctcagtgccaggttcaacacttattaacagtggggactcaggtgatttaggctttctgagactcagttttcttgtctttaaaatgggctgacacttttatggggcgatctatgtagaatgctcttattattactataccttaagctgtgtttactgtatgccacacacttyagaaccatatgcttttccaacataaacgcaatgtgccgcaaaatgccaggtggctataagacttgtttgtttgtttaggagctatgtataccaaatgaatggatctgtataagctctaagtaacttgggaataagataagaataatagttcttcccttgcaagaaaggtttggaatgaaaaatgctcataaaacggcaaacatattgcaaggcacatggcaaaggcccaatgcattacagttgatgctttttagggtagcaatgctctgggtagtttgtcttattcaccttatatttcag

SEQ ID NO: 4380 - DNA, 601 bp, Human; identical to SEQ ID NO: 1033

SEQ ID NO: 4381 - DNA, 601 bp, Human; identical to SEQ ID NO: 1034

SEQ ID NO: 4382 - DNA, 601 bp, Human; identical to SEQ ID NO: 1035

SEQ ID NO: 4383 - DNA, 601 bp, Human; identical to SEQ ID NO: 1036

SEQ ID NO: 4384 - DNA, 601 bp, Human; identical to SEQ ID NO: 1037

SEQ ID NO: 4385 - DNA, 601 bp, Human; identical to SEQ ID NO: 1038

SEQ ID NO: 4386 - DNA, 601 bp, Human; identical to SEQ ID NO: 1039

SEQ ID NO: 4387 - DNA, 601 bp, Human; identical to SEQ ID NO: 1040

SEQ ID NO: 4388 - DNA, 601 bp, Human; identical to SEQ ID NO: 1041

SEQ ID NO: 4389 - DNA, 601 bp, Human; identical to SEQ ID NO: 2920

SEQ ID NO: 4390 - DNA, 601 bp, Human
tattaaccatttgctctctgcaaggcactatttactgccttattttacatacttctttctctttagcccctcttaagagatttttggccaataagggaataatatatccccagtgctttttttttttttttttttgggacggagtttcactcttgtagtccaggctggagtgcagtggtgcaatctcggcttattgcaacctccgcctcccaggttcaaatgattctcctgcctcagcctcctgagtagctgggactacaggcatgttccaccacacctagctaacttttttttttttttwaatttttttagtagagacagtgtttcaccatgttggccaggctgacctcaaactcctgacctcaagtaatccgcccactctggccttgcaaagtgctgggagtacaggtgtgagccaccgcacccggcctcaatgcattttaaaagcatggtatgctgttgctaaaaccaatattaaagggtaaccatagtgataaagtatacaagtatcagtcatgattttatagtttaaattcttccacatgctaaccaaaattaaaaccaattcccaaaggcaatgagtacttacatgacgattgcc

SEQ ID NO: 4391 - DNA, 601 bp, Human
attctacagatacatattaaccatttgctctctgcaaggcactatttactgccttattttacatacttctttctctttagcccctcttaagagatttttggccaataagggaataatatatccccagtgctttttttttttttttttttgggacggagtttcactcttgtagtccaggctggagtgcagtggtgcaatctcggcttattgcaacctccgcctcccaggttcaaatgattctcctgcctcagcctcctgagtagctgggactacaggcatgttccaccacacctagctaactttttttttttttttaatttttttagtagagacagtgtttcaccatgttggccaggctgacctcaaactcctgacctcaagtaatccgcccactctggccttgcaaagtgctgggagtacaggtgtgagccaccgcacccggcctcaatgcattttaaaagcatggtatgctgttgctaaaaccaatattaaagggtaaccatagtgataaagtatacaagtatcagtcatgattttatagtttaaattcttccacatgctaaccaaaattaaaaccaattcccaaaggcaatgagtactt

SEQ ID NO: 4392 - DNA, 601 bp, Human
ttgcaatccaagttgtgtggacttacatgagtatttaccttggtctattaatatttgcaacatgaacctatctttcccacataactctgaatgggcttagtttatgaagttttatacaaatttgctacaaactaacagctttagttatacattctacagatacatattaaccatttgctctctgcaaggcactatttactgccttattttacatacttctttctctttagcccctcttaagagatttttggccaataagggaataatatatccccagtgctttttttttttttttttttgrgacggagtttcactcttgtagtccaggctggagtgcagtggtgcaatctcggcttattgcaacctccgcctcccaggttcaaatgattctcctgcctcagcctcctgagtagctgggactacaggcatgttccaccacacctagctaactttttttttttttttaatttttttagtagagacagtgtttcaccatgttggccaggctgacctcaaactcctgacctcaagtaatccgcccactctggccttgcaaagtgctgggagtacaggtgtgagccaccgcacccggcctcaatgc

SEQ ID NO: 4393 - DNA, 601 bp, Human
aataatggaatattttcaccttgcaatccaagttgtgtggacttacatgagtatttaccttggtctattaatatttgcaacatgaacctatctttcccacataactctgaatgggcttagtttatgaagttttatacaaatttgctacaaactaacagctttagttatacattctacagatacatattaaccatttgctctctgcaaggcactatttactgccttattttacatacttctttctctttagcccctcttaagagatttttggccaataagggaataatatatccccagtgctttttttttttttttttttgggacggagtttcactcttgtagtccaggctggagtgcagtggtgcaatctcggcttattgcaacctccgcctcccaggttcaaatgattctcctgcctcagcctcctgagtagctgggactacaggcatgttccaccacacctagctaactttttttttttttttaatttttttagtagagacagtgtttcaccatgttggccaggctgacctcaaactcctgacctcaagtaatccgcccactctggccttgcaaagtgctgggagtacaggtgtgagcc

SEQ ID NO: 4394 - DNA, 601 bp, Human
atttgtgtttgtatttacgattgtttatatgccaaacagccatacttcaataattgcaggctaatgatgaaagaagagtgaacagagggagatttaatagaaacaccatgtgtgtaagccgagagaaggtcccacggcattacaaggaggcttacaaacaaaagtgtctcagtaggttcaatagagaaatatgataaaagaactcagaagtcacataccacatcatattttagatttgctgagattcagaaaacaaaccaaaccaaaacaaaaaccaagtaaaactcaaaaaaaaaaaaacaacaaacccagcattatagccattgggaccatttcatgttgagcacagctattgaatctcaacaaaataacattgtctattacactatgttgatgacatacatttaaacagcattgacttataacattatcatttaatttatatatttgttttggttgtgtagctgtttcaaaaccaccagcattctagttttgtttgtacatattcaagtaactttctaatgcaaataagttaagccattactgggatagttttttgttctttaaaaagattttgtatttacttttttacatgtattca

SEQ ID NO: 4395 - DNA, 601 bp, Human
tttaaatgtctgcatttgtgtttgtatttacgattgtttatatgccaaacagccatacttcaataattgcaggctaatgatgaaagaagagtgaacagagggagatttaatagaaacaccatgtgtgtaagccgagagaaggtcccacggcattacaaggaggcttacaaacaaaagtgtctcagtaggttcaatagagaaatatgataaaagaactcagaagtcacataccacatcatattttagatttgctgagattcagaaaacaaaccaaaccaaaacaaaaaccaagtaaaactcaaaaaaaaaaaaaaaacaaacccagcattatagccattgggaccatttcatgttgagcacagctattgaatctcaacaaaataacattgtctattacactatgttgatgacatacatttaaacagcattgacttataacattatcatttaatttatatatttgttttggttgtgtagctgtttcaaaaccaccagcattctagttttgtttgtacatattcaagtaactttctaatgcaaataagttaagccattactgggatagttttttgttctttaaaaagattttgtatttactttt

SEQ ID NO: 4396 - DNA, 601 bp, Human
gtagtcctttctattgcctgttcattagccttgcaagtaatttcccagaaatcatgagtccatttgagtttgtgattatttccacatttatcaatggctctactaggtctccctccctctgtcattctgcacatatcctatagccacactcccgtggtaaagtaatcttaatattgatctcacttctgtatttttccctagatagtgattcttgtgaaaacccagacaatagaagagtcatctagctaaacctaagcagatttttccactgatctgatctttctctctgtgtacactctayctgcaaagctcactggacacaaggacatgtcctccaggataaggaaattctttgaacattgtgtgatttggcggatgataatgacccagtatcttggttactgctgctccacataggttagttacaaacactaggtctttggttcaaaaaaatcattaatagtggcaaaagaattgaggatagcacaaaagtaattttcgtttcaggattggttaggatttcagatgatagtaccttgaaaaatgcaatttcctggccaatattctactggctctgcaataatagttgtcaattatctat

SEQ ID NO: 4397 - DNA, 601 bp, Human
cacacctgtaatcccagaactttgggaggctgaggtgggaggatcgcttgagcccaggagtttgggaccagcctgggcaacataggatgacccgtctttaaaaaaattagctgggcatgatggcacatgcctgtagtcccacctacttggaggtctgaggtaaaaggattgcttgaaccagggaggttgaggctgcagtgagccataattgtgccactgcactccagcctgggcaacagagcaagaccctgtctcaaaaaaaagtaatatttcctaatcttatttatttaagatgatctttaataaataaataaataaggatcttatttatttatttaagtcttttgaaatgatctagactgctttctgctagggcttgatcatgggtcttctggatttgggatcacagtttaatgcacacccttggttaagaccatacttattttaatttcaaattctcagccatatttcacctgcctccagagcctgtcttcttttctcaggaatctggatctatttccccacttgtcatgcagctttcagatgttctttgtccacgttcatctgagtgttcaccttgcctggtgttcacctgccacaa

SEQ ID NO: 4398 - DNA, 601 bp, Human
agtggctcacacctgtaatcccagaactttgggaggctgaggtgggaggatcgcttgagcccaggagtttgggaccagcctgggcaacataggatgacccgtctttaaaaaaattagctgggcatgatggcacatgcctgtagtcccacctacttggaggtctgaggtaaaaggattgcttgaaccagggaggttgaggctgcagtgagccataattgtgccactgcactccagcctgggcaacagagcaagaccctgtctcaaaaaaaagtaatatttcctaatcttatttatttaagaygatcttaaataaataaataaataaggatcttatttatttatttaagtcttttgaaatgatctagactgctttctgctagggcttgatcatgggtcttctggatttgggatcacagtttaatgcacacccttggttaagaccatacttattttaatttcaaattctcagccatatttcacctgcctccagagcctgtcttcttttctcaggaatctggatctatttccccacttgtcatgcagctttcagatgttctttgtccacgttcatctgagtgttcaccttgcctggtgttcacct

SEQ ID NO: 4399 - DNA, 601 bp, Human
tagtaagcactttataaatgtcagttactatcattaacatttcagaaggtctcgtttaaacttccagttaaaaccatcaccactgggagttttagttttggttcctgttgctgtggctgtagcactgggaggtgggctcacgctgctgggacatgcaggattctctcccctgcaccaagtggctccagactcccgcggctctagaattcttgtgttgaggtttcatttaacatgttcttccttctatcagtgtatctgtcctctgccgacttcttaccacctccttacaatggctggtttkttttttttttttgtatccaccatagacaaaatatccaaaaggccaagattgcataattgtacctaaaatgtagctacccttcagagacttgtctttaaatgaagaaggtatgcattggtgcatgtcatgctttgacatcaaaggcccttttcacttcctcctacacttttgcagtggcattctgaaggactaactttctgggataatagatttcctgaggtcaagtgcagtggctcacacctgtaatcccagaactttgggaggctgaggtgggaggatcgcttgagcccaggagtttgg

SEQ ID NO: 4400 - DNA, 601 bp, Human
tgcctaaatccaaatctgtgcttgacctcttactagctgtccaactaggaacaatttacctaaactctctttgccttactttccccatatttaaaaggggactaataatagtatctccctgataggattgttgtgaagaccaaatgacgtaacacatgtgaagtgcttggtggcgtgaaggactcaaacttccagggtcactgttcacaccctcaaaacagctcacagtctagtaagcactttataaatgtcagttactatcattaacatttcagaaggtctcgtttaaacttccagttamaaccatcaccactgggagttttagttttggttcctgttgctgtggctgtagcactgggaggtgggctcacgctgctgggacatgcaggattctctcccctgcaccaagtggctccagactcccgcggctctagaattcttgtgttgaggtttcatttaacatgttcttccttctatcagtgtatctgtcctctgccgacttcttaccacctccttacaatggctggttttttttttttttttgtatccaccatagacaaaatatccaaaaggccaagattgcataattgtacctaaaatg

SEQ ID NO: 4401 - DNA, 601 bp, Human
aaggcatagtgttaaaaatttgtgcctaaatccaaatctgtgcttgacctcttactagctgtccaactaggaacaatttacctaaactctctttgccttactttccccatatttaaaaggggactaataatagtatctccctgataggattgttgtgaagaccaaatgacgtaacacatgtgaagtgcttggtggcgtgaaggactcaaacttccagggtcactgttcacaccctcaaaacagctcacagtctagtaagcactttataaatgtcagttactatcattaacatttcagaagrtctcgtttaaacttccagttaaaaccatcaccactgggagttttagttttggttcctgttgctgtggctgtagcactgggaggtgggctcacgctgctgggacatgcaggattctctcccctgcaccaagtggctccagactcccgcggctctagaattcttgtgttgaggtttcatttaacatgttcttccttctatcagtgtatctgtcctctgccgacttcttaccacctccttacaatggctggttttttttttttttttgtatccaccatagacaaaatatccaaaaggccaaga

SEQ ID NO: 4402 - DNA, 601 bp, Human
aaaagaagctttattgaacccaaggcatagtgttaaaaatttgtgcctaaatccaaatctgtgcttgacctcttactagctgtccaactaggaacaatttacctaaactctctttgccttactttccccatatttaaaaggggactaataatagtatctccctgataggattgttgtgaagaccaaatgacgtaacacatgtgaagtgcttggtggcgtgaaggactcaaacttccagggtcactgttcacaccctcaaaacagctcacagtctagtaagcactttataaatgtcagttaytatcattaacatttcagaaggtctcgtttaaacttccagttaaaaccatcaccactgggagttttagttttggttcctgttgctgtggctgtagcactgggaggtgggctcacgctgctgggacatgcaggattctctcccctgcaccaagtggctccagactcccgcggctctagaattcttgtgttgaggtttcatttaacatgttcttccttctatcagtgtatctgtcctctgccgacttcttaccacctccttacaatggctggttttttttttttttttgtatccaccatagac

SEQ ID NO: 4403 - DNA, 601 bp, Human
agaaatcccaataggttaatcttctatttggcgtaaaaagaagctttattgaacccaaggcatagtgttaaaaatttgtgcctaaatccaaatctgtgcttgacctcttactagctgtccaactaggaacaatttacctaaactctctttgccttactttccccatatttaaaaggggactaataatagtatctccctgataggattgttgtgaagaccaaatgacgtaacacatgtgaagtgcttggtggcgtgaaggactcaaacttccagggtcactgttcacaccctcaaaacagcycacagtctagtaagcactttataaatgtcagttactatcattaacatttcagaaggtctcgtttaaacttccagttaaaaccatcaccactgggagttttagttttggttcctgttgctgtggctgtagcactgggaggtgggctcacgctgctgggacatgcaggattctctcccctgcaccaagtggctccagactcccgcggctctagaattcttgtgttgaggtttcatttaacatgttcttccttctatcagtgtatctgtcctctgccgacttcttaccacctccttacaatgg

SEQ ID NO: 4404 - DNA, 601 bp, Human
taggaagaccccccatctctacaaaaaattaaaaagtagctgggcgttgtcatgctcgcctgtggtcccagctacttgggggtatgggggtgctgaggtaggagaaccccgagaggctgaggctgcagtgagcagtgattgtgacactgcactccagcctttgccatagagcgagatcctgtctcaaaacacaaaacaaaaacaaaaaacccagatggttctaaaaccacatgggagtggagtaatagttatgcagagagaactatggaagccttaaggaagagcatccaatccagcttgrggggcaggggatggagaaagctcagggaaggggctaaagagatgacgaggtgatgattcagttcaacagtttcagaaatcccaataggttaatcttctatttggcgtaaaaagaagctttattgaacccaaggcatagtgttaaaaatttgtgcctaaatccaaatctgtgcttgacctcttactagctgtccaactaggaacaatttacctaaactctctttgccttactttccccatatttaaaaggggactaataatagtatctccctgataggattgttgtgaagaccaaatgacg

SEQ ID NO: 4405 - DNA, 601 bp, Human
aggcaggtatacaaaacaggtggttctgttgggcacagtggctcgcacctgtaatcaatcccagcactttgggaggctgaggttggaggattcctgagccccggagttctagaccagcctgagcaacataggaagaccccccatctctacaaaaaattaaaaagtagctgggcgttgtcatgctcgcctgtggtcccagctacttgggggtatgggggtgctgaggtaggagaaccccgagaggctgaggctgcagtgagcagtgattgtgacactgcactccagcctttgccatagagcragatcctgtctcaaaacacaaaacaaaaacaaaaaacccagatggttctaaaaccacatgggagtggagtaatagttatgcagagagaactatggaagccttaaggaagagcatccaatccagcttggggggcaggggatggagaaagctcagggaaggggctaaagagatgacgaggtgatgattcagttcaacagtttcagaaatcccaataggttaatcttctatttggcgtaaaaagaagctttattgaacccaaggcatagtgttaaaaatttgtgcctaaatccaaatctgtgc

SEQ ID NO: 4406 - DNA, 601 bp, Human
agtgtgaggcaggtatacaaaacaggtggttctgttgggcacagtggctcgcacctgtaatcaatcccagcactttgggaggctgaggttggaggattcctgagccccggagttctagaccagcctgagcaacataggaagaccccccatctctacaaaaaattaaaaagtagctgggcgttgtcatgctcgcctgtggtcccagctacttgggggtatgggggtgctgaggtaggagaaccccgagaggctgaggctgcagtgagcagtgattgtgacactgcactccagcctttgccayagagcgagatcctgtctcaaaacacaaaacaaaaacaaaaaacccagatggttctaaaaccacatgggagtggagtaatagttatgcagagagaactatggaagccttaaggaagagcatccaatccagcttggggggcaggggatggagaaagctcagggaaggggctaaagagatgacgaggtgatgattcagttcaacagtttcagaaatcccaataggttaatcttctatttggcgtaaaaagaagctttattgaacccaaggcatagtgttaaaaatttgtgcctaaatccaaat

SEQ ID NO: 4407 - DNA, 601 bp, Human
ggaatgtaaatagatataagaatttgaactccaactgggcaaaacactgatttgtttaagatttatttagaaaatgcaatgaatgcattgatgaatttatccaaattttattaagcatctaccatgctgcaggcattgtgttggtgatggggatatataggtgaacaaaatacaattctaccttcaggaaaccatcagtccagtgtgaggcaggtatacaaaacaggtggttctgttgggcacagtggctcgcacctgtaatcaatcccagcactttgggaggctgaggttggaggattcytgagccccggagttctagaccagcctgagcaacataggaagaccccccatctctacaaaaaattaaaaagtagctgggcgttgtcatgctcgcctgtggtcccagctacttgggggtatgggggtgctgaggtaggagaaccccgagaggctgaggctgcagtgagcagtgattgtgacactgcactccagcctttgccatagagcgagatcctgtctcaaaacacaaaacaaaaacaaaaaacccagatggttctaaaaccacatgggagtggagtaatagttatgcagagagaactat

SEQ ID NO: 4408 - DNA, 601 bp, Human
ccaactctccatttaagaaagccttccaaggaactctaatgtgctgaagtttaaaatcactgctggcctaaggaaataaaatctaatttccttagtgtcgtaggttgaacagtatcacccccaccccctcacccaactcatgtctactcacagccgcagaattcaccttatttggaaagagagtctttgtagatgtaattagttaaggatctcaaaatgaaatcatcctggatttagagtatttcctaaatccaattattgctgtctgtattagctcattttcaagctgctaataaagacwtaccccagactgggtaatttataaaggaaagaagtttcatggactcacagttccacatggttggggaggcttcacagttgtggcagaaggtgaaggaggagcaaagtcacatcttacatggcagcagggagagagggaaccctgggtggggtggggaaatgagcagaatgggggagttctccgggctgcattccgggtgagaagcctgaggaggcaggtgtggtgctaacccgggtttcaatgccatcatctgggcatctctgtaggttgaatggtgggagttccccatagtcaatgctg

SEQ ID NO: 4409 - DNA, 601 bp, Human
ctgacttgggcttccctatgcctaaggcagcagttctcaaagtgtagttcctagaccagcagtaccaacatcaccagggaactcagaaatgcagactctcgggctccaccttagatttactgaatcaacattctgggggttggacccaactctccatttaagaaagccttccaaggaactctaatgtgctgaagtttaaaatcactgctggcctaaggaaataaaatctaatttccttagtgtcgtaggttgaacagtatcacccccaccccctcacccaactcatgtctactcacagccrcagaattcaccttatttggaaagagagtctttgtagatgtaattagttaaggatctcaaaatgaaatcatcctggatttagagtatttcctaaatccaattattgctgtctgtattagctcattttcaagctgctaataaagacataccccagactgggtaatttataaaggaaagaagtttcatggactcacagttccacatggttggggaggcttcacagttgtggcagaaggtgaaggaggagcaaagtcacatcttacatggcagcagggagagagggaaccctgggtggggtggg

SEQ ID NO: 4410 - DNA, 601 bp, Human
ttgttatttaagccaaagtgagtcctgtggtgtgctactttcgatcaaacacatactaattgtccaacaaacaaacaaaaacaactgtgaactcatacttcgcaaagatatctcaaactctatagatccccaaaccaaattcaatctgtcactgccttacatccctgggatgtgccaccatccacctgtgcacacaaactagacaagacacctggagtcactctgtcgtcttcctttccctcacctcccacatccacttagcaagttatgttcgtttgactcagatctaccttctccccarttccattgttgctattttagccgatgagggtggagggtggcagagggtcttcatttctctccagggccactgcttccgaagtgcttgacttgcctctagtcatgtttctctccaagcccttctccactagcttccagcatggtctagctaaaagcagcactcaagttgttactcccttgtctgattctgacttgggcttccctatgcctaaggcagcagttctcaaagtgtagttcctagaccagcagtaccaacatcaccagggaactcagaaatgcagactctcgggctccaccttag

SEQ ID NO: 4411 - DNA, 601 bp, Human
atggccatgcctccctctcaccagccccttttgcttcccatacgaggaaaacaaaaagcttattttcagtaggagagaaagaggccaacacatagaaagaagagagagagaactgagaagatgatttgttcagcctcagggatgaattatgattcaaggctctcctcttcctctttgccagtcttgggttgggcttttgaccagttctggccagtgagatagaaagggatgtctgctgcttggagctttgcagaaagattttcctccctgataggggagatgtacataaggaagaaggtaytttttccctctatctgcttccttcttgcttgtgactatcttgagagatcattaacttgaacacatgacagttatcttgcacctaggtggggagacattgctaatacatccagagtatgtctgacagaaaggcagacatagcttgggtccctaatgatgtactgaactgctgaaccaacactggaatcagcttaattcagagctcctgttagaattgacaattaaatgtctttgttatttaagccaaagtgagtcctgtggtgtgctactttcgatcaaacacatactaattgtccaacaa

SEQ ID NO: 4412 - DNA, 601 bp, Human
tgaactatctatggccatgcctccctctcaccagccccttttgcttcccatacgaggaaaacaaaaagcttattttcagtaggagagaaagaggccaacacatagaaagaagagagagagaactgagaagatgatttgttcagcctcagggatgaattatgattcaaggctctcctcttcctctttgccagtcttgggttgggcttttgaccagttctggccagtgagatagaaagggatgtctgctgcttggagctttgcagaaagattttcctccctgataggggagatgtacataagsaagaaggtactttttccctctatctgcttccttcttgcttgtgactatcttgagagatcattaacttgaacacatgacagttatcttgcacctaggtggggagacattgctaatacatccagagtatgtctgacagaaaggcagacatagcttgggtccctaatgatgtactgaactgctgaaccaacactggaatcagcttaattcagagctcctgttagaattgacaattaaatgtctttgttatttaagccaaagtgagtcctgtggtgtgctactttcgatcaaacacatactaat

SEQ ID NO: 4413 - DNA, 601 bp, Human
atataatagttataagaaagcggtgatgataaagataaggccaaccttacttactatgattattcacagggtaggtccatgacccaagccaactggaattcttccctgacatcttacagatacttagagaaagaagagattttccttgaggctgctaatctggagctatgtgaggccatggagttctcttggtgcctgaactatctatggccatgcctccctctcaccagccccttttgcttcccatacgaggaaaacaaaaagcttattttcagtaggagagaaagaggccaacacataraaagaagagagagagaactgagaagatgatttgttcagcctcagggatgaattatgattcaaggctctcctcttcctctttgccagtcttgggttgggcttttgaccagttctggccagtgagatagaaagggatgtctgctgcttggagctttgcagaaagattttcctccctgataggggagatgtacataaggaagaaggtactttttccctctatctgcttccttcttgcttgtgactatcttgagagatcattaacttgaacacatgacagttatcttgcacctaggtggggaga

SEQ ID NO: 4414 - DNA, 601 bp, Human
aaggtaactaggaggaaggtgtgagctgagatcagttcaaagtgagaaacctgttgtcacctcctgcttctttgtctgcatcaagattgttgtgaacatcccagcctataccggcagggcaacgtgcccaagtgacatctctctgttgactcattcttaggggcccttgagtgctgtgttgggctggagaacttggagtttctagtagaggcagaataacattcattatgtggaaacaagattttgtgtcctggggaaaatgactgtctgctttgaggttgtccacagattgtttggggarttggagacctctgaagagtgctaaacttccagatatccaattaccactgtattgcatcaacaaaagagaacttggaggataaagtggttgtgtggagatgatggatatttctcaaccgtgaaaggaaccatgctttcaggagttatgaaaaatgaagcacgtttctcattagaaaagaatgatccatttccttcttatattgccaaaggtcgtcttttgccaattcaatgagagtatgaacatgggattcattacttgcaggaaaaaaggtagcaagtgtactctggaatcctcaagagt

SEQ ID NO: 4415 - DNA, 601 bp, Human
tgctaaacatccttcagtaatgcacagaacagacagcccccctccccccgcccacacacacacaaataattacctgggcccaaatgtcagcagtgccaaggacgaatgtgccaagggtccacaaccctggctgaatggttgtaacgattctgtcaacgggtctctttaaaaagtgtggagaaggccaagcctctggtggtaaacggcacacaggtgctgactaaagcaaggcctccagtcaccaagggcaaattgctgtggtaacttaaaagggaagaatagaaatggaccatgatgtctyacattctttaatttttttgcaaagaaacccagatgacaaatctgaaagatgagtgctgagataaggtaactaggaggaaggtgtgagctgagatcagttcaaagtgagaaacctgttgtcacctcctgcttctttgtctgcatcaagattgttgtgaacatcccagcctataccggcagggcaacgtgcccaagtgacatctctctgttgactcattcttaggggcccttgagtgctgtgttgggctggagaacttggagtttctagtagaggcagaataacattcattatgtggaaaca

SEQ ID NO: 4416 - DNA, 601 bp, Human
gccagaagggcaggaatggtgatttctggtggagatccagtgacataaagacattctgaggacatctgccctggagccttgttttcccatttaagcggtggttctcaataaaccaggagcgatttttgtctcccaggagacaattggcaatgtctggagacattttcagttggcacgagtaggggagtattactggaatatctagtgatagaggccaggattctgctaaacatccttcagtaatgcacagaacagacagcccccctccccccgcccacacacacacaaataattacctggkcccaaatgtcagcagtgccaaggacgaatgtgccaagggtccacaaccctggctgaatggttgtaacgattctgtcaacgggtctctttaaaaagtgtggagaaggccaagcctctggtggtaaacggcacacaggtgctgactaaagcaaggcctccagtcaccaagggcaaattgctgtggtaacttaaaagggaagaatagaaatggaccatgatgtcttacattctttaatttttttgcaaagaaacccagatgacaaatctgaaagatgagtgctgagataaggtaactaggagg

SEQ ID NO: 4417 - DNA, 601 bp, Human
tgcatattaatagcagcacaatttgcgattgtaaaagtgtggaaccaacccaaatgcccatcaatcaatgagtggataaagaagctgtggtatatatatacaatagactactactcatccataaaaaggaatgaattaatggcatttgcagcaacctggatgggatcggagaatactattctaagtgaagtaactcaggaacagaaaaccaaacatcatatgttctcactcataagtgggagctaagctatgaggacggaaaggcataagaatgatacaatggatttttgggacttggggraaagggtgggagagggtaaggaataaaaaactacaaatagggttcagtgtatactgctcgggtgatgggtgcaccaaaatctcacaaatgaccactgaagaacttactcatgtaaccaaataccacctgttcccccaaaacctacagaaataaagaatttttaaaaaagaagaagttgttactcatgggctaacagttttgagaaaaactgctgcctcttggctgctgctgtcatcaacaggaggataagggtcaatcttcaggagaagctgacttttctctgttataagagaagaaatc

SEQ ID NO: 4418 - DNA, 601 bp, Human
tgcacatgcatattaatagcagcacaatttgcgattgtaaaagtgtggaaccaacccaaatgcccatcaatcaatgagtggataaagaagctgtggtatatatatacaatagactactactcatccataaaaaggaatgaattaatggcatttgcagcaacctggatgggatcggagaatactattctaagtgaagtaactcaggaacagaaaaccaaacatcatatgttctcactcataagtgggagctaagctatgaggacggaaaggcataagaatgatacaatggatttttgggacytggggaaaagggtgggagagggtaaggaataaaaaactacaaatagggttcagtgtatactgctcgggtgatgggtgcaccaaaatctcacaaatgaccactgaagaacttactcatgtaaccaaataccacctgttcccccaaaacctacagaaataaagaatttttaaaaaagaagaagttgttactcatgggctaacagttttgagaaaaactgctgcctcttggctgctgctgtcatcaacaggaggataagggtcaatcttcaggagaagctgacttttctctgttataagagaa

SEQ ID NO: 4419 - DNA, 601 bp, Human
ttggcatttcagcaccttttaatgaagattggtatagttaggtcattttccagaaagacaagcttccttaggctatgccatctgggttacacgtgttgatgtgatatttacttatcaaaggtgactgcagggctgggtaggagttaggagacctgacttgaaggcccttcaatatgttgtgccttaaactggtgggcaccattgtacctgaaggtactgatggtatcctcaggagtgtaaacaatgtgggcatcctgccatgcactgagctgtggtatagggagtccaagtggggtagccyttttgggggctacacccaaacagaggagaggtgagccaatcagctcctgaaggttccagcctgtgtctttccaggggagcactgctcatctaggcaggaaatccagcagcccagcagcctttttactgagggtttctgcagtgaaacccttctcactctggtataagaactactatttgatccagcaatctcactactgggtatctacctagaggaaaaggagtcattatatgaaaaagatacttgcacatgcatattaatagcagcacaatttgcgattgtaaaagtgtggaaccaacc

SEQ ID NO: 4420 - DNA, 601 bp, Human
acatccatttggatcacagctcaacatgatttgcttgcatatgttgactgtatgttctgaaaaatgagttcagttctttagattaaaacatgacctttctattacatttgggattgcttccatgttggcatttcagcaccttttaatgaagattggtatagttaggtcattttccagaaagacaagcttccttaggctatgccatctgggttacacgtgttgatgtgatatttacttatcaaaggtgactgcagggctgggtaggagttaggagacctgacttgaaggcccttcaatatgytgtgccttaaactggtgggcaccattgtacctgaaggtactgatggtatcctcaggagtgtaaacaatgtgggcatcctgccatgcactgagctgtggtatagggagtccaagtggggtagcctttttgggggctacacccaaacagaggagaggtgagccaatcagctcctgaaggttccagcctgtgtctttccaggggagcactgctcatctaggcaggaaatccagcagcccagcagcctttttactgagggtttctgcagtgaaacccttctcactctggtataagaactactat

SEQ ID NO: 4421 - DNA, 601 bp, Human
gcccaccttagtagggtgctggaatgttacagagttgttcattgctgttgatacctcctttccaagatgcagtattacagtgacttacatgatgactaagtgtttggctatcactctaaaggggcagaaatatttgtatcatttaacaactaaaactaaaactagaaaaacatccatttggatcacagctcaacatgatttgcttgcatatgttgactgtatgttctgaaaaatgagttcagttctttagattaaaacatgacctttctattacatttgggattgcttccatgttggcatwtcagcaccttttaatgaagattggtatagttaggtcattttccagaaagacaagcttccttaggctatgccatctgggttacacgtgttgatgtgatatttacttatcaaaggtgactgcagggctgggtaggagttaggagacctgacttgaaggcccttcaatatgttgtgccttaaactggtgggcaccattgtacctgaaggtactgatggtatcctcaggagtgtaaacaatgtgggcatcctgccatgcactgagctgtggtatagggagtccaagtggggtagcctttttggg

SEQ ID NO: 4422 - DNA, 601 bp, Human
agagctggtggtgagacatattctagcacaccactgactcttttgttctaccctccactctagagtcttctatcagatcttttaacagatacattatcatacttttttattagtctatttccttccctagactgtaagacttttggaggctaggttatgtcatgttcactctcatatccccagcacctagcacaatgcttgacacattgtaggtacttggtaaatgttatcttcttttccatgggaggaagaatcttcttcctttgtatgttacagaatacactgaatgccttttctttgygtcctggtcttgctcccagtttgtattaatgtcagagtcagtggcagtagtagggacagaagaatggaacaggaaacttatctggatagaaatcttgagctgagaatagtgtcaagctttccaaaatgatgaagcagagagaatgaaaagaggaacagtaaatttaaccaaggtgtctgggagggctcaatcagacctcagttggagaaataacaggaatcacaaatgaaagtgaagtcctaagaccttcgggtgtgaaacagtttgagctaaatagagtttggggctcttagaatttaa

SEQ ID NO: 4423 - DNA, 601 bp, Human
aagttgaggttgcagtgagccgtggttgcactactacactccagcctgggtgacagagtgagaccctgtctcaaaaagaaagaaagaaaaagaaagaaaagaaaagaaagaaagaaagaaagaaagaaagaaagaaaagctcagttcaactcttagaatgatagtcttttacagaaacactaaatgagacctgagacttgtccggtgaccagagaagccaagaaccccttgcatagctgtaggatcaataaatattctcgatgatgagaaaatagaaagtaaaatgaaaaatgaagtcacygctatttgcaaggcaaaacagacagccatctcccagtgagcaaagtgtgtatgtaggagaggcactattgtcaaattctgctcccaatattccttctgatgctaatagaatcatgttttctgcctctcatttgtaaaatgggactaatacctgcccaccctgaagaatctcaggaagattaaataagacaatgtcacagcgctggacagggaggtttcattatgatgactcagggctggcaggggaggaagtggcccttctgcccttcaaaggctgttaggaagcttcttccttctcctt

SEQ ID NO: 4424 - DNA, 601 bp, Human
aatgagaccctgtctctacaaaaaattttaaacatttagcttggcatggtggtgtgtgccagtagtcccagctacttgggaggctgaggctgaagcaggagaatcacttgaggccaggaagttgaggttgcagtgagccgtggttgcactactacactccagcctgggtgacagagtgagaccctgtctcaaaaagaaagaaagaaaaagaaagaaaagaaaagaaagaaagaaagaaagaaagaaagaaagaaaagctcagttcaactcttagaatgatagtcttttacagaaacactaratgagacctgagacttgtccggtgaccagagaagccaagaaccccttgcatagctgtaggatcaataaatattctcgatgatgagaaaatagaaagtaaaatgaaaaatgaagtcactgctatttgcaaggcaaaacagacagccatctcccagtgagcaaagtgtgtatgtaggagaggcactattgtcaaattctgctcccaatattccttctgatgctaatagaatcatgttttctgcctctcatttgtaaaatgggactaatacctgcccaccctgaagaatctcaggaagattaa

SEQ ID NO: 4425 - DNA, 601 bp, Human
cttcagtcttggcctccataagtattaggattacaggcatgagccactgcacttgaccttaacaattgaccttaacaattttttaagtgtgtaataaagtatagggtacagtttgctgtactccagatctctagaacgaattcatcttgcgtaaccaaaactttgtaccagttgaacagtgcttcatttcccctccctctggtccctggtaagtacagttctattctttacttctatgagtttgactattttaggtacctcatgtaagtagaatcatgcagtatttatttttctcccttayttcacttagcataatgttccccaggtttgttcaagttgtcacaaatggcagaatttccttcttttttgaggctgaataatattccattgtaaacttgccttgtatagatcttaagaatactacagatttaaggaaactgagtccagtttggggaaggttcttctttgaggtcacataagttctgcctcctctctcacagacatctacctttgaaccaggcacgaggctgttttttcctccgtatcttttccaaggctgttttcccatctgaaagatggtaataatagtacccacctcgta

SEQ ID NO: 4426 - DNA, 601 bp, Human
ttactgaggtataattgctgtaaaatatattgtatatttaattatacaatttggtgaatttggacataggcatacactcataatatcatcaccaccatcaaggtaataagtatttcatcagctatgaacgtttcctgtgtccccgtgtgtgtgtgtgtgtgtgtgtgtgtgtgtgtgtgtgtgtgagttaagaacatttaacttgacatcaacccattaaacaaataatactttatatttaaaaatttttgtagcaagagggactcactatgttgcccaggctggtcttgaactcctgggstcaagcaatcctcccgcctcatgtgatccttcagtcttggcctccataagtattaggattacaggcatgagccactgcacttgaccttaacaattgaccttaacaattttttaagtgtgtaataaagtatagggtacagtttgctgtactccagatctctagaacgaattcatcttgcgtaaccaaaactttgtaccagttgaacagtgcttcatttcccctccctctggtccctggtaagtacagttctattctttacttctatgagtttgactattttaggtacctcatgtaagtaga

SEQ ID NO: 4427 - DNA, 601 bp, Human
ggagagagcctcagacacacctgattctcctcggtttaggctgttaccattgccactgttggttaatggcaccttgcgccaatattggtgattctgattaagcttgccttgtatagtttttttttcaaaattcctgaaaaatattttaaacatctttactgaggtataattgctgtaaaatatattgtatatttaattatacaatttggtgaatttggacataggcatacactcataatatcatcaccaccatcaaggtaataagtatttcatcagctatgaacgtttcctgtgtccccgtgtgtgtgtgtgtgtgtgtgtgtgtgtgtgtgtgtgtgtgagttaagaacatttaacttgacatcaacccattaaacaaataatactttatatttaaaaatttttgtagcaagagggactcactatgttgcccaggctggtcttgaactcctgggctcaagcaatcctcccgcctcatgtgatccttcagtcttggcctccataagtattaggattacaggcatgagccactgcacttgaccttaacaattgaccttaacaattttttaagtgtgtaataaagtatagggtacagtttgct

SEQ ID NO: 4428 - DNA, 601 bp, Human
tggagagagcctcagacacacctgattctcctcggtttaggctgttaccattgccactgttggttaatggcaccttgcgccaatattggtgattctgattaagcttgccttgtatagtttttttttcaaaattcctgaaaaatattttaaacatctttactgaggtataattgctgtaaaatatattgtatatttaattatacaatttggtgaatttggacataggcatacactcataatatcatcaccaccatcaaggtaataagtatttcatcagctatgaacgtttcctgtgtccccstgtgtgtgtgtgtgtgtgtgtgtgtgtgtgtgtgtgtgtgagttaagaacatttaacttgacatcaacccattaaacaaataatactttatatttaaaaatttttgtagcaagagggactcactatgttgcccaggctggtcttgaactcctgggctcaagcaatcctcccgcctcatgtgatccttcagtcttggcctccataagtattaggattacaggcatgagccactgcacttgaccttaacaattgaccttaacaattttttaagtgtgtaataaagtatagggtacagtttgc

SEQ ID NO: 4429 - DNA, 601 bp, Human
tgacgatgggcctcaggcctgtttccctatccagagatttagtttttgaaacctgaagcaactgagcagaacttctgcatacagtgagaatgcaagtcagatacagaatgggctgcggggtactccaggatggggtctgacaagcttgtgaggctttaggagaccacacggatattccatttgttttcaactaggagacattgtagagccagggcaacattccttgttttgttttctttcaatttgtttattttttgacagtgcttgcactgacactcaggagacagataaaaacagcacragatattaaacgtcaataataatgattttggaggtctgcgctttgagcccacaggaatcctggtttgaatgaggatctgcctcttagcagctgtgtgaacttgggccattaacctctaagctaccatttcctcatctgtaaaatgggagcagtctctgtgttgcaaggcttgaggtttacgtgaaataacttttcaaatgccagaaaacagggagctagataaatgttagtccttcccctgtctctttgggtcatttcttggctttttgccttgtgataagatttcataaaagtgatatc

SEQ ID NO: 4430 - DNA, 601 bp, Human
ccaaagtgctgggattacaggtgtgagccacggcgcccggcatgtccatatattttccatccttcagtgaaggctggtttaagtgctactggcagtagcaccgcagttcaactctccctgctttcatatcctttggcacccagtggaagtgaacagtcaaccacatgcagctcagtgggtatgttgcctttctctgcatggcatccttattctccttatttccccttcccccattgtgtggcctcactggggctgtcagtcatgaggcttgagcccctttgtcctgcccttggtcaccaaygtaggcacgtgtcctgtgactctggcaatcaggattggttcaggagtgaagatgtaatccaagcaggattagagtcaattagagtctttcccttggtggatacatagatactgagagagatacacgtctgcctcctgctgagtctgctacagtgaaagtgcgtgagtctagggctcttagtgcccattttgtccactacataaagggagagagagaaagaatcacattgtacaaatcctcagacacagcagcgcctgtgtccttgggcttccccgtttcattagctagcaaacttccttg

SEQ ID NO: 4431 - DNA, 601 bp, Human
ttcaagtgattttcatgcctcagcctccccatagctgggattataggtgcacgccaccatgcctggctaattttttgtatttttagtagagatggggttttgccatgtttcccaggctggtcttgaactcctgagctcaggcaatctgcctgccttggcctcccaaagtgctgggattacaggtgtgagccacggcgcccggcatgtccatatattttccatccttcagtgaaggctggtttaagtgctactggcagtagcaccgcagttcaactctccctgctttcatatcctttggcayccagtggaagtgaacagtcaaccacatgcagctcagtgggtatgttgcctttctctgcatggcatccttattctccttatttccccttcccccattgtgtggcctcactggggctgtcagtcatgaggcttgagcccctttgtcctgcccttggtcaccaatgtaggcacgtgtcctgtgactctggcaatcaggattggttcaggagtgaagatgtaatccaagcaggattagagtcaattagagtctttcccttggtggatacatagatactgagagagatacacgtctgcctcctgc

SEQ ID NO: 4432 - DNA, 601 bp, Human
atacgcattcctaaatgatctctggctaaaatcggtagcaaactggaggaccaaatagtcatcctaaccagggaccagctgtcacttcacacactggtacatgcggaaatcagctggggagactctggccccagagaggtggctggtactccttggggccagctggccttggatgaccaggagaatgggcccctctgttctcaaggacaatcatcctggccagctctgcaatgagagattttcatatcaaccccacctttgtgtgtctgcctctgaaacaaagaataatactgtaagccaktgtactggagtgcttgttctccccctttgtcatgagacacagctatgtctaaggaataggtcagaggctgagggttctaggaccttattacaggttcatatggtgacttggatctttgccatccatacaatgagagatacatatttggtttgttggagatactgtaggaaccagtaaaagcacagttttggttttagtgctccttgggaaggtaaagtcctgtttatatagtgtattgagctgtttcccatacttcagtcattggcacaatacatgcactattgcatccacagttaccta

SEQ ID NO: 4433 - DNA, 601 bp, Human; identical to SEQ ID NO: 2921

SEQ ID NO: 4434 - DNA, 601 bp, Human; identical to SEQ ID NO: 2922

SEQ ID NO: 4435 - DNA, 601 bp, Human; identical to SEQ ID NO: 2923

SEQ ID NO: 4436 - DNA, 601 bp, Human; identical to SEQ ID NO: 2924

SEQ ID NO: 4437 - DNA, 601 bp, Human; identical to SEQ ID NO: 2925

SEQ ID NO: 4438 - DNA, 601 bp, Human; identical to SEQ ID NO: 2926

SEQ ID NO: 4439 - DNA, 601 bp, Human; identical to SEQ ID NO: 2927

SEQ ID NO: 4440 - DNA, 601 bp, Human; identical to SEQ ID NO: 2928

SEQ ID NO: 4441 - DNA, 601 bp, Human; identical to SEQ ID NO: 2929

SEQ ID NO: 4442 - DNA, 601 bp, Human; identical to SEQ ID NO: 2930

SEQ ID NO: 4443 - DNA, 601 bp, Human; identical to SEQ ID NO: 2931

SEQ ID NO: 4444 - DNA, 601 bp, Human; identical to SEQ ID NO: 2932

SEQ ID NO: 4445 - DNA, 601 bp, Human; identical to SEQ ID NO: 2933

SEQ ID NO: 4446 - DNA, 601 bp, Human; identical to SEQ ID NO: 2934

SEQ ID NO: 4447 - DNA, 601 bp, Human; identical to SEQ ID NO: 2935

SEQ ID NO: 4448 - DNA, 601 bp, Human; identical to SEQ ID NO: 2936

SEQ ID NO: 4449 - DNA, 601 bp, Human; identical to SEQ ID NO: 2937

SEQ ID NO: 4450 - DNA, 601 bp, Human; identical to SEQ ID NO: 2938

SEQ ID NO: 4451 - DNA, 601 bp, Human; identical to SEQ ID NO: 2939

SEQ ID NO: 4452 - DNA, 601 bp, Human; identical to SEQ ID NO: 2940

SEQ ID NO: 4453 - DNA, 601 bp, Human; identical to SEQ ID NO: 2941

SEQ ID NO: 4454 - DNA, 601 bp, Human; identical to SEQ ID NO: 2942

SEQ ID NO: 4455 - DNA, 601 bp, Human; identical to SEQ ID NO: 2943

SEQ ID NO: 4456 - DNA, 601 bp, Human; identical to SEQ ID NO: 2944

SEQ ID NO: 4457 - DNA, 601 bp, Human; identical to SEQ ID NO: 2945

SEQ ID NO: 4458 - DNA, 601 bp, Human; identical to SEQ ID NO: 2946

SEQ ID NO: 4459 - DNA, 601 bp, Human; identical to SEQ ID NO: 2947

SEQ ID NO: 4460 - DNA, 601 bp, Human; identical to SEQ ID NO: 2948

SEQ ID NO: 4461 - DNA, 601 bp, Human; identical to SEQ ID NO: 2949

SEQ ID NO: 4462 - DNA, 601 bp, Human; identical to SEQ ID NO: 2950

SEQ ID NO: 4463 - DNA, 601 bp, Human; identical to SEQ ID NO: 2951

SEQ ID NO: 4464 - DNA, 601 bp, Human; identical to SEQ ID NO: 2952

SEQ ID NO: 4465 - DNA, 601 bp, Human; identical to SEQ ID NO: 2953

SEQ ID NO: 4466 - DNA, 601 bp, Human; identical to SEQ ID NO: 2954

SEQ ID NO: 4467 - DNA, 601 bp, Human; identical to SEQ ID NO: 2955

SEQ ID NO: 4468 - DNA, 601 bp, Human
ctaacaatcactgtgctctcccttccccaggcacatagattctctctttgaacaatgcagctgctgcaggggatggggaagggatggcactggcaattcaagactgcctttcctacttcttcagtgcctctttcaccaatatgaagttaaaaccaggtactgtggtcacttacctgatttttggttcttatgatggtgcttttttttctgtgaatagttgttcaatttggtgttccttcagggaggatgattgatggaggctactatttggccatcttgctctgtctccatccatactaatttttttttttttttttttttttgagacagagtctcgctctgtcgcccaggctggagtgcagtggcacaatcttggctcactgcaagctccgcctcctgggttcatgccattctcctgcctcatccatactaattttttttaaatctgcctgggccctgtagctagagtaaggtcagagtctggggcagaactaaacatggaagcagagtctgctgctccagctcagagactagagggtcagagagttgaatgggtgctgacattgtggatccccagtgagaacttgctcctgcaacctta

SEQ ID NO: 4469 - DNA, 601 bp, Human
cagagagttgaatgggtgctgacattgtggatccccagtgagaacttgctcctgcaaccttacaagaaaaactgcttttctacaggagaatcaccacgttacattagcagtttatttatttattttttttggaatggagtcttgctctgtcttccaggctgaagtgcagtggcataatctcagctcactgcaacctccgcctctcaggttcaagcaattctcctgcctcagcctccaggatagctgggattataggcacgtgccaccacgcccagctaatttttgtatttttagtagagayggggtttcaccatgttggccaggctgttctctttctgatcacttattgataatcttgacctaaatttagaagtaacttgggtatcactagatacatatgggcaactggaatgcattctaaactgagtaattagaattgaaataatctgctcaaaagtaggaacactgctttccattttatatttctttatttactttgggggtttctttagtgactcttccaggacttgtatgtgggttcattatttacttgacagttaaaaagttggtcagaaaagttatgtctgcctcctagtcataa

SEQ ID NO: 4470 - DNA, 601 bp, Human
tgttgctgtaacggaatactcaagaccgagtaatttatagagaaaagaaatttatttctcacatttctggaggctggaaagtccaagaggatggtaccagcatctgataagggccttcttgctatgttatcctatggtgggaggtaagcaggcaagtgagtgtgtgtaaaaagagagagcatgggggccaggctcacttaataaaaacctagtcttgcaataacaaacccactcccatgacaatagcattaatccattcatgagagtgcagtccccatgacctaatcacctcttaaaggtkccacctcttaatactgtcacaatggcaattaaatctcaatgagagttttggagtgaacattcaaaccatagcatgtggctagtccaaatggagatatactataagtgtaaaacccatgctgaattttgaagacttagtatgacaaaaagtatgtgaactatctcaataatttttgaatattagttacatgttgaaataatattttggatatattaggttaaataaaatatagtattacaatttattttacctggtgctttttacttttaaaaagttacacatggtttgcattatctttct

SEQ ID NO: 4471 - DNA, 601 bp, Human
ataagggccttcttgctatgttatcctatggtgggaggtaagcaggcaagtgagtgtgtgtaaaaagagagagcatgggggccaggctcacttaataaaaacctagtcttgcaataacaaacccactcccatgacaatagcattaatccattcatgagagtgcagtccccatgacctaatcacctcttaaaggtgccacctcttaatactgtcacaatggcaattaaatctcaatgagagttttggagtgaacattcaaaccatagcatgtggctagtccaaatggagatatactataagygtaaaacccatgctgaattttgaagacttagtatgacaaaaagtatgtgaactatctcaataatttttgaatattagttacatgttgaaataatattttggatatattaggttaaataaaatatagtattacaatttattttacctggtgctttttacttttaaaaagttacacatggtttgcattatctttctgttagatagtgctgcactgaactacaagcttattgaagacaagagttgtatccgttttacctttttttcccccacaacatccaacagtgtctgggatatgagatat

SEQ ID NO: 4472 - DNA, 601 bp, Human
agtgtgtgtaaaaagagagagcatgggggccaggctcacttaataaaaacctagtcttgcaataacaaacccactcccatgacaatagcattaatccattcatgagagtgcagtccccatgacctaatcacctcttaaaggtgccacctcttaatactgtcacaatggcaattaaatctcaatgagagttttggagtgaacattcaaaccatagcatgtggctagtccaaatggagatatactataagtgtaaaacccatgctgaattttgaagacttagtatgacaaaaagtatgtgaastatctcaataatttttgaatattagttacatgttgaaataatattttggatatattaggttaaataaaatatagtattacaatttattttacctggtgctttttacttttaaaaagttacacatggtttgcattatctttctgttagatagtgctgcactgaactacaagcttattgaagacaagagttgtatccgttttacctttttttcccccacaacatccaacagtgtctgggatatgagatatgcaacattaatgtaggtttaatgaacaaactgtgtctccatttatatgtagt

SEQ ID NO: 4473 - DNA, 601 bp, Human
ggagttatggacggatgcatactaggctgttccattggctaaggagcggcaggggaggtgacacaggggaaggggaagatagatactctcatcaaaagaccatagaattagcaaaaacttgtccacaaaccaacttatatactattccatgtgcataaaatcacatattatgtgtatgtgcatagaaagatattacaacagtggttaccaaactgtagtgattctttctctgtatggtggctgaatctcaggtgacttttactttctttgttacacattttgaatttttctccagatgagyatgtatcatctgtatactcagcaaataatctgatctagcattttttcatttatgggtaacatcaggacaaagattaagaacccaaccaaaaattgtctatattatttgcattctgttgaatgctaatttttaaaataaaactgtcaaattattataaatataaaagtaatcagaagtatactgccagtacatgcattttggttatcacagaatatttaaaatgtacatgtttataggcctagtatcctcctccctgggttaggctccaattgattttctaaatgacacagggaagtagct

SEQ ID NO: 4474 - DNA, 601 bp, Human
attcatcttgagcatgtgctactttcagtcaggaaaaaaaagaagccctcctttatgaaatgatatggtaattattgcttactacttagagtctttgtagcagttgattttcaggcaattagaataaccacatcacttttatctgataattagagctaatttgcaagtactgatgataggctcattcactgaataaacaaaatgcagagcacaaagtttgtttctacagccatatatgtgaagttcctcttcaggtcttttgcaccacagggctgctgaattagtgcagagtttaattcaraattttcactcttgttcattgctaagctcatggctttattctgtaatggtattgtgtactttgggaagaatgccgttgggggaaattctgaccccttctcccaatctcagctgcgctgtcagaagctgtttgccctgacaggcctgggagcttggaagctagctatagtaagagtgatgcttggccgggcgcagtggctcacgcctgtaatcccagcactttgggaggccgaggcgggtggatcatgaggtcaggagatcgagaccatcctggctaacaaggtgaaaccccgtctctact

SEQ ID NO: 4475 - DNA, 601 bp, Human
catatatgtgaagttcctcttcaggtcttttgcaccacagggctgctgaattagtgcagagtttaattcagaattttcactcttgttcattgctaagctcatggctttattctgtaatggtattgtgtactttgggaagaatgccgttgggggaaattctgaccccttctcccaatctcagctgcgctgtcagaagctgtttgccctgacaggcctgggagcttggaagctagctatagtaagagtgatgcttggccgggcgcagtggctcacgcctgtaatcccagcactttgggaggcygaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggcgtgaacccgggaagcggagcttgcagtgagccgagattgcgccactgcagtccgcagtccggcctgggcgacagagcgagactccatctcaaaaaaaaaaaaaaaaaaaaaaaaaaagagtgatgcttcacattattgagtgtccacgaa

SEQ ID NO: 4476 - DNA, 601 bp, Human
aaatacaaaaaattagccgggcgcggtggcgggcacctgtagtcccagctactcgggaggctgaggcaggagaatggcgtgaacccgggaagcggagcttgcagtgagccgagattgcgccactgcagtccgcagtccggcctgggcgacagagcgagactccatctcaaaaaaaaaaaaaaaaaaaaaaaaaaagagtgatgcttcacattattgagtgtccacgaaatgcttatgacaatgccagttgttttgcatagattatctctaaattatattaaaacccctgcaaggtaggtatttttatttccattttaatgatgaggaaacagaagcttaaggtgacatggctagtaaattacaaaatcaggcctagggtctgcttgcttctgaaagcatctacaattttcattctgccaggctgttaaactgccaaaatttgccttagtttattcttccagtcctgctttctcctatcaactcttatgtctttccagccaaaaacccaattggctatcatctacatttctgtctttaaaaatcatccctaagggccaggcacccctgcaatcccagtactttgggaggcctaggtgggaag

SEQ ID NO: 4477 - DNA, 601 bp, Human
tctctaaaaatacttaaaaattagctggatgtggtggcacatgcctatagttccagctactcaggaggctgaggcaggaggattgcttgagcccaggtcatcaaggctgcagtgagctatatttgtgccactgaactccagcctggcagcctgggtaacacagcgaggctcttttcacccccatccaacaacaacaacaacgacaacagaaaaaacagaaaaaagtcccctgaagtatacacacccctaccccgcctcttacgcctctggtttctgtctaaatatttcagccccatcctcraattcatacctttcttctccccaaccataccttcctagtacactctaggattctattacttacacagacctctcattctttaacttttcccttaatatttccctacactcttgccaaaactcactcttggctttattctaaattacaagttcctgagccacattcttcactcgtcgtcatttctttcaattttctggctctcagagtgaggagcaggagccagagaatttcctgcttcccaccagcacatccagtctattgcttgttcattgcctctcaagaacttgtgttgtgaattcc

SEQ ID NO: 4478 - DNA, 601 bp, Human
ttggttaatttagcgatccaataacatcatcaaagaccttggatcttcccatttccccccgccccctcacctaaccccctgttgtcctattaggacagcttcagtctctagctagccaccagctgctgcatttccaggggccgtgcagagaccagactcagcagaaaaattggtttgattggttttaccacaaatatcaacccacaattagaacctcttctggcttcattgcagtctcattacaaatttgctcctacttgtgtttctcactggaactattctgagctttttccaattccartcttatcaagccccacctacttgtttctttttttgtttcaaaagtgtcttccatatctgttcctattgcccctaccctaacttgcacccaacaattgtttaccttgcccccatccattcattcccctgtccctttcctgccaggttactgttcctgaagctggcgctgagtgtggcacttttttgttcactctgcctctagtgggtccctgaagttcagatggcttattgtagcatttgggatccattaagacctggccctggactacattctcagttttaatttccattatttctattt

SEQ ID NO: 4479 - DNA, 601 bp, Human
taagtgtataatctcagagggctagttaggaatttgctgaagagtggtagagaaagccatacttttaactatctttaagcctcctcatgctttctaagaaattaatcttctttttctgtttcccgatctcttcccttctgtctgtttcacttggtactagatcagctcttatcattcctcctgcagttgaatccacattctgtttccaggattttacgaatctcaaaaatttgaaagctactgaccattctggaaaataatcagttatgggtgcacttacatatgtaaactttaatatatyacttcacattttaagtggaccttaccattgtttttgcctccttttgtgatataaatgtggggtaacctgatctgctgagggagtagctgtgatccaaacatgtgagttgagtgcccacaaggcagggctgaagccttggaggacctcgcatccatctttagctacaagtcaactggcttctcaaaaacagaacagcctcaacaatttgttgattcaaaacttttaaatatcaatatttttcagattaatacttttatttgtctaacatttaaatttatatatttttcttagctaaatgtt

SEQ ID NO: 4480 - DNA, 601 bp, Human
atctggccacactgtgcccacattcatgcatggcagtaggctgaatttaaacagttgtctcctttggagggggcatttgctttctagtttctacaagtcactataatgccctgttgccctcccattcaaacctcacttcaatcatttagggtacctacctgactcctggaagcatttgagtttgtgatccctgatctagactaggatactcattttgtgaatgaagaagtgacattcgaagtagtaagtcaattaggcagcaccaagattacaacttgttttcctgagacagagccctttyttggatcctggcttcatggccagattatcattactgaagaataacagaacagcaagggaatagtaattagaaatgccaaaatgatgcacacttttaaataaatggatatggttttagtgagggtctgctatatattttatatttatgccatattagccagacttaaaatatttcaaacatcagactatgtattgtatgtttcagttttgaaaacatgggtcactgtaaactgaatgaatgaatttcattttcttatgttggagaagttgattggagggtgcatttttgaatgaatttcag

SEQ ID NO: 4481 - DNA, 601 bp, Human
atgtagtattatttattcctcaccctccttccttctcattctgtgtccattatatcactctgcatgcctttgcctacccatagcttagctcccacctataagtgagaacatacagtatttgattttccattcctgagttacttcacttggaataatggcctctggctccatccaagttgctgcaaaagatgttatttcattcttttttaatggctgagtagtattccatggtgtatatatatcacattttctttaaccactcattgattgatgggaacttagcttggttccatatctttgyaattgtgaattgtgctgcaataaacatttgtgtgcagctgtctttttgatataataacttcttttcctttaggtagatagccagtagtgagattgctggatcggatggtagatcaatttttagttctttaagaaatctctgtactgttttccatacagggtgtactaatttatgttcccaccagcagtgtataagtgttcccctttcaccatattgacaccaacatttattgtcttttgacttttcaataatagtaattcttgcaggagtaaggtgatatctcattgaatcacttatttt

SEQ ID NO: 4482 - DNA, 601 bp, Human
tctggctccatccaagttgctgcaaaagatgttatttcattcttttttaatggctgagtagtattccatggtgtatatatatcacattttctttaaccactcattgattgatgggaacttagcttggttccatatctttgcaattgtgaattgtgctgcaataaacatttgtgtgcagctgtctttttgatataataacttcttttcctttaggtagatagccagtagtgagattgctggatcggatggtagatcaatttttagttctttaagaaatctctgtactgttttccatacaggktgtactaatttatgttcccaccagcagtgtataagtgttcccctttcaccatattgacaccaacatttattgtcttttgacttttcaataatagtaattcttgcaggagtaaggtgatatctcattgaatcacttattttttgtgaagtgtaatttctaggatggattatatagttcaaacccaaggggataaattatatcctattgagtgaaagaactaactaggggacttgcaaaaaataactataataaacaatgaagagtagaaattcttgttttttgaatgaacctacaaaatgc

SEQ ID NO: 4483 - DNA, 601 bp, Human
caccaacatttattgtcttttgacttttcaataatagtaattcttgcaggagtaaggtgatatctcattgaatcacttattttttgtgaagtgtaatttctaggatggattatatagttcaaacccaaggggataaattatatcctattgagtgaaagaactaactaggggacttgcaaaaaataactataataaacaatgaagagtagaaattcttgttttttgaatgaacctacaaaatgcgtaaaacaaaatatttgatgaaaacattttcagattatgatggctgttcttattacttttcattcattcattcattcagtaattatttatagaagtttgctaggtgtagggcaccatactgagcattggggaaacgtctctgcctttgagttgcttttgacctagttggggagataaaaaaggaagacatggagtattctacataaggcaagcccatgttaagttaatgttttggtggcttagagaaagagacaccacttctcctagcttgactttctgagggatgaggaccaggaatttgaactagatctgaggggatgagtaggatttgaaataccagaggaatggtagaagtttg

SEQ ID NO: 4484 - DNA, 601 bp, Human
gatgatcatttggtttttgtccattttcttaatttggttattacattggttaatttttatattttgaactattctttcatttcatttataaatccctcttgatcatggtgtgatcaacgtgtgcttgaatttggtttgctattattttgtttagggtttttgcatcagtattcatcagacatattggtctacagttttttttgtgtgtctttttctggttttggtattaggataatgctagcctcatagaatgagtttggaattgttctctcttaatttttttggcagaatttgaggaggattggtaatcattattcattaagtatttgatacaattattcagagaagccacatggtcctgggattttctcttttggaaggttattttttttttttattactgcttcaatctcctcactagttatagatctgtttccgtcttgataggttgtatgtttctaggaatttgtctttttttagattatccaatttgttggcatataattgctcatagtagtatattttttattgctgtgacatcagtggtaatatctcttttttcttttctaattttagccatagagtcttctctcttttttct

SEQ ID NO: 4485 - DNA, 601 bp, Human
cctcccagtttatgttattgatgacacaattatctgccgtcatatttcatatccatgaacatagatttatcattactttttatgctttattaaatagattttaaaaatctataccagatttataagtgttaatttttctagcaggctttgatatggttggctttgcacttgcctggggtgcaggatccttttaactggtttctagatttctctcaggggcattggtccattggtcatttttaagttcatatttttgtggttgaaggggagtccagggcttcctattttgccattttaatgwtatcactcctggttctaggttttatatatggtgatattgaagatcagtttgtgattgtaagtgctgagactaaatgagactgttatcatcatcctttgattgtgaccactttattaggactatcgcttttcccttaagcctttttgtttcccagatgaatcccattaattgacttttggggtttaccttttgggtaaatcttcttactccaagactctgtgtctatgtaccatgctgattaatattatactagaaagtggtttgctgttttatttgactacagcttaactaaaaatcttt

SEQ ID NO: 4486 - DNA, 601 bp, Human
aaaacaatattttgtgtgaacattaaacttttcttcctttggtatgaatactctggggatttggaataagcatgattattataattcacacctcttttaaaatcttaatgttgtttgtggctagttgagcatgtgagactataaagtagtgaactctgcgctctttatggccacagcttttgttcctaattcttcttggcctgtttcaacctgtgtgtcatgactcccaagctgaactaggtaaaagaatgtgaatggatcatcatttctagaaaagcatctcagaacatagtccatttakataattggtttaaaaagtagccttttatttcatagaaagcagcacagtctaatacaaggaactggtgtgctacacatgaggacatgctctgccttaataattctctggctgtcttaggtagaaaagtttggggttgaaagaaaagtgatgtctgtttcaaaggaatgaaaattcttagggtgtaacaatagcttattagtgaagagcctaactttggctcaagcatcagactgcttgagttcaaatacaaattcctccatttaccatcaatgtgagcttggtcaagttattcctccaata

SEQ ID NO: 4487 - DNA, 601 bp, Human
atataacacattctctcataaggcacattttttccacacttttattttgtttttacgatttaaagtagtcacttaaaaatcagaaagcaaaagttttttgacctagatttagttggtttataataagtcttgttggttatggtgagtaatcagttaatacctgttaagctaataatgaggtaagaaatatattgactttatttcttggtgtggaaatgacttattcattcaacagatacttattaagtgggccaggtactacttgttaatacaaatggtgaataaagtggcttacactctwatgagagagacagacagctccgagttaacaaatggataaaaatatacttacatatgtgatatgcatagtgtaagataacgagggtggtcacggtggtggtaacctactccaaatactgtactcagagcatatgtgtgataaatgaagttgttgcagtatgtttaaaacactggagccaaaattttgagtgctcatttgaaaacactttatggtaaaacagtggtgcttagaatgatgcattaaaaaatatatatgactatcttgctgaaggtaaactttttttacaacttacctgacatg

SEQ ID NO: 4488 - DNA, 601 bp, Human
tagtcacttaaaaatcagaaagcaaaagttttttgacctagatttagttggtttataataagtcttgttggttatggtgagtaatcagttaatacctgttaagctaataatgaggtaagaaatatattgactttatttcttggtgtggaaatgacttattcattcaacagatacttattaagtgggccaggtactacttgttaatacaaatggtgaataaagtggcttacactctaatgagagagacagacagctccgagttaacaaatggataaaaatatacttacatatgtgatatgcrtagtgtaagataacgagggtggtcacggtggtggtaacctactccaaatactgtactcagagcatatgtgtgataaatgaagttgttgcagtatgtttaaaacactggagccaaaattttgagtgctcatttgaaaacactttatggtaaaacagtggtgcttagaatgatgcattaaaaaatatatatgactatcttgctgaaggtaaactttttttacaacttacctgacatgatctttctaaattacaatagattgtatatgttggaaaacatttttgtaaaatgtacaataagtct

SEQ ID NO: 4489 - DNA, 601 bp, Human
tagatttagttggtttataataagtcttgttggttatggtgagtaatcagttaatacctgttaagctaataatgaggtaagaaatatattgactttatttcttggtgtggaaatgacttattcattcaacagatacttattaagtgggccaggtactacttgttaatacaaatggtgaataaagtggcttacactctaatgagagagacagacagctccgagttaacaaatggataaaaatatacttacatatgtgatatgcatagtgtaagataacgagggtggtcacggtggtggtaamctactccaaatactgtactcagagcatatgtgtgataaatgaagttgttgcagtatgtttaaaacactggagccaaaattttgagtgctcatttgaaaacactttatggtaaaacagtggtgcttagaatgatgcattaaaaaatatatatgactatcttgctgaaggtaaactttttttacaacttacctgacatgatctttctaaattacaatagattgtatatgttggaaaacatttttgtaaaatgtacaataagtctgacatgtgagtgaaaaaaaccttttttcttaactttca

SEQ ID NO: 4490 - DNA, 601 bp, Human
tattatatactgttcttgattgtgtgggaatttcaaagataaatgagattctatctttgccacttaagacttacaattattggctcccaggcaagatggctgaataggaacagctctggtctgcagctcccagtgagaccaacacagaaggcgggtgatttttgcatttccaactgaagcacccggttcatctcactgggattggttagacagtgggtgcagcccatggagggcgagcagaagcagggtggggcattgcctcacccgggaagtgcaaggggttggggaactcccttcctakccaagggaagccaagagggaccctgccatgagggacagtgctatcaggaccagatactacgcttttcccacagtcttcgcaacctacagaccaggagattccctcaggtgcctacaccacaaaggccctgggtttcaagcacaaaactgggcggctgtttgggcagacatcgaactagctgcaggagttttatttcatacctcagtggcacctggaacaccagcgagacagaaccgttcactcccctggaataggggctgaagccagggagccaagtggtcttgctcaatggatcccacc

SEQ ID NO: 4491 - DNA, 601 bp, Human
ttggctcccaggcaagatggctgaataggaacagctctggtctgcagctcccagtgagaccaacacagaaggcgggtgatttttgcatttccaactgaagcacccggttcatctcactgggattggttagacagtgggtgcagcccatggagggcgagcagaagcagggtggggcattgcctcacccgggaagtgcaaggggttggggaactcccttcctatccaagggaagccaagagggaccctgccatgagggacagtgctatcaggaccagatactacgcttttcccacagtcttcrcaacctacagaccaggagattccctcaggtgcctacaccacaaaggccctgggtttcaagcacaaaactgggcggctgtttgggcagacatcgaactagctgcaggagttttatttcatacctcagtggcacctggaacaccagcgagacagaaccgttcactcccctggaataggggctgaagccagggagccaagtggtcttgctcaatggatcccaccccatggaacccatcaagctgagatccactggcttgaaattcttgctgccagcacagcagtctgaaattgacctgggaca

SEQ ID NO: 4492 - DNA, 601 bp, Human
tcttgctgccagcacagcagtctgaaattgacctgggacactctagcttggaagggggagggacgtctaccattactgaggcttgagtaggcagttttcccctcacagtgtaaacaaagccgcctggaagttcggactgtgtggagtccactgcagtgccacaaagccactgtagccagactgcctctctagattcctcctctctgggcagggcatctctgaaagaaaggcagcagccccagtcaggggattatggataaaactcccatctccctgggacagagcacctgcaggaaggggyggctgtaggcgcagcttcagcagactttaacgttcctgcctaacggctctaaagagagcaacggatctcccagcacagtgctcgagctctgctaagggacagacggcctcctcaaatgggtccctgacccttgtgccttctgacggggaaatatctcccagcaggggtcgagagacacctcatacaggggagttccggctggcatctggcaggtgcccctctgggacgaagcttccagaggaaggaatacacagcaatctttgctgttctgcagcctctgctggtgatacccaggcaaac

SEQ ID NO: 4493 - DNA, 601 bp, Human
ctggcatctggcaggtgcccctctgggacgaagcttccagaggaaggaatacacagcaatctttgctgttctgcagcctctgctggtgatacccaggcaaacagggtctggagtggacccccagcaaactccagcagacctgcagcaaaggggcctgactgttagaaggaaaactaataaacaaaaagcagtagcatcaacatcaacaaaaaggacgaccatgcaaaaacttcatcctaaggtcaccaacagcaaagaccaaaggtagataaatccatgaagatgaggaaaatccagcataaaaagggtgaaaattccaaaaatcagaatacctcttatcttccaaaggattacaactccttgccaggaatgggaacaaaactggatggagaatgagtttgatgaattgacagaagtaggcttcagaaggtgggtaataacaaaatcctccaagctaaacaagcatgctctaacccaatgcaaggaagctaataaccttgataaaaggttagaggaattgctaactagaataactagtttagagaagaacataaacgacctgatgaagctgaaaaacacagcccaagaatttcatgaagca

SEQ ID NO: 4494 - DNA, 601 bp, Human
gcccctctgggacgaagcttccagaggaaggaatacacagcaatctttgctgttctgcagcctctgctggtgatacccaggcaaacagggtctggagtggacccccagcaaactccagcagacctgcagcaaaggggcctgactgttagaaggaaaactaataaacaaaaagcagtagcatcaacatcaacaaaaaggacgaccatgcaaaaacttcatcctaaggtcaccaacagcaaagaccaaaggtagataaatccatgaagatgaggaaaatccagcataaaaagggtgaaaattscaaaaatcagaatacctcttatcttccaaaggattacaactccttgccaggaatgggaacaaaactggatggagaatgagtttgatgaattgacagaagtaggcttcagaaggtgggtaataacaaaatcctccaagctaaacaagcatgctctaacccaatgcaaggaagctaataaccttgataaaaggttagaggaattgctaactagaataactagtttagagaagaacataaacgacctgatgaagctgaaaaacacagcccaagaatttcatgaagcatacacaagtatcaata

SEQ ID NO: 4495 - DNA, 601 bp, Human
caggacataagcatgggcaaagacttcaagactaaaacaccaaaagcaattgcaacaaaagccaaaattgacaaatgagatctaattaaactaaagagcttctgcacagcaaaagaaactgtcatcagagtgaacaggcaacctacagaatgggagaaaatttttgcaatctatccatctgtcaaagggctaatatccggaatctacaaggaacttaaacaaatttacaagagaaaaaacaaccccatcaaaaagtgggcgaaggatatggacagacgcttttcaaaataagacatttatkcggccaatgaacatattttaaaaagctcatcatcactggtcgttagagaaatgcaaattaaaaccataatgagataccatctcatgccagttagaatggcaatcattaaaaagtcaggaaacaatagatgcaggagaggctgtggagaaataggaacacttttaccctgttggtgggagtgtaaattagttcaagcattgtggaagacagtggggtgatttctcaaggatctagaattagaaataccatttgacccagcaatcccatttctgggtatatacccaaaggattataaatcat

SEQ ID NO: 4496 - DNA, 601 bp, Human
cacatatacaccatggaatactatgcagccataaaaaaagaatgagttcatgtcctttgcagggacatggatgaaactggaaatcatcattctcagcaaactaacagaggaacagaaaacaaacaccacatgttctcactcataagtgggagttgaacaatgagaacatatgggcacatggaggggaacgtcacacaccagggcctatcaggggttggcaggcaaggggagggatagcattaggagaaatacctaatgtggatgacgggttgatgggtgcagctagccaccatggcacatrtatacctatgtaacaaacctgcacgttctgcacattgtatctcagaacctaaagtataataatttaaaaaaaggaaaaaaaagcataattatttttatattaacactagcatttcatatcttaaagcaactgatgtttaggaattactacacgtggtggctcatgcctgtaatcccagcactttgggaggccgaggctggtggatcacatgaggtcgggagttcgagaccagcctgaccaacatggagaaaccccagctgtactaaaaatacaaaattagcaaggtgtggtgacacatgc

SEQ ID NO: 4497 - DNA, 601 bp, Human
tacgagtggtacctttttttgcattagtgtcttttatgtggcatcatgaaaatttctgatgaattaatttccctaattaacgtaattccattattcctagtgactttaacataattcctaatgatacttccataaacaacaggaccattgaatttttgagatttctctgtggttctttttttcctcaggatattttccattgaaatgtatggttgaaatttgatctttgaaaatctacttgatgtataattaggcttatttctatcagtttgttttttaagagttgttttgattttttcckttttatttaaccttggtttttaataatctaaaacttgtacatgattccaaaatcaaaactatgaaacaaggtacatttggagtattcattcctgtctgttctctatacccttttaacaaatgaattttaaaaattagtttttagtgtatgttttagtttacttatttctttttaaaagcataagcaaacccacacacatgcatatataagataataatatgaatatttatacatatatcaattcataaatcttttcccctttctacacaaatgtagtatactagatgcactctactggac

SEQ ID NO: 4498 - DNA, 601 bp, Human
tccattattcctagtgactttaacataattcctaatgatacttccataaacaacaggaccattgaatttttgagatttctctgtggttctttttttcctcaggatattttccattgaaatgtatggttgaaatttgatctttgaaaatctacttgatgtataattaggcttatttctatcagtttgttttttaagagttgttttgattttttcctttttatttaaccttggtttttaataatctaaaacttgtacatgattccaaaatcaaaactatgaaacaaggtacatttggagtatkcattcctgtctgttctctatacccttttaacaaatgaattttaaaaattagtttttagtgtatgttttagtttacttatttctttttaaaagcataagcaaacccacacacatgcatatataagataataatatgaatatttatacatatatcaattcataaatcttttcccctttctacacaaatgtagtatactagatgcactctactggaccttgttttctcatgtaacaatacattctgaagatcattttatttcttttgatagctgcacagtaccatattatgtggctacataat

SEQ ID NO: 4499 - DNA, 601 bp, Human
tactaatcatcagggaaatgcaaattaaatttagaatgagatatcaccactcacctattagaatggctaatatagaaaataccaaagattacaaatattggcaagggtgtggagaaaagagaactcttgcacactgctggtgggaatgtaaattagtgaagtcattatagaaaatagtatggagagttctcaaaaaactaaaaaaagaactactatatgatccagcaatcccactattgggtgtatatccaaaggaaattagtatgttgaaaagatatagctgcactcccacgttcattaygcattgtcgacaattggcaagatatcaacctaattgttcatcagtggatgaatggatatagaaaatatggtatatatacacatggaatactatttagcctttaataaaaaggaaatcatgtcatttgcaacgacatggatgaacctggaggcaattatgcttagtgagatcaaccagactcagaaggacaagtaccacctgccctctctcatatgcagaatctgaaaaaagtctcatggaagcaaagactagaatggtggtggctaggagctgggggaatggaggaattggggagatgct

SEQ ID NO: 4500 - DNA, 601 bp, Human
tgaggtttctaacatgactttggcccattcgtacaaatgattccatcttggagctccccctgccagtgccaccacccccactttctgttttttacagaagatacatatgaagtctatttaaagagaagatattacaaacaaatatacagtactattcaaacattctgaaattagatatagttggattcagatgaatttattaaataaaaagacaaattcatgagtgacatttcttaacttggtatattcacagcatatcagtggagaagtaaggagatttacttcattattcacagcgtgrtcatgatcttcagcaggtgttcaagaactctctgatgctgagactaaaagtaattcatcttcctaaagactttctatctttgggagggtgacatttcctgtctggcttttctgatgattcttacaacttaattacttttggcatgtccagttgcttgctttatttactacattgtataggtcaaacacttgaacctcaggtttatgtttgttttatcaaacttagagaatataattattcagagagtaattttcagattagcacaaacatacattttctactagagagtatctattctta

SEQ ID NO: 4501 - DNA, 601 bp, Human
aactctctgatgctgagactaaaagtaattcatcttcctaaagactttctatctttgggagggtgacatttcctgtctggcttttctgatgattcttacaacttaattacttttggcatgtccagttgcttgctttatttactacattgtataggtcaaacacttgaacctcaggtttatgtttgttttatcaaacttagagaatataattattcagagagtaattttcagattagcacaaacatacattttctactagagagtatctattcttaaagctcacttgtgagacattatattyttcctgttgtgaggatgagatggcattctctttgggatctaaattgcttctgaggcaggcacttttgtgtattgttatctctataccccgaagaacaactggagtgcaggaaaagcagggttttagacaaatgaaagtgggatatgccgtctgggctgatggctacgcttggcatcaccaaatgggagacttaagagccttctgcagtcacggctgcagtggctgattattcttccagccatgtctcttccttccttcttctcttctcttctctcctcttctctcctcttctctcttctc

SEQ ID NO: 4502 - DNA, 601 bp, Human
ttgtataggtcaaacacttgaacctcaggtttatgtttgttttatcaaacttagagaatataattattcagagagtaattttcagattagcacaaacatacattttctactagagagtatctattcttaaagctcacttgtgagacattatatttttcctgttgtgaggatgagatggcattctctttgggatctaaattgcttctgaggcaggcacttttgtgtattgttatctctataccccgaagaacaactggagtgcaggaaaagcagggttttagacaaatgaaagtgggatatrccgtctgggctgatggctacgcttggcatcaccaaatgggagacttaagagccttctgcagtcacggctgcagtggctgattattcttccagccatgtctcttccttccttcttctcttctcttctctcctcttctctcctcttctctcttctctttttttttgagacagtctcaaaaaaagaggctggaatgcagtggcgcaatcttggctcactacgacttctgtctcctggattcaagtgattctcctgcttcagtttcctgagtagctgggattacaggcatgcatcaccatgccc

SEQ ID NO: 4503 - DNA, 601 bp, Human
aacctcaggtttatgtttgttttatcaaacttagagaatataattattcagagagtaattttcagattagcacaaacatacattttctactagagagtatctattcttaaagctcacttgtgagacattatatttttcctgttgtgaggatgagatggcattctctttgggatctaaattgcttctgaggcaggcacttttgtgtattgttatctctataccccgaagaacaactggagtgcaggaaaagcagggttttagacaaatgaaagtgggatatgccgtctgggctgatggctaygcttggcatcaccaaatgggagacttaagagccttctgcagtcacggctgcagtggctgattattcttccagccatgtctcttccttccttcttctcttctcttctctcctcttctctcctcttctctcttctctttttttttgagacagtctcaaaaaaagaggctggaatgcagtggcgcaatcttggctcactacgacttctgtctcctggattcaagtgattctcctgcttcagtttcctgagtagctgggattacaggcatgcatcaccatgcccagctaattttgtattttcag

SEQ ID NO: 4504 - DNA, 601 bp, Human
aaaaagtttaggaagcaaagaagatggtaatggggtttttacgagccttcccctctttgaaggccagcagggtagttgaatgtgtgtgtacagaagccacatgctagcaatagtatgatgataatcatagtagttatcattttctggcactcactatgtgcctgaagtggtgtaaatgctttacatgtcattaatgctgttagtttctttaacagctctgtgaggtgaatgtattgttattctgctttgctaatgagaaaactgcagcatagagagcttagtggagcaatctcaccaagtktacagttagcacactgcagaggcggaattctcactgacatgttttctactccattgtctctgatttgacccaggaggaatggtgatggtaggcacctgagctattgagtgttgtaatatagaaggcagactttctgtgttcgtaaggcacaagagtctgctaaggatttccttttttgcttcattttacattttattcaaaggttcaaaattgataagcttaattaaaatatcagttccttaataaagcgctctaaaacatatttaaacaaaatgccatacatcatgccttagttgcttt

SEQ ID NO: 4505 - DNA, 601 bp, Human
gcacttttctgaggccttatcttaattaaacttggccagatgaagtttctttggtaaatgcaggttcttctcacaaagcctttcatcccttattgcagggagagccacattttccaaagaattgccccctcactggagggaacccagacagcaaaccccagaacttactggcatcaagagtgctccatgtgagggtaccatgaagacggagattgggagatattgggtgttctcaaatgcgacagattttaccagtaccgttttctcttgggatcagtataatgtaaacctcttgagaacrgtatctgagtctctgtatttcctcacatgcctactatccaagaattcaaaacacatatgtggttgaatgagtacccttaagcccaaactgctgactgtaaccctttatccaacctcatcttgtttacctttgtgtaacattggaaatcacccatccccttttctgttggaaactttctttaactttcctgattctccgtttacgtgatttattgctgctgcctctttctttctctgggttccagtctctaccccctcaagctggctatttcctaagattctgtttccagccctcttcttt

SEQ ID NO: 4506 - DNA, 601 bp, Human
ctttcatcccttattgcagggagagccacattttccaaagaattgccccctcactggagggaacccagacagcaaaccccagaacttactggcatcaagagtgctccatgtgagggtaccatgaagacggagattgggagatattgggtgttctcaaatgcgacagattttaccagtaccgttttctcttgggatcagtataatgtaaacctcttgagaacggtatctgagtctctgtatttcctcacatgcctactatccaagaattcaaaacacatatgtggttgaatgagtacccttwagcccaaactgctgactgtaaccctttatccaacctcatcttgtttacctttgtgtaacattggaaatcacccatccccttttctgttggaaactttctttaactttcctgattctccgtttacgtgatttattgctgctgcctctttctttctctgggttccagtctctaccccctcaagctggctatttcctaagattctgtttccagccctcttctttatattctttggctgactgtgcattagaattgcctgggaggtaaccgcagcctgccctgtcctgcctcgtgtttctgtgt

SEQ ID NO: 4507 - DNA, 601 bp, Human
ccttaagcccaaactgctgactgtaaccctttatccaacctcatcttgtttacctttgtgtaacattggaaatcacccatccccttttctgttggaaactttctttaactttcctgattctccgtttacgtgatttattgctgctgcctctttctttctctgggttccagtctctaccccctcaagctggctatttcctaagattctgtttccagccctcttctttatattctttggctgactgtgcattagaattgcctgggaggtaaccgcagcctgccctgtcctgcctcgtgtttctgtgtgtgtgtgtctgtatgtggtgcacacgtttctgtttttatttttttattttaaaaaatttgatttttattagctttttcttttcttattattatactttaagttctagggtacgtgtgcacaacgtgcaggtttgttacatatgtatacatgtaccatgttggtgtcctgcacccattaactcgtcatttacgttaggtatatctcctaaagctatccctccccctcccctcaccccacaacaggccccggtgtgtgatgtcccccttcctgtgtccaagtgttctcattgttcagt

SEQ ID NO: 4508 - DNA, 601 bp, Human
tttttgtctttgcgatagtttgctgagaatgatggtttccaacttcatctatgtccctacaaaggacatgaactcagggatctagaactagaaataccatttgacccagccatcccattactgggtatatacccaaaggattataaatcatgctgctataaagacacttgcacacgtatgtttactgcggcactattcacaataacaaagacctggaaccaacccaaatgtccaacaatgatagactggatgaaggaaatgtggcacatatacaccatgaaatactatgcagccataaaamaagtttttgtttttaatgtttgcaagtaagttacagacttcctgtccccttatacctcagtgtgcattttgaaaaacaaggacattctcttgtattattaccacaatacaattatcaaaacctaaaaattaacattaatagacttcattcagattctgctgattgtctcatcaatgtcatctctaacaaagggcaaaaaccaatttttgtggtctaggaaatcaatccaggatcacatgttgtgttgtgctgtcatttttaaagtctcttttaacttagatcagttcttcggtatttcgt

SEQ ID NO: 4509 - DNA, 601 bp, Human
ttcgtggtttttatagctatgtagatcaatctaattgcctagctgtatcctctgacaggataaagaagcaatgataattcagtagcaattagcataagtagtaccattatcttggtttctaaatactattcaccaacaaaaatcaaccaagtcttcttccttgctggggcaggaaaagaacaagataagcctggaacaggtgttgttttttgtttttgtttgtttgtttgtttttggtttttttccatttgaaagtaagagagtgagcaaagaatgatggggacatgtcaaaaggacacaygagccagctccaaggggctcctactagccaaatacaggacaatgtgaccataaaaataaatggtagtaacagatggaataagaatccatgagtccatactgataagaacaaatagatgagcaactatgtaaaatggaaagttagttattcattacaatagaattccaacaaataaatgtgtgtggtatggctggatgcggtggctcacgcctgtaatcccagcactttgggaggccaaggcgggcagatcacctgaggtcaggagtttgagaccagcctggccaacatggcgaaacccca

SEQ ID NO: 4510 - DNA, 601 bp, Human
tatgtagatcaatctaattgcctagctgtatcctctgacaggataaagaagcaatgataattcagtagcaattagcataagtagtaccattatcttggtttctaaatactattcaccaacaaaaatcaaccaagtcttcttccttgctggggcaggaaaagaacaagataagcctggaacaggtgttgttttttgtttttgtttgtttgtttgtttttggtttttttccatttgaaagtaagagagtgagcaaagaatgatggggacatgtcaaaaggacacacgagccagctccaagggrctcctactagccaaatacaggacaatgtgaccataaaaataaatggtagtaacagatggaataagaatccatgagtccatactgataagaacaaatagatgagcaactatgtaaaatggaaagttagttattcattacaatagaattccaacaaataaatgtgtgtggtatggctggatgcggtggctcacgcctgtaatcccagcactttgggaggccaaggcgggcagatcacctgaggtcaggagtttgagaccagcctggccaacatggcgaaaccccatctctactaaaaataca

SEQ ID NO: 4511 - DNA, 601 bp, Human
aattcagtagcaattagcataagtagtaccattatcttggtttctaaatactattcaccaacaaaaatcaaccaagtcttcttccttgctggggcaggaaaagaacaagataagcctggaacaggtgttgttttttgtttttgtttgtttgtttgtttttggtttttttccatttgaaagtaagagagtgagcaaagaatgatggggacatgtcaaaaggacacacgagccagctccaaggggctcctactagccaaatacaggacaatgtgaccataaaaataaatggtagtaacagatrgaataagaatccatgagtccatactgataagaacaaatagatgagcaactatgtaaaatggaaagttagttattcattacaatagaattccaacaaataaatgtgtgtggtatggctggatgcggtggctcacgcctgtaatcccagcactttgggaggccaaggcgggcagatcacctgaggtcaggagtttgagaccagcctggccaacatggcgaaaccccatctctactaaaaatacaaaaaaattagccgggcatggggtgtgcacctgtagtcccagctactcaggaggcagag

SEQ ID NO: 4512 - DNA, 601 bp, Human
ttctattagtttgaattaagttgagatgctagagaagtttgctagaatcatttttcattgccagctaacataagtgcattttcaaacatgctattgataaaatctggataagttagagggaactatctgcttgggaagcagataaatgagagtctattgggggcaaatgagacttttggggttccttctatatcatagaatggatggacatataatttcatcttctgccttgaagacaggtgttgagaattgacctaagctgatttggtcattcatagcccttagtggttttttcctccayggttcatacatcaaaagaggtttgagctgagtcagtgttaggcactacacaaaactttgctactagtccataatgaaagcaagccagacaaaattctgctacacacagagaccattgattacataaatacttaacagcaagcaaagtaaaaaacatttttttacagctcgttatacaacttgttaggaagtcccagttctgctaccttgcataaaggttcttccaaggcagacagggcaacatcccagaggctggatcctgttacccttatcaatccagtgggcaatgccaaatcttctt

SEQ ID NO: 4513 - DNA, 601 bp, Human
agacttttggggttccttctatatcatagaatggatggacatataatttcatcttctgccttgaagacaggtgttgagaattgacctaagctgatttggtcattcatagcccttagtggttttttcctccatggttcatacatcaaaagaggtttgagctgagtcagtgttaggcactacacaaaactttgctactagtccataatgaaagcaagccagacaaaattctgctacacacagagaccattgattacataaatacttaacagcaagcaaagtaaaaaacatttttttacagctygttatacaacttgttaggaagtcccagttctgctaccttgcataaaggttcttccaaggcagacagggcaacatcccagaggctggatcctgttacccttatcaatccagtgggcaatgccaaatcttcttaaatcaacaggtggacactgggccatttaggaaaaaacctcaggtttgtctctgggggagaggctctctggatccttatcctccattacactagagtggagaatatctctaaaatatttttgctactccacatactcttgattgtctttaattttactcgagagagtcc

SEQ ID NO: 4514 - DNA, 601 bp, Human
ttatactgattattaaagtcttaggtgttaataaaaatcaggataatagaagtacttatagtgattgcttctggagtattgcctttctgataaaatactggataaatgtacagtcttgatgaaatacactgggagaacattacatactatagtgccatcttggaaattaaaaatgcatgttagctatttagaggttaatgtcctgcaataaaggaaagctgcttagttttgttcgaccttgcatttcccaaacttagttgaccccaagtccttttttccatcgcactcttgaaattagttwttcctgggaaaggctttagaaaacattgctttagagattataggagaagcttccttcaacatccacttaactgacactcagcattctctttataaaattcgaggataataggcacctatcttaaatactctctatcaagttgagttctgtgcttacaaagagtcaattgagattttttccaaaacggttttattctatttgtacttgtaattacagttacataacttaattaaatattacataatcccgtgacttttgagtgtaaatataaagagttattgtttctttgaaaaataaact

SEQ ID NO: 4515 - DNA, 601 bp, Human
tttgggaaaaatataaaaaagaatttctaatacaacttactttgtaagtatcttttaagttattgatgcattttcaagaaactgaaatgtatcatttttcaagaaagagttcaagcagagaacttgaattagtggagccatactcaaaagccttacatttaaataaaacatgtgaggtatatgtatgccaatttttattattttctgcttttactgaattttttgattaagtgactaagcataaaccttgtaagagtcagaaaagggcttttgttctagagagagagagaattaaagagamgacttcacaaagcaaagtgtgtacacacacacacacataccccttgtggcatgttttaaaatattccacatagattttgcccatatttcctcaagccaggctcagttgtcttcagaaccctttggcattcttgacacactgcttttgtgttttttcaactttattgtaagtctgtgggattgcttaataccttgttaaagaaaattagagttaaaaatctaatttctccctgggagtggtccatatatatatacatagttcatggctgggaacaaagtttactactagtgtattttttca

SEQ ID NO: 4516 - DNA, 601 bp, Human
cttcttaggatttgtttgttactgtaataatgaaatattttcctgtctcttggtatacccatgtgtatactgtgttttttattttgtaagtcccatgaaggagaaaggacttctatttttgttttattggagttgaacacttcttgagcctccttcttggagattctcaggtttctgatcattcttgttatagttaactgattatttttgtttccttagatcaatttagagggtcacaatatagcactttcagaaaatttgtcagagcttttattacattaggaagagtagccatttaagwgtgcaaacacatcactcattgactggctcactgaacatctatgagtcaggtagctgctgagaactagagatgttaagctagatgagatagttctctgcaagattggtcaatattcctttttcagctgctatgttctagaaaatgtatggtaccatatgaaaagataattgaaatggagaacatgttatttgctagaatggggcaaacatatgtcttaacctacatgaaaaatatgggagtgacattgagattggagttagggagagggaatagatcagatttggacattttgtccgaagt

SEQ ID NO: 4517 - DNA, 601 bp, Human
taaattatgtcttaaatacgacttgataccaaatccaaaagtagaatggttgcaacaatatttcttctagttatacttctttttctgaatcttactttgttatggaaatcatagagcatgctgatattctcagcatagacgaggagttgaggagggtaagggaaaatataggcaaacaggacaagattttcatcccgtggacattagtgcatttgaaaaactggctcttgggcttcatgttttggacagtcaggacagaggtctcacaggggttatttgcaggttttgctttttttgaggwtgcagccatcctaggactatcatgactgtcatgtggtgttgagagaaaggaagatagaaaaaagatgctttttgaaaagcttttccccaagacctatcattgggtcttctttctcctggtggagataggggaggagaggcagagaggaacccagctgtcagcaatggtgcagtgggtccaaactgcttctccttggtgggtggaatttccgttctagaggaggatctgaggaggcttatgagcttccctgggaattgctttcttcttccagcttctgaaaggttctcttcatttggcccc

SEQ ID NO: 4518 - DNA, 601 bp, Human
ttatggaaatcatagagcatgctgatattctcagcatagacgaggagttgaggagggtaagggaaaatataggcaaacaggacaagattttcatcccgtggacattagtgcatttgaaaaactggctcttgggcttcatgttttggacagtcaggacagaggtctcacaggggttatttgcaggttttgctttttttgaggttgcagccatcctaggactatcatgactgtcatgtggtgttgagagaaaggaagatagaaaaaagatgctttttgaaaagcttttccccaagacctatcrttgggtcttctttctcctggtggagataggggaggagaggcagagaggaacccagctgtcagcaatggtgcagtgggtccaaactgcttctccttggtgggtggaatttccgttctagaggaggatctgaggaggcttatgagcttccctgggaattgctttcttcttccagcttctgaaaggttctcttcatttggccccaggaggaatgaggaacacactacaaagctttccattctacaggctctgtgagctgagtggtgaagttgcacattttctaattggagaaaacatggtccc

SEQ ID NO: 4519 - DNA, 601 bp, Human
gagggtaagggaaaatataggcaaacaggacaagattttcatcccgtggacattagtgcatttgaaaaactggctcttgggcttcatgttttggacagtcaggacagaggtctcacaggggttatttgcaggttttgctttttttgaggttgcagccatcctaggactatcatgactgtcatgtggtgttgagagaaaggaagatagaaaaaagatgctttttgaaaagcttttccccaagacctatcattgggtcttctttctcctggtggagataggggaggagaggcagagaggaacscagctgtcagcaatggtgcagtgggtccaaactgcttctccttggtgggtggaatttccgttctagaggaggatctgaggaggcttatgagcttccctgggaattgctttcttcttccagcttctgaaaggttctcttcatttggccccaggaggaatgaggaacacactacaaagctttccattctacaggctctgtgagctgagtggtgaagttgcacattttctaattggagaaaacatggtcccatacattttaggttggctaagaagaaatgcctgagattcatggattgaagtg

SEQ ID NO: 4520 - DNA, 601 bp, Human
tggacattagtgcatttgaaaaactggctcttgggcttcatgttttggacagtcaggacagaggtctcacaggggttatttgcaggttttgctttttttgaggttgcagccatcctaggactatcatgactgtcatgtggtgttgagagaaaggaagatagaaaaaagatgctttttgaaaagcttttccccaagacctatcattgggtcttctttctcctggtggagataggggaggagaggcagagaggaacccagctgtcagcaatggtgcagtgggtccaaactgcttctccttggygggtggaatttccgttctagaggaggatctgaggaggcttatgagcttccctgggaattgctttcttcttccagcttctgaaaggttctcttcatttggccccaggaggaatgaggaacacactacaaagctttccattctacaggctctgtgagctgagtggtgaagttgcacattttctaattggagaaaacatggtcccatacattttaggttggctaagaagaaatgcctgagattcatggattgaagtgtgccttcaattggtcttctgctagagtttcatgtagaaactgatag

SEQ ID NO: 4521 - DNA, 601 bp, Human
cctcatatagatcagcatctctctaaaataaatcacttgactgttttctgcctaacattgcaggaatggcttgggagactaacccttcggtttgaaatgtctgaaaactgcttctctgttttacaatcttgaattttacttagctctgctgctctttttagctttctcagaagtggattatattttgctacctttgccactgaagtacaaatataatcgttgttattttcttgtctcacagagtatattttgaccgaaataagtagacaatgttctgttttctaagttccaaccacagtgttttttttgtttgtttgttttacactcagtaatccacatattgttatttctaggtaattatagaatttttcagtcagtaatttactaagcacatgtcatgttttcagcactgtgtaaggaactgaggcatacaaatgaaatctgaggcatggttcaagtcttcatgtaggttacagtgtttgtggagaaataaaaccaaatcagaggaaacaaagaacaattaaatgttcaactgtgtagtactcatgataggaatctcctggaagtaaatactgaatatggataaattaatgaatgaagt

SEQ ID NO: 4522 - DNA, 601 bp, Human
tatagaatttttcagtcagtaatttactaagcacatgtcatgttttcagcactgtgtaaggaactgaggcatacaaatgaaatctgaggcatggttcaagtcttcatgtaggttacagtgtttgtggagaaataaaaccaaatcagaggaaacaaagaacaattaaatgttcaactgtgtagtactcatgataggaatctcctggaagtaaatactgaatatggataaattaatgaatgaagtgttcattcaaggaagaaatcattgtggactagaatgtgtcattgaataggtcggataygaacatagccatgaaacataaataggactggtaagtggaggagagaatattctaggtgaagagagcaaaggtaacaaggttgatgatggagttgagcatggcatgtgttttggacaataagaggagaccaggtgacaaaaatcggtatgcaagagaaacaaaaaaataaagttgggtatccccccttccttgataagtgaacctcaattttgtgcctatctgcaagtgatgaatcatgattggtctaacccattcatgatgattctatcctccgcctttccagtctcctttggagctagg

SEQ ID NO: 4523 - DNA, 601 bp, Human
tttccaagagaggatatattggctgcccagatctgagcagttaagtgggaagggaagggagtccaagatgaaagtggtagtgacagatcattcattgaaggagctgggaattgagaaaggctgattcttgcaagggtggtagacctagtaaaagatggttttaaaaacagtgaaaactgggaggaaagaatttcatggaaaggcccaacatttaaatggaaagaaaggtataaacacacagagaaagttaaagaaatgtgtaatgttggagaaagactttagtttcaggacagttcagatwttcctctgaaattggaggcagggatgacaaggaggctctggaatctaatgagtggaagcaaatatacttgtaaacagctgtctctactgggtaggtgaagtcctgtgttaggagctggtctagtggtagggagaagtgaaaggggagctagccacttcatgcagttacaaaatcatgcagccttgccatcaacgtggcaaggattgtcaagggcaaggctgcgtaattttgtgtctttctcaggcaggaccatagcggagaaccagaagctgaagaggagacccagaatcaggtggaggt

SEQ ID NO: 4524 - DNA, 601 bp, Human
ggcactgtattagtccattttatgttgctgtaaaaaatgcctgagactgggtaatttataaggaaaagaggattgacctggctcacagttctgcaggctgtacaaagaagcatggcaccagcatctgcttctggtgaggcctctggaaacttccagtcatgcagaaggtgaagggagagcaggtgcatcacgtggtgagataaggaacaacagagagggagaaggagagagagtggggaggtcccagactcttttcaacaatcagatctcatgtgaactcattaccatggggaggacaccrggccattcatgagggatctgtccccatgacccagacacctcccactaggccccatctccaacattggagatcatatttcaacatgagatatggaaggaacaaataaccaggcactaaccatattcacctcctagcggccccacctcccattaccactgcactggggactaagtttcaacatatgaattttggggagcataagctttcagaccatattcagcaatgagcatggtttgtgtagaagaagaacttgggcaaagtgaatggcttatgcctcaagttgagcagattagttgcgta

SEQ ID NO: 4525 - DNA, 601 bp, Human
taccacttgggtcagcctagtttctgtgattccgttacattatgggattgagtgtttaatgctcagtgacatctcatagaatgaatcatagggagaccaagtggtgtgcacaggtctacctggtttgggaatcactgagattgttttgctctgctccaagttgcaactgaagacaaatcacattcctggagggaaaggaacatcaagtgactaaaatgcaacagcataaatcctctctcataatagacagcacctgtagccttttgaccctttgttctaaatcttttatagaagagtgtakgatgtagataggaaataaataaaattgcctcctgattttatgtcactatggagctggttgggagtctctttccttttcagagaagccacagagagaaagaagaaaaagcaaaggcaagaccccttctcttacatatcccaatggactttgagtgttagtgttgctttttaatgaaggtggatggcagagagagattttcaatatagcttaaccataaattttcttaagggggttaggtggtgctgtccaatactccagggtgtggtggtggagctggcagaggctacaaaaagcagcagg

SEQ ID NO: 4526 - DNA, 601 bp, Human
aaagggaaaagacaaagaagatatcatctatttgagtaaataaaatggagatgtagtaaagatatcattttgggaaccttgagattgataaaaaaaaatacacaacttactagaactttttcagttcaaagctgaatgctaaaaggttgttttgtgtgctgtatgacagacaaatattttaaaatatgtctcacaacattcctttggcttaggtggtgatatttaagttaagacttacatatatcagttggccagtttgacagataggaaattatttggaattaaaaattccccttctagyttttcccctaaaaagtccctgcttaattcatgattgttctctcctttgcctcttctttcctaattctttatcttctcccatatccaaaagaacatctggcaactatctctttagaggcatctatgatcctggattgaatttgttatccagtcagcaccttcgtgagctgtgtttgattttctgaaattgggtttccgcaaatggtcatatttcaaagtgctatgccatataattatttgaagggaaaacattttaacgtggtacaatgacaacgtaaagaatgaaaattgtgctaagtga

SEQ ID NO: 4527 - DNA, 601 bp, Human
tttccaaatttaggtatgttaccatggcattttatcctggaaaattgctttgactggaagtttctttggcaaatctcacttttatttatttattttattttatttagacggcgtcttgctctgtcgccaggctggagtgcagtggcgcgatctcggctcactgcaacctgtctcctgggttcaagcgattctcctgcctcagcctcccgagtagctgggactacaggcatgtgccaccacggccagctaattatcattattattattattattttttgagaccgagtttcactcttgttgyccaggctggagtgcaatggcgtgatcttggctcaccacaacctccgcctcctgggttcaagtgattctcctgcctcagcctcctgagtagctgagattacaggcatgcgccaccatgcccggctaatttttttgtatttttagtagagacagggtttctccatgttggccaggctggtctcgaactccctacctcaggtgatccacccgccttggcctcccaaagtgctgggattacaggcgtgagccaccgcgcccagcccctaatttttgtatttttagtagagacagggtttcacca

SEQ ID NO: 4528 - DNA, 601 bp, Human
tagtctctgcttattatataaaagtaatcatatgctatatatagcccatgatggtataaatgttgtagctgaagggcaactgacaagagaaggcagtggagacttgggaaaaagtgggattttaggtctgagagaccttcaagttctagcctgggctgcaggatagaaccctaggtttggtactttgaccctcggtttggtacttatcctcttgaggccatatttcattatataaaatgggaagtcagtaatctatagtgagagctacatgtaagagtgaatttatcttatgaactaatcmttggccttttttgctgtcagatctattccttttctcccacttcattatctgcatggctgaaggttcaacccctgcaggctgatttcctagctctttcccagctgggtttagccaatgagaggcactggcaggagatgggcaggcaagcacagctgctgtgtttgctttgtggctccagcttgtgtaagacaggcccactgtggttccagctttttccatgactctggccctttggtgctggtaataccatcctctccttctgtccctccagccaaggagtggtagtagctacctgcagtt

SEQ ID NO: 4529 - DNA, 601 bp, Human
gtgatgtatctaagtcactgtattacattccctctttttagaatgttggagtggttcctatttccctcattggacccttattgatccagtccatttcggtaatctagctgtgagctgcagtacttcaactaggctggttgtgatagaaatagaaaggaaggagagacctgccaaaggagaaagagagcagtaacctattagatggggaaaagatcaggagaaataaagcaattcagataattgtgactgccattgttgaagacaggcctttggaaggggaactggtttgggtgtagaaccwatgggttttgtgtagagcatgtcaaagaagataaacttcatgatttcactgcctttcccacttcagtgtattgcagctgcaggagtatttatggagttgcctttctctcttgggaaagggtaaaaatgttcagaggaaagagatcaggggtagctacacttatgtcagataaaaatagactttacgtcaaaaactacaaaaagaggcaaagaaggtcattacataaggatacagaggttaattcctcaagaagacataacaattgcaaatatgtatgcacccaacatcagaacacctaaa

SEQ ID NO: 4530 - DNA, 601 bp, Human
tatagtatatgtgtgttgggaaagaaaagaagagtctaataaatgaagacaaacaggaaacccttcctaaactctcttcccaaatacttcttagtcacgttgtacaggtcgaaggttctgggaagaaacagctagtgctctgacctgcattctgcaaatataacgtttcctgttttgtaggaacttggggctgaaaaatgcataaaccaattgatttaaactcttaaacccataatattcacaaacctcaaggactgctggtcaaagcctctctctctctctctctctctctctctctctstctgtgtgtgtgtgtgtctgtgtatgagagagagagaaagagagagagagagagagagagaaagatctattgcagatgttcttggagtattacattacatctaatttccagatagtctccagataactgaataattgattcatgtgaatcttaaatacatcaatattctgtagtttctcaaaccttttattttgttttttttttttcaactctgagtgaattaggtttagttggagaaaaccgtttatgttatgtacttctaaaatatgatgaggtgaagcatgaagcatggttctcctt

SEQ ID NO: 4531 - DNA, 601 bp, Human
tagtatatgtgtgttgggaaagaaaagaagagtctaataaatgaagacaaacaggaaacccttcctaaactctcttcccaaatacttcttagtcacgttgtacaggtcgaaggttctgggaagaaacagctagtgctctgacctgcattctgcaaatataacgtttcctgttttgtaggaacttggggctgaaaaatgcataaaccaattgatttaaactcttaaacccataatattcacaaacctcaaggactgctggtcaaagcctctctctctctctctctctctctctctctctctstgtgtgtgtgtgtgtctgtgtatgagagagagagaaagagagagagagagagagagagaaagatctattgcagatgttcttggagtattacattacatctaatttccagatagtctccagataactgaataattgattcatgtgaatcttaaatacatcaatattctgtagtttctcaaaccttttattttgttttttttttttcaactctgagtgaattaggtttagttggagaaaaccgtttatgttatgtacttctaaaatatgatgaggtgaagcatgaagcatggttctccttgg

SEQ ID NO: 4532 - DNA, 601 bp, Human
tagtcacgttgtacaggtcgaaggttctgggaagaaacagctagtgctctgacctgcattctgcaaatataacgtttcctgttttgtaggaacttggggctgaaaaatgcataaaccaattgatttaaactcttaaacccataatattcacaaacctcaaggactgctggtcaaagcctctctctctctctctctctctctctctctctctctgtgtgtgtgtgtgtctgtgtatgagagagagagaaagagagagagagagagagagagaaagatctattgcagatgttcttggagtatyacattacatctaatttccagatagtctccagataactgaataattgattcatgtgaatcttaaatacatcaatattctgtagtttctcaaaccttttattttgttttttttttttcaactctgagtgaattaggtttagttggagaaaaccgtttatgttatgtacttctaaaatatgatgaggtgaagcatgaagcatggttctccttggaatgatgtttacattaataaggctttttatctcacaacgacatagataatataaaattaaaatcaactgctgatctcagggagcaaaca

SEQ ID NO: 4533 - DNA, 601 bp, Human
actctgagtgaattaggtttagttggagaaaaccgtttatgttatgtacttctaaaatatgatgaggtgaagcatgaagcatggttctccttggaatgatgtttacattaataaggctttttatctcacaacgacatagataatataaaattaaaatcaactgctgatctcagggagcaaacagatttttatgataaggattgtatagccacctttacatctttttctttccttttaaataaatgatgaaagctccagtgctgtcataaaatcacatttatttgtagtgatagggatgaamtaatcactgtttcatcaccgtgatcagcggtcacatacacacaatggaacctgacatgctggcagcctcagctcattacagctttccaaccaacctccaagcttatggctggaagtcaaatggggtgggcaggttccaagtaggaaagaaaaataattggctttggagataaagggattatttaaatttccatatgaaatttccacaatttcttggcttcaaattgagagggagttacactaagatgcctgtgtttcaattttaaaattaaaagcattcaaagaagtggagaaaattatt

SEQ ID NO: 4534 - DNA, 601 bp, Human
gttgtttatcacactattaattacctgctaattaaaaacaaaacaactggaaaattctagcaacagaatttttcatcaggaaggcttttggtttaataatttttttcttatccttacaatatcaagttgttcccctcccccccataaggattgattagtttaaaagattggtgtttgatcggaatgcaaacatcagtgggacaaagtgggacttttctggtactatgtagtttttggagaccaaggcctctgagtcagacagacctaggattacatttaagctatctctcctttgagccaratttgaatctcaatttatctttccacttcgtgatcttgggcaggttacttaatctttcaaagcctcagtttcctcatctgcaaaatggtgataatgaaaccaccacgaagacctgttgtgaggggaaaataggatcgtgtgtgtaaagagcttacataacagagagcctagcatatagattcatagtagctgttttttaacaaaattatttttgcactattttcttttgtgactattagcatttggcagtgtgcttaccgcattactaaattttgtcttgatagagcagtccctgagcga

SEQ ID NO: 4535 - DNA, 601 bp, Human
ccacgaagacctgttgtgaggggaaaataggatcgtgtgtgtaaagagcttacataacagagagcctagcatatagattcatagtagctgttttttaacaaaattatttttgcactattttcttttgtgactattagcatttggcagtgtgcttaccgcattactaaattttgtcttgatagagcagtccctgagcgatggttgagacctcacagtgtagatagacctgttgaagtgttgggtgttgctgactttgatttgcacccctggacaccacattcagcacctggatagctttagmagcaatggcaaaagatgaattccatttcaatcaacgctatccacaaccttgatttggggtttttgaataaaaatagggttttatgcttgaggatatagcacattttgagctgctgagtgagacttgcacttggcatgtgtgggtgccctggtgaaaactcagggagctttgcatttcattatatttttaataatgcttggcaagtagcagaattaaacttgtgaatcatttgaacaaccacttttcttaatggagatgagcctctttatcttttaggagtcaatactctgtggttctaaa

SEQ ID NO: 4536 - DNA, 601 bp, Human
tgcttggcaagtagcagaattaaacttgtgaatcatttgaacaaccacttttcttaatggagatgagcctctttatcttttaggagtcaatactctgtggttctaaattagagtcctcgatgtgattgtattcctctcaaacagtattaagaacttattttataatggagaggttcataatgaaagcagtctggggaacgaggcatcctaggctcttgatggtgctgggttgaaggacaggaggagctggtgaggatgtggccaggacctgttccctggtgtgggggtagtagggaggatrctaacctttttttactgtgtactagatgctttgtacacattgtttcatttagtcttctcggtacacctttaaggcaggtattgtcatgcccatttcaaaggtgcagagagatgatttatccaagattacatagtgaatagaaaagcagtaataaaaggaggaaatatcagttttggttacccagtatattttgtgaaaatccatcaagatgtatatttataatttgtgtacttttctgtatatatgctcacttcaataaaaagttacttataaaaacaaacagatctgcctgacaaagtc

SEQ ID NO: 4537 - DNA, 601 bp, Human
ctctgatatagtgtggagtgaaaactggttttcgaactgcagatatagtatgatggtatttttgtagttgttttttctttatgtaacatattcatataaataaatggctggaaagatatttgccaaaatattaatagtgatacctctgcatttttgtgatactggttgaattttactttccattttatgtccttctgtatggttggttttatatagacattgctttcctacaattctataaataaaattttaatttttaataaaacagtacctttaatcaaaggctgcatcccaaattaartatatcccttctcaaggtgtctactgtaaaggaggaagaattcattttagtgtatgagtttcgatacatcaaaataatattaaattatagtcaaatcatagaaaagaattttcaggaataaaaagtgccatttaataagatcaaatacatgcaattaccagactgcttggcttctgtaaacatttttaaaaaatcattttgagggatatagtttataaaagtaacaattataataaacaattttaattatattaataaatataattaagaactactttaattatattctatataagcaag

SEQ ID NO: 4538 - DNA, 601 bp, Human
aaatcatagaaaagaattttcaggaataaaaagtgccatttaataagatcaaatacatgcaattaccagactgcttggcttctgtaaacatttttaaaaaatcattttgagggatatagtttataaaagtaacaattataataaacaattttaattatattaataaatataattaagaactactttaattatattctatataagcaagttgctctatctacctgtaccagatatcatagcaatctaaaagatagctgttttacttatccaaatatgtgtcttatatagataggtcagtttsaaaaattctccgttctttttagattttagtataaagacatatgattgctttattttattttattctatttcattccattttagcgattccttcaatcaggctgaagacagaattaaaattatgcacattaaatactcatgcaaaaacagattatagagcaggatatgactttcatttttgtctttttcttaaagatttccaaggaactaacctaagagaatcctgagtacatcttactgtgggtgtcattgatatatactgtttcattgcctataacccccaacaggaatcatgagctct

SEQ ID NO: 4539 - DNA, 601 bp, Human
taccgatacaatttctattgtttcttgaacactaggaaatgcttgaggtgtgaatattgttttccagtgtgatttgtactacctacacattataaagggatgttaaccgttcgaatcctctttaacggcccccagcagtgaaggagggtgggcagggagaggaacagctgttgcctaagaggggaaggaagggagggaaggggaactagagaagctggcttcattggtatatgatctgggataatgggaagcactgatttaggaattatcaaatcattcctccattgcaaatgtatcgtctttattattattattattttgagacaagtctcgctctgtcgcccaggctggagtgcaatggcaccatctcggtttactgcaacttccacctcccgggttcaagcaattcttctgcctcagcctcctgagtagctgggattacaggcatgtgccaccacacctggctaattttttgtatgtttagtagagatggggtttcaccgtgtcagccaggatggtctcgaactcctgacctcatgatctgcctgcctcagcctcccaaagtgctgggattacaggtgtgagccactgagcctggctg

SEQ ID NO: 4540 - DNA, 601 bp, Human
ccttgtcttattaaaacccaaaatttctgaaccccacccccagatccagtgggtgtagagtctgaaagtctgcaatttttaacaaggtccttggtgatgctgttgctggcagtccaaagatcacactgtggggaccactgatgtagtggaaagaatgtagtcttgagatgagacacatctgggttccagtctcatttaatagctggaaattttttagtatagttacttaatactatactaagtacttaatactatactttactgagttttttcctctttattttcaattttttaaaatatycttaaataaatttatacactcatacatatatattatgcttgggtttaaatgctaccttgaataaatatggagcacagatggaaaccgagaagaaggaggcagaaatgagagcaaggaggaggctgataagtaggttcaagggagagtgagtggtctgcacagtaataactgtgtcctagaataaccagaacccagcaaaacaacataatcagaagcaaactcaaagtgaatgtattaaaagtcaagctaactgtttactttgcaaggagaagagaaaggtcacttggctgtacaagtatg

SEQ ID NO: 4541 - DNA, 601 bp, Human
tttcatgtcagtgaggataaaatgattgctacctgctctttttacacacatgactaatgacatatttgtaaacttagttttctaagaaagaaacatagccatcatatttagggttcataccattatttaaatttgtatactgtgttccatcagcttttcatgggaagtatttttatcctctctgatgatttgaaatagaaaagccaatttgggtgtaaaatccaatgttcaggcagaagccttatgtggagatagtgttcccacagaattgaactcctggagtactggttaagagcaagtrctccaggagtcagatatctgggttccaatcttgctttcacctcttagggcccgttctgttgccataggaatgttcaataagctagtaatcattatagtacatagctatgggatttctacaaacttttattcaacaagtatttattgactgcttgagaggtgccaggcatggtggcaggtactggggatatccactctcagggagctctgggagacaggcaagaaacctgtgaataagaaagttcatataataatagtaggtgttaaggatggagcaattaacaaaactaaaacataagtc

SEQ ID NO: 4542 - DNA, 601 bp, Human
agtatttattgactgcttgagaggtgccaggcatggtggcaggtactggggatatccactctcagggagctctgggagacaggcaagaaacctgtgaataagaaagttcatataataatagtaggtgttaaggatggagcaattaacaaaactaaaacataagtccctagtcctccaagttccattatagtgccttatatcctagtttgtttaccttccataagctcatcaaaagtcaaatgtgacttagatttactgactaggttactattttattcatcagattgagctccttaattcrggaatttaacagaggttagtttgcaacttaaaaaaatcttcatttctatcctgtcttaggcattaatagattttgtccatattaccagtgcaaataacagtgaactttatgtttttattctctatttgatatgcttgtaatttaaggcttagccacaattaaaatgttcactttataatctattagaaattctatataatttaataattttcattttgttgaggtcaaatttaactacaaaatctaggaagctattgattcccactaaccgcaccattgttatagtcttagtatgtttga

SEQ ID NO: 4543 - DNA, 601 bp, Human
atttattgactgcttgagaggtgccaggcatggtggcaggtactggggatatccactctcagggagctctgggagacaggcaagaaacctgtgaataagaaagttcatataataatagtaggtgttaaggatggagcaattaacaaaactaaaacataagtccctagtcctccaagttccattatagtgccttatatcctagtttgtttaccttccataagctcatcaaaagtcaaatgtgacttagatttactgactaggttactattttattcatcagattgagctccttaattcgggratttaacagaggttagtttgcaacttaaaaaaatcttcatttctatcctgtcttaggcattaatagattttgtccatattaccagtgcaaataacagtgaactttatgtttttattctctatttgatatgcttgtaatttaaggcttagccacaattaaaatgttcactttataatctattagaaattctatataatttaataattttcattttgttgaggtcaaatttaactacaaaatctaggaagctattgattcccactaaccgcaccattgttatagtcttagtatgtttgaaaa

SEQ ID NO: 4544 - DNA, 601 bp, Human
taaaatttgtttccagggccaaaaggagagtactattttagttttgtggaactttgccaaaattgtattaattattaactgtgattcatttatgactgtacttcttctataggattttaactaatttaaagcaaagactgaatgaaagtctttatgttttgcagacaagagagcacccatttatcctcagcaaatgaattgttggagcaaataatttcagtggaccgtttggtatagggaagcttatggagacagaagcttgtggagacagaaaattcaagggattaggatttttgaaatrcagaataagactgaggggcagctaagatttatgtagtcttcaagaacatagactatgcaaatacacaaacctacattctgtagactgcattgtagggaataatggacacactcaacatcctctaagattaggatagagagaaaagctccactctatttgaaggaagggaaatttttagcaaatcagaataatattaatctaagtttttcattttctttggtggtagtcctttctggattggtttagttgccaccttgccagaatactttaggaaacttctttaaaaaaacttctttagtc

SEQ ID NO: 4545 - DNA, 601 bp, Human
aggagagtactattttagttttgtggaactttgccaaaattgtattaattattaactgtgattcatttatgactgtacttcttctataggattttaactaatttaaagcaaagactgaatgaaagtctttatgttttgcagacaagagagcacccatttatcctcagcaaatgaattgttggagcaaataatttcagtggaccgtttggtatagggaagcttatggagacagaagcttgtggagacagaaaattcaagggattaggatttttgaaatacagaataagactgaggggcagcyaagatttatgtagtcttcaagaacatagactatgcaaatacacaaacctacattctgtagactgcattgtagggaataatggacacactcaacatcctctaagattaggatagagagaaaagctccactctatttgaaggaagggaaatttttagcaaatcagaataatattaatctaagtttttcattttctttggtggtagtcctttctggattggtttagttgccaccttgccagaatactttaggaaacttctttaaaaaaacttctttagtccaaggggtactctcaatccagga

SEQ ID NO: 4546 - DNA, 601 bp, Human
attttaactaatttaaagcaaagactgaatgaaagtctttatgttttgcagacaagagagcacccatttatcctcagcaaatgaattgttggagcaaataatttcagtggaccgtttggtatagggaagcttatggagacagaagcttgtggagacagaaaattcaagggattaggatttttgaaatacagaataagactgaggggcagctaagatttatgtagtcttcaagaacatagactatgcaaatacacaaacctacattctgtagactgcattgtagggaataatggacacactyaacatcctctaagattaggatagagagaaaagctccactctatttgaaggaagggaaatttttagcaaatcagaataatattaatctaagtttttcattttctttggtggtagtcctttctggattggtttagttgccaccttgccagaatactttaggaaacttctttaaaaaaacttctttagtccaaggggtactctcaatccaggatgagtaaggctttcaactttccagaccaaataaataagtcagaaagcttttcaagtctaaataacttaattcttcttacagaattctctc

SEQ ID NO: 4547 - DNA, 601 bp, Human
ggagcaaataatttcagtggaccgtttggtatagggaagcttatggagacagaagcttgtggagacagaaaattcaagggattaggatttttgaaatacagaataagactgaggggcagctaagatttatgtagtcttcaagaacatagactatgcaaatacacaaacctacattctgtagactgcattgtagggaataatggacacactcaacatcctctaagattaggatagagagaaaagctccactctatttgaaggaagggaaatttttagcaaatcagaataatattaatctaastttttcattttctttggtggtagtcctttctggattggtttagttgccaccttgccagaatactttaggaaacttctttaaaaaaacttctttagtccaaggggtactctcaatccaggatgagtaaggctttcaactttccagaccaaataaataagtcagaaagcttttcaagtctaaataacttaattcttcttacagaattctctccaccaattgcttgataaatgtcaattcaatgaaatgacatgcacattcagaatcatggtaaatttttgttttccatatccttcagaatca

SEQ ID NO: 4548 - DNA, 601 bp, Human
tttttcattttctttggtggtagtcctttctggattggtttagttgccaccttgccagaatactttaggaaacttctttaaaaaaacttctttagtccaaggggtactctcaatccaggatgagtaaggctttcaactttccagaccaaataaataagtcagaaagcttttcaagtctaaataacttaattcttcttacagaattctctccaccaattgcttgataaatgtcaattcaatgaaatgacatgcacattcagaatcatggtaaatttttgttttccatatccttcagaatcaktttttaaactttcccaaatctttggcttatcaatgatgcattattctgtcaccctattaatgtatgtttcctttgtcattcataaaacggttgtattgtttggccttatggaaggatgttgattaagtgcctgtgaatgtttgctttattggcattgagaaagaagagaaaatgatttgttttgccaacaatgaattattgcatctgtttgtggctgttaaataatttaatagaacttaaagggcctattttcccttgattaaactacaggaaaatatcagtctctgcctcaccttggat

SEQ ID NO: 4549 - DNA, 601 bp, Human
caagtgattctcctgcctcagcctcctgagtagctgggattataagtgtgcaccaccacactcagctaatttttgtatttttagtagagacagggtctcaccatgttggccaggctggtctcgaactcctaacctcaggtgatccacccgcctcggcctcccaaagtgttgggattacaggcatgagccaccgcacctggcctttgtggccctctttttgagcggcatttttgccaagtaatatagcactgttgggaagagataattagtgtaagtaacagttcttttttttcaacattcrgtgagggaaaatatcaataatggtaaaacttgtattccttcccgtagtgaagggtgagaaaatacacttggaactagaaaagcatagtagtaaaatgtagaggtagtataaacttaaaggaaaaaaatttcaccaggactagaaatacctgggtttggcatctgactctgccactgatttatgtttttggcatgttgttcagtctcctgtgtcttgcattttctcatctcaaatcttcagagatgtcaacagaaaacaaatgtggaaaccctttgaaaaaattaaaacttcttagaaagg

SEQ ID NO: 4550 - DNA, 601 bp, Human
gggaggccgaggtggacggatcatctgaggtcaggagttcaagaccagcctgaacaacatggagaaaccccatctctaataaaaatacaaaaaattagccaggcgtggtggcaggcgcagtggcaggcacctgtagtcccagctactcaggaggctgaggcaggagaatggcgtgaacccaggaggcggaggttgcagtgagctgaggttgcaccactgtactccagcctgggcgacagagtgagactctgtctcaaataaaataaaataaaataaaaataaaaaaataaaaaaaattgcytagataagcaaacataactactcaaatttcataagattttgtaaacttctctcagtgccaagaaagtaagccacctggcagtttttttttttttttaaagtgaaccaacacacaaggatatgcaccagagctgggcacggtggttcatgcctgtaatcccagcactttgggagactgaggcgggaggatcacttgagcccaggagtttgaaaacagcttggacaacatggcaagaacctgtctctacagagataaagaaacagcctggagtggtgatgcatgcctatactctcagccact

SEQ ID NO: 4551 - DNA, 601 bp, Human
actcaggaggctgaggcaggagaatggcgtgaacccaggaggcggaggttgcagtgagctgaggttgcaccactgtactccagcctgggcgacagagtgagactctgtctcaaataaaataaaataaaataaaaataaaaaaataaaaaaaattgcctagataagcaaacataactactcaaatttcataagattttgtaaacttctctcagtgccaagaaagtaagccacctggcagtttttttttttttttaaagtgaaccaacacacaaggatatgcaccagagctgggcacggtggytcatgcctgtaatcccagcactttgggagactgaggcgggaggatcacttgagcccaggagtttgaaaacagcttggacaacatggcaagaacctgtctctacagagataaagaaacagcctggagtggtgatgcatgcctatactctcagccacttgggaggctgaggcgagaggattgcttgagcccaggatttcacggctgcagtaagccatgatcccaccattgcactccagcctgagtgacagagcaagaccctgaccaaaataaaaaatatgcactagaattgagtgttaatat

SEQ ID NO: 4552 - DNA, 601 bp, Human
aaataaaaaaataaaaaaaattgcctagataagcaaacataactactcaaatttcataagattttgtaaacttctctcagtgccaagaaagtaagccacctggcagtttttttttttttttaaagtgaaccaacacacaaggatatgcaccagagctgggcacggtggttcatgcctgtaatcccagcactttgggagactgaggcgggaggatcacttgagcccaggagtttgaaaacagcttggacaacatggcaagaacctgtctctacagagataaagaaacagcctggagtggtgrtgcatgcctatactctcagccacttgggaggctgaggcgagaggattgcttgagcccaggatttcacggctgcagtaagccatgatcccaccattgcactccagcctgagtgacagagcaagaccctgaccaaaataaaaaatatgcactagaattgagtgttaatatttcacctgaatttggctcagatttacatgggctatgagagcattttttattttagttaccatttcttattacttataattatattctcattctgcagatattctcaggaggcaataagcctggtggtaattg

SEQ ID NO: 4553 - DNA, 601 bp, Human
tttgtctgctaattagtgaagaatttgaattttgccagtagtatgtttttggtaatttttaacatttttatttatttaatttttccttttaactttaagtgaaataaaattatataagttttgcacatatcttgttaagtttattcttgacttgtttataatcttaattactgatttgaatgggattcctctcacccccattcacccctgccattatgtttagaaacaggttggcatataaggcagctattaatttttctatatttatattatattttgccactatcacttttactggttytaataagtttttcatttgatcttttgggattttctcggtaaatagttatattttctgcaagtaataatgatctgtcactttctttacaatattttacgcttaatttcttatctttatcttattgctttggcttaactatccaaaattatattaaaatataaagtaaataaatagtgggcttttttgttttgtttgctttttgattttcatgagaatgcgtctaaatcttcagcagttggtaaaatgttttctctaggattctgaaatggttttgattatgttaaggaagttttcttctct

SEQ ID NO: 4554 - DNA, 601 bp, Human
tgaatgggattcctctcacccccattcacccctgccattatgtttagaaacaggttggcatataaggcagctattaatttttctatatttatattatattttgccactatcacttttactggttttaataagtttttcatttgatcttttgggattttctcggtaaatagttatattttctgcaagtaataatgatctgtcactttctttacaatattttacgcttaatttcttatctttatcttattgctttggcttaactatccaaaattatattaaaatataaagtaaataaatagtrggcttttttgttttgtttgctttttgattttcatgagaatgcgtctaaatcttcagcagttggtaaaatgttttctctaggattctgaaatggttttgattatgttaaggaagttttcttctcttctcagtttactgagttttgttgtgaattgatactgtattttgtcagatgtctttggggtagtttcagttatgaacaattgtttttctcttttaaccaatttacttattgaattacattgatggactgtctcatgttgactcattcctacattcctggaataaatctgactttttg

SEQ ID NO: 4555 - DNA, 601 bp, Human
taccaataagggacccactagggaaggccagtggtttacttgggttatgcttcagctacttctcaatagtggccattaggacctccactcccactgcatcacagtgaccctgggtaagtcacatggtattaaccataaataagtgcatcacctgtttgtgtctctgcattaagtaactggagttgaccatgggaataaaacttgggaaaatttaacgtgaaattaatggtataattctatagttgcagacttcccttttctgaaacttgaaggcaacagatacagtgatgatcccatctcycccaccatcttgaattttgtgtgaactgttaggccttgtgtatgggtaagggttttctccagaacacttaactgccaaacatggatgtgattttgagcataggcccattggaaaggcaaaatgtatgcatcagaactgaattccattctgtgatcacaatccaggttagtggagccaacatttttgaggatagccctctcctggatttattactctctgcctctgcctgttattcggtctcatttggggccactttatctcacttagtatatggtagtagccatcctggctgtctttccc

SEQ ID NO: 4556 - DNA, 601 bp, Human
agatatttaaatatgctcatgaggtcaaaggcagggaagcttgggcttggtatttcctttactcacttttaaatttttgtacaatgcttcagtgtgcattttttccctgtgtgttaaaatatacataacataaaagttacaatttaaccatttttaagtgtgtaagtacacttaagtacataaccatttctaagtgtataagcattaggtagattcacattttttgtgcaatttcagtatactttttcctgaatttatattgaaataatttgatattttcatgattgagatccaaaacttktattgaataagtagagttttctgggggcttatcaatgtgttttgaagaaaaatgatttttttttaaattttgattaaggagcttgcattatatccaatcttattgggcttagggagagcaaatgtcaatgggaatttatggaaacatgtttattaatttggcttatctgaactttgtttccaattttagtttaataaaattattaaatattttaatacaattattaaaaatattaaatatttaggaagctgaaaatattttgctgttgtgacgagtctcatttaatcatgattggtatcc

SEQ ID NO: 4557 - DNA, 601 bp, Human
cttttaaatttttgtacaatgcttcagtgtgcattttttccctgtgtgttaaaatatacataacataaaagttacaatttaaccatttttaagtgtgtaagtacacttaagtacataaccatttctaagtgtataagcattaggtagattcacattttttgtgcaatttcagtatactttttcctgaatttatattgaaataatttgatattttcatgattgagatccaaaacttgtattgaataagtagagttttctgggggcttatcaatgtgttttgaagaaaaatgatttttttttwaattttgattaaggagcttgcattatatccaatcttattgggcttagggagagcaaatgtcaatgggaatttatggaaacatgtttattaatttggcttatctgaactttgtttccaattttagtttaataaaattattaaatattttaatacaattattaaaaatattaaatatttaggaagctgaaaatattttgctgttgtgacgagtctcatttaatcatgattggtatcctattcctaacagtagtagataagcaacagtgttgtagaaaataatttaaaaattaaaaagacatt

SEQ ID NO: 4558 - DNA, 601 bp, Human
ttgaatcctttataagatattgaataatttcaaaagacagtagatccaaaatgtgaaatattatttagagatgttcagagaccatataaacccaattttgttaattttttttaatttaacttatttaaatgtgattcctttcttgagaaatgataatttggagacttatgcatagaatattaggaagtagaaaggattgaattcaatgtctgactaattattggactcaactacaatatgaggttaagctttaatttaggggacagaggcatgacaatgcactatttatcttaataaattyaaagcgtttgttgtaagctgctcaaagagagactttggttgtggggcaggagttgggtggaaggggtattggtacttcagcctcttgccttcattctcatgtgaggagagttagctttgaaataagctgaaagaccttgtagtttataaaaatctcctggaaagatgttatggtcattggaatcagttcagtcatctaatgagctacacattggctggagcacacctgaactgataataaacttggtttcttttggaaagtgccaaaagtacccatcttcccaatacatacataacataa

SEQ ID NO: 4559 - DNA, 601 bp, Human
tgaatcctttataagatattgaataatttcaaaagacagtagatccaaaatgtgaaatattatttagagatgttcagagaccatataaacccaattttgttaattttttttaatttaacttatttaaatgtgattcctttcttgagaaatgataatttggagacttatgcatagaatattaggaagtagaaaggattgaattcaatgtctgactaattattggactcaactacaatatgaggttaagctttaatttaggggacagaggcatgacaatgcactatttatcttaataaatttwaagcgtttgttgtaagctgctcaaagagagactttggttgtggggcaggagttgggtggaaggggtattggtacttcagcctcttgccttcattctcatgtgaggagagttagctttgaaataagctgaaagaccttgtagtttataaaaatctcctggaaagatgttatggtcattggaatcagttcagtcatctaatgagctacacattggctggagcacacctgaactgataataaacttggtttcttttggaaagtgccaaaagtacccatcttcccaatacatacataacataaa

SEQ ID NO: 4560 - DNA, 601 bp, Human
ataaatttaaagcgtttgttgtaagctgctcaaagagagactttggttgtggggcaggagttgggtggaaggggtattggtacttcagcctcttgccttcattctcatgtgaggagagttagctttgaaataagctgaaagaccttgtagtttataaaaatctcctggaaagatgttatggtcattggaatcagttcagtcatctaatgagctacacattggctggagcacacctgaactgataataaacttggtttcttttggaaagtgccaaaagtacccatcttcccaatacatacayaacataaaatttaccatttaaccatttttaagtgtatagttgaattgtgttaagagagaattgactctcattcaatcatcatcatcataattatgttttgtatttaccaagaaggaaaactgatactcaaccttcaactttttctagtctgtttaccttaatattcctactttctcaccatcaatctgccaagatcttcttgagggaatacagatgtaggggtgtaggactctggtggtggtgaagcttagaaggagatttggagtcgtccacccttcagtccgctgaggcaccatttcc

SEQ ID NO: 4561 - DNA, 601 bp, Human
ttcacacatgctctggccaagttttagctcatttggagacttgtaatgactttggattctgtcctttgtaaaatgacaacctaagaatcatgtctttttactggttccaagttttaggtgggattttgatataagttttataatcatgtaggaattgtgggtcaaagcaagaaataagcattatgggcaggtggattcttttgcaggctagatgtaaaacatgtatttcttgaaggcttggcattctaggagggaatgtcttgatttaaggagatatggcagagaagagccttgtaagagraagctattctgacatgagtggttttgttcttacaaataaacagtgactcaagtcagtagcagggcgatagactgtggagaacgctagcataatatcatacttggggtataggaaccatatacattcatttagagtagcattaatttcccatttaatatttgttagaaactattagagattttatcactctgctgacaacaattctatttggaacatgagctgcttatataaaaatcatttttaatgtgaaagctctcattagcttaaaaggcaaatgaaatggttagctttaaaagctga

SEQ ID NO: 4562 - DNA, 601 bp, Human; identical to SEQ ID NO: 3396

SEQ ID NO: 4563 - DNA, 601 bp, Human; identical to SEQ ID NO: 3397

SEQ ID NO: 4564 - DNA, 601 bp, Human
tattaagggacaaccaatagtctgctacagaggtgaataggcaattcacttaccccccacccaataacaatgaaaaattaaaaacatttaactttaaaataagtttttaattagaaattaagaaaatatagtaagatattcccctcaccattaaattgacatgttttttctctttaaaaatagtacctctgatcaagaatttaagcaaatggatactctcattcatctacttctagtggaaaaataaattgatatagtatttcttggagaaacaattggcaatacaatttaaaatgcttaygagtttgatctatagagttccttttcttggatttattctaagccagtagagagaagcataaacatttatgttaataattcaacatagaaagattagctaagtgaaatataataatctatattatagattcctttgaagatattaaaatcatgtgttagaagaatatgtaatggtatggagaagtccttacaatgttttgtagaaaatttgattacaataaaatgggagataggatttaaattacatttctatgaatatgcccctaagttgctagcaggttattaatagtgaatgttttta

SEQ ID NO: 4565 - DNA, 601 bp, Human
tgttataaaatgtacttcatggttgctagggggaaagtttacctattacctgtatctcatttttcatgaaatcaactttttcatcataaaaatggggactgaaagctattcagtgaataggtataattgccatctaagaggtgaaattagggtactagttgccatagagacagacagtagaaatcacttattcctccacttctcttttaagctaagaaaaagaaatcattcatggccagggaggtccctgaagctggcctgtaataagcagaaggatacctggtctggggctgggcaattkccatttcacacccccgagtgtctgacagtgtcttattttttgttttatctgctgaagccaagactgaaatattagccttttctcatctgtattattaaaatgcaaattgtaattgcaggcagagcatggttttcaaagattaaaataaaaggctacggtggaagcagaaatacttataatgaagtctttcatgtacagttctctatggaaaaccattttgggagggaattgagtgtaaatatccttataccacatggtaaacttggtagaattcaaaaatgattaaaaacaccattgaca

SEQ ID NO: 4566 - DNA, 601 bp, Human
ctgaaagctattcagtgaataggtataattgccatctaagaggtgaaattagggtactagttgccatagagacagacagtagaaatcacttattcctccacttctcttttaagctaagaaaaagaaatcattcatggccagggaggtccctgaagctggcctgtaataagcagaaggatacctggtctggggctgggcaattgccatttcacacccccgagtgtctgacagtgtcttattttttgttttatctgctgaagccaagactgaaatattagccttttctcatctgtattattamaatgcaaattgtaattgcaggcagagcatggttttcaaagattaaaataaaaggctacggtggaagcagaaatacttataatgaagtctttcatgtacagttctctatggaaaaccattttgggagggaattgagtgtaaatatccttataccacatggtaaacttggtagaattcaaaaatgattaaaaacaccattgacatctctgttgagtatttatttgggggatggggtgggtagggacagatacatgtaatgatgatattggccttgaaattaaaacaccatttttactttcta

SEQ ID NO: 4567 - DNA, 601 bp, Human
gacagtgtcttattttttgttttatctgctgaagccaagactgaaatattagccttttctcatctgtattattaaaatgcaaattgtaattgcaggcagagcatggttttcaaagattaaaataaaaggctacggtggaagcagaaatacttataatgaagtctttcatgtacagttctctatggaaaaccattttgggagggaattgagtgtaaatatccttataccacatggtaaacttggtagaattcaaaaatgattaaaaacaccattgacatctctgttgagtatttatttgggrgatggggtgggtagggacagatacatgtaatgatgatattggccttgaaattaaaacaccatttttactttctaggatttgcattgtattggttggcatctttaatgctcttagtgtattactgtgtgttaattttaaataggtcttctaagatctcttcagatctggagtgaacatttaaaaacatagatcaaggggctggattacacttgcaatcccaggactttaggaggccgaggcgggtggatcacctgaagtcaggagtttgagaccagcctggccaacatagtgaaaccccgt

SEQ ID NO: 4568 - DNA, 601 bp, Human
ccagtccagcctcacttgcctctctcacctgcttccccagccccatttgcctctcccaacctcaccagcttgtcccagtctcacctgcatctccagtctcatctgccttttctagcctacctgcctctccagcttcacctgccttccccaacctcacctgcctctccagtctcatctgcttctccagcctcattctcacaccctctattttgctcactctcttccagccacactggctttctttgcacatatttatggggtatggtgtgatatttccgtacatttatacaatatgtaatgrtcaaattagagtaattagcatatccatcacctcaaacatttatttcttagtggtgagaacatttaaaatcctctcttctggctattttgcaaggtacttaccactgtaccaccgacaccacctcttctagctatttggaaatatgcaatatattattgttaactatagtcactactgtgcaatggaacaccataatttattcctccttatctcttaattcttagctcaaatgtcattttctcagaaaagccttccctaactactctccccatacattcctttgtcacatagccatgtttt

SEQ ID NO: 4569 - DNA, 601 bp, Human
gatatttccgtacatttatacaatatgtaatgatcaaattagagtaattagcatatccatcacctcaaacatttatttcttagtggtgagaacatttaaaatcctctcttctggctattttgcaaggtacttaccactgtaccaccgacaccacctcttctagctatttggaaatatgcaatatattattgttaactatagtcactactgtgcaatggaacaccataatttattcctccttatctcttaattcttagctcaaatgtcattttctcagaaaagccttccctaactactctcsccatacattcctttgtcacatagccatgttttatttccatcttcctgcttagaagtattgaaaaatactttgcttgaactttttaattgctgtcctcttttactcctcaatttgaatgtaaactccgtgaggttagatcctatctgtatatttattactgtcacctctggcacccaaaacaatgttggcacatagcacgttatcaggtaatgttcactgagtaaaaacaataaataaaagcatctattgttggtgaaaatcgtgtagtttccatcctataactgaacatgtttgatgata

SEQ ID NO: 4570 - DNA, 601 bp, Human
ttccgtacatttatacaatatgtaatgatcaaattagagtaattagcatatccatcacctcaaacatttatttcttagtggtgagaacatttaaaatcctctcttctggctattttgcaaggtacttaccactgtaccaccgacaccacctcttctagctatttggaaatatgcaatatattattgttaactatagtcactactgtgcaatggaacaccataatttattcctccttatctcttaattcttagctcaaatgtcattttctcagaaaagccttccctaactactctccccatmcattcctttgtcacatagccatgttttatttccatcttcctgcttagaagtattgaaaaatactttgcttgaactttttaattgctgtcctcttttactcctcaatttgaatgtaaactccgtgaggttagatcctatctgtatatttattactgtcacctctggcacccaaaacaatgttggcacatagcacgttatcaggtaatgttcactgagtaaaaacaataaataaaagcatctattgttggtgaaaatcgtgtagtttccatcctataactgaacatgtttgatgataaatta

SEQ ID NO: 4571 - DNA, 601 bp, Human
gtacatttatacaatatgtaatgatcaaattagagtaattagcatatccatcacctcaaacatttatttcttagtggtgagaacatttaaaatcctctcttctggctattttgcaaggtacttaccactgtaccaccgacaccacctcttctagctatttggaaatatgcaatatattattgttaactatagtcactactgtgcaatggaacaccataatttattcctccttatctcttaattcttagctcaaatgtcattttctcagaaaagccttccctaactactctccccatacatycctttgtcacatagccatgttttatttccatcttcctgcttagaagtattgaaaaatactttgcttgaactttttaattgctgtcctcttttactcctcaatttgaatgtaaactccgtgaggttagatcctatctgtatatttattactgtcacctctggcacccaaaacaatgttggcacatagcacgttatcaggtaatgttcactgagtaaaaacaataaataaaagcatctattgttggtgaaaatcgtgtagtttccatcctataactgaacatgtttgatgataaattattaa

SEQ ID NO: 4572 - DNA, 601 bp, Human
atttgaatgtaaactccgtgaggttagatcctatctgtatatttattactgtcacctctggcacccaaaacaatgttggcacatagcacgttatcaggtaatgttcactgagtaaaaacaataaataaaagcatctattgttggtgaaaatcgtgtagtttccatcctataactgaacatgtttgatgataaattattaaatccccttgattttacctctctgacaccacccttgctgaattgttccctatcttatatttggctaaaaaacttacagagtaaggcaaaactatggagacattaaaaagattattatttgccagggcctttgagtgggtcagggagggatgaactggtggagcacaaaggatttttaaggcagtggaactattctgtatgaaactgtaatggcagatacatgtcattatacactagtcaacaacctatagaatgtacaacacaaagagtcaaccctaatgtcaactatggactttagctaataagaatgtatcaatagtggcttgtcaattgtagtaaatataccacactaatgcaaaatgtaaacagtagggaaaactgggaggtgggggtagagttagag

SEQ ID NO: 4573 - DNA, 601 bp, Human
ctataaataaataaataaataaatcccactatttattagtcattaaatatttgaaaatatttcctcctgagggttttaaaattcagtcttaaaagtcattttttttctctctctctttttgttttggaaacggagtctcactctgtcgcccagactggagtacagtggcgcgatctcagctcactgcaagctccgcctcctgggttcatgccattctcctgcctccgcctccccagtagctgggacaacaaacacccaccaccatgcccagctaattttttgtatttttagtagagacagrgtttcaccatgttagccaggatggtcttgatctcctgacctcgtgatctgcccgccttggcctcccaaagtgctgggattacaggtgtgagccaccgtgcccagccttaaaagtccttttaaattagtcttgcaattataattccattatagcaactgtgttggtatcaagaaatcaaaaatcaaatgtatttgtagcaaaatgggcctattgacgtggcagaatttcagaagaaagggaaggcacactctcccctgtcttagcacatcttacttaaagtatacgttttctgtctgcttc

SEQ ID NO: 4574 - DNA, 601 bp, Human
aataaataaataaataaatcccactatttattagtcattaaatatttgaaaatatttcctcctgagggttttaaaattcagtcttaaaagtcattttttttctctctctctttttgttttggaaacggagtctcactctgtcgcccagactggagtacagtggcgcgatctcagctcactgcaagctccgcctcctgggttcatgccattctcctgcctccgcctccccagtagctgggacaacaaacacccaccaccatgcccagctaattttttgtatttttagtagagacagggtttyaccatgttagccaggatggtcttgatctcctgacctcgtgatctgcccgccttggcctcccaaagtgctgggattacaggtgtgagccaccgtgcccagccttaaaagtccttttaaattagtcttgcaattataattccattatagcaactgtgttggtatcaagaaatcaaaaatcaaatgtatttgtagcaaaatgggcctattgacgtggcagaatttcagaagaaagggaaggcacactctcccctgtcttagcacatcttacttaaagtatacgttttctgtctgcttcctggg

SEQ ID NO: 4575 - DNA, 601 bp, Human
cacccaccaccatgcccagctaattttttgtatttttagtagagacagggtttcaccatgttagccaggatggtcttgatctcctgacctcgtgatctgcccgccttggcctcccaaagtgctgggattacaggtgtgagccaccgtgcccagccttaaaagtccttttaaattagtcttgcaattataattccattatagcaactgtgttggtatcaagaaatcaaaaatcaaatgtatttgtagcaaaatgggcctattgacgtggcagaatttcagaagaaagggaaggcacactctcccctgtcttagcacatcttacttaaagtatacgttttctgtctgcttcctgggacttgaaatttcaaaattacaaccagttccctagggttaagactttttatcttttttaaaatgcagcaacatccctgtgagtaataacacactgggttatcagtaattcattcttactttcgagtaaatttagcagatcctgttctacaagcaggttttaacctgggagaagcgagagatggtaatgacagagggttcaccaagtctgggtaaggtgaaggtggggttgctcaaagaattgcaattt

SEQ ID NO: 4576 - DNA, 601 bp, Human
caccaccatgcccagctaattttttgtatttttagtagagacagggtttcaccatgttagccaggatggtcttgatctcctgacctcgtgatctgcccgccttggcctcccaaagtgctgggattacaggtgtgagccaccgtgcccagccttaaaagtccttttaaattagtcttgcaattataattccattatagcaactgtgttggtatcaagaaatcaaaaatcaaatgtatttgtagcaaaatgggcctattgacgtggcagaatttcagaagaaagggaaggcacactctcccctgtcttagcacatcttacttaaagtatacgttttctgtctgcttcctgggacttgaaatttcaaaattacaaccagttccctagggttaagactttttatcttttttaaaatgcagcaacatccctgtgagtaataacacactgggttatcagtaattcattcttactttcgagtaaatttagcagatcctgttctacaagcaggttttaacctgggagaagcgagagatggtaatgacagagggttcaccaagtctgggtaaggtgaaggtggggttgctcaaagaattgcaatttgctt

SEQ ID NO: 4577 - DNA, 601 bp, Human
accgtgcccagccttaaaagtccttttaaattagtcttgcaattataattccattatagcaactgtgttggtatcaagaaatcaaaaatcaaatgtatttgtagcaaaatgggcctattgacgtggcagaatttcagaagaaagggaaggcacactctcccctgtcttagcacatcttacttaaagtatacgttttctgtctgcttcctgggacttgaaatttcaaaattacaaccagttccctagggttaagactttttatcttttttaaaatgcagcaacatccctgtgagtaataacrcactgggttatcagtaattcattcttactttcgagtaaatttagcagatcctgttctacaagcaggttttaacctgggagaagcgagagatggtaatgacagagggttcaccaagtctgggtaaggtgaaggtggggttgctcaaagaattgcaatttgcttacgggcagccctgtttactgttaccattaatactctcaataggatgttgccatgtaaatgcctatctagtattttgtgcaactgaagcagagatgactttgctgatataaaacgtgtcacggctggaggtgggaagtg

SEQ ID NO: 4578 - DNA, 601 bp, Human
tcagaagaaagggaaggcacactctcccctgtcttagcacatcttacttaaagtatacgttttctgtctgcttcctgggacttgaaatttcaaaattacaaccagttccctagggttaagactttttatcttttttaaaatgcagcaacatccctgtgagtaataacacactgggttatcagtaattcattcttactttcgagtaaatttagcagatcctgttctacaagcaggttttaacctgggagaagcgagagatggtaatgacagagggttcaccaagtctgggtaaggtgaaggyggggttgctcaaagaattgcaatttgcttacgggcagccctgtttactgttaccattaatactctcaataggatgttgccatgtaaatgcctatctagtattttgtgcaactgaagcagagatgactttgctgatataaaacgtgtcacggctggaggtgggaagtgtacagcttctaaaacagcactagagggaactgggagcactatcaatcaataactctggcaagtagaaaaggctctaaaagtcgaaggtagaatggatgcctctttcgcaggctaaatacacaaagagaagagc

SEQ ID NO: 4579 - DNA, 601 bp, Human
caaccagttccctagggttaagactttttatcttttttaaaatgcagcaacatccctgtgagtaataacacactgggttatcagtaattcattcttactttcgagtaaatttagcagatcctgttctacaagcaggttttaacctgggagaagcgagagatggtaatgacagagggttcaccaagtctgggtaaggtgaaggtggggttgctcaaagaattgcaatttgcttacgggcagccctgtttactgttaccattaatactctcaataggatgttgccatgtaaatgcctatctartattttgtgcaactgaagcagagatgactttgctgatataaaacgtgtcacggctggaggtgggaagtgtacagcttctaaaacagcactagagggaactgggagcactatcaatcaataactctggcaagtagaaaaggctctaaaagtcgaaggtagaatggatgcctctttcgcaggctaaatacacaaagagaagagctgttggcattggattgttcaccacagtgccatttcagtggccctctgctcatcaggaaagttttccagaaactgtccctggagcttaatttgaaatca

SEQ ID NO: 4580 - DNA, 601 bp, Human
agcaagtatttcaggttggcttttttttgtggaattttgtccatgcatactcaaagctggctttgcattcttgaatcctcaggctttgtaacacttttggttaaaggtagtaaggtagtcaaattggcctgaaaattctggagaaggtttactaaggctactcatctggatattttatgaaggagttaaatcgtaatgacagctggataaaaacaaatatttctaatgactactcaaggtatagctgacaactgtttggggaacaaaacaacaagagaaaaaaaatgatctgtttatgccaaaagggccccctgaagtagattttgtcaccattgtgaatgtggagacaaacgtcctctgacttgctgtgtgcaagttcacttgtcctgcgccattacaaatcaggcttgcaaatgtgatgcattagtcccaggacagagagctctgttgcatacaccaaaggcagtggacttccagtgaacttgcaaatattctgactttacacttgtttctgtatgaccgagagttgaccacactgacaggcttgattgcttaaaaacaacatgccaatctattagcaatgcttttatttgtttcattt

SEQ ID NO: 4581 - DNA, 601 bp, Human
ggcttgcaaatgtgatgcattagtcccaggacagagagctctgttgcatacaccaaaggcagtggacttccagtgaacttgcaaatattctgactttacacttgtttctgtatgaccgagagttgaccacactgacaggcttgattgcttaaaaacaacatgccaatctattagcaatgcttttatttgtttcattttaaatatttaaggaacttgagaatgaaaggaaataatcttcattctagttagcaaatatatatgtaagagcaatctgatttacaaatgtaccaagtttaataaragtcatcttgttttaaatgatctgaaaagatgagccactgcagaaccatagaatcgaaacctagtttttttgcttagaaggaaagtaagagctagaggaattattccagtgttctgaaaaggagaggacaaaaaaagtctagagtagattagctttttattgactcacattttctcaagcaatagcttctccaaagttcctaactccttcctgaaaaaacagaggactcaagtaaatacatttcttcctatgtttcatatgaaaaaatgtttatcatgattgatgcatgttgtgaattag

SEQ ID NO: 4582 - DNA, 601 bp, Human
atacaccaaaggcagtggacttccagtgaacttgcaaatattctgactttacacttgtttctgtatgaccgagagttgaccacactgacaggcttgattgcttaaaaacaacatgccaatctattagcaatgcttttatttgtttcattttaaatatttaaggaacttgagaatgaaaggaaataatcttcattctagttagcaaatatatatgtaagagcaatctgatttacaaatgtaccaagtttaataaaagtcatcttgttttaaatgatctgaaaagatgagccactgcagaacyatagaatcgaaacctagtttttttgcttagaaggaaagtaagagctagaggaattattccagtgttctgaaaaggagaggacaaaaaaagtctagagtagattagctttttattgactcacattttctcaagcaatagcttctccaaagttcctaactccttcctgaaaaaacagaggactcaagtaaatacatttcttcctatgtttcatatgaaaaaatgtttatcatgattgatgcatgttgtgaattagacttggagggaaaagcagtcatggcaaaatttattttcatgatgctt

SEQ ID NO: 4583 - DNA, 601 bp, Human
caggggtaatcctattaaaagctttatgcttatttttcagtacttaatttgaaagagaattaagagcatacaaaattacagaaaaatgaggaagcctaggaaaaataagagtggagaaatctagagacaaaaagagagatgggagttcaaaaagataattacaagtttgagaagtggtcagtaataaataaaatgttttattgcacacacatatgtgggtagcagacagagagaagaaataagtatcacaaaagcaaaacggggaaaaaagtgattatgtaaatggatggatgcatctggsaatacaaagctgaataagattgagtccctgctctactggaattacaatttactggagaagtaacaagatggaaataatataggtaaagaataaatcataagatagaaaataaaaaaattccatgaacagatttaaaaaaatagaatgttttgggaatatggggagtgagaaggagacagaaggggaaatcaggaaactaatagaggagagggcactgaagtgagctttgaggcctggcaggattttgatcagggcagatggcttaagaaagtttccctaatagaaagaaatgtgtgggag

SEQ ID NO: 4584 - DNA, 601 bp, Human
agtgggacttcaagcccacctttgagtgctgcttgagagaattcggagaagataggagatacttcatttttttggtgggagtggggtgggggagagacagggaggataaaatggagcagataatatttttaaaggtgactttgctgcctctggaaggataaaaaaccctattctggttctcattgctattatgttccaataccacttgccttgatattgcagtaatctttgatgttaagggagtggaattaggtatttatgaatatgacctgggacataaggaatgtatatacatttattygacagctacttatttggtgcccactgtgtgccaagcatgttacacaagagagtaatcataaggaaggtgacactagcctcagtgttaggatggatgggggttggaacagagcttatccttctccctcccatctgttgtggtgagactatggcttacttttactggaggtatcatgtgggtctctctgtatgtcgtcttcccaatgagccagttcaaggattctgacaaccacctttttgatgtttattttgtaacagatgattcaagagagccggtttctcatagaaatggcggacacag

SEQ ID NO: 4585 - DNA, 601 bp, Human; identical to SEQ ID NO: 3398

SEQ ID NO: 4586 - DNA, 601 bp, Human
tttattgaagctgagatggttgtaggtgtgcagcattatttctgagctctctattctgttccattggtctatatgtctgtttttgtaccaatgccatgctgttttgattactgtagccttgtagtatcgtttgaagttgggtcaagtgatggcttcaggaatgtgtggcttgatctctaggttcatactctaggagatggggagctgcatactggaattaacatggtttttgccttaataaggcaatgaggttttcggtgcaggcagggtacagcccatgtgtgagattaatttgcctggggtgtgtgtgtgtgtgtgtgtgtgtgtgtgtgtgtgtgtgtttactcacatgaatacttacgttcaagtcaatatggctgttcttgtttgtggaaagaataatgacaaatgcttctggggaagattccaacacaaatgattttgaagagacaaagtacaaaatatctagggccattgaggatttttattttaagaacagttcctataaatacatttctttttgcaaataactttggaagtcattttcttgagattatgatttgctctctgctgcacatgaattttagaattttgaagtaaa

SEQ ID NO: 4587 - DNA, 601 bp, Human
ttgaagctgagatggttgtaggtgtgcagcattatttctgagctctctattctgttccattggtctatatgtctgtttttgtaccaatgccatgctgttttgattactgtagccttgtagtatcgtttgaagttgggtcaagtgatggcttcaggaatgtgtggcttgatctctaggttcatactctaggagatggggagctgcatactggaattaacatggtttttgccttaataaggcaatgaggttttcggtgcaggcagggtacagcccatgtgtgagattaatttgcctggtgtgtgtgtgtgtgtgtgtgtgtgtgtgtgtgtgtgtgtgtttactcacatgaatacttacgttcaagtcaatatggctgttcttgtttgtggaaagaataatgacaaatgcttctggggaagattccaacacaaatgattttgaagagacaaagtacaaaatatctagggccattgaggatttttattttaagaacagttcctataaatacatttctttttgcaaataactttggaagtcattttcttgagattatgatttgctctctgctgcacatgaattttagaattttgaagtaaatatg

SEQ ID NO: 4588 - DNA, 601 bp, Human
cctgggctctgttggagactttttattccagtggtgctgctctaagaagatatctttttctatacgattcttcctttagttcttatgcattagatctgaaacacttgattcccaattaattctccagacttgctattgattttcagagctcctctaagtattttaataaatgctctttgtttataagtttagtagattcaatttaccttgcttccagttggttgaatgattaataaccatcctggaaagacataatcactgaattaggaggctgtggtacaattctgcgttgcctactgaraaagtttccttatacatgatttagactagtattccctactatctagagagagggagtgggaattaaccaattctggttaaatgtgttggtttgtatttctaaaaatatttaattccagtgtaatttccaataagtaaggaaggagctggaaaaaaatgagaaatgtgccctcagcaagttgggggattgacagcatggagtggtgcaaaggggcattggctttagagtaaattgagctgagactgaaaaataaattgtttagtgttttctgcagttcaatattacatttatctgatatta

SEQ ID NO: 4589 - DNA, 601 bp, Human
tgagggtcttattccagtggcagccagtttagtctcgctcaacctagtaagccctcaactcacttggaatcttagccagctgctttacaatggatatcattgattaccaggaagaaggtgggtggcagaagggagagaatggatggatcacttctagaaaaacagcttgaatctcatatgtcagtaccattatttttatacacaaaagaaaatattattaagccttataaagtgtagagtatacatttagaaggcatagcatctatctgggggttataaactaagtttgatatatttatcygtggacgaggtatctgaaaagatactcctagacacatttgtagaatcttgttattgtttggctaattagtgcaaaataaagacccttctctcccacctcaagaaggtgatgttatttccacactgacatttataaataaggaagtgcaatgcataaatgaggcttataatccataaattagcaaacaataatttaacaaatttttatttcattttatttttggtgaaaccaaatttattaattcaacaaatgtatctgttacgtctttactaggtgacaggctttgtgcttgggaatgta

SEQ ID NO: 4590 - DNA, 601 bp, Human
gcctaattaaagtttggccaagtccaggtagtaggtatcaatattttctccagattggttagtggacacaaacagacaaacagttcagctagtcatttatgaggcaagaaagggaatttgaaaggtctgtgtctggccatgtcacagataaacaagggagattccatgagtcttagccaagtcctatggggaagaggggttctttgcagtaagtaaggtcttttgaggaacacaaaaggatgaggggatttcttaaccatccctgatttcctggaacacagggctcagataaagttgagcrttgtcaacatatgcatttatatattgtattatgctgctaataaagatatacctgagactggttactttataaaagaaagaggtttaatggactcacagttccacatggctggggtagcctcacaatcatggcagaagacggaagaagagcaaaggaatgtgttacatggtggcaggcaagagagcttgtgcagtggaactccatttataaaaccatcaggtctcgtgagacttattcactaccactagaacagtatgggggaaaccacccccatgattcaattatttctgtttggccccg

SEQ ID NO: 4591 - DNA, 601 bp, Human
aagtcattttaactggggtgagatgatatctcattgtagttttgttttgcatttctctgatgatcagtgttgttgaatacctttccatatgcctgtttgccatttgtcttcttttgagaaatgtcttttcagatcttttgcccagtttttaatcagattattagagtttttcctacagaattgtttgagctccttatgtattccgattattaatcccttgtcagataggtagtttgcaaatattttcttccattctatagtttgtctcttcacttttgggttgttgcctttgctgtgcagraactttttaacttgatgtgatttcagttgtccagttttgctttggtttcttgtgcttgtggggtattacttaagacacatttccccagacaaatgttctggagagtttccccaatgttttcttgtagtagtttcatagtttgagggcttatatttaattcattttgatttgatttttgtaaatggtgagagatagggatctagtttcattcttttgaatatggacatccagttttcccagcaccattattgaagagactgtctcttccccattgtatgttcgtggcacctttgtcgaaaa

SEQ ID NO: 4592 - DNA, 601 bp, Human
tgggtaacctggtgagaccccagctctacaaaaaatacaaaaattagctgggcatggtggcacatatctatagtctcagcttcttgggaggctgaggagagagtcgcttgagtcttggagggtgaggctgcagtgagacatgattgcacctctgcacatcggcctgtgtgacagagtgagaccctgtctcaaacaacaacaacaagatagagccatttactaagcagattggcaggtgagggacgctggttttagctagtacagtgaatgagtgtgtgagtgtgtgtgtgtgtgtgtgtgkggggggtgtattcttagtcccttttacactgacagttgaaaaactgacctttgcccttctctctcccatgttatttctgatgttagtaggcagtttgtagcacagcaggatggaagagttgcaaagggaattgtctatggggtgaaccttttcaattgcccttccatccacataccctctttactgtgaataatcataaatgcataatgataacattttccacatgctaaatcatgctaatgacccctaccaagtagaggaaagaatgttgtcttataataccaacagattatttaaacc

SEQ ID NO: 4593 - DNA, 601 bp, Human
tggggggtgtattcttagtcccttttacactgacagttgaaaaactgacctttgcccttctctctcccatgttatttctgatgttagtaggcagtttgtagcacagcaggatggaagagttgcaaagggaattgtctatggggtgaaccttttcaattgcccttccatccacataccctctttactgtgaataatcataaatgcataatgataacattttccacatgctaaatcatgctaatgacccctaccaagtagaggaaagaatgttgtcttataataccaacagattatttaaacytgagagctttacatcatgttagattaagttgtgtatattaaaattttccaaacagtaagtataaagatactgtcttatacatataagaggtatggctattttaacatattttttaaattatatgaaataaactttattggacatagttttacgttaccattttttctctctttcaccaaattgtgaaagcaaatagctagatatgctttctccctttgaagaggcatgacagtttcaggttttgctaagaaagatagtttccatctgaaaatgtgtgtacatagtgtttacttctaattt

SEQ ID NO: 4594 - DNA, 601 bp, Human
taatgataacattttccacatgctaaatcatgctaatgacccctaccaagtagaggaaagaatgttgtcttataataccaacagattatttaaacctgagagctttacatcatgttagattaagttgtgtatattaaaattttccaaacagtaagtataaagatactgtcttatacatataagaggtatggctattttaacatattttttaaattatatgaaataaactttattggacatagttttacgttaccattttttctctctttcaccaaattgtgaaagcaaatagctagatatrctttctccctttgaagaggcatgacagtttcaggttttgctaagaaagatagtttccatctgaaaatgtgtgtacatagtgtttacttctaatttaaatgcctatttacacaggttggggatacaccaatgttttttgatgatgtggtaagttttcaaaatctatttgaggtcatttttatatgcttagaatgacttaggtgcaaatctacatggaagcagaggaataaaccacatggttttagaagccatttctgatcattggagcacaagctttttgtggacagcaggcactccctac

SEQ ID NO: 4595 - DNA, 601 bp, Human
tgctccctgggagcccccatcctgttgttttcacactgcatggggcactgttatctgtacttcaggtgtttgctcaggtacggagtcttcaggatgccttcatggacacctcaccttctcctgcctcccatcttcaacagagttaggtatccctgtacgtattcccacagaactctgctattccactatcatagcactttaattgcttttttatctttcacgagacagtctctattattgtaagcaattaggtgatgaattttaacatagcaattttaacctgagccccaattaataaacmgtagacatttagcatatgaggtcaaatcaaagaacgtctcgtcaaatccccatgttttggagaaaaggaaactgctgcccacaggagttagggacatttccaaagtcacaaagtcaattcataacttattaatcattcttcccactgcagacatcagccataacccctattctttctatccttttgactgattctggttttctctgcaagaagcttgaaagccttagccaggacatggtttaaactctattttgccttggttatcaagcaatcaaatggtgtggttaaaattgtagcaag

SEQ ID NO: 4596 - DNA, 601 bp, Human
ctgaaattggagccagtctcagattagagaaaataggtcttgactttccttgcagtaacattaatctggtgtttaaatgaatgctttgctgaatctggggcaccgagagtgaatatctcattaatgaccaaatctccaaaccagtcattgtggaggaagctgagttggccacatccttgatttaactaagaagtagcatgttttattttatagctgccttagcctcattcattaaaacctgactcattgggcggagggtggaagaagttgcccctttagaaatatcttgctaataactctktggccacttcagctaacacagaacctggaactcatgccagcatagaagggtggctacaaggctatgggatgggccagccgtacacatgccatgattcactctcaaagaggacaatttcagcctctttaaaagcattatgatttagcagagaataaagaataaatgtccttggtaaaaggacatatctagaccagatgtagtacaactgtcattggctgtagggaatgccatgcacgtagaaggcagggtgaattgtgcccttggaattgtgtaacacgggacagatgtcatgaaaaacaa

SEQ ID NO: 4597 - DNA, 601 bp, Human
aaataagcttttgagaggggaggatgatgccttttgggatcccccaaggaaagttgccacattaatgcaattgtcatttttattttaaacatggggtctttttttggactaatgagtaatgcaatcctggcttttattgtcgcattttattctctccactttgtcaacttgtctttttaagtttcaagatgtttttgtttcctcacatttttatgaggcaaaggacagtggacttatctacaacattgttatttctgtttatataatagaataataattgctaacgatcattagagttttycatgtatggcaggcattgttctaaagaatttagaggtattatctctcttaatctcacaaaaaatctatgaggtgagtacaattattatagccattttatggatgaggaaactgaggcacccagtgatcttgcccaaggtcaaaaagctagtaagtcttggagccaggatttgagcccaggtacagtaagagtggagcttatgctgtaaattcacttataagaatggcaatatggttacgattcaaagtctctagtctagagactagagactagtctagattgttattctaagagagaaat

SEQ ID NO: 4598 - DNA, 601 bp, Human
ttgggatcccccaaggaaagttgccacattaatgcaattgtcatttttattttaaacatggggtctttttttggactaatgagtaatgcaatcctggcttttattgtcgcattttattctctccactttgtcaacttgtctttttaagtttcaagatgtttttgtttcctcacatttttatgaggcaaaggacagtggacttatctacaacattgttatttctgtttatataatagaataataattgctaacgatcattagagttttccatgtatggcaggcattgttctaaagaatttakaggtattatctctcttaatctcacaaaaaatctatgaggtgagtacaattattatagccattttatggatgaggaaactgaggcacccagtgatcttgcccaaggtcaaaaagctagtaagtcttggagccaggatttgagcccaggtacagtaagagtggagcttatgctgtaaattcacttataagaatggcaatatggttacgattcaaagtctctagtctagagactagagactagtctagattgttattctaagagagaaatgaggaatccttagaatcagatttattccttcat

SEQ ID NO: 4599 - DNA, 601 bp, Human
acaaagacgtttagagggagatctggtataagctggctggttaagagaagtttgggggtgtttgtgacagagtagagagaaagagattgctagatgattagggaaaattgctgcatataaaatgggaaaaaagtcagcatgccaagggaaaatgccagggtggtggttgttaacaatcaaattcaccttctacaattttcaccagaatgtgtcttttctgattctggtgccttgattcggaagacccaaagaagagatgcaggttgtgattcctggaaccacagaacagaaagatgactgytattcctccttcataaaaaaagagaaaacagaagtttatatcatgtttcaatgtacactcttcacaacacagcctttcagttttgcttcttttattagttaatagtttacctatttttttttttcttgcctatatggtacagccagtgtgtgttgtctccagggttatcaggagatgatgtagttgtgttagttatgcactggtacaaactgtttcctcccattggccattgttttctacagagactgacttctatttaccagaaatggcacagtctggcatttggatgccacctcttag

SEQ ID NO: 4600 - DNA, 601 bp, Human
atgacattctggattattaaaatatgtttcatgccatgctgtgggaaaaggggatgtgagaattttatgcgttagtaggataaaatgatgtttttgtacgtttcactgttctcttgcaattaggaaagttgccagttttgctactgctatgcttttaaaattcttgatgaaactttcaaaactaaatgaaaagggaacacttaaaagtaatactctgaaaatgaaggaggatatagtctcattactaatagattttttataaatggaaagattcctttaaaaatatagtagtacatatacwttatacatatctctgtaaaacagactctggtagatgcattttaaatgttagtcaaatttttaataaaatatagatagtaccaagatacttattatatatagtagcagataatgttaaccactttctaaatcaccttatatcattgtgattcctatacttatgatcatttaaatcataaagagctcttcaacatattgtctttaatcttagaactgtaaggaaggctgaaggatattttcatcatttttgcagaagagaaaatggcccagataaaaattggttgaagatgctccaaccctc

SEQ ID NO: 4601 - DNA, 601 bp, Human
tgccctgcagagagtgcctgctttgctgttaaaagatgcctatcaggtagtggttaaaaccacagaccccggagccagctgctggattttaagctccagctctaccacttagcagctgtatgactttgggaagggtgactgtgctctgggcctcagtttttttaatcagtaaattgagaataatgaaagtacccatctcatagggatgttgtaatgaatgattgaatgaacatgtataaagcacaaagagtgaccacactgagcaagcacttcatatgttggtctgttattattattactsaagagttgcacttttcaaagtggatgtgacttcacttttttttttaaatttatgttctgggatacatgtgcagaatgtgcagttttgttgagcagactcattcgtgatgtctatagtgttaagaacagacttcccaaagtctgctggtgtagtaaatattttttctttagaaaatacatctctcactgacagagtctttaggctctaatctctagtctttagtctcagactagattgtaaacatggtgtggggaatagagcattgatgcaggaggccaaaggcctgaactttagtcccag

SEQ ID NO: 4602 - DNA, 601 bp, Human
ttccaaaatcccataccataattgatgtacttgagaagaagttcgctttaacacaaacatcaggcaaagcccaactatttaatcatcccatataattaaaagctgctattagaaggatttagctattttttacagaggatagaattggcaagtgcatatttaggttttgagaaataaaatattccaagcttttgtaaaatacaagtttcttcatacaccctaaggaaaaagcatttactggcctttcataaaataggtaaattatcctttctctgagcctctgctttgtagaataatgctmcagcaatcgtcataaccccatatccacccatattgtcctttcaaggtcacactttcaggcactgccatgagaatggagaggagagggaagaagctacttcttcctctgtctatgggccatagacacctgtccctgcttccccacactcagtcattcagcccttgggccagtatcagtatacgcactttatcttcataacagtgaactaaaataagaaataaaaatagcaggaaaagatctctgttgggcactgatgtaaatgacagctaatgtgttcctgcaatcctcatttcctttttg

SEQ ID NO: 4603 - DNA, 601 bp, Human; identical to SEQ ID NO: 3349

SEQ ID NO: 4604 - DNA, 601 bp, Human; identical to SEQ ID NO: 3350

SEQ ID NO: 4605 - DNA, 601 bp, Human; identical to SEQ ID NO: 3351

SEQ ID NO: 4606 - DNA, 601 bp, Human; identical to SEQ ID NO: 3352

SEQ ID NO: 4607 - DNA, 601 bp, Human; identical to SEQ ID NO: 3353

SEQ ID NO: 4608 - DNA, 601 bp, Human; identical to SEQ ID NO: 3354

SEQ ID NO: 4609 - DNA, 601 bp, Human; identical to SEQ ID NO: 3355

SEQ ID NO: 4610 - DNA, 601 bp, Human; identical to SEQ ID NO: 3356

SEQ ID NO: 4611 - DNA, 601 bp, Human; identical to SEQ ID NO: 3357

SEQ ID NO: 4612 - DNA, 601 bp, Human; identical to SEQ ID NO: 3358

SEQ ID NO: 4613 - DNA, 601 bp, Human; identical to SEQ ID NO: 3359

SEQ ID NO: 4614 - DNA, 601 bp, Human; identical to SEQ ID NO: 3360

SEQ ID NO: 4615 - DNA, 601 bp, Human; identical to SEQ ID NO: 3361

SEQ ID NO: 4616 - DNA, 601 bp, Human; identical to SEQ ID NO: 3362

SEQ ID NO: 4617 - DNA, 601 bp, Human; identical to SEQ ID NO: 3363

SEQ ID NO: 4618 - DNA, 601 bp, Human; identical to SEQ ID NO: 3364

SEQ ID NO: 4619 - DNA, 601 bp, Human; identical to SEQ ID NO: 3365

SEQ ID NO: 4620 - DNA, 601 bp, Human; identical to SEQ ID NO: 3366

SEQ ID NO: 4621 - DNA, 601 bp, Human; identical to SEQ ID NO: 3367

SEQ ID NO: 4622 - DNA, 601 bp, Human; identical to SEQ ID NO: 3368

SEQ ID NO: 4623 - DNA, 601 bp, Human; identical to SEQ ID NO: 3369

SEQ ID NO: 4624 - DNA, 601 bp, Human; identical to SEQ ID NO: 3370

SEQ ID NO: 4625 - DNA, 601 bp, Human; identical to SEQ ID NO: 3371

SEQ ID NO: 4626 - DNA, 601 bp, Human; identical to SEQ ID NO: 3372

SEQ ID NO: 4627 - DNA, 601 bp, Human; identical to SEQ ID NO: 3373

SEQ ID NO: 4628 - DNA, 601 bp, Human; identical to SEQ ID NO: 3374

SEQ ID NO: 4629 - DNA, 601 bp, Human; identical to SEQ ID NO: 3375

SEQ ID NO: 4630 - DNA, 601 bp, Human; identical to SEQ ID NO: 3376

SEQ ID NO: 4631 - DNA, 601 bp, Human; identical to SEQ ID NO: 3377

SEQ ID NO: 4632 - DNA, 601 bp, Human
ccgggcactctgcatcatcaggcttgtttaaaggaaactttaatcacagctggttcctaaattaaggtgtcacaaataatgactcaattaatatagttaagcatagtccatccatggactatcaatattcaaatagaacataataaaacatagaaatgattatcaaattacactaaaaagatggtctttatttggttattcaaatatgtttccagatctttcattactttggagttaccactgaaagcattatacacacactaactctcatttgggtaatagtctaaagttatacaattamactatccagtatagtatccactaaccacaggtggctttgaacacataaaatgtggctagtcagcgatgagagggctgtaatgtaaattacatactggcttttgaatacttagtataagaaaactcattaatttttatgatatatattgaaacaaacactttaaaattattgattacataatattttggatttattaggcgaaataaaattttaggttaaataaaattaattttatttttacttttttcatgtggctattataaaatttaaaatttccaatgggcttgtattatatttcta

SEQ ID NO: 4633 - DNA, 601 bp, Human
taggagatgctttcctgatatttatgcataaatgagtagaactttcactttcttttctagactaagtgttctatagttactgggccttcaagctgcctgcctgtccctctcttacaggaaagacccatctcaagttagtcaccattacccatatttagatttctttctggaaattttattaccttagccagcctcctggttcatattatataacctatttgaaagaatttaattagcattgcattattaaactaatgattacctaatcctcacttctacttgattcataggagttattagcttaacattaaatagcaaatatctcactgttgaaacttcaaatatgtttttcttgataactttttactttttcatttgcaatgtgctttaaattgtagcttatgaagctgagattgcagattggtcattttgaaaaatcatccctgaatgaaggctgttatacaattatgtagaaaatcaagacagagagcttcactaataaactatcaggttaccagaaagaagtttccttatttccagcagtttcccaaactttatgtcccaaaaggatgaggtttccacctaatttgagagatgaggc

SEQ ID NO: 4634 - DNA, 601 bp, Human
caccattacccatatttagatttctttctggaaattttattaccttagccagcctcctggttcatattatataacctatttgaaagaatttaattagcattgcattattaaactaatgattacctaatcctcacttctacttgattcataggagttattagcttaacattaaatagcaaatatctcactgttgaaacttcaaatatgtttttcttgataactttttactttttcatttgcaatgtgctttaaattgtagcttatgaagctgagattgcagattggtcattttgaaaaatcrtccctgaatgaaggctgttatacaattatgtagaaaatcaagacagagagcttcactaataaactatcaggttaccagaaagaagtttccttatttccagcagtttcccaaactttatgtcccaaaaggatgaggtttccacctaatttgagagatgaggctttctaaatgcactttagtttttgccttaagtttacttggtcactgagtgatatacccaatgacttgaaaatatatccccttggcaacagttctagggtcagatgctgaaatccgttgcacatgtgggtaatttatcca

SEQ ID NO: 4635 - DNA, 601 bp, Human
tgaacctgggcatacaaaagaaacatactccttgtcccaaaggctttaaagtttataagataggttattataggaaagtatggtgagatttaatctaggtaagacaataaagtgatgcattcctgaagaattggtgttcaagtgggggaactgaaaaataatcagaagttagccagaggaagaggctatggaaaagtttgccagaaagagcaaactgtgtgtataaagaccctgaagtctttgagagcacgatgcttttgaagaactaaaaattgtgtacagttgcactatggagtgtgarctaaactgtaggttagagaggcaggcaggaattacttctgatacaactctaagtatgaatttaccctaggatatttaaaactggggagtgacatgatcagatttgtgtgtttgacagattctctggttgcaggttagtgaatgctttggagtaactgggtcaagactgaaggcaatgaggcagttgtaggaagattttgttataatttagactacagatgacaagtgtctgtacaaggacactggcaatagcagtggagaagaacatggagattctgaaggtatttaggagatagcactt

SEQ ID NO: 4636 - DNA, 601 bp, Human
ttgaagaactaaaaattgtgtacagttgcactatggagtgtgagctaaactgtaggttagagaggcaggcaggaattacttctgatacaactctaagtatgaatttaccctaggatatttaaaactggggagtgacatgatcagatttgtgtgtttgacagattctctggttgcaggttagtgaatgctttggagtaactgggtcaagactgaaggcaatgaggcagttgtaggaagattttgttataatttagactacagatgacaagtgtctgtacaaggacactggcaatagcagtgragaagaacatggagattctgaaggtatttaggagatagcacttggtaattattgaatgaaagagatgagtgagaatgttccaaagatgttactgaagtttctaatttgggctgtgacatggatgatgatccaatatactgaaaaagggaagagcagcaggttttctggcaaaatgatgagtttcgttggcttgagattcctgtgagacatagaagtaaaaatctagtgatcagttctatgatcagttccatgtatgggtgtggtagacagtagagaggtctgtactagcaaatcagaggt

SEQ ID NO: 4637 - DNA, 601 bp, Human
gcatggttaaagcccttgagtaactcagttgagatgatgggagagacaggtaaatggacaattaattatgagataatgtaataagcatgacaatagacaggtacatagtgatgagaagaaatgaatgggagaaggcttcctggaggagtgaaatctgagtagtggacccagttctgactggttttgaagagcacatgtaagggctcaataaatgtgaaataattttcatctttttcacatttgggcaaaatcccctgggatttgctgcacatttcagcctcattccaaagtgtctaggtcygccttgggttccaaagactcatatcaggtagttcagacagtaacacctgctcctgaaatagggagcttggaaatgactgtctttaaaagcagggatttttaattttgagattagctggaaacatcaaattagaatatggaagtggacatacaggtgacaggtctgggctcagtgtgcttgttctcagtttacctctgagaatttttaaaaatcatagaaaatcttttttatataaactatgtaaaacactataattcacaaaaatgttcagaaaatagattgtagacttagttctaaaaa

SEQ ID NO: 4638 - DNA, 601 bp, Human
agagcacatgtaagggctcaataaatgtgaaataattttcatctttttcacatttgggcaaaatcccctgggatttgctgcacatttcagcctcattccaaagtgtctaggtccgccttgggttccaaagactcatatcaggtagttcagacagtaacacctgctcctgaaatagggagcttggaaatgactgtctttaaaagcagggatttttaattttgagattagctggaaacatcaaattagaatatggaagtggacatacaggtgacaggtctgggctcagtgtgcttgttctcaktttacctctgagaatttttaaaaatcatagaaaatcttttttatataaactatgtaaaacactataattcacaaaaatgttcagaaaatagattgtagacttagttctaaaaaccccttttatgggactccttgtgtgcagtggattagacatgttcttttgacattatgccctgtgtagaaaatgctggtcaatgtgcaccatctgtttgtgaatcccttcaaggtctacctcaccacaataccagtctgttttcttgcggaagttttctagaagtcattagactacaatcattttgtc

SEQ ID NO: 4639 - DNA, 601 bp, Human
ttcctgggaaagctcttcctacatttattcttaagtaaacatctctttcttgtggcttctggagggctaattgttctcctatttctaagaatcattatttttagcctagaacaagaagaagggaagggcatgagccacactggaaataaagtcccaggactttggtgagactacatgggacacatcttaaaatagcctaatgatttagtggcccttttcccagagagctgagaggcactcatgtggagagaaagaagtttcagggaagtgatgttagtaagtgagaaagtgagtagtttgkggtgtgtgtaaacctcagtgtgagcctgggcagtgatgacattgtgatgttacctgatggagctaaaactaaaacaagaaggaggcaatgcagaatattaaatagataagagttcataatgcaagagtttgtctagtcttcacttagaaatttacaaaacagttcagctaagaaaccgataacaatacactatttttgcacataattttttggccattttcattaagctatttacatggtacattgtggttctaaactattgtctttttaatcttctgggtggctctctctagaataata

SEQ ID NO: 4640 - DNA, 601 bp, Human
tcccttcagtctagttctccaggaagccattaccagttagtgggggttgccatttattctatgtgtatgctgtcgagaaaaacattctctgcatttcacagtaacagtgttcctgaccatgagaaccacttagggcaggggtccccaatccctgggctgtggatgggtactggcccgtggcctggtaggaactgggctgcacagcaggaggtgagcagtggaccagtgagcattcccgcctgagctttgcctctgtcagatcagtggtggcattagattctcgtaggagtgcaaaccctaytacgaactgcacagccgtgggatctaggttgtgctttccttagcagaatctaatgccagatgatctgaggtggaacagtttcattccaaaccttactactgcccatggaaaaaattgtcttcacgaaaccagtccttggtgccaaaaagattgggaaccactgacctagggtaatcagggcctcacctggatctgctggagcagaatctccagaggaggagctcaaacattttcttcacttcagttgtgattaaaggttttgtttttcctgaatgacattttagaaaacgaaagtataaa

SEQ ID NO: 4641 - DNA, 601 bp, Human; identical to SEQ ID NO: 1409

SEQ ID NO: 4642 - DNA, 601 bp, Human; identical to SEQ ID NO: 1410

SEQ ID NO: 4643 - DNA, 601 bp, Human; identical to SEQ ID NO: 1411

SEQ ID NO: 4644 - DNA, 601 bp, Human; identical to SEQ ID NO: 1412

SEQ ID NO: 4645 - DNA, 601 bp, Human; identical to SEQ ID NO: 1413

SEQ ID NO: 4646 - DNA, 601 bp, Human; identical to SEQ ID NO: 1414

SEQ ID NO: 4647 - DNA, 601 bp, Human; identical to SEQ ID NO: 1415

SEQ ID NO: 4648 - DNA, 601 bp, Human; identical to SEQ ID NO: 1416

SEQ ID NO: 4649 - DNA, 601 bp, Human; identical to SEQ ID NO: 1417

SEQ ID NO: 4650 - DNA, 601 bp, Human; identical to SEQ ID NO: 1418

SEQ ID NO: 4651 - DNA, 601 bp, Human; identical to SEQ ID NO: 1419

SEQ ID NO: 4652 - DNA, 601 bp, Human; identical to SEQ ID NO: 1420

SEQ ID NO: 4653 - DNA, 601 bp, Human; identical to SEQ ID NO: 1421

SEQ ID NO: 4654 - DNA, 601 bp, Human; identical to SEQ ID NO: 1422

SEQ ID NO: 4655 - DNA, 601 bp, Human; identical to SEQ ID NO: 1423

SEQ ID NO: 4656 - DNA, 601 bp, Human; identical to SEQ ID NO: 1424

SEQ ID NO: 4657 - DNA, 601 bp, Human
cagaggactccctgcctgtctgttggttggacatggtttacttgtgtagatgtccctactggccattcactccattaatttgataggtatttattgagtacccacattgtgtcaaattctgtatataccagtgaataagacataaaaacatcactaccctcatggagcttatagtctactggggtgagaaaaaaataatatgataaaaatatacattttatagtattttggaagatacaggtgataaaggaaaaaggagggcagagtacagaaatgtgcagtgctgcagaaggagtgaagyggagaattttaaataggatactcagagtaggcttcattcagaaagtgacatctgagcaaagacgtgaagaaagtgaggaagttacccatgtagatatctagggcagttgttcttagttttagggtgtaatagcaacaacacctgtagggcttctgaaaacacaaattgctggcccccatctagaatccctgatttagtaggtctgcagtaagggctgagaatgtgcatttctgcaaagttcccagaggacccatactttgagaacagctggttcaggagaagagtattccagcgagaaaa

SEQ ID NO: 4658 - DNA, 601 bp, Human
caggtgataaaggaaaaaggagggcagagtacagaaatgtgcagtgctgcagaaggagtgaagcggagaattttaaataggatactcagagtaggcttcattcagaaagtgacatctgagcaaagacgtgaagaaagtgaggaagttacccatgtagatatctagggcagttgttcttagttttagggtgtaatagcaacaacacctgtagggcttctgaaaacacaaattgctggcccccatctagaatccctgatttagtaggtctgcagtaagggctgagaatgtgcatttctgcaamgttcccagaggacccatactttgagaacagctggttcaggagaagagtattccagcgagaaaagctgagtcaaaaggcctcaagaatgtacctggttattttaaagaacaatggggaggcaaggatggctagaaatgtaagcaaagggaagaatggtggaacaagagattatatagaacctgtggctttttctctgagagaaagggggatctataacagcattttggcagagaagtcacatgatctaacatacgtatacaaaggaacactctagctgctgtgttgtgaatagagtaggag

SEQ ID NO: 4659 - DNA, 601 bp, Human
gggaaacccaaactgtaacttgaagcagtttttagacatgttagagcagccatggtagtgaaacttcccttgaaattttgacagatgatatctcttggttgaacttgatggatccctgcatcaaaatatccactgatatttgagaggagaagaagggtgctacattgggataacaaaagaagcaatgagatttcctgtttgtctgcatttccaacaaagctagaaatactggcttagttgctgaacaaagaatgcctgtccccagagatattctgagagccagtgaattcagtggccttcrcatgttttattaaaatcatgacatcaatctacctgggtagattagttaattcttttctttgatttctcaaatttctgaattttagatttctgaaatgtgggtttattttgttatgtaaatctttaggtgacttctaaaactcatcttttttccatagtagtttcaggaaaacgtgtatttgattagtaaatacatttttttgtaattttttatttcatttgcttatattattgagcaatacatgcacatagtttaatgaaatgtcatttactccaaagaagaaattttttaacaatagca

SEQ ID NO: 4660 - DNA, 601 bp, Human
gtaatttcaggcatgtgctaatttgcatgcttgtgggcaccctattttatgtaattgtccataaaaatgtggcatggaatcttcattatttttaatatagatagcacatgcccatccaaattttaaaatgtaaacaaatctacttttttactcccaaatatttaattaatcacttcaagacatttttgatattacagcttttgtccttaggtggagctgttaaagttaaataagtgtgaatatctgtcaaatacagtttttgcaagagtgcatgtacattttatatattgtaagaaaagcrtaattaatagctaattaggataatgaaagtaatatacaacagatgtagagaagaccttgtggaaaattagtatgaattagatagcatgtgatttggtcaaagtaagcttgttgagaagaattaaaacagtggacatgtggagggacaatcagtggctgtctagctcctcctacacctagggaatgatttaatcaagtttgctattacttgaatactcagggcttcaagctgttccgttttcacaagtcgataacttgggatttggccttgatttgcagcattcctatacggtcaaagttt

SEQ ID NO: 4661 - DNA, 601 bp, Human
agtctgtgaccaattcatcaaattatctcctgcgtatagcaacaattctaataccaagaaaaacaaaaactgcatagattttctccacttgtttccgtgtaggtgggctatatgtggtgatgtgaactgctctctcatatcctgagatcatttctacttttaatttttgcagtgtctaaatcttattttatagatttctcatcgacatgtcttactttaggtttctcaattgaattctgttataaatcctcttaggttactttagtagtaaaatcttattagcttacccttttagataagsagaagtctgttttgttgagtaccctttgaaaatcacatttctgtctgcgtagtgcttgaacaggtgctttctaagagacactgtgttttatatgctacctgattttcatatacatttgccctgcagtaaccctgggggattgattccaggaccccacttggatacaaaaatccaaggatcctcaagtcccttatataaaattgtgccatatttgcacttaacctttgtaaatcctctcatatactttaaatcacctctaaattacttataacatgtaatacaatgtaaatgctatgtaaa

SEQ ID NO: 4662 - DNA, 601 bp, Human
ctctctcatatcctgagatcatttctacttttaatttttgcagtgtctaaatcttattttatagatttctcatcgacatgtcttactttaggtttctcaattgaattctgttataaatcctcttaggttactttagtagtaaaatcttattagcttacccttttagataagcagaagtctgttttgttgagtaccctttgaaaatcacatttctgtctgcgtagtgcttgaacaggtgctttctaagagacactgtgttttatatgctacctgattttcatatacatttgccctgcagtawccctgggggattgattccaggaccccacttggatacaaaaatccaaggatcctcaagtcccttatataaaattgtgccatatttgcacttaacctttgtaaatcctctcatatactttaaatcacctctaaattacttataacatgtaatacaatgtaaatgctatgtaaatacttgttatactgtattagttagggaataatgacaagaaaaaaaatctgtacatgttcagcactgatgcaaccatccattatttgccaactatttttgatccaaggtggctgaacccacagatgtgga

SEQ ID NO: 4663 - DNA, 601 bp, Human
tctcatatcctgagatcatttctacttttaatttttgcagtgtctaaatcttattttatagatttctcatcgacatgtcttactttaggtttctcaattgaattctgttataaatcctcttaggttactttagtagtaaaatcttattagcttacccttttagataagcagaagtctgttttgttgagtaccctttgaaaatcacatttctgtctgcgtagtgcttgaacaggtgctttctaagagacactgtgttttatatgctacctgattttcatatacatttgccctgcagtaaccmtgggggattgattccaggaccccacttggatacaaaaatccaaggatcctcaagtcccttatataaaattgtgccatatttgcacttaacctttgtaaatcctctcatatactttaaatcacctctaaattacttataacatgtaatacaatgtaaatgctatgtaaatacttgttatactgtattagttagggaataatgacaagaaaaaaaatctgtacatgttcagcactgatgcaaccatccattatttgccaactatttttgatccaaggtggctgaacccacagatgtggaacc

SEQ ID NO: 4664 - DNA, 601 bp, Human
ctacttttaatttttgcagtgtctaaatcttattttatagatttctcatcgacatgtcttactttaggtttctcaattgaattctgttataaatcctcttaggttactttagtagtaaaatcttattagcttacccttttagataagcagaagtctgttttgttgagtaccctttgaaaatcacatttctgtctgcgtagtgcttgaacaggtgctttctaagagacactgtgttttatatgctacctgattttcatatacatttgccctgcagtaaccctgggggattgattccaggacyccacttggatacaaaaatccaaggatcctcaagtcccttatataaaattgtgccatatttgcacttaacctttgtaaatcctctcatatactttaaatcacctctaaattacttataacatgtaatacaatgtaaatgctatgtaaatacttgttatactgtattagttagggaataatgacaagaaaaaaaatctgtacatgttcagcactgatgcaaccatccattatttgccaactatttttgatccaaggtggctgaacccacagatgtggaaccgatgggtacagagggctgact

SEQ ID NO: 4665 - DNA, 601 bp, Human
tgcgtagtgcttgaacaggtgctttctaagagacactgtgttttatatgctacctgattttcatatacatttgccctgcagtaaccctgggggattgattccaggaccccacttggatacaaaaatccaaggatcctcaagtcccttatataaaattgtgccatatttgcacttaacctttgtaaatcctctcatatactttaaatcacctctaaattacttataacatgtaatacaatgtaaatgctatgtaaatacttgttatactgtattagttagggaataatgacaagaaaaaaartctgtacatgttcagcactgatgcaaccatccattatttgccaactatttttgatccaaggtggctgaacccacagatgtggaaccgatgggtacagagggctgactctctttgttttcatagacttgagagtctaggacacttttactatctagtgaagtgcttacttaatcgaatgacaaatgctttcaaagatttttttttgtttatttcactgtgtgtaagcaaataattttgaaaataatgtggaatttttttaatgaggatagcaagtaatcaaatgaaaagaaaatcatttgt

SEQ ID NO: 4666 - DNA, 601 bp, Human
tttctgtgtaactggtaaataaattcaagagttctttgtgaagtataaaagcacaataaacttagaaaaaacaaaaacggctgggcgcggtggttcaagcctgtaatcccagcactttgggaggccgagtggggtggatcacttgaggtcaggaatttgagaccagccctaccaacatggtgaaacctggtctttactaaaaatacaaaaattagctggatgtggttgtgcatgcctgtaattccagctactcgggagactgaagtgggaggatcacttgaacccaggagagagagattgyagtgagctgaaatcacgccactgccctcaagcctgggtgacagagcaagactgactcaaaaacgaaaaataaataaataaataaataaaaactttaacaactaataagaaaatcagtgaagcgaccagtgtatacaattagatgtacaaaacaaatacttttcctatataccattcagtatctgttagaaaagataatagaaaagttccataaagaaagaaaagggctgggtatggtggctcacacctgtaatcccagctctttgggaggccaaaactggaggagcccttgagcccagga

SEQ ID NO: 4667 - DNA, 601 bp, Human; identical to SEQ ID NO: 1425

SEQ ID NO: 4668 - DNA, 601 bp, Human
tctaaattcatagaaggggaaacagagtaaaaaggaaatagatatgtgttttagaatagcatctaacacatagcaaagactggataaatgttggttgctgtcgttattttataatggcaaataaaccactgcaattttgtatcatatctggatcccctatattcaaatcattttgcatatcaaaaagatgatgtgaaaacaaggaccagagagagagaatgaacacttcaggttgaggattgatcatagaaggcaagtgaaagaagggaagaagatgcatcagtgacggggcagggaaacrgggaactatttttgggagattgggatataaatggagcagctttaatctggggcatgttgaatttggagggacttttctatgtggcattccacttgaaaatctagttcaggattatgtttggaagttcctccatatattagtgacttgtgagatggcccaagggatagaaatgtgaatttcacagaggaaaaaaattacagatcaaatcttggaggacagttttattcaaggagattaaaaagaatggggagtccctgtaggagactgagaaggcatcttcaaggaattaaagagaaccaa

SEQ ID NO: 4669 - DNA, 601 bp, Human
atcttggaggacagttttattcaaggagattaaaaagaatggggagtccctgtaggagactgagaaggcatcttcaaggaattaaagagaaccaagtccctggtgaaatagccaatggagaatataaaaagggagacttaatattgtaaaatttataaaaagatcagatagcgtaatgtctaaaggtcatggaagttggcatttattaataaaatgtgacgggtggtgaaaaaatgggtatcactggcaaatgttaagatagaactctcagtgcagaagtagccaaatgacaggattagtrattaaagaaaggagagtatactgggaacaagtaggttcaagtgaggtatttttatgtatttatcaaatgttgttatttgttcaattattagaagatgtaaatgtgagtgccagaggcagggaaaagaataaattggagggagacatcttcaacttaacttccagcacatgcttttcagtccatacttgaattccactctgaagcatttcactgttcacttcctcttttgaacgtcttatcctttaattttcatgatactatcctactcccattgtcttagtagttatttagccctttctt

SEQ ID NO: 4670 - DNA, 601 bp, Human
aatgtctaaaggtcatggaagttggcatttattaataaaatgtgacgggtggtgaaaaaatgggtatcactggcaaatgttaagatagaactctcagtgcagaagtagccaaatgacaggattagtgattaaagaaaggagagtatactgggaacaagtaggttcaagtgaggtatttttatgtatttatcaaatgttgttatttgttcaattattagaagatgtaaatgtgagtgccagaggcagggaaaagaataaattggagggagacatcttcaacttaacttccagcacatgcttwtcagtccatacttgaattccactctgaagcatttcactgttcacttcctcttttgaacgtcttatcctttaattttcatgatactatcctactcccattgtcttagtagttatttagccctttcttttcagctgtttttgatggatctttgggtttggcaccctaaatggtcctccctcagccctttctctcactaccacattcaaccttggtagtcttgctcataactgcaatttcaactggcatgcctacactgctgatgcctaaaccagtgtctcttgagtttcacacccacctaca

SEQ ID NO: 4671 - DNA, 601 bp, Human
aatgggtatcactggcaaatgttaagatagaactctcagtgcagaagtagccaaatgacaggattagtgattaaagaaaggagagtatactgggaacaagtaggttcaagtgaggtatttttatgtatttatcaaatgttgttatttgttcaattattagaagatgtaaatgtgagtgccagaggcagggaaaagaataaattggagggagacatcttcaacttaacttccagcacatgcttttcagtccatacttgaattccactctgaagcatttcactgttcacttcctcttttgaaygtcttatcctttaattttcatgatactatcctactcccattgtcttagtagttatttagccctttcttttcagctgtttttgatggatctttgggtttggcaccctaaatggtcctccctcagccctttctctcactaccacattcaaccttggtagtcttgctcataactgcaatttcaactggcatgcctacactgctgatgcctaaaccagtgtctcttgagtttcacacccacctacatatcaaattccctattagacatgtccttttggttgccctatagtttcaatctgtccag

SEQ ID NO: 4672 - DNA, 601 bp, Human
tgctgagaatggaacaagatcccaaaagggatcagattcataggtagaggaattagccttagttaagaatctccttatcttgagctaacaagctatgaaaatatgtttgacattaagaaatttcaatgtggaaggaagggaaatacagagaactcatggatggctaggataaaaagcaagtttatatgtggtaattgaaggcattgaggatatgtttgggaactgaaaggaatggaaaaaattcaaaatagattaaggacagggagtcaactaggaataagtaaaaaggttgacaaatagrgttgagtaccctactgtggtaggatcacatatggctgagaatcaattattttcacttaggcaatgtcagtttagccttgagagtccatagttcagggccaaaaagccttgacctatttgattgatgattggattttatacttaagttacccagattaactgtaatccagaaacagagactacggactactttgtatcccagcatgtagggcagtgcctttattgatttcttagttgaataacttataatcttcccatttctgtatttattttcttcctaaaccgcttaattatcttggtg

SEQ ID NO: 4673 - DNA, 601 bp, Human
gttttcattttcttaaatcagacacttgtgctatcacctttcattgcagtctctctggcctatgagaaaatgagacattgacatttataagaaaatattactaactatgcttctttcctgaataatgaaaatgcatcttaatgaattatttttctttgttacatgttttctcacaacaaaatatctgctttgcatttttaatttagagtgataatatttcttgcagcctatcaaacccattatgatttttaaatggcataatgattttaaatgaagtataaggctgtgtttcttaaggtgytgtctctgagccacctttatgagaatcacctggatgcttgaaagaaatgcagattcctaggccccagaccatccacgtcagaactaaaggggaccaggccacagatcttcacaattaatagagctccaagttcttatcacactgaaacctaagaaccaatgttatggtggtgaagagcttccagatttgaagtcaaactgacctggttcaaatcccatatctactgtattactagtgaccttttcagagaagacttttaacttctctagacctctttcctcattgctaagtgggtaaaaa

SEQ ID NO: 4674 - DNA, 601 bp, Human
agagcccttctaattaatttcttagactcacagtgaaaggttctgacaaagtgctttgtgttttggtaaattatactctatcagacagaaatatgtctctcccacagaggtgtcctctctcctttctcagaaacagtaggcgaattgtgaccatatgttccatacattctcccagctataactctgctggcactaatggtatttatgtgccccagagctataaacctgttttaggtaaatgtatttactcagtaaagaacatgagtttctgaagactgcaataataaactgtcaacagtaygctaaacagtgcttatccactctctctcatctcttcattaagttgaggcttcctcctgtatgtctaaatgcttaggacaataaactgcatttataaaggacttgcagtgcaaaataaagatgaaccaacacgacttcaagattacaaatataatagaaggtattagccatcacatagggagtttaaaatcaaatccttgaaactcatgtaaatgataccgcaatacatttctgcacctcagttgtgcttccagaatgagtgatgtaagctttccctgaacaattgcttctgtatctgcta

SEQ ID NO: 4675 - DNA, 601 bp, Human
acttttaattgcaagttttagagtaattaactaatagtgacttgaacaataaagatattatttcgcataataagcagtcttgaggaaggatgttcacaggtttggtgaacagctaccaaagactagacattgatggttatctttccagctctctcagcttttcctcatgatcacagtatagccaagcagcatcaagcttccaagcaagagaaaagggaaaagagcaaaagtgcttggtcatctttaagttgcccttccaggaagggcagtgcctcatttgatgtattctgattaaccagaygtgtgttacctgtttatccctgattctgttatggttgaaggagaatggagtcgtcatgatcacagtaaatggatcctgaatcaattattttgttattgtgatacattctctggagttgaacctagaggtctgtcttctgaaatattaagggaatgctgcctgtcacctgaataatctagggctctgttggcagctaagaagggaaatcactgttggctagacaatgagcaaggagcaacatttgccaccatgctgttaattcccgaaagagctagtgtgatgaaattgtccatttttaaa

SEQ ID NO: 4676 - DNA, 601 bp, Human
tttaagttgcccttccaggaagggcagtgcctcatttgatgtattctgattaaccagatgtgtgttacctgtttatccctgattctgttatggttgaaggagaatggagtcgtcatgatcacagtaaatggatcctgaatcaattattttgttattgtgatacattctctggagttgaacctagaggtctgtcttctgaaatattaagggaatgctgcctgtcacctgaataatctagggctctgttggcagctaagaagggaaatcactgttggctagacaatgagcaaggagcaacatytgccaccatgctgttaattcccgaaagagctagtgtgatgaaattgtccatttttaaaatggaaatagtacgaatatttgcctcactgacagcataaagttttgggagaatgaattatatgctttataaactaagacatgctaattactggttcaatcttccaatttaagtttttctgctgttcttcccttaacctcagtgagtttgcctgtctttaataaaatcttcctaaatgtcaggtaacctgtctattccaacaggcaagaatttttcagtattgtctttttccctgaagtcagt

SEQ ID NO: 4677 - DNA, 601 bp, Human
acattacatttatataaaatacaaaaccgaacaaaaccaagttatattattaaaaatcaaggagggtgaggacaataactggaagaaaaagccccagagggtttttcagtggtgctgctaatatttatttccttgagctaggtgcttaacgcatgtattcataaaaaatattgagctgtacaatcaggatatgtgcatttttctatgcatgtattatactctgataagtttaaaatagaaaaaaagaggaagaattttctagcattaagtgaagtgtccattttcttagaagttacattasagttataaaagtggggggaaatatccaaaattattttatttgcatattccgaggttcataagaataactctgaaaaaccgtaccacatttccagtttggattttgccatggtcatatgatgccattaattcataggtcatttcagtaggtttatcaccaccaaaacattaggttgtctggatgggggtacagatcgcaatgtggtaatgctagatatttactttcttagtgagacatttggaatttgtatagcatcacagaacagataaacacggtttaaggctataacgtgacagtatt

SEQ ID NO: 4678 - DNA, 601 bp, Human
caataactggaagaaaaagccccagagggtttttcagtggtgctgctaatatttatttccttgagctaggtgcttaacgcatgtattcataaaaaatattgagctgtacaatcaggatatgtgcatttttctatgcatgtattatactctgataagtttaaaatagaaaaaaagaggaagaattttctagcattaagtgaagtgtccattttcttagaagttacattagagttataaaagtggggggaaatatccaaaattattttatttgcatattccgaggttcataagaataactctsaaaaaccgtaccacatttccagtttggattttgccatggtcatatgatgccattaattcataggtcatttcagtaggtttatcaccaccaaaacattaggttgtctggatgggggtacagatcgcaatgtggtaatgctagatatttactttcttagtgagacatttggaatttgtatagcatcacagaacagataaacacggtttaaggctataacgtgacagtatttatgctgatactttcatagacttctaacagtcaataacttatccaataatttccccaatttttttctgacat

SEQ ID NO: 4679 - DNA, 601 bp, Human; identical to SEQ ID NO: 1426

SEQ ID NO: 4680 - DNA, 601 bp, Human; identical to SEQ ID NO: 1427

SEQ ID NO: 4681 - DNA, 601 bp, Human; identical to SEQ ID NO: 1428

SEQ ID NO: 4682 - DNA, 601 bp, Human; identical to SEQ ID NO: 1429

SEQ ID NO: 4683 - DNA, 601 bp, Human; identical to SEQ ID NO: 1430

SEQ ID NO: 4684 - DNA, 601 bp, Human; identical to SEQ ID NO: 1431

SEQ ID NO: 4685 - DNA, 601 bp, Human; identical to SEQ ID NO: 1432

SEQ ID NO: 4686 - DNA, 601 bp, Human; identical to SEQ ID NO: 1433

SEQ ID NO: 4687 - DNA, 601 bp, Human; identical to SEQ ID NO: 1434

SEQ ID NO: 4688 - DNA, 601 bp, Human; identical to SEQ ID NO: 1435

SEQ ID NO: 4689 - DNA, 601 bp, Human; identical to SEQ ID NO: 1436

SEQ ID NO: 4690 - DNA, 601 bp, Human; identical to SEQ ID NO: 3399

SEQ ID NO: 4691 - DNA, 601 bp, Human; identical to SEQ ID NO: 3400

SEQ ID NO: 4692 - DNA, 601 bp, Human; identical to SEQ ID NO: 3401

SEQ ID NO: 4693 - DNA, 601 bp, Human; identical to SEQ ID NO: 3402

SEQ ID NO: 4694 - DNA, 601 bp, Human; identical to SEQ ID NO: 3403

SEQ ID NO: 4695 - DNA, 601 bp, Human; identical to SEQ ID NO: 3404

SEQ ID NO: 4696 - DNA, 601 bp, Human; identical to SEQ ID NO: 3405

SEQ ID NO: 4697 - DNA, 601 bp, Human; identical to SEQ ID NO: 3406

SEQ ID NO: 4698 - DNA, 601 bp, Human; identical to SEQ ID NO: 3407

SEQ ID NO: 4699 - DNA, 601 bp, Human; identical to SEQ ID NO: 3408

SEQ ID NO: 4700 - DNA, 601 bp, Human; identical to SEQ ID NO: 3409

SEQ ID NO: 4701 - DNA, 601 bp, Human; identical to SEQ ID NO: 3410

SEQ ID NO: 4702 - DNA, 601 bp, Human; identical to SEQ ID NO: 3411

SEQ ID NO: 4703 - DNA, 601 bp, Human
gcctccaggagccgctccccggttacctgggtctcacctgcttgaacccggaatgccgcccttccccctcaacctggaaaaggcctggttttagtaaagtgctctcaaggtgcaaagtcatcacgcctagctgctaagcagtacgctctccaggtcctggggagaggaacacgtaggaacgaagaagcttggttgaaaattaaagccgtggggaaaggggcagagtctgtgagtccaggggccaccgttggctgtggtttgaggcacatcctcacctgcagtcctccttttccttacccaycaaacgggattagtaatgcatcctttccaggatcagagactgtgtgaagtgcttagcactctgctcggctcagaataggtttacaagtcacacgtgtggcaatagtgaatctgtgattaaatgtctctgggccaggatgtcaggttacagttttaaaattgggtattgcaggtgttttagcagaagacgcctgggctagcaggagtgtgtgtgtgggtgggggggtgggtgtcaccaaagagctttaaatgaagcaatggcgttattttttttttctggtttttttttttttttcccatt

SEQ ID NO: 4704 - DNA, 601 bp, Human
tgaatctgtgattaaatgtctctgggccaggatgtcaggttacagttttaaaattgggtattgcaggtgttttagcagaagacgcctgggctagcaggagtgtgtgtgtgggtgggggggtgggtgtcaccaaagagctttaaatgaagcaatggcgttattttttttttctggtttttttttttttttcccatttgaacaaagcatctgctattaggaattgcttgaaaaaaaatccagaatgttttcccttaatggaaaaattttttctttgtagctgtaaacagtcaataaaagggartcaaaagtaacattcagcattctgaatcctgttaatataacttgggtagccttccttctctccatttaatttggcggaagagagctgcatgtaaacctttcctatgaattcggtgattccccagatcacttaattctacttttagcagcaaggcttacagatgatgccttcaaatgaggcagatggggatgggtgaatgaaattttttcctaagtgccagttaaaaagcacggtgttttgagaatacaccattaataatgtttatggaatgattgcaaccaaaaaggtagctgaatattt

SEQ ID NO: 4705 - DNA, 601 bp, Human
agtgtgctgggctgtgtgtgaggtggcaggaatagaacaccaagaagaatatgtcctctctttggagggacctacagtccagcaagaggaacagaatcctgtaaacaaatcagtgcagtaaaatctgaggaccacatctgtaggaatgcttggagtcctgtggatgtgcaagggtgcaggtggtcccagggcgtggggctgtggtgagggagggccttatatgatgtcgtaccgttgagtcttgaagtccaggcagttacctgtgggttaccaaatgctaaggcactaagctggttcattmtggtcttctgtacctgcctccctgccttaggtaaatattgatctactcctgaggtggtggccaactcggcgtctgcggtaggattttcacagtcacctggtctctagagggctgctcagaccaagaatttggggtgatcctcaattcttcccatgcaccccacgtttccaggcaccggtgccttcctttgtggagcatatacatgcattccaggcccgcactgtctgatgaggcagcctaagacaaatccagctctcagccgccacattgcaagtactcagtagccacacgtggctggtg

SEQ ID NO: 4706 - DNA, 601 bp, Human
gagggacctacagtccagcaagaggaacagaatcctgtaaacaaatcagtgcagtaaaatctgaggaccacatctgtaggaatgcttggagtcctgtggatgtgcaagggtgcaggtggtcccagggcgtggggctgtggtgagggagggccttatatgatgtcgtaccgttgagtcttgaagtccaggcagttacctgtgggttaccaaatgctaaggcactaagctggttcattctggtcttctgtacctgcctccctgccttaggtaaatattgatctactcctgaggtggtggccarctcggcgtctgcggtaggattttcacagtcacctggtctctagagggctgctcagaccaagaatttggggtgatcctcaattcttcccatgcaccccacgtttccaggcaccggtgccttcctttgtggagcatatacatgcattccaggcccgcactgtctgatgaggcagcctaagacaaatccagctctcagccgccacattgcaagtactcagtagccacacgtggctggtggctaccatattggctcagcaaccaccgggagagccatcacctggaaacttgctgaaatgcagag

SEQ ID NO: 4707 - DNA, 601 bp, Human
attcttcccatgcaccccacgtttccaggcaccggtgccttcctttgtggagcatatacatgcattccaggcccgcactgtctgatgaggcagcctaagacaaatccagctctcagccgccacattgcaagtactcagtagccacacgtggctggtggctaccatattggctcagcaaccaccgggagagccatcacctggaaacttgctgaaatgcagagccccgggttccacccaggacaatttttacagcatctccacgtacaccacaggcacgtgagagcttgcgaagcactgttckagacggaaccccggctgcacactggagttgcttgggcgtttgtgaagcagagctgcctggctccactccctaaaattctgacttaaattagtctgggtggggcttcgagccttggcattttttaaagcctcctcccaaatagggttgataatcactgataaacagacagttacgtaacaaccttaggcagttgatacgtgctgtaaaggaaagtcatgcataacatggggatagaaagtggttctggagatcaggaaaccgaaatcaggaaaagcctctctgcagaggtgacatttgagc

SEQ ID NO: 4708 - DNA, 601 bp, Human
gttccacccaggacaatttttacagcatctccacgtacaccacaggcacgtgagagcttgcgaagcactgttcgagacggaaccccggctgcacactggagttgcttgggcgtttgtgaagcagagctgcctggctccactccctaaaattctgacttaaattagtctgggtggggcttcgagccttggcattttttaaagcctcctcccaaatagggttgataatcactgataaacagacagttacgtaacaaccttaggcagttgatacgtgctgtaaaggaaagtcatgcataacatkgggatagaaagtggttctggagatcaggaaaccgaaatcaggaaaagcctctctgcagaggtgacatttgagcaggctggaatgcagagaggaagccagccacagaagatgtgggaatagaacagcttgggaaaaggccctgaaatgccaatgggcgggatcatggaaggactgaaggaaggtcagggtgtgtggggaggagtgggcgaggaagagaaggatgagagacgggcagaggggtgggcagtgccaggtcacagagggccttgtccatcttggggaaggaatttggattttgtt

SEQ ID NO: 4709 - DNA, 601 bp, Human
cagttgtggggtgaggggctattgcagtcatctaggcaagaggtcttggatgaggaggtagcagggggggtggtggtaagtggcctgattgaggtccattgtacaagaagaggggtccaaacctactgatggattgtcattattgtgtgctagtggcatagaggtagacccaatagaactcctgccccaaacagggcaacagccaagctcagttcatccaagccccctgaacagaccttccagcatccccatggtgaagctgttgctgtctagagctacttagtgtcagaatccaggccakctctgtgctgcttgatgtgactggttataggacttgtgttgggaccagttccagggtcaatcaaggaaagattgaagcatagctgcatagactggggcccagggaaagagagaagcatggctgcatagactgagactgagggatctgctcatgcgaccctctgctgtttctatgcagactacagcaggtgatacttatgggcattgtcagatgcctgggatgctatccccatttcagctccccaaacactcctctttctttccctactaaagagaggtgacgttccgtgatatgaaccta

SEQ ID NO: 4710 - DNA, 601 bp, Human
gtgtcagaatccaggccagctctgtgctgcttgatgtgactggttataggacttgtgttgggaccagttccagggtcaatcaaggaaagattgaagcatagctgcatagactggggcccagggaaagagagaagcatggctgcatagactgagactgagggatctgctcatgcgaccctctgctgtttctatgcagactacagcaggtgatacttatgggcattgtcagatgcctgggatgctatccccatttcagctccccaaacactcctctttctttccctactaaagagaggtgacrttccgtgatatgaacctacctcctttgcttacgccttttctgtgtaatgtggcctccaagtggattgctagggcccttccaggtactttttttcttttctttttcttttttattttgtttgaggtggagtcttgctcggttacccaggctggagtgcagtggtgcgatctcggttcactgcaacctctgcctctcgagttcaagggggattctcctgcctcagcctcctgagcagctgggattacaggtgactgccaccatgcccggctgatttttgtattactagtagagatggggttt

SEQ ID NO: 4711 - DNA, 601 bp, Human
cttttttattttgtttgaggtggagtcttgctcggttacccaggctggagtgcagtggtgcgatctcggttcactgcaacctctgcctctcgagttcaagggggattctcctgcctcagcctcctgagcagctgggattacaggtgactgccaccatgcccggctgatttttgtattactagtagagatggggtttcaccatgttggccaggctggtcttgaactcctgacctcaggtgatccgcccacctcggcctcacaaagtgctgggattataggcgtgagccgctgcgcccggctrcctttccaggtgcttttataccattatcgtttttatcatgtcaacaatgtcttggaataaacagactaccaacccgagctggaatacttgggctgtatttttatgatgatggtcatttctatgaagggatttgactgatttagtttcttcactcataaatgtatattgggcccctaccgtatgttgtcactgccaggtgccagggatgtaaaagtggacaggatggcctggacgtctaaaaaaaaaaaaaaaaaaaaagtgaacaggactagctccttccttagaaagcacttaatagtc

SEQ ID NO: 4712 - DNA, 601 bp, Human
catggctccctttgacactctggcgaaggtgatctgcctcttcagaaaaatgttttaatgcagagaacaaaataagattccgaaggaaactaatcacagtcatgcattgcttaatgacgaacatgcatcgttaagatttcttcattgtgcgaacatcctagagtgcacttacacacacccagatggcatgcaggcacctaggctatatattaagagcctattgctcctaggctgcaaaccttacagcatgccactgtgttgaataccgtggtaactgcgacacagttacagtatttatgtrtggtatttgtgtatctaaacatagaaaagacagtaaaaatccctcttataatcttatgagaggtcgtctgtgtggttcattgttgactgaaatgtcactatgtggagcacgactgtatattgaaattcagttaggagaatattttaaaaatttttaccatgctcataatgcttctttactaaagcatttaataacaagatttactggtgggtctaacaaataccttaattttgaggtatttgatgaatataaacaatacgagatatttctaataaagataatgtaatgttcatatctttt

SEQ ID NO: 4713 - DNA, 601 bp, Human
actaaagcatttaataacaagatttactggtgggtctaacaaataccttaattttgaggtatttgatgaatataaacaatacgagatatttctaataaagataatgtaatgttcatatcttttattgcaagtattgataatattaccatgtgttgcttacatttgtaattgaaagatacgataaatttcagttagaccctaatgaaaatacagataattttttttttccaatccaagtttatggaccccctggattcagacagagaattccaggcttgatggtaagatttgtttagctagttttttttttttttttggagtgatggattctttaaccactctgtttgttaaatataattattatatttcataattattatactgtccttgccatgaattggttctaagagtctagctgagaagagttgcaccctaggccagtgttagaattatgaggcgctaaaggtgtttagaagcgctcttggcggggagccatccactgtggttttacatccgtggggtgccctctgttctttcagggttatggcttggcagcttctcatctgatcccacaggtcagttcatatacttgtgcatgcct

SEQ ID NO: 4714 - DNA, 601 bp, Human
ttgatggtaagatttgtttagctagttttttttttttttttggagtgatggattctttaaccactctgtttgttaaatataattattatatttcataattattatactgtccttgccatgaattggttctaagagtctagctgagaagagttgcaccctaggccagtgttagaattatgaggcgctaaaggtgtttagaagcgctcttggcggggagccatccactgtggttttacatccgtggggtgccctctgttctttcagggttatggcttggcagcttctcatctgatcccacagrtcagttcatatacttgtgcatgcctcaagagttcagcagagctgcaaattggaccttctgagtcctgtaattaggattctgagctgggtaggtcctacaacccagctctcctatttgtgcctttcttgtttgtgtcacacggcatgtactgcctttgactctgcagggcaagttccattgtgaagcaccagaagattcatgggcaccacctacccagaattttaagggagactttgcagtgtgtgttattttcagtgagggtatggatttgaaatgctgctgctgttgcaagagtgtgtt

SEQ ID NO: 4715 - DNA, 601 bp, Human
ccctccttggagatatcactggagttgatgtggtggttggtacttgagctggaatcccaatgggtgccttgctggtttgagattgggccgaatgaggccgtgttgtttgccatctgtcttgcctcagagcagtattttttgcagtctttgctgctttcgttggtctcttaattaaaactttgttgtgctttgcttctctggtgaaaagcaggttgtgttagtgatgatcatggggttttgtggtcattgagtaatgtggactgttgaacttcaagaaaatactgattttcttatatccagygagcttcctagattttgtggggaaccagtgttctcatcattggaagatgtgctctctagtgtgaagcagtgattttcacatttgccctgtgattcggttgtgtttatgttgtggagcagaaagacctagccagggagttaggagagcgggattggagttgtaaggtcaaccttattgtgaccttgagccagttaactgtgtatctggtctgtaacatgagagatttggactagatgttctctgaccatcctccctgacctaaaaattccatagttctttgtattcatatatactggatgt

SEQ ID NO: 4716 - DNA, 601 bp, Human
ggcctcccaaagtgctgggattgcaggcatgagccactgcacctggcctcattttcttgtctttaatttctttcagtaatgttttgtagttttcaatgtacaaatcttacacttcttctgttaaatttattcctaagtactttattctttttgatgtgagtggaattgttttcttaatttcatttctggattattcattgctagtgtatagaaatatggttactttttgtatattgatcttatggcctacaatttgctgaatttgtttattggcttttatagttttgtgtatttgtatgtrtattccttaggatttttaatatgcaaaatatcatctgcaaatagagacagttttgtttattctttaataagctgagcaccttttatttcttttttttgtttttttgagacggagtctcgctctgtcgcccaggctggagtgcatggcgccatctcggctcactgcaagctctgcctcccaggttcacgccattctcctgcctcagcctcccgagtagctgggactacaggtgcccgccaccacgcctggctaatttttttttttttgtatttttagcagagatggggtttcaccatggtc

SEQ ID NO: 4717 - DNA, 601 bp, Human
gctttctatcaacattgccttgatttggtccccacaggagactgctcacttcttgacaaaaggtaattattgagattcctggttttcttctcaccttgtaaattctcttgtttttgttttttggcaaataggaatgaggtgtgtttactactggagcatcgggctgtcagaacccgtagctttggtttgccttggtcgcagcctgccaggttgcatacttttgatttggaagaggtgccggtgggtgtgttcgctagcaggaatcacccacagtaaaaatcatgggtaggagaaatggccsttcaccttttcccatcttccttccttccattgtctacactcctggtcccaccttttccttggggactgggatgcttatgctggaacctaatcagtgtccaaagcttaaaattctcctctcctcctcacttttttcctctttgttttctcttgactttcattgccttggtctatttccagaccctccaaggcctgtgttttctctttaaaagatcctgttccatccagaggagactcaagagtcccactttaatttgggattttaggcagaggccttcctgcatctctcaagtcacacttg

SEQ ID NO: 4718 - DNA, 601 bp, Human
tattgagattcctggttttcttctcaccttgtaaattctcttgtttttgttttttggcaaataggaatgaggtgtgtttactactggagcatcgggctgtcagaacccgtagctttggtttgccttggtcgcagcctgccaggttgcatacttttgatttggaagaggtgccggtgggtgtgttcgctagcaggaatcacccacagtaaaaatcatgggtaggagaaatggccgttcaccttttcccatcttccttccttccattgtctacactcctggtcccaccttttccttggggacygggatgcttatgctggaacctaatcagtgtccaaagcttaaaattctcctctcctcctcacttttttcctctttgttttctcttgactttcattgccttggtctatttccagaccctccaaggcctgtgttttctctttaaaagatcctgttccatccagaggagactcaagagtcccactttaatttgggattttaggcagaggccttcctgcatctctcaagtcacacttgcaagcgactgctttggtgatgacatttaaagttggcctcctttcctaccactctgactcccctcaat

SEQ ID NO: 4719 - DNA, 601 bp, Human
tatcagaacaaatttctgaattcttgaagcaattagtttttgactcactttatgtgtccttttttatccatccatctgtccatttatctgtctctgtccatccattgatccatctttgggacagacctgggatgtctgtgctcagaagcagagtgctctacatctgggaagcacagtggtcgtgcccacagctgtcaggctccttgcatgctgggctgtggtcctggcttctcttgtcttctgtagagtgggagtctcaccaaaggagggcatgggagggctagcttgagtcaaggtgcgwaagttggaacattgcagatggggttcagggtacccagggttgtccctgtttggtcagggcagggtcagcaaagctccagcctgtttttgtatgcaaaaagtgtaagctaaaaatggtgtttatggtttttaggggttgtaaacaaaatcccagaagaagatgcaacagagaccgtgtatatgcaacctgcaaagtctaaaatatttatcatctgctcctttatagaaaaagttgtcccaagcctggttagagctctgagtgagtgtgggtagatctgtctcacagatctactctgtccca

SEQ ID NO: 4720 - DNA, 601 bp, Human
ggtatggtgacccagggacctgctgctggtagaagcagccttttcttccccaggaaatgtatactaaatgaaagcaagtactttcaccttttcctctgtggtcccgattttacctctgaggtcatgagtaagtccaggtgacaggtgggtcagagctggattatggagggctgagcatgtcagttggaaattgattcagaaggttgtggggaaatattaagggcttttgcgtaggggagtgacatgagcatagctgggcttaggaagtctggcctggcatggtttgggatcctgggggagctggagcaggctggaaaggttaggggcagggagaccaataggaagcattggccactgccgtgggaagtggttgtaggggtctggattagggcatagggaatacaaaggaagggacgtattccagggaagttaagtggcaactcctcatcttctagtttgtgctgtcaccagggttggttggtgtgtggctggcacactcaggccggccttcccccttcccttcctcctttcatagagcaactgctccataccaggccgtgggttctgcggagttcctgcctggaaggcgcccatgagctgg

SEQ ID NO: 4721 - DNA, 601 bp, Human
gccggccttcccccttcccttcctcctttcatagagcaactgctccataccaggccgtgggttctgcggagttcctgcctggaaggcgcccatgagctggaggaaaggagaaacaatggttctgccagggaggagatgacattggataagctccttgaaggcggaggttgtgtcctgtgtgctgcctcatgcgagctagtctcaccctggggcacgtaagaggggctcagaaggtcagttgtttgaagtcccacagctggctggccacgtagacgataatgctgtacaccagaaatcaacrttataataaaactcttaaaaatccaatcttatctctacttttaaggaacctaccatttacaaataaaagatcacccacttatttattcattcagtgtctgttttctgtaaagcacactgtatggctgtgtacccttatgcacagtaattgccaaaatgcctattgcagggagcggggtcacctccctgaggccatgcagaactcggcatgggtctactttccgcccctcttgagcttttatttccccaaatacctttgcctcatttcttgatctgaggatgttccataatgacttcaagg

SEQ ID NO: 4722 - DNA, 601 bp, Human
attcccttctcctgcatgctggaggggtgcaccatgggcctgggataggctgttgtcagtggagcagaggtgtcgcccagccagaagggtaagggagctcagatccagtccaggtgttcgggtcctgctccctggcgagaaggaagtatgtgtgagagagtatttcagatcctcctctcctgtggctctggaatcctgctcatctgccatccggcgtctccagccctgctgtgcttgagaagtcttcatttctcactagcagcctccattatctccacttcctccattatccccacttccyacattttcagggcacttggcctctgctgtaccctcagcccccaatcctaagggcatgtgctctgtgaagagggggacttggggttgtgcgcccctgtgccctgcagtgcctgatgcatgagtgttgtgctgaccctccctcagtgtcgttcagcagtgagcctcctctaaagcaagttcaccatttacacggtggacttgtttcctgtgtttgtgttcttatttcctaaaaccgaactgcaaactcctgagggcaggatctcttttttctttttttaaaataagctctcatttgtattta

SEQ ID NO: 4723 - DNA, 601 bp, Human
tgtcgcccagccagaagggtaagggagctcagatccagtccaggtgttcgggtcctgctccctggcgagaaggaagtatgtgtgagagagtatttcagatcctcctctcctgtggctctggaatcctgctcatctgccatccggcgtctccagccctgctgtgcttgagaagtcttcatttctcactagcagcctccattatctccacttcctccattatccccacttcctacattttcagggcacttggcctctgctgtaccctcagcccccaatcctaagggcatgtgctctgtgaagwgggggacttggggttgtgcgcccctgtgccctgcagtgcctgatgcatgagtgttgtgctgaccctccctcagtgtcgttcagcagtgagcctcctctaaagcaagttcaccatttacacggtggacttgtttcctgtgtttgtgttcttatttcctaaaaccgaactgcaaactcctgagggcaggatctcttttttctttttttaaaataagctctcatttgtatttatacttggctattttcaaacgctattcgggtgggacagggctcatgcacattttacagctgagaaacagca

SEQ ID NO: 4724 - DNA, 601 bp, Human
cttagaaacttctttgaccagcctcttcatttgaaaagggatttcaaggttcatatatgcattgtttgttgcatgttactttctttggaaatgactagtgaggacagataacttagaaatatttgcatgttacatcagaagagagttaatagtactggttactgttaatactagtggtattagctgttccagcaaaaggtactgcttatttataataaccagataatagcagcgagatcggagaggatagtctagataacattatgagtgtatctataattataattgaaatggaatgggrgtgaatcttttaatatgaggttttaagaattctggaattttagtgtgagacataattcatggtgtatggttgatagggacatactctttggccatataaccttgaagaagtaataatcttgaattatttatcattggaatgaatcatccttttgagagaatcatatcttccttcagtgttaaaaatatacttatgtcatctgtcatggtgagtattccagttacaatgcatatttctttttttcacatcctgcctactcacttggtgttatccttgagaagagaaagatttgagatgatg

SEQ ID NO: 4725 - DNA, 601 bp, Human
tagggatctggcagttgaaggctaggggcggaaagtggacaatcaggatagagacaggactcggcagagaagcggagttttagtacagatgtactaaacatctgtacagatgtggagccccccccgcatcatcacacttaacttcaggaacaaagaaacccaacagatttaaagatagtagggcatacctgcagggctggtggcggggcaggtggccggtgctgcttccatggtggacttcgcagttgccctggggatgctgacccctggactggactttgctcagtggtgcccgccacaktgagcctcagccccacctctgttgtcttcaccctttgacctcacttgagcctggactgagggatttcccctgtcgatgaaccaacctgagtactgtgcatccagcctctcactgagctgggaaccaggggcagctacaaaggagacaggagaaatagccgtcccccttgggcactgctggcctggcaggagaggcccagcatgtgtctagggaggagcggagcggttgtggccagcattgagctggctgcttttctgtaggagcctgaatctcagtcgagcctggaaggacatgcaggtg

SEQ ID NO: 4726 - DNA, 601 bp, Human
tacagatgtactaaacatctgtacagatgtggagccccccccgcatcatcacacttaacttcaggaacaaagaaacccaacagatttaaagatagtagggcatacctgcagggctggtggcggggcaggtggccggtgctgcttccatggtggacttcgcagttgccctggggatgctgacccctggactggactttgctcagtggtgcccgccacagtgagcctcagccccacctctgttgtcttcaccctttgacctcacttgagcctggactgagggatttcccctgtcgatgaaccracctgagtactgtgcatccagcctctcactgagctgggaaccaggggcagctacaaaggagacaggagaaatagccgtcccccttgggcactgctggcctggcaggagaggcccagcatgtgtctagggaggagcggagcggttgtggccagcattgagctggctgcttttctgtaggagcctgaatctcagtcgagcctggaaggacatgcaggtgttagggagccaggattgcctgcgttaggcacggggctgggcacacagagcactggagggaattggttgagtaagtgatggagt

SEQ ID NO: 4727 - DNA, 601 bp, Human
attctgcaagaagagatgatgatgtttgcttcttttacatactgcattaaaggtcccagacactggggcatttgctgatgtcagtaaagagggagtcctggatttctaggcactcacagtttcagaataaacacatatgtaaacagctgattaccatatggtgtgataaatgtgtcaggatacagaggcagttgctattggcaacaccaaatcagtcataaccttcaggagtgaacagggcttgtttgctcagggtctggccagggacccagaggaccagtgttggggacccagaggggcygcgtgggcctgctgccactgcgagcctgtgttacaagactgagcagtgcagccgtgactctggcaggcgagtttcccaagccgaggtttctggaagccacagcctgagcccagggcctggaacctgcaggcaaaaactgtgctgagactgattccccagtggtcagccccacagctggactgcaagctgctttccctgggcagactcagcctcctgcaggaggggtgtgggagggaaggagcagtatctgtgtgcagacctgggttcccccagaactgagatgctggatgaggtgcctgc

SEQ ID NO: 4728 - DNA, 601 bp, Human
ggatgaggtgcctgcatcccctgagctgcttggcgaggaggacggtccatgttttccatcacagctgggagtaagagcagatatgtgcaaggcaaggacgttgtttcaccttttgaaggaaggttgttaggaaaacgcctgcattttctaatcactggagaagcccttttaagcagaccagatttataagggttttgatgaaaacagtggtttgggagcagcaatgtctttaatagcaacaaagcccagagatggggtctgcctgcacaggagcatgggccagggggtcctgtgtgacctkggaggtgtgtgagggaggccctgggctggttccatggcagggcacagtccagcttcttgcttcctggcagcacaaacccctgcctgtttctggcggggagatgctgcccaggctcggctgctttgcggttctatgtcggtcactttccccaggccacttccttcctttttcttcttatgccagcctgggcaagaggaatttgtgcttcctgccagcaggatggatgggggaaaggcagtggctgggtgtttctctctgctggaagggtttgctggggtgaatcctttcccttcactccct

SEQ ID NO: 4729 - DNA, 601 bp, Human
ctcctgcttccatctctcttgatctggccccttctctccattcctccagctgcagtgggtgcccctgtcatttgtcagccagagcattcaacagcctctgctcccactgaggtcatggtgattgtcttaaagatttgctctttagcttctcagctgaagacacgttggtggcttccctgaccttttggaaagtaaccagactctgggtccttctcctttgttgacctggcccctgcctccctcccaccccatctcatccatgcctgtcctctgtgtcaacacgcctcactgccctgcgccygatccttttacacaggtggtccctctgtttgtagagtcgccctgctcttcgtatctccctgcctgttctgtgaagttcagcccagtgccccttccttggaggccacattagagggccctcctctgctggctttgtgcccccgtacccctttcgcagctgactgtccacattatactgtctgtatctgttatttactgtctgtctttgacaaactatgatcttggaagtgcagagaacttgtctgatttgtttaaccacctcacttagcacataacttgtcatatttttaatttattttct

SEQ ID NO: 4730 - DNA, 601 bp, Human
ctttcgcagctgactgtccacattatactgtctgtatctgttatttactgtctgtctttgacaaactatgatcttggaagtgcagagaacttgtctgatttgtttaaccacctcacttagcacataacttgtcatatttttaatttattttctatctccccttctccccattagatcataagcttcctgggggcagggatttttgactcttacttagtgatgcatcctcagcacccagaattgcactggacacatcatatatgtttaatatgtgtttgttgaatgaataaaactgacaggyaactacagcttagattgcagggagtgagacatgctgttgccggagctctggtgtcattggttcatagaaagcttgtttctctggccatggggacttgattcttagagggtaatggttcgaaagttgaattagtgagtgtaaatccttaaaaaagtaaaaatatgtttgtgcccttgtacagaggggctgccttgcccttctggaagaaggaattccacgttagacgtgttcccagctgcagttttgttctgtatctattgccagcaggaatccaaggatttcctttattatttccaaatt

SEQ ID NO: 4731 - DNA, 601 bp, Human
ggtaatggttcgaaagttgaattagtgagtgtaaatccttaaaaaagtaaaaatatgtttgtgcccttgtacagaggggctgccttgcccttctggaagaaggaattccacgttagacgtgttcccagctgcagttttgttctgtatctattgccagcaggaatccaaggatttcctttattatttccaaattgctgcctcttaggaatggagaatgctgccagtctgtgctctgtgttttttttgctcagtgggaccaaagtagttttgtggtagagagatacagagatacggctttgaracagtttgagtcatctaattactgtccaggagggctgggaggttaaccctggtggttgctttggtgatagtgatcgatgtctgtgtgacaattataatgaaggctggtattatgccgggactttgaagagtctatcagatagtgaaggaattgcgaagccgtactatgttgaggtctccagaataaacatcctcagaatggaaggtccagatgagaaggttaccttgatgagaggcctttatgctttttgtgctattttcctttatgggctctggtagttctttagtgttttataatctc

SEQ ID NO: 4732 - DNA, 601 bp, Human
caggtggaataaagtctggtcagccactctggggccgatgcacaggggcccagcctggagcccacttccggccttgcgaatgcttcagtggctttgcatattgtctctttgttctcactctttagaaatgttctcccacaccttccttccagtggatttctagaaataccctatttttcatgactcaccaattgaacacatcctgtttggggaagtgataagagaggaatttgagaatggcatggagttgactcctaatgatgactggtgcaaggagtagacggcccagccttctgcttgytctgcctctcacctgtgtctccagacgagctgaatttctccaagtgccgtgtttcactgtccccgcccgacatatgccaactggagcttttcctgtcctgttgtaggcggggatctgtgtgtggctacagagtgactaatggtagaattaatcgagttagagatggggcctgtagttttgaacctgatgagttagatgaccttttggaccacacagatggctggtcgtcctgtgcaccagtgtggcagggatggagcttgtgccagctgccccgggcagagttgttttctttttaagagg

SEQ ID NO: 4733 - DNA, 601 bp, Human
agagaaatggaggagggagaactggagctggggcacgtgagctgctgtggtagcgtgcgggaggcaggggagttcagaccacgtctcggggccaggagtggctgacagctgaggtgtcgggctgggtagggcagagtgagccgcatggcctggcagctgtgatgggaacatgtaagaagtggtcaggctgctgttgttttagatgtctgaaccctgagggtagaactcggagaacttggttggtggatgcagccggcaatgccttcccatgaatggcaagggcagtgggcttaggcagatrgagctgctccacctggcagtttagcctcccaggggacttctggcaaggtccggagtcatgtttgatctgccaggactggggactggggtgctggtggcatctggtgggtggaggccaggatgctactacacatcccacagtgcccaggactgcacccaccacaaagaagtaccttgtcccaagtgtgtccgggcctgatgttgagaaacgctgggtcaaaaggcttcaggtgatggtggacttggagggccggtcagggagggacaaagggatgtccttggcacctggactgctttgggg

SEQ ID NO: 4734 - DNA, 601 bp, Human
atttttttctgttttttaacctgtgttgtgcagtatgccagatgaactttttagggtgtatattttgatatcttacttttatgaagattaataaaattaaaattgtctctgtactgatgtaaagagcttgaacttaatttagttttataattgtctgtataaacattcttaatgtctaaagaggattttttaccggagaggcaaagggaaataaaaacttgataaaatttaaaaaattaaaagcaactgttatctgttattgtatgtatgtatgtgtaggtggttgtgtgtatgtatgagmgacacagacagtgcattttacttttttgttttttaaagatcctgcctttaaatttggaactataattatttgtcagcacagttaaattttttttttcttgcttttctttctctttctcctttcctgtgttggagcaaaggtgctgtgtgttgtctacttcaggtttcttttttgagtgaatgggacaaggacagggcaatatctgagtgtcagaaagatcccccccgaggctggtgtgggtaccaggcagggctggggtacggagacgggcaggcggaccaggcaggggctagtgaaggc

SEQ ID NO: 4735 - DNA, 601 bp, Human
gaatccaggaaaacactggtttctggcttgagtgagtggaagcttttttaaaaaaagagagttaaaaaaaaaagccctgttttgtacacattttgatggttaatgttgctttctgacttttgcttttcaaaaagtgaaaatggaaaagtttaacagggcctcaactcctgaggctggattaggacatttctcatttacattgtgacttttagatgaaaacataattgatacctttgaaaagattaagatggttctgcctattttctgaaatttaggaagcacccactgggtcttttggtctttttttttttttttttgacagattcttgctttgttgcccaggctgggatgcagtggcatgatctcagctcgctgcagcctcgacctcctaggctccagcaatcttcccatcttagcctcccaagtagctgggactacaggtacatgccaccatgcctggctaattacttttatttttattttttgtagagatgagggtctcagtatgttgcccaggctggtctcaaactcctgggctcaagagatcctcctgcctcggcccctcaaagtgctgggattacaggcatgagccaccgtgcct

SEQ ID NO: 4736 - DNA, 601 bp, Human
ttaacactgcaactactctttggtgtggaagccttatgtgtggggtaagcacagatttggtgtcatcatgttgggatttgaggattagctgttctgcacttcataaggatatagtacattcagttattgacagcagctaggctgtgtagtcactcctgtggggctgatttgtttaattatgattgttgacctttttactctttcattatattttgggtagaatgaaatcatgtgtgtggtgatggaggggtggtggtggggggagataataacaaactcttctgtagcctgaactcattasttcttataacccataggtgtaggtaccattttctttattttatgaatgagaaaattgaggtccagcttcttggaaggtaagagaaatgagtcccatttcccctaatattaaccgagcaccatttatgtgccggccatttggacccatctaaggggcacaaaaccattgttttttgttgttgtcgttgttgttgaaaccactgtaatggcagcatctttttttttttgttttagatgaggcctcactgtgtcgcccaggctggtcagtggagtggtcacggctcactgcagccttggcctt

SEQ ID NO: 4737 - DNA, 601 bp, Human
tgttttagatgaggcctcactgtgtcgcccaggctggtcagtggagtggtcacggctcactgcagccttggcctttctgggctcaagtgatccacccacctcagcctcttgagtagcttggactccaggtgcacaccaccatgccccagtaatttttttgtagagatgagtttttgtcatgtttaagtgactttcccaaggccttgtagctggtaagaaggaggtcttctgtttctaagttgaattcttttccctgtcctgctacttttggggtggtttatggaaagaaattaagtcaggrtgaaaaaactagtcaacttcttagagcaatgtagataagattttcacagttgatcttcacagacttatctaaatactgaagccccattatccctggggggtatgttccaagaccctcggtggatgcctgcagccagctaatattgaactagtttgccttcaatcacgacatgtctctgttcatgtcatgtcttcctcccataattttttttttttttttttttttatttgagacagggtctcactctgtcacccaggctggagtgcagtggcgccatcacggctcactgcagccaccatt

SEQ ID NO: 4738 - DNA, 601 bp, Human
gagtttttgtcatgtttaagtgactttcccaaggccttgtagctggtaagaaggaggtcttctgtttctaagttgaattcttttccctgtcctgctacttttggggtggtttatggaaagaaattaagtcagggtgaaaaaactagtcaacttcttagagcaatgtagataagattttcacagttgatcttcacagacttatctaaatactgaagccccattatccctggggggtatgttccaagaccctcggtggatgcctgcagccagctaatattgaactagtttgccttcaatcacracatgtctctgttcatgtcatgtcttcctcccataattttttttttttttttttttttatttgagacagggtctcactctgtcacccaggctggagtgcagtggcgccatcacggctcactgcagccaccatttcctgggcccaggtgatcctcccacatccacctccccggtagctgggatcacaggcatgcaccaccatgccaagctaattttttgtagagatggggtttctccatgtttcccaggctggtctcaaactcctggactggagcgattcacctgccttggcctcccagag

SEQ ID NO: 4739 - DNA, 601 bp, Human
tttttttttttttttatttgagacagggtctcactctgtcacccaggctggagtgcagtggcgccatcacggctcactgcagccaccatttcctgggcccaggtgatcctcccacatccacctccccggtagctgggatcacaggcatgcaccaccatgccaagctaattttttgtagagatggggtttctccatgtttcccaggctggtctcaaactcctggactggagcgattcacctgccttggcctcccagagtgctgaggtttcaggtgtgagccaccgtgcccagcccctcccamaagttaatgatttttccatcataactaagcacttgccacgcaccacggccgtagcttttgcagtttgagatgtgaaggcaaagctagcatgagtttatttttttcttctttaccatttcatgaatagaagacccacttttcccttagatcttagcaacctcagcataggaatttttccttaagtcaaggagtttcatctttttacttaaaggaagtgctgtatgatttctccttggcatatctgcattaccagcatctagggttcttgtgctctgggaccattattatgtaaaaaataag

SEQ ID NO: 4740 - DNA, 601 bp, Human
attatgtaaaaaataagggttacttgaacacaggctctgcaatactgggacaatcatctcataacctaggcagctactaggtgactcatgggcaggtagcatggaccttgtggttctgccagacaaagggaggagtcacgtcccgcgtgggaggcaggacggtgtgagatttcatctcttgacatagaacagcaagcaatttaaaagttatgaattgcttatttctggacttttctgtggaatatttttggactgtggttagtggaaactgtggaaaatgaaactgtggataagagggtartactgtatctggatgagtccaaaaacacattctaagatgaaatattattagctcacatatttatcttttaggatacaatctttcttaatttagcatgtgtgctggaagatattttgtcagtattaagtaatgctgcagaattttggttgaactgttgtgcatgtagaacattaattctttgttttcctgatagtttttggtgagaggttttctgggaagtcattgtcctattaccactttgcatgctaaactggtgcgattatgagttccttatccatatcagggttggggatgtacata

SEQ ID NO: 4741 - DNA, 601 bp, Human
atgtgtacttcactttccaagaacaggaatgttttgccctagtgagccttgaagattttttgttttgttttgttttgtttttttgagacggagtcttgctctgtcgcccaggctggagtgcagtggcacaacctcagctcactgcaagctccgcctcccgggttcacgccattctcctgcctcagcctcccaagtagctgggactacaggcacccgccaccacgcccagctaattttttgtatttttagtagagatggggtttcactgtgttagccaggatggtctcgatctcctgacctygtgatccacccacctcggcctcgcaaagtgctgggattacaggcatgagccaccgtgcccggcctaaagattttttttataatgtgcatttttgtccatagattacaatcactgttgtttaggaactcagacggaaaatgtgactgagtcagagaagtaactgttaaaatacaactttgcttacaatatctgctttctgtacgtcaggcagatgaattgtattaaaatacttcctaggtctagtttggtggaaaccaaagatataactgtatttgcagggagattggagaatgagatagc

SEQ ID NO: 4742 - DNA, 601 bp, Human
gaagttttcttttgggaattagtgggaacatgatatgtatataaactcatcattaaaataatttgaatatcagctgggcacgttggctcataacgataatcccagcactttgggaggccgaggtgggcggcctataatcctagcactttgggagaccagtctgggcaacatggtgaaaccccttctctaccaaaaaaaccccacaaaaatttggtggcacgcacctgtggtctgagctactggggaggctgaggtgaaataatcacttgaacccgggaggtggaggttgcagtgagccaaratcgcgccactgcactccagcctatgtgacagagtgagaccctgtctcaaaacaacaacaataaaaagaatttgaatatgttcagactttccaccatacagtaccttagcaaggtacactgagattaggaataagttaaaatgcttgtctttggaagattaagtggatgttaatctaagcaaagtggattctgtaaaaccctgaaagaagtttttgagtttcacggtgtgaacagaacagagaacccttgatgagaacacatgcgtagctcctagcacagagtgtgcgacacagttaatg

SEQ ID NO: 4743 - DNA, 601 bp, Human
cagcactacttgaagtcctcccgtcatataaaaggtaaaagtctgaatcatgcaggcctaggtttggttgtgaacttttacctcttactggtagtgtggccttgggcaagtcactttgatacccactttgtaggactgcggtaagaataatattgttattaatagagattccaggaacttgtagcttgattttggatgcagagagctgggctcctcccacacaggagcttctggtttgagaaccacagctagcaatggctttgttgaggagggtgttggtgtgactatcgaattgtcagtrccagtgtgttgctgccgtggctgttgcatttgaatgggctctggagacacctggggtgggtgggggctgcctgacacggagccagcctgcctggccacttcttcggctctgtgcttacttgggggcattcactgtgctaggtgtggagggttctataaaaacaaaccctaaaagattagtcatacatttactgttggtcatttctcaaagtgatgacagttaccttctgtaacctacacttagtttctgagtctttttggtgtgtgttgctcgaatatcactatacatcttcctgacttc

SEQ ID NO: 4744 - DNA, 601 bp, Human
aagaataatattgttattaatagagattccaggaacttgtagcttgattttggatgcagagagctgggctcctcccacacaggagcttctggtttgagaaccacagctagcaatggctttgttgaggagggtgttggtgtgactatcgaattgtcagtgccagtgtgttgctgccgtggctgttgcatttgaatgggctctggagacacctggggtgggtgggggctgcctgacacggagccagcctgcctggccacttcttcggctctgtgcttacttgggggcattcactgtgctaggwgtggagggttctataaaaacaaaccctaaaagattagtcatacatttactgttggtcatttctcaaagtgatgacagttaccttctgtaacctacacttagtttctgagtctttttggtgtgtgttgctcgaatatcactatacatcttcctgacttctgaatctaaaagagcaccactctttctctttgtttcttcagtcagaaaatacctactgggtgctggtgctgcgtttgtgaacagagcacacagaaatctgggcctgggggcgcttgcaggattctgcttgctttccttcctc

SEQ ID NO: 4745 - DNA, 601 bp, Human
ttggtgtgtgttgctcgaatatcactatacatcttcctgacttctgaatctaaaagagcaccactctttctctttgtttcttcagtcagaaaatacctactgggtgctggtgctgcgtttgtgaacagagcacacagaaatctgggcctgggggcgcttgcaggattctgcttgctttccttcctcccgtctctgcagtctgacgctgtgtgccatgcattagtcggttcgtcgtctgcctccactagagtgtcatggatgctcctgggggacagagcctttgttttcttcgccaccagayccccagtgcccagagcagtgcctgggacagaacttgttctcaataaatagtttgttattgttgttgtggggcttggatgcaagaggagtgagccccacatttgattatataataattaaaaccttaaaaacaagcatacgatggggatggctatctaagtttagaaggttctgtgaaaaggacaggagggtggtgtgaccccgttgggggaaggagctctgtgttgactggcaggagccctggtttgggagtgttggctttatccctgatcagctgcttgacttcaggcaactctttaca

SEQ ID NO: 4746 - DNA, 601 bp, Human
attttagcattctcctggacaaattgcatgttttgtggctgggctgggcatgtaggggctgagaggctgtcttgtggctgaggccacacagccagtctgtggtggagctaggctggccctcttggggcctccttagctccagtttctttcctctgtcagacagcaatggcctcatgtcttgttcttcctgctgcgagctttagcctcaaactccaccttgaatgtggagtgaacttggagtgaactttgtctgtggctcagcctgcccgtggcctgtctgtctgccccattctgccctcaygtctctagagaggacagcaatgccttccccatatatgttcatttctctgatgattgtagtgtctaatgggtttcattctgatgaacttgagcccctcacttgggcttgttctttgctctgatggggagtaatttgagggactctcatgacgccatgcctgctccagacaacccctaggagcttgcaaagattgccctgtaggaggaattgctgatgtcctgtgaataattcctgggaaggaaatgccaggctgacccatcacatagactgcatagccatgacttagcagggtggagcacc

SEQ ID NO: 4747 - DNA, 601 bp, Human
tctgatgattgtagtgtctaatgggtttcattctgatgaacttgagcccctcacttgggcttgttctttgctctgatggggagtaatttgagggactctcatgacgccatgcctgctccagacaacccctaggagcttgcaaagattgccctgtaggaggaattgctgatgtcctgtgaataattcctgggaaggaaatgccaggctgacccatcacatagactgcatagccatgacttagcagggtggagcacccacactgtcgtgtggacagaaagttcacagcctgagtgagactggkcgctgggctgagattgctggcacgggtctcctggagctgcaggcaggcatgcccgggctggcgggggagctgcatgcactgccacccccagaggagggcagggccgtgtggggatactgcagaggatgaccgaggggcatgattagagagaggctaccctgaaaacactctgctaggcttccagatttttgttttgggctggtcctgctcaggatctgtgagaagtatgtaggaacattgggccaccgtctcctgcccatcaaaaggctacatgccatgtggaaggaaggcagggcttgg

SEQ ID NO: 4748 - DNA, 601 bp, Human
tggaaggaaggcagggcttggggtcaaatctgggtatacaactcttcccttctttccattttcttacttggaatatttacttactcacttgagtttcagttttatcatctgtaacatgaggaaaataatacctacctcaattgctttgtagggtttcataaagctaaaataatacccatgatctccttgggggcagaaactgccaggatcatttttagcatttaacacgctgcctgacacaaagtggtcatgtaacatttgttggataaaactccacaaactgtaaggaatgttacacacrtggtaattattactaataattcagcaaatggtatttgaccacagacttcctgcctaggcaccagggaaagaggggaaagaacacgacatgtgaatacacagctgtccctagggctcctggagttctcgcggtgccccaggtgccatgcatgactttaaagatgggagtggggatgcaggatgccagacatgtggcccttgggtgggaattgggaccccagatctttaatcacttaagccttgggaggtgtaaaagtgttttcccattccacagagggtacaaaaggatacagggcacatt

SEQ ID NO: 4749 - DNA, 601 bp, Human
acaactcttcccttctttccattttcttacttggaatatttacttactcacttgagtttcagttttatcatctgtaacatgaggaaaataatacctacctcaattgctttgtagggtttcataaagctaaaataatacccatgatctccttgggggcagaaactgccaggatcatttttagcatttaacacgctgcctgacacaaagtggtcatgtaacatttgttggataaaactccacaaactgtaaggaatgttacacacatggtaattattactaataattcagcaaatggtatttraccacagacttcctgcctaggcaccagggaaagaggggaaagaacacgacatgtgaatacacagctgtccctagggctcctggagttctcgcggtgccccaggtgccatgcatgactttaaagatgggagtggggatgcaggatgccagacatgtggcccttgggtgggaattgggaccccagatctttaatcacttaagccttgggaggtgtaaaagtgttttcccattccacagagggtacaaaaggatacagggcacattgcacggcccccagggcaaatgcagtgtggtgctcttt

SEQ ID NO: 4750 - DNA, 601 bp, Human
agaaactgccaggatcatttttagcatttaacacgctgcctgacacaaagtggtcatgtaacatttgttggataaaactccacaaactgtaaggaatgttacacacatggtaattattactaataattcagcaaatggtatttgaccacagacttcctgcctaggcaccagggaaagaggggaaagaacacgacatgtgaatacacagctgtccctagggctcctggagttctcgcggtgccccaggtgccatgcatgactttaaagatgggagtggggatgcaggatgccagacatgtgrcccttgggtgggaattgggaccccagatctttaatcacttaagccttgggaggtgtaaaagtgttttcccattccacagagggtacaaaaggatacagggcacattgcacggcccccagggcaaatgcagtgtggtgctctttcatttaagccgaggccacaagtaactatcggacaaggttggaagcagaaagcagtgagcacccagagaggaacaggagtaggctgtggagctcaggagctctgaatcagagccagggtggagcggaggtgtctcagcccctgagatgttgcagtctt

SEQ ID NO: 4751 - DNA, 601 bp, Human
cgttgtcacatcaggagtttagtccgcaagtagaggtgggccctgtggctttccctctagtcacttgtcttacagagaaggggactgaggttgtgagggtggggctggcatttgacttcgtcccactccttcccatcttctgggctccatctgcttggtactcacgtgtaacagccttaggggacctgccctccctgtgggggcccagacctggggaatctggttgagtctggctgctcagtgggtctgggcgcaaagcatgtggagaaattgagaagctcgaagcagaacagctaatccytgatgtccatcgggtgggttttgtatgcttaataagtaaagataacgtgcattttacactttactaaaacgcattacctcatctgactttccttttccctccatcccagctggtgagttggggactcagtgacccttgggagaaggggaagggagcagctggggggcgcaccttgttgaattcatggggtctttcctggggaccttcggttttgtgatgaggaagtggagtggctggaggacatcagcgtggcaaatggaatgccttcaggaatgacgcaaggggaaggtggctgtggct

SEQ ID NO: 4752 - DNA, 601 bp, Human
atcaggagtttagtccgcaagtagaggtgggccctgtggctttccctctagtcacttgtcttacagagaaggggactgaggttgtgagggtggggctggcatttgacttcgtcccactccttcccatcttctgggctccatctgcttggtactcacgtgtaacagccttaggggacctgccctccctgtgggggcccagacctggggaatctggttgagtctggctgctcagtgggtctgggcgcaaagcatgtggagaaattgagaagctcgaagcagaacagctaatccttgatgtccrtcgggtgggttttgtatgcttaataagtaaagataacgtgcattttacactttactaaaacgcattacctcatctgactttccttttccctccatcccagctggtgagttggggactcagtgacccttgggagaaggggaagggagcagctggggggcgcaccttgttgaattcatggggtctttcctggggaccttcggttttgtgatgaggaagtggagtggctggaggacatcagcgtggcaaatggaatgccttcaggaatgacgcaaggggaaggtggctgtggctgagggtgag

SEQ ID NO: 4753 - DNA, 601 bp, Human
cgtgcattttacactttactaaaacgcattacctcatctgactttccttttccctccatcccagctggtgagttggggactcagtgacccttgggagaaggggaagggagcagctggggggcgcaccttgttgaattcatggggtctttcctggggaccttcggttttgtgatgaggaagtggagtggctggaggacatcagcgtggcaaatggaatgccttcaggaatgacgcaaggggaaggtggctgtggctgagggtgaggaacagctgccaggaaggaagactgaatgtgagtttyctggcagtgatggacggagcagagatgggcctgaggccactgacagggagctttaggaatgagaagcctgtgcccacattgcttttttttttctttccttaattttttttttttaattatcatctgtagctcattgaatttagttcatcagttatttgaaataaatcagatgtacttgggaagtactggccagtaggtgttagagtgttagcctgtacaaaaccttccctctgggaaatgctggaaggagagccttcgtgtcacaaaagccgttaacacacactgtgaggtgccttggag

SEQ ID NO: 4754 - DNA, 601 bp, Human
ttactaaaacgcattacctcatctgactttccttttccctccatcccagctggtgagttggggactcagtgacccttgggagaaggggaagggagcagctggggggcgcaccttgttgaattcatggggtctttcctggggaccttcggttttgtgatgaggaagtggagtggctggaggacatcagcgtggcaaatggaatgccttcaggaatgacgcaaggggaaggtggctgtggctgagggtgaggaacagctgccaggaaggaagactgaatgtgagtttcctggcagtgatggayggagcagagatgggcctgaggccactgacagggagctttaggaatgagaagcctgtgcccacattgcttttttttttctttccttaattttttttttttaattatcatctgtagctcattgaatttagttcatcagttatttgaaataaatcagatgtacttgggaagtactggccagtaggtgttagagtgttagcctgtacaaaaccttccctctgggaaatgctggaaggagagccttcgtgtcacaaaagccgttaacacacactgtgaggtgccttggagagaggtcactcaggc

SEQ ID NO: 4755 - DNA, 601 bp, Human
ccttcggaagacagttaaagaatttaggaacacggccgggtgcagtggctcacgcctgtaatcccagcacttagggaggttgaggcgggcagatcacgaggtcaggagatcgagaccatcctggctaacacggtgaaaccctgtctctactaaaaatacaaaaaaattagccaggcgtggtggcgggcgcctgtaatcccagctactcgggaggctgaggcaggagaatggcatgaacccaggaggcggagcttgcagtgagccgagatcgcgccactgcactccagcctcgcgacaaagygagactccgtctcaaaaaaaaaaaaaaaaaagaatttaggaacacaagcagatagtgcgtgggcccaatcactggtcctacaccaagcatcttgactatttagttgttcactgcagccctcaaaagctgcccgtgcatccctaagcccaagccaatcccgaggcaacaaagaaacgaaagtcgttttttgttgttttttaaaaagtttttaaagtcagctgaattgaggtctactctgcaaacaataaaattcaccagtttttgtttttgtttttgtttttttaaacagtttcactcttg

SEQ ID NO: 4756 - DNA, 601 bp, Human
cactgcactccagcctcgcgacaaagtgagactccgtctcaaaaaaaaaaaaaaaaaagaatttaggaacacaagcagatagtgcgtgggcccaatcactggtcctacaccaagcatcttgactatttagttgttcactgcagccctcaaaagctgcccgtgcatccctaagcccaagccaatcccgaggcaacaaagaaacgaaagtcgttttttgttgttttttaaaaagtttttaaagtcagctgaattgaggtctactctgcaaacaataaaattcaccagtttttgtttttgtttytgtttttttaaacagtttcactcttgtcacccaggctggagtgcaatggcgcgatattggctcactgcaacctctgcttcctgggttcaagcgattctcgtgcgtcagcctcctgagtagctgggattacaggtgcccgccaccacacctggctaatttttgtatttttagtagagacagagattcaccatgttggccaggctggtctccaactcctgacctcaggtgatccgcccgcgttggcttcccaaagtgctgggattacaggcatgaaccactgtgcccggccaaaattcacgt

SEQ ID NO: 4757 - DNA, 601 bp, Human
ttgaggtctactctgcaaacaataaaattcaccagtttttgtttttgtttttgtttttttaaacagtttcactcttgtcacccaggctggagtgcaatggcgcgatattggctcactgcaacctctgcttcctgggttcaagcgattctcgtgcgtcagcctcctgagtagctgggattacaggtgcccgccaccacacctggctaatttttgtatttttagtagagacagagattcaccatgttggccaggctggtctccaactcctgacctcaggtgatccgcccgcgttggcttcccaaagtgctgggattacaggcatgaaccactgtgcccggccaaaattcacgttttaaatgtgcagtttagtgggttttgtgaaatcgtctaagcaccctacagatgtaacgtagcagagtgccgtcacgcagaactcccctcttcagttggttcccccattcctgcctcctgtcatctctgcgctgctttctgtccttacaattttgcctttcttagaattccgtataaatggaatgatagggtatgtaaccttttgtgtatgattgcttttgcttgacctagtgccctggagattacaatg

SEQ ID NO: 4758 - DNA, 601 bp, Human
tactctgcaaacaataaaattcaccagtttttgtttttgtttttgtttttttaaacagtttcactcttgtcacccaggctggagtgcaatggcgcgatattggctcactgcaacctctgcttcctgggttcaagcgattctcgtgcgtcagcctcctgagtagctgggattacaggtgcccgccaccacacctggctaatttttgtatttttagtagagacagagattcaccatgttggccaggctggtctccaactcctgacctcaggtgatccgcccgcgttggcttcccaaagtgctrggattacaggcatgaaccactgtgcccggccaaaattcacgttttaaatgtgcagtttagtgggttttgtgaaatcgtctaagcaccctacagatgtaacgtagcagagtgccgtcacgcagaactcccctcttcagttggttcccccattcctgcctcctgtcatctctgcgctgctttctgtccttacaattttgcctttcttagaattccgtataaatggaatgatagggtatgtaaccttttgtgtatgattgcttttgcttgacctagtgccctggagattacaatgttacatgt

SEQ ID NO: 4759 - DNA, 471 bp, Human
acggggttttaccatgttggtcaggctggtctcgaactcctgaccccaagtgatctacccacctcagcctcccaaagtgctgggattacaggtttgagccaccgtccccggcctataaactaaactttatcagaggtatgtgtgtatagaaaaaaaaaacccagtatatayaggatttggtactgtctggtttcaggcatccactgggagtcttggaatgtattccctgaagataagcggtactacttgttatcagttcaccaagtgatgggcatttgggttctttccagtttttggctattatggataaagcttctatgaacatttgactacaagtctttgtgtaggtagacacgttttatattttgacttcgggaaatacctgagagtgcaattgccgtgttgtgtgctaagtgtgtgtttaactttatcaaatgctgccatcccattttccaaagtggctgcatcatt

SEQ ID NO: 4760 - DNA, 601 bp, Human
taccatgtaagttggttctcagatcatacaatgcatcatgagagtagagattctaatgagtattgaatgtctcttacctgaagggctgttcaggagaaatggactatttaagtaacaataatctgaaacaagattctgaaagatgtgctctgtggaataatattgcacatattcctagaagctgggataaatcattcacacagaaaaaactggaaggatctagcaatttacttaaattctcctatggaattttaaaaagatggcctcatattgccttgttactatggaatggttgatttgrtgtaaatgcacactgcagcttaatgaagtagcctctctggttctgtgtgtccttgccgtggattcggcagatggtgtcgtcagagattatggagttcaagccacctagctttacagaggtgaagggaggtgcctgagttgatgaagggagtcgggggcagagctggtgccagcaccatgtggtgctccagaggttcttcaggggtctgcttgacctgtattgcttttatctttaaaatttccaacagttgttaaaaagttttctgaaaagatttatactctgatgtttgcatcacatagc

SEQ ID NO: 4761 - DNA, 601 bp, Human
tccctagtcattgacatatttgcacgttcagacattcatagaaatggcaggagaaaaactattctagggtcccctgcaaaaaaaaaaaaaaaaaaaagaaagcaagtaattctggcagcccaattaattcatttaatgaatatttattgagtgccaaccatgtgccagcttggggtgatgaagataaaaaattagcatgtcagtgggcgccaggatgttaaaagttggagtttagcacgagggtgtatatgcatgtgctgccttcacttaaatgtcaggcaaagcggcagtgtcaactgtrcataaagaaattagcgtttaacatgctgtgccaatgatgatgctgtccatgggctgagcagtcaatatatgtttcagatgcttcttgtctaacatatctgagataaggactgcaaggagatattagatgttgttagtggtagagagttgaaacaaatttcttactattccaaagcttttggattttgtttttaaaaaagaatgtggccatctgtttctatttacatgtgcaaatcagaattgtctctgtcttgtgtaactggaagagtattgaaatgaaagtgcaggccactggcatcca

SEQ ID NO: 4762 - DNA, 601 bp, Human
attcatagaaatggcaggagaaaaactattctagggtcccctgcaaaaaaaaaaaaaaaaaaaagaaagcaagtaattctggcagcccaattaattcatttaatgaatatttattgagtgccaaccatgtgccagcttggggtgatgaagataaaaaattagcatgtcagtgggcgccaggatgttaaaagttggagtttagcacgagggtgtatatgcatgtgctgccttcacttaaatgtcaggcaaagcggcagtgtcaactgtgcataaagaaattagcgtttaacatgctgtgccaatgatgatgctgtccatgggctgagcagtcaatatatgtttcagatgcttcttgtctaacatatctgagataaggactgcaaggagatattagatgttgttagtggtagagagttgaaacaaatttcttactattccaaagcttttggattttgtttttaaaaaagaatgtggccatctgtttctatttacatgtgcaaatcagaattgtctctgtcttgtgtaactggaagagtattgaaatgaaagtgcaggccactggcatccaactgccaatttcaaatgaatgaaaacagcctca

SEQ ID NO: 4763 - DNA, 601 bp, Human
ttttaaaaaagaatgtggccatctgtttctatttacatgtgcaaatcagaattgtctctgtcttgtgtaactggaagagtattgaaatgaaagtgcaggccactggcatccaactgccaatttcaaatgaatgaaaacagcctcagtgttctcattgattccattttggggatgtgatggtatgcatttgagcaatttgtattccagcaagagacctttttaatccatttcctctgtgtgacagaggagttgggttttaaaaaagcactgaccgagagtcagtatgactgtctcttagccrcttgtcctgtccaccctcagtccttgttcctctccttcctgatcctcctgctgcagccaagggctgggagggggcagcacagctgatggactcattccaagtccttggctggagtgcctcctgcctgctaacagcctgtcactttcttcaggatgtgcctgtgttacctgctccagggtgtctttccctaacagcctgtcacagggcgtttggtagaaactaaagagcagcagaggatggtttcattcattccatgttcgtggagtgtttacacgtgtcgggcattccactggtgctgga

SEQ ID NO: 4764 - DNA, 601 bp, Human
tgtttcttaactttttaacaggagattaccttgaacaaactaatgaaccagtacatgatgtcggaaagaacaggctaggagaatgtgaaagtgtggttgttttgttttgtttttgagacaaggtttctctctgtcactcaggctggagtgcagtggcacgatctccattcacgtcaaccttcgtttcccaggttcaagctattctcctgcctcagcctcccgagtagctgggagtacaaactcacgccaccatgcccggctaatttttttgtatttttggtagagatggggtttcaccacrttggctaggctggtcttgatctccttgtgacctcaagtgatccgcccgcctcggcctcccaaagtgctgggattacagatgtgagccacggtgcctggcctgaaagtggtttttaagcaaaaaaagagaatacaaaggtggcattttggtttatccttacctatgtggccttggaaaaatacctttgtgagtgttactttctatgttgttgcaataatattgcctgtgttaccaactgcccaggttggagagtcatgtgccataatctgtgtgaaagcacttttagaagtgctgtgcagt

SEQ ID NO: 4765 - DNA, 601 bp, Human
aatgcagtggaattcttcattaaaaattacctttggccaggtgtgggggctcacgcctggctgggtgacagagcgatacttcatctcaaaaaaaaaaaaaaatttctatgattaccagctatttatttgtaaagttgaaataaatgctattcacagtattgatagtaatcagtagttgttttttttttttttttttgagacttttggtcaggagtcttactttcctttaaaaaatacctcacatatgtttgaatgtaattgtaagatttccttcttggaaagataactaaaatgcaagctrttttaaaggtggtactttcatagaattttgtatctagaagctcagaggagaagtggctcacctaaggccccaatccgagtaggtgacagtctccatggtgcccccgccgccacactcatcttctcattttgcacaatgcatgattttcagtccccacaacaaatgcaaaccttcccgggtcctggggcagtgtggcttgagcaggcgaaacccccggaagctgctgactctcttgtggctgttgcaacttctttaggtctcttgaggaacagtaaatattccacagatcagcttcagagc

SEQ ID NO: 4766 - DNA, 601 bp, Human
attgtaagatttccttcttggaaagataactaaaatgcaagctgttttaaaggtggtactttcatagaattttgtatctagaagctcagaggagaagtggctcacctaaggccccaatccgagtaggtgacagtctccatggtgcccccgccgccacactcatcttctcattttgcacaatgcatgattttcagtccccacaacaaatgcaaaccttcccgggtcctggggcagtgtggcttgagcaggcgaaacccccggaagctgctgactctcttgtggctgttgcaacttctttagrtctcttgaggaacagtaaatattccacagatcagcttcagagcagacagcattctggctgagaaacagatgatcttcacttttacttatttatttctctcgctctctctcctcttcacttctcaaactaaacatagcagcattacatgtagtctttgcttttaggactcagcattttagagtctgtaggtccatgctcctgattacagactggggtctgcagccctccagtgatattcctcggattgcagccagtttcgcggggccagaccaggaccctgggcctgctcttcggcctttc

SEQ ID NO: 4767 - DNA, 601 bp, Human
tctcttgtggctgttgcaacttctttaggtctcttgaggaacagtaaatattccacagatcagcttcagagcagacagcattctggctgagaaacagatgatcttcacttttacttatttatttctctcgctctctctcctcttcacttctcaaactaaacatagcagcattacatgtagtctttgcttttaggactcagcattttagagtctgtaggtccatgctcctgattacagactggggtctgcagccctccagtgatattcctcggattgcagccagtttcgcggggccagaccrggaccctgggcctgctcttcggcctttctctgtggtgtctgcaggcctgactgtccccttagcagggaagggaattgctctgggccgtggtccagcccgtgggacggaggttcagcctcttccccttacttgctgctgcccagggagcccttcccctcgcttcctctcttgttctgttagctggggtttcaaattttcttttctttggatggaaaacaaacaaagaaagtaaaactaatgggctgaagcccttccttggggagaaacattcatccctcaacgctgagaataaatggcctt

SEQ ID NO: 4768 - DNA, 601 bp, Human
caggaccctgggcctgctcttcggcctttctctgtggtgtctgcaggcctgactgtccccttagcagggaagggaattgctctgggccgtggtccagcccgtgggacggaggttcagcctcttccccttacttgctgctgcccagggagcccttcccctcgcttcctctcttgttctgttagctggggtttcaaattttcttttctttggatggaaaacaaacaaagaaagtaaaactaatgggctgaagcccttccttggggagaaacattcatccctcaacgctgagaataaatggccyttgctgaccctagcagcacagccaagggccgccatccctgcctgttgctgcacttcccctcccttctgcgccatcctgcagtggcagggaccctgcccttccttgcgtctgcccccgcttcctgcgccctgctctcctgccaggctgcccaggctggggtgcccctctctgcaggctcccacccctcagcctggcttgtacctctcaagtcctcctcttgtactcctgctccctggtaggtggatgctatcagagggcacagttttcagcccaaaaccttaaggaacaaaaatgaacagc

SEQ ID NO: 4769 - DNA, 601 bp, Human
ctgctttccattgagggcagcagaacccagccttgtgtgtgtgttttagcgcagagatcttcagatgaactcatctgaggccgacaggcaaagtagccctgcacatctggggccagggatggaggccgatgctaaatgccccccatgtctcctcagctcccttgcaccctgatgagcccctgcagtgtcctgcatagtccttgggctaagtggagccgagtatggaacccaggtctaaaattgggaatggctgtccagtgtctgcgcatcgccccctcccctatctgggaaactctgtggktgaggaaccccacttacaaggccccaggcaggctggcctctccccgagtcaggcaccagtctgatggcctgatggctctgctatggaggtgggaggggaaaggtcctccaccaacctggggactctccaactgtcaaggcaacaatcactgtattgagtagctattactgcccgcattttaaggataggaacactgaggcccaggtgatcaagtaatttgtgtgtggagatgtgggaatgaaagctcatggtcttcatctgtagcagtgactcccgcagtaagcctgggtcatgaggatg

SEQ ID NO: 4770 - DNA, 601 bp, Human
tagcgcagagatcttcagatgaactcatctgaggccgacaggcaaagtagccctgcacatctggggccagggatggaggccgatgctaaatgccccccatgtctcctcagctcccttgcaccctgatgagcccctgcagtgtcctgcatagtccttgggctaagtggagccgagtatggaacccaggtctaaaattgggaatggctgtccagtgtctgcgcatcgccccctcccctatctgggaaactctgtggttgaggaaccccacttacaaggccccaggcaggctggcctctcccccagtcaggcaccagtctgatggcctgatggctctgctatggaggtgggaggggaaaggtcctccaccaacctggggactctccaactgtcaaggcaacaatcactgtattgagtagctattactgcccgcattttaaggataggaacactgaggcccaggtgatcaagtaatttgtgtgtggagatgtgggaatgaaagctcatggtcttcatctgtagcagtgactcccgcagtaagcctgggtcatgaggatgaggtgggatccagaatctgctgctgggggcgggaaggatgcctggc

SEQ ID NO: 4771 - DNA, 601 bp, Human
ggaaccccacttacaaggccccaggcaggctggcctctccccgagtcaggcaccagtctgatggcctgatggctctgctatggaggtgggaggggaaaggtcctccaccaacctggggactctccaactgtcaaggcaacaatcactgtattgagtagctattactgcccgcattttaaggataggaacactgaggcccaggtgatcaagtaatttgtgtgtggagatgtgggaatgaaagctcatggtcttcatctgtagcagtgactcccgcagtaagcctgggtcatgaggatgaggygggatccagaatctgctgctgggggcgggaaggatgcctggctgatccctgtgcaccttcgggccctccctcagctcattccccctctcccatcacctcactgcttggattgtagaaaaatgaaaggttcatgcctagagatgaccaattttggggtaggagctgcgggtggagcggggcccatgacctctgtgtgggagaagctggagaggggcacggggctggccaggctctaaaaggcacatgaccttgtttgcatcgtcacactccttttttagaaaacaatctctgctgcataca

SEQ ID NO: 4772 - DNA, 601 bp, Human
attgtgtaacctggacacatgcaaatgatgaccctgcccctactctatctgcttctccgccaccctggcccttcagaagattctgaaacaaggaattggttacccagggtggttaggggggttgtgcctgtgtccctggtgaactttagattcttgtgcccctggtgaacttcaaatgctagtgtgctgggagccgtatgacagccccttggggtggcaggagctggcttgtgtggaggagagccactggcagctttcttggtgaaggggtggacagcactcttggtgtggaagtagcagyccccttgcctgtagctgggctggggttagtggaacagggtttagagaaagcaggggtaatgccgggtggttattttccccaaatgttagagaaagccagcgcttctggctctggaagtgaggctgttgggaagtgggagggggagcacagctctggaagctgccttccgtcctccctccattggctggagctctcccagcatttcatcggttcaaagccaaacacatgattttggacaagtcacttaaactctttgagtcagtttcttctcctttaagctggggaaagaggtggtgattt

SEQ ID NO: 4773 - DNA, 601 bp, Human
ccgtgtttgtgctgctgctgtgcagtggtgatcttgccaaaatgtggcttttcctttctcactcccccagagctcccagaaaagtctctaggacttttcttccccctaaataaaagtcaggatgtgaagccttttgacagaattggagtttactgtcatctgtttccgtttctctaagatagggatcctggcgaagcccatgaaagccatggggcgctcccaccgaagcctccgaggcacagacctcccgggagtgcctgtgggcgctgcttccttaaactgcaggaggctgcagcctctygttgttcatgcgtcgttttttcatagtgtgtgtgggtttagagctacatgggttcttttctcacttatctgttcataccgcatgacaccgtccacttcaggcacagttgacggccgtctggaggtcatcagctgagggcacagtttgcctggttcttctataataggttaagtatttttttctccatttttttcccttttaaaagtactgctagaaggccaggtgcggtgtctcacacctgtaatcccagcactttaggaggccaaggcgggcggatcagttgaggtcaggagttcaata

SEQ ID NO: 4774 - DNA, 601 bp, Human
gcctccgaggcacagacctcccgggagtgcctgtgggcgctgcttccttaaactgcaggaggctgcagcctctcgttgttcatgcgtcgttttttcatagtgtgtgtgggtttagagctacatgggttcttttctcacttatctgttcataccgcatgacaccgtccacttcaggcacagttgacggccgtctggaggtcatcagctgagggcacagtttgcctggttcttctataataggttaagtatttttttctccatttttttcccttttaaaagtactgctagaaggccaggtgcsgtgtctcacacctgtaatcccagcactttaggaggccaaggcgggcggatcagttgaggtcaggagttcaataccagcctggccaacctaaggaaacctcatctttactaaaaatacaaaaattaaccaggtatggtggtatgcacctgtagtcccagctactcagaaggctgaggtgggaggatcacttgagccttggaaagagaggttgcagtgagccaagatcacaccactgcactccaccctgggcagtgagtgagaccctgtctcaaaaaaaaaataaaaaataataataataat

SEQ ID NO: 4775 - DNA, 601 bp, Human
gtactgctagaaggccaggtgcggtgtctcacacctgtaatcccagcactttaggaggccaaggcgggcggatcagttgaggtcaggagttcaataccagcctggccaacctaaggaaacctcatctttactaaaaatacaaaaattaaccaggtatggtggtatgcacctgtagtcccagctactcagaaggctgaggtgggaggatcacttgagccttggaaagagaggttgcagtgagccaagatcacaccactgcactccaccctgggcagtgagtgagaccctgtctcaaaaaaawaataaaaaataataataataataataataaacacaagtactgctggaacttctttgcagaaacaacttgtggggaaggagggaggtatattttagtatttggccttgggaaaaggttttgcttctgcaggcatgtcttccagagactgggggggcccgtgctggcgtcaccactgtccccttccccatcaggaaccttccttccttggatggcatttccagtgtgtccgggcctctgctgttctcattatgagtccccagctctgacggccactgtggctgatgcacagggtgttggaga

SEQ ID NO: 4776 - DNA, 601 bp, Human
ctgctagaaggccaggtgcggtgtctcacacctgtaatcccagcactttaggaggccaaggcgggcggatcagttgaggtcaggagttcaataccagcctggccaacctaaggaaacctcatctttactaaaaatacaaaaattaaccaggtatggtggtatgcacctgtagtcccagctactcagaaggctgaggtgggaggatcacttgagccttggaaagagaggttgcagtgagccaagatcacaccactgcactccaccctgggcagtgagtgagaccctgtctcaaaaaaaaaawaaaaaataataataataataataataaacacaagtactgctggaacttctttgcagaaacaacttgtggggaaggagggaggtatattttagtatttggccttgggaaaaggttttgcttctgcaggcatgtcttccagagactgggggggcccgtgctggcgtcaccactgtccccttccccatcaggaaccttccttccttggatggcatttccagtgtgtccgggcctctgctgttctcattatgagtccccagctctgacggccactgtggctgatgcacagggtgttggagacag

SEQ ID NO: 4777 - DNA, 601 bp, Human
tgctagaaggccaggtgcggtgtctcacacctgtaatcccagcactttaggaggccaaggcgggcggatcagttgaggtcaggagttcaataccagcctggccaacctaaggaaacctcatctttactaaaaatacaaaaattaaccaggtatggtggtatgcacctgtagtcccagctactcagaaggctgaggtgggaggatcacttgagccttggaaagagaggttgcagtgagccaagatcacaccactgcactccaccctgggcagtgagtgagaccctgtctcaaaaaaaaaataaaaaataataataataataataataaacacaagtactgctggaacttctttgcagaaacaacttgtggggaaggagggaggtatattttagtatttggccttgggaaaaggttttgcttctgcaggcatgtcttccagagactgggggggcccgtgctggcgtcaccactgtccccttccccatcaggaaccttccttccttggatggcatttccagtgtgtccgggcctctgctgttctcattatgagtccccagctctgacggccactgtggctgatgcacagggtgttggagacagt

SEQ ID NO: 4778 - DNA, 601 bp, Human
tagaaggccaggtgcggtgtctcacacctgtaatcccagcactttaggaggccaaggcgggcggatcagttgaggtcaggagttcaataccagcctggccaacctaaggaaacctcatctttactaaaaatacaaaaattaaccaggtatggtggtatgcacctgtagtcccagctactcagaaggctgaggtgggaggatcacttgagccttggaaagagaggttgcagtgagccaagatcacaccactgcactccaccctgggcagtgagtgagaccctgtctcaaaaaaaaaataaawaataataataataataataataaacacaagtactgctggaacttctttgcagaaacaacttgtggggaaggagggaggtatattttagtatttggccttgggaaaaggttttgcttctgcaggcatgtcttccagagactgggggggcccgtgctggcgtcaccactgtccccttccccatcaggaaccttccttccttggatggcatttccagtgtgtccgggcctctgctgttctcattatgagtccccagctctgacggccactgtggctgatgcacagggtgttggagacagtgat

SEQ ID NO: 4779 - DNA, 601 bp, Human
gtggtatgcacctgtagtcccagctactcagaaggctgaggtgggaggatcacttgagccttggaaagagaggttgcagtgagccaagatcacaccactgcactccaccctgggcagtgagtgagaccctgtctcaaaaaaaaaataaaaaataataataataataataataaacacaagtactgctggaacttctttgcagaaacaacttgtggggaaggagggaggtatattttagtatttggccttgggaaaaggttttgcttctgcaggcatgtcttccagagactgggggggcccrtgctggcgtcaccactgtccccttccccatcaggaaccttccttccttggatggcatttccagtgtgtccgggcctctgctgttctcattatgagtccccagctctgacggccactgtggctgatgcacagggtgttggagacagtgattcagcccagcaggctgtattcatgtgctgttcctctgtacacccagagctgtcttctcgctcatcatttattaatctttcccatgcaagtcatacgtgaatatatccttgtggtaaagttttcaggtgatagcgaaaactcagtctcctgt

SEQ ID NO: 4780 - DNA, 601 bp, Human
ataagtaatctagagatgatttaaagcatgtgggaggatgtgtgtaggttacatgcaaatatgacaacattctacattacgaattgagcatccttggattttggaattcaacggaatcccggaattaatcccccatggagaccgagggactacagttttgagtatttttgttttattgtttaatctgtccctttgacacatttttgtgctcagagttaaagacctcaataccctgcttgatgggaggagaagagaaaagggtaacaaagtataggatagtacttttcattttctttaattmgaaaaaattatcaaataatgtattcatgttaatgatagtttaaaagtgggaaaacaaaaaattcctccaacttttcctaagacaacaatgattattttctttctgtatctttatatacagagttttaagtgtttgatatatcacttgtctatcctcttttataagtatttttttctttgcttttacaatttgtgtgtgtgtgtgtgtctgtgcgtgtaatggatttaataaacaagcttgtgattttcatttatgtatttatttttttgagacggagtttcactcttgttgccaaagctg

SEQ ID NO: 4781 - DNA, 601 bp, Human
tgtgtgtgtgtctgtgcgtgtaatggatttaataaacaagcttgtgattttcatttatgtatttatttttttgagacggagtttcactcttgttgccaaagctggagtgcaatggcacgatcttgactcactgcaacctccacctccccggttcaagtgattctcctgcctcagcctcccgagtagctgggattacaggcgcgtgccaccatgcccagctaattttttgtatttttagtagaagcggggtttcaccatgttagccaggctggtcttgaactcctgacctcaagtgatccacccccccaccccctgccttggcctcccaaagtgttgggattacaggtgtgagccaccacacccagcccataagcttgtaattttctatttctgaaattggaatttttataaaaacgattgcctttttatcttttttttttttttttggacacaggatctcactctgttgcccaggctagagttcagtggcacagtcatagcccactgcagcctcgacttcccagactcaagtgatcctcctgcttcagcctcaccagtaactgggaccacaggcacctaccaccacacccggctaattttt

SEQ ID NO: 4782 - DNA, 601 bp, Human
ctgcaacctccacctccccggttcaagtgattctcctgcctcagcctcccgagtagctgggattacaggcgcgtgccaccatgcccagctaattttttgtatttttagtagaagcggggtttcaccatgttagccaggctggtcttgaactcctgacctcaagtgatccacccccccaccccctgccttggcctcccaaagtgttgggattacaggtgtgagccaccacacccagcccataagcttgtaattttctatttctgaaattggaatttttataaaaacgattgcctttttatcttttttttttttttttggacacaggatctcactctgttgcccaggctagagttcagtggcacagtcatagcccactgcagcctcgacttcccagactcaagtgatcctcctgcttcagcctcaccagtaactgggaccacaggcacctaccaccacacccggctaatttttttactttttgtagagatggggtctcactgtgttgcctaggcctgtctgaaatgcttaggctcaagtggtctgcccacctcagccttccaaagtgttggggttacaagcatgagccactgtgccagttgcc

SEQ ID NO: 4783 - DNA, 601 bp, Human
ggtactaagggattcctaagtcccttttgcttcctgtggtcaaccaacatgctaggctaataaattactcctgaagttcactttcattttggcaacattttctggttctttcgccaactctaatttcttttctttaaaagatgctttaattttacttgtattcttaataatatatcttatatatacacacacatagcattaaaaattttttcaatgagatttttttaaaaaattcaacttttattttagatcggggggtacatgtgtaggtttgctacgtgggatatattgcatgatgctragttttggggcatgattgatcccatcacccaggtactgagcatagtacccaacagttagtttttcagcctctctccacatctctccgctctctagtagtccccagtttctattgtttgtttctttatgtcatgagtactcaacatttagctcccacttataagtgagaacatgcagtgtttgtttttttgttcctgtgttgatttgcttaggattagggcctgcagctgcatccatgttgctgcagaggacatgatttagttcttttttatggctgcgtcatattccatggtgtatatgt

SEQ ID NO: 4784 - DNA, 601 bp, Human
atgtcatgagtactcaacatttagctcccacttataagtgagaacatgcagtgtttgtttttttgttcctgtgttgatttgcttaggattagggcctgcagctgcatccatgttgctgcagaggacatgatttagttcttttttatggctgcgtcatattccatggtgtatatgtaccacattttctttatccaatccactgttgatgggtacctgggttgattccatgtctttgctattgatacaaatgacatttaaagaatgattatgaaggccacgtgcagtttctcatgcctgtaaycccagcactttgggaggtcaaggtgggtggatcacttgaggccgggagttcgagaccaacctgcctaacatggtgaaacccccgtctctactaaaaatacagaaattagctgggcgtagtagtgcacacctgtagttccagctactcagaaggctgaggcctgagaatcgcttgaacccaggaggcagaggttgtagtgagtcgagaatgcaccactgtactccagcctgagcaacagagcaagactctatctcaaaaaaaaaaaaaaaaaaaaaaaaggaatgattataaagcctggtt

SEQ ID NO: 4785 - DNA, 601 bp, Human
atgctctctgttactttctgaagagtcgaatgcgtggtgagacaaagctgccatctgaatgtctgtctgactcttcttggcaaagccaccctgggggcacggacctgggtgtgttttgttttttgttttgtctactgtctttcagaaatgtcccttcttctcaggctggcctttcgtccgtggaacgaggggagaggagataggacgggagagcggagcatgctagggctgcctgagtgctgcaggcctctgctctccccagggcagcatcttcgggttctaagaaggaagccagcctctycccacccctgctggttcgcattgagaactcagggtgctggggacaaaccggtgctgtgctgcctgcagtgtgggctccctgtcagggctgggaggagtggggtgcaggggccgctggtgctgtgggaggggcattttgcatggatccttgaggccagggctcagcaaaccttttctgtgaggggccagagatagtaaatattttaggtttggcgggcctcaaggcggtatgtaggtacttacataagagaggtgataaatatctacaaattttttattaatgaaattcaaaatataaaaa

SEQ ID NO: 4786 - DNA, 601 bp, Human
gggctgcctgagtgctgcaggcctctgctctccccagggcagcatcttcgggttctaagaaggaagccagcctcttcccacccctgctggttcgcattgagaactcagggtgctggggacaaaccggtgctgtgctgcctgcagtgtgggctccctgtcagggctgggaggagtggggtgcaggggccgctggtgctgtgggaggggcattttgcatggatccttgaggccagggctcagcaaaccttttctgtgaggggccagagatagtaaatattttaggtttggcgggcctcaaggyggtatgtaggtacttacataagagaggtgataaatatctacaaattttttattaatgaaattcaaaatataaaaataataatggagtacaattttttggtaatgcaggtctcctaaggggaagagaggaattattttgcgggggggagggggcgcgcataacatttatcttaattaatttgggttcagttggtctttcctgtgaccctgtccttgcattcattggaaatgttcgtctggaaacacccttagctcacggttggataaaagctgtcccgcaggccgtgtgtgcccaccctga

SEQ ID NO: 4787 - DNA, 601 bp, Human
tgaggtcatagatttaagtctttaatccattttggtttgatttttgtgtatggtgaaagatagaggtctagttttattcttctgagcatggatatttagtcttcccagcacaatttattgaaaaaattgtcctttccccagtgtatgttcttggcacatttgtaaaaaatgagttcactgtaaatgtatggatttatttctgggttctctattccattagtctatgtgtctgtttttatgccagtaccatactgttttggctactatagctctatagtataatttaagtaaggtaatgtgrttcctccagttttgttctttttgcttagaatagctttggctattctgggtcttttgtggttctatataaatcttagggttattttttctatttctgtgaagaaaagcattggtattttgatagagattgcattgaatctgtaaatcgttctgggtagtatggacattttaacaatattgattcttccagtccacaaatatggaatatcttcattttttttggtgtcctcttcaatttcttacatcatcgttttatagttttcgctgtagagatcctgtacttctttggttaattcctagg

SEQ ID NO: 4788 - DNA, 601 bp, Human
ttttttttttttttttttttttgagacagagtctcattttgtcacccaagctggagtacagtggtgtgatctccgctcactgcaacctttgtcccccaggttcaagcgattctcctgcctcagcctcctgagtagctgggattatgggcatgcaccaccatgcccagctaatttttgtatttttagtagaatcggagttttaccatgttgtgcaggctggtctggaacttctgacttcaagtaatccggccatctcggcctcccaaagtgctgggattacaggcatgagccaccgcgtccrgcctaacactcaatcttaaacaatcattctagcttctcgtcctgaccaagtttaattttaattgtctataaatatgcaccataatgaagggtgtgtttctgaatagggaggtaattgcttttcccacttgcaattttaattaaaaattacctcttccacctacctcacctttatttctaatctgtttaacagattgtagaaaagcaagtttatgcactcatccctgagttcaggaagcactacttcctctttggtaacaaaggtagaagattccatatggtgacctattttttcaagagt

SEQ ID NO: 4789 - DNA, 601 bp, Human
tcattctagcttctcgtcctgaccaagtttaattttaattgtctataaatatgcaccataatgaagggtgtgtttctgaatagggaggtaattgcttttcccacttgcaattttaattaaaaattacctcttccacctacctcacctttatttctaatctgtttaacagattgtagaaaagcaagtttatgcactcatccctgagttcaggaagcactacttcctctttggtaacaaaggtagaagattccatatggtgacctattttttcaagagttttatgcagtaaatgatcagggasgggtgtgtcccatgacataatatgggaggaaatttgtcagagttcaattgtgttattaaggtatgttgtctgtgagcagccttttacattgaagtttaccaccgcttccagtcccatgttttgttttttcatttgtctgttttttttttttttttaagagacagggtctgtctgtcacccaggctatagggcagtggcgcaatcatggttcgctgcagcctccaacttctggatttaagtgatcctccctcctcagcctgggattacaggtgcatgttcccatgcccggctaacttattt

SEQ ID NO: 4790 - DNA, 601 bp, Human
tgagatgagtacctgccaccctatcgtggaggtgggaaggcatcagaggccttctcaggagagaggagtgtgtgcacgggctgggaagacagcagggggagggggagccacaggtagctcattatgatggaagcttggggtacatgtgaaagtgatggagaatatgaggagctgatgccagagaagcaggcagagctcagatgatcagatttttaaagcttgctaaagatgttattctgagaacaccaggaagccttatagtgcctgggctgggacctgcccctcaagccttcctgtgtcrtcttttttttctcttttttttctttttgagacagagtctcaccctgttgcccaggctggagtgtagcggcacaatcttggctcactgcaacctccacctcccaggttcaagcgattcttttgcctcagcctcctgagtagctgggattacaggcacacccaccaacacgcccggctaatttttgtatttttagtagagacagggtttcaccatgttggctaggctggcctcgaactcctgacctcaagtgatcctcccacctcgacctctcaaagtgttgggattacaggcatgagccac

SEQ ID NO: 4791 - DNA, 601 bp, Human
aatttaattatgattgtcctgagttatttactgtttccaagtccccttttgtatcttgaaggaaggtaggaatggatcagagataaccacttgggaaaatacgagttaactccatataagaaatcttgattatcttgtatcggtaactctctactctttagtatggcaggaaagaatgccttttttatttaaataaacatttttagttttaggttcacaacaaaattgaatggaaaatacagaaactttccaaatacccgttccccttgacatgcatagcctcctcctttgttaacatccygcactacaagtggtatgctggtgaccctcagtgaaccgacagggacacatcactctcacctatatctttacttcaccttagggctcactcttgtacattccatgggcttggacaaatgtataatgacatgattataacttctctttgtattgcagccactctgtcaaatgtctggtgccttgtgatcatttttccatttaaaattgccagcactaatcatgtctgtttttagcatccaataaaattatcattgtggcattagaaccagggcttacgattctgctattgaaaactggttca

SEQ ID NO: 4792 - DNA, 601 bp, Human
tgatcatttttccatttaaaattgccagcactaatcatgtctgtttttagcatccaataaaattatcattgtggcattagaaccagggcttacgattctgctattgaaaactggttcaaaaggtgatttcaggaaggctggaagtccagaatccattgctctgaggagctgtgctgtgtttctgatgataggttgttgcaggtttttatgatctaaactcacatggggtaataatggacactcaatagcagtagttattatgtgccagtagctgtagggcagggtgcttcatttagttttsataggatagcctgtgattggcatcgctatcccagttcacaaatgttgtctccctccagtcacaagtcaccctttgcttttctatgttgtttaagtgggttaaaaggactttttacccagcatgttgggaggttgaggcaggtggatcccctgaggtcaggagtttgagaccatcctgtctaacatggtgaaaccccgtctctactaaaaatgcaaaaattagctgggcatggtggcatacccctgtaatcccagctacttgggaggctgaggcaggagaattgcttgaacccaggaggca

SEQ ID NO: 4793 - DNA, 601 bp, Human
ttagttttgataggatagcctgtgattggcatcgctatcccagttcacaaatgttgtctccctccagtcacaagtcaccctttgcttttctatgttgtttaagtgggttaaaaggactttttacccagcatgttgggaggttgaggcaggtggatcccctgaggtcaggagtttgagaccatcctgtctaacatggtgaaaccccgtctctactaaaaatgcaaaaattagctgggcatggtggcatacccctgtaatcccagctacttgggaggctgaggcaggagaattgcttgaaccyaggaggcagaggctgcagtgagccaagatcgtgccactgcactctagcctgggtgacagagcgagaccccttctcaaaaaaaaaaaaaaaagaaaaagaacaaaggactttttacctttgtatctgttgtgaaagtcaaggtgtaattaaatttccaggtgtgattagtcgttgaacagataactgtttgagcgcctcctatgtgctggacattgtgagtgccatagacaactgccgtgtagtagctggtctataaacatttgctgaatattatatatgagagtacctctatctaattat

SEQ ID NO: 4794 - DNA, 601 bp, Human
tagttttgataggatagcctgtgattggcatcgctatcccagttcacaaatgttgtctccctccagtcacaagtcaccctttgcttttctatgttgtttaagtgggttaaaaggactttttacccagcatgttgggaggttgaggcaggtggatcccctgaggtcaggagtttgagaccatcctgtctaacatggtgaaaccccgtctctactaaaaatgcaaaaattagctgggcatggtggcatacccctgtaatcccagctacttgggaggctgaggcaggagaattgcttgaacccrggaggcagaggctgcagtgagccaagatcgtgccactgcactctagcctgggtgacagagcgagaccccttctcaaaaaaaaaaaaaaaagaaaaagaacaaaggactttttacctttgtatctgttgtgaaagtcaaggtgtaattaaatttccaggtgtgattagtcgttgaacagataactgtttgagcgcctcctatgtgctggacattgtgagtgccatagacaactgccgtgtagtagctggtctataaacatttgctgaatattatatatgagagtacctctatctaattatt

SEQ ID NO: 4795 - DNA, 601 bp, Human
tgataggatagcctgtgattggcatcgctatcccagttcacaaatgttgtctccctccagtcacaagtcaccctttgcttttctatgttgtttaagtgggttaaaaggactttttacccagcatgttgggaggttgaggcaggtggatcccctgaggtcaggagtttgagaccatcctgtctaacatggtgaaaccccgtctctactaaaaatgcaaaaattagctgggcatggtggcatacccctgtaatcccagctacttgggaggctgaggcaggagaattgcttgaacccaggaggyagaggctgcagtgagccaagatcgtgccactgcactctagcctgggtgacagagcgagaccccttctcaaaaaaaaaaaaaaaagaaaaagaacaaaggactttttacctttgtatctgttgtgaaagtcaaggtgtaattaaatttccaggtgtgattagtcgttgaacagataactgtttgagcgcctcctatgtgctggacattgtgagtgccatagacaactgccgtgtagtagctggtctataaacatttgctgaatattatatatgagagtacctctatctaattattcaaccc

SEQ ID NO: 4796 - DNA, 601 bp, Human
accctttgcttttctatgttgtttaagtgggttaaaaggactttttacccagcatgttgggaggttgaggcaggtggatcccctgaggtcaggagtttgagaccatcctgtctaacatggtgaaaccccgtctctactaaaaatgcaaaaattagctgggcatggtggcatacccctgtaatcccagctacttgggaggctgaggcaggagaattgcttgaacccaggaggcagaggctgcagtgagccaagatcgtgccactgcactctagcctgggtgacagagcgagaccccttctcaaaaaaaaaaaaaaaagaaaaagaacaaaggactttttacctttgtatctgttgtgaaagtcaaggtgtaattaaatttccaggtgtgattagtcgttgaacagataactgtttgagcgcctcctatgtgctggacattgtgagtgccatagacaactgccgtgtagtagctggtctataaacatttgctgaatattatatatgagagtacctctatctaattattcaaccctgcaaagtgggtattgttcctgctggtttctggagaagaaatctgaggctcgggaagcaataggacccg

SEQ ID NO: 4797 - DNA, 601 bp, Human
actttttacccagcatgttgggaggttgaggcaggtggatcccctgaggtcaggagtttgagaccatcctgtctaacatggtgaaaccccgtctctactaaaaatgcaaaaattagctgggcatggtggcatacccctgtaatcccagctacttgggaggctgaggcaggagaattgcttgaacccaggaggcagaggctgcagtgagccaagatcgtgccactgcactctagcctgggtgacagagcgagaccccttctcaaaaaaaaaaaaaaaagaaaaagaacaaaggactttttasctttgtatctgttgtgaaagtcaaggtgtaattaaatttccaggtgtgattagtcgttgaacagataactgtttgagcgcctcctatgtgctggacattgtgagtgccatagacaactgccgtgtagtagctggtctataaacatttgctgaatattatatatgagagtacctctatctaattattcaaccctgcaaagtgggtattgttcctgctggtttctggagaagaaatctgaggctcgggaagcaataggacccgtcttctaacacagcttacaagctaatgatatttgggttt

SEQ ID NO: 4798 - DNA, 601 bp, Human
agtcattaagtgactatatagtttcattcagcaacaaaaaggtggcatccttgcagggctaggaactgtgaggagtccctgagagactgaaacagggctgatgggttgctcaggggagcttgcccgtgctcaggtgcagatagagtttgggtgacagggtgggaggaggaggggcctggggtctgctcccactgaagtagtcaggtcccttcatctatactgtgtcccctcaccctcgtggtgtctttctttagtgaaaggggtgattggaacaggaggacagggagtgccttagatggtygtggtgtcaggagggaaggggaagagcctggaagtacacattccacctgctcccccccaccgcccccaccagttacaatagggcgggcacaagctccagttgccgctcttgattctccccccatgagagctgtgcaagccacaatcgggaagaatctagcaggaaatcccaggtgcaggataatgttacagttgagcattgccaagtgtatttaggaacaaatttaacagaagacgcacaggaatcctacatcaacaagtacaaaacgctgctgaccaaaatgaaagaagacctaaatga

SEQ ID NO: 4799 - DNA, 601 bp, Human
caaagctctacagtgacagggctgggattttaacgtagctccttgggctcatgtcctttttgaggccccgcacataacagcctggcatgtgaccttggagggggtctcctatttttgtcatcctttagccatctattatgtcatgccaagtttgagttattctaaggtcatgagtctgagtcctgaaaagtcctaagtcctaaaaccagagcctgatcctgaaatctttatttcggaacaagcgttgtctactgcaaagaagtcacctgaggaaacgtgatactttctcctgtcatgttgmtgacatcattcacagtgtctttagaactctttagaactgcttttagtagcacgttcttttgcatatatttagtagagaagtctaaggatagattaaatttttttagaactagatgtcagaaataagtcaggcatattcaagaagggactgagtgccagcgaccacagttggcttcggtgcactgtaactacagtcatgggctctgaaggcagctggttccaaaggagaagtccccatagtgttttgatcacgagaataaaggccaaaggcaattcctgtataggaagagcgctcatttta

SEQ ID NO: 4800 - DNA, 601 bp, Human
tcacctgaggaaacgtgatactttctcctgtcatgttgctgacatcattcacagtgtctttagaactctttagaactgcttttagtagcacgttcttttgcatatatttagtagagaagtctaaggatagattaaatttttttagaactagatgtcagaaataagtcaggcatattcaagaagggactgagtgccagcgaccacagttggcttcggtgcactgtaactacagtcatgggctctgaaggcagctggttccaaaggagaagtccccatagtgttttgatcacgagaataaagrccaaaggcaattcctgtataggaagagcgctcattttatgtacgattgaaagaacagtgagaataaattagcatttatgcttcatactgccatattccttgtcttgtctcatgtttcttaatttctttgggaccaagatttcctgcctgctttcctgatttgtcacagattggccccatttgacccatctctgtaccagtgtccctcactgcaggctgctggcctgtcactgcttcctgagtgtgtgccagctgtacttctgtgtctttgcacagccccacccagtctgtaaacggactc

SEQ ID NO: 4801 - DNA, 601 bp, Human
gtcatgttgctgacatcattcacagtgtctttagaactctttagaactgcttttagtagcacgttcttttgcatatatttagtagagaagtctaaggatagattaaatttttttagaactagatgtcagaaataagtcaggcatattcaagaagggactgagtgccagcgaccacagttggcttcggtgcactgtaactacagtcatgggctctgaaggcagctggttccaaaggagaagtccccatagtgttttgatcacgagaataaaggccaaaggcaattcctgtataggaagagcrctcattttatgtacgattgaaagaacagtgagaataaattagcatttatgcttcatactgccatattccttgtcttgtctcatgtttcttaatttctttgggaccaagatttcctgcctgctttcctgatttgtcacagattggccccatttgacccatctctgtaccagtgtccctcactgcaggctgctggcctgtcactgcttcctgagtgtgtgccagctgtacttctgtgtctttgcacagccccacccagtctgtaaacggactcccccatcccagtcacctgcaggggacctg

SEQ ID NO: 4802 - DNA, 601 bp, Human
agaagggactgagtgccagcgaccacagttggcttcggtgcactgtaactacagtcatgggctctgaaggcagctggttccaaaggagaagtccccatagtgttttgatcacgagaataaaggccaaaggcaattcctgtataggaagagcgctcattttatgtacgattgaaagaacagtgagaataaattagcatttatgcttcatactgccatattccttgtcttgtctcatgtttcttaatttctttgggaccaagatttcctgcctgctttcctgatttgtcacagattggccccmtttgacccatctctgtaccagtgtccctcactgcaggctgctggcctgtcactgcttcctgagtgtgtgccagctgtacttctgtgtctttgcacagccccacccagtctgtaaacggactcccccatcccagtcacctgcaggggacctgcccttgcttccccacccattttcatcaagccttagctctctttgacttcagcgtagccctctttgactctcttgtaatagattcttttttttttcctctctttttttgagatggtgcttcactctgttgcccaggctggagtgcagtgg

SEQ ID NO: 4803 - DNA, 601 bp, Human
ctgcctgctttcctgatttgtcacagattggccccatttgacccatctctgtaccagtgtccctcactgcaggctgctggcctgtcactgcttcctgagtgtgtgccagctgtacttctgtgtctttgcacagccccacccagtctgtaaacggactcccccatcccagtcacctgcaggggacctgcccttgcttccccacccattttcatcaagccttagctctctttgacttcagcgtagccctctttgactctcttgtaatagattcttttttttttcctctctttttttgagatgrtgcttcactctgttgcccaggctggagtgcagtggcatgatctcggctcactgcagcctccgcctcctgggttcaagtgattttcctgcctcagcctcccaagtagctgggattacaggtgtctaccaccacacccaactaatttttgtaattttagtggagatgggttttcatcatgctggctaggctgatctcgagcttctgacctcaagtgatccaccagcctcggcctccctgtaatagtttcttattgctgttgtaacaaattaccataaaatgagttggcttaaaatggcacaa

SEQ ID NO: 4804 - DNA, 601 bp, Human
tgtaattttagtggagatgggttttcatcatgctggctaggctgatctcgagcttctgacctcaagtgatccaccagcctcggcctccctgtaatagtttcttattgctgttgtaacaaattaccataaaatgagttggcttaaaatggcacaaagttatctttcagttcggccatgggaaacccgacatgggtctcactgggctaaaatgaagatgttaacagggctccttccctgaggcttcaggggaaatcggtgtccttttcctgctcctagaggccacctgcattccttagctcayggctcccttccatcttcaaagctggtcatggccggtggtgtctttctcacactgcattgctctgacacttagatggctcgggctgctataacaaaataccatagattggtgggttaaacaacagaaatttattttctcacaggcctgggggctgggaagtccaagatcagggtgtcagtgtggatgggttctggtgagggctctcctctccttcctggcttgcagacagctgccttctccctgtaccctcacatggcagcgagagaaagcaagatgtccactttctcctcttataaggac

SEQ ID NO: 4805 - DNA, 601 bp, Human
cggtgtccttttcctgctcctagaggccacctgcattccttagctcacggctcccttccatcttcaaagctggtcatggccggtggtgtctttctcacactgcattgctctgacacttagatggctcgggctgctataacaaaataccatagattggtgggttaaacaacagaaatttattttctcacaggcctgggggctgggaagtccaagatcagggtgtcagtgtggatgggttctggtgagggctctcctctccttcctggcttgcagacagctgccttctccctgtaccctcacrtggcagcgagagaaagcaagatgtccactttctcctcttataaggaccctaatgccatcaggagggcctcacccacttgacctcatctaaacctaattattatgcttcccaatggccccatctccagacaccattgccttggggattagggctttaatatatgaatctgggggaagggacgcaattcagtcccatagcaaacactgactcttctgcctccctcttctacatataaggacccttgtgatgacattggcctcatccagataatccagataatctccccatctcaagttcagc

SEQ ID NO: 4806 - DNA, 601 bp, Human
gacacttagatggctcgggctgctataacaaaataccatagattggtgggttaaacaacagaaatttattttctcacaggcctgggggctgggaagtccaagatcagggtgtcagtgtggatgggttctggtgagggctctcctctccttcctggcttgcagacagctgccttctccctgtaccctcacatggcagcgagagaaagcaagatgtccactttctcctcttataaggaccctaatgccatcaggagggcctcacccacttgacctcatctaaacctaattattatgcttcccratggccccatctccagacaccattgccttggggattagggctttaatatatgaatctgggggaagggacgcaattcagtcccatagcaaacactgactcttctgcctccctcttctacatataaggacccttgtgatgacattggcctcatccagataatccagataatctccccatctcaagttcagctgattagcaactgtatttcatccacaatttcaattcctctttgccaagtagcataacgtactcacaagttccagggattaggaggtgggcatctggtggtggaggagacgt

SEQ ID NO: 4807 - DNA, 601 bp, Human
taccacacctctcctgaattcttaggatttggaggttgaatcagtttccactgttttgttcagctacaaattaaagggtacctaacatgcaggcactgttaacactttaaatattgctcctgattgttctctagtagttttgtatctgttgatcttttctcagttaattagaagcccttgaggtgaaagaccaattctgggagatggtgtcatttaggataaagaagacgtaggtattagaatccaagaacccttgattaaaagctagcaatgccactcaaaaagcctgtgacattaggaygattattttacctttctgagcctcaatttcctcatgtgtaaaatgggaatttaataggtcataggattgctagtgaagattaagtgagataacatgaaaaagtgccatgcatggttctggacatacacgtggtaagtgtgacagctgtgacatacctcctgtgtgttccttgcagtggctgccatgggtgtgggcgggtaataggtgcccagtaaatactgagtgtttatacattatcaggttcctgctgtatgtacttacactgctttcttagtgtaggaggggtgaacttacaatttt

SEQ ID NO: 4808 - DNA, 601 bp, Human
tctgggagatggtgtcatttaggataaagaagacgtaggtattagaatccaagaacccttgattaaaagctagcaatgccactcaaaaagcctgtgacattaggacgattattttacctttctgagcctcaatttcctcatgtgtaaaatgggaatttaataggtcataggattgctagtgaagattaagtgagataacatgaaaaagtgccatgcatggttctggacatacacgtggtaagtgtgacagctgtgacatacctcctgtgtgttccttgcagtggctgccatgggtgtgggygggtaataggtgcccagtaaatactgagtgtttatacattatcaggttcctgctgtatgtacttacactgctttcttagtgtaggaggggtgaacttacaattttagatgtaagtggtgtgtgttacgacaggccctgtattctattctttgaggatttatatggatttatgtagaaggaagatttaagatgccttacaatggaggctggaaaactgtggccagacacctgtgttttcacagcctgaaagctaagaatggtttcttaccatcgttacctgcacaataacctcagtattgc

SEQ ID NO: 4809 - DNA, 601 bp, Human
gctaagaatggtttcttaccatcgttacctgcacaataacctcagtattgcctcagcaacccacagtgtgatggtctctggagatggggcctttgggaagtaattagctttagatgagggcatgagagtggggccctcatgatggggttagtgccctgcttaaatatttactctctgactttctaggaaaaagtttttgaatccctgcattagagcagtggttataaactggagagagtatcagaataccccggggtcttgttaaaatagggattgagtttctggttcagcaggtcagggwtggagcctgagtattttatttgctaattgaaaaagctcccaggtgacggcactggactttgagaatcctacctcagaaccccccatccccacttcaaacactgaactgggacaaaagggtatctgcatgtcccacgtgtatacaaaacagtagtcttcttccacaatagtcagtgcattatgtttgctcccagtcttcaaaatgatggcaacccagccagctgtattttctggagagtcttagcttgggtttccaaaagcagttgtcataatgatttatgagaaactgtttgccactcag

SEQ ID NO: 4810 - DNA, 601 bp, Human
caaaacagtagtcttcttccacaatagtcagtgcattatgtttgctcccagtcttcaaaatgatggcaacccagccagctgtattttctggagagtcttagcttgggtttccaaaagcagttgtcataatgatttatgagaaactgtttgccactcagtgatggattgcttatttattttaaactcttacttgtctaaaatttcccaagctctggctcagcccaaaggtgttccttccacaccccaggaagttgaagctaacatttttagctgtttgacatatcagtgggtggaaaaattmatctctatcaagaaggaagcaacagaagattttcattttcacttctctagaattattctgtcataaggacttgttagaacattcttatcgagagtgatattcctaccctcaatcagaatatcctagaaaattatcacattcttgaaagtacaaagaaatgctgattttccctcaaatccttaccatctcccacatacaaaagaaaatgagaatacaacaactttgtgtgtgtgttcctgcctgttgtttgcagtgttaattggaatatgatattaaaatacacttcaaattcatacagaa

SEQ ID NO: 4811 - DNA, 601 bp, Human
agcactttgggaggctgaggcagatggatcgcttgagctcaggagttgaagaccagcctaggcaacatggcgaaaccctgcctctacaaaaaaatacaaaaattagctgggcatgatggtgtatgcctgtagtcccagctgtttgggagggtgaggcaggaagattacatgaacctgggaggttgaggctgcagtgagctgaaactgcaccactgcacttcatcctgggtgacagagtgagaccctgtctccaaaacagaaaaaaaggaaaaggattttttttaaaaaaggaaaaaaaaawatatatatatatatactgtatctgatttctacctgttacatgagaaaataacaaaatcagaataatctttactgtttggcaagcttacagtaactagtactctgctccattgttgtggcactgaaaacatgcacgcagagtttctggaaagcagtttggtggtacacatcaagaaaaataacaatctttttgtggaaggagatccatgcacaaagatgttcactttgttgttgcactgcttatcaaagtgagaaattggatgcctcctatatatagctgaattaggatttagctgcttgc

SEQ ID NO: 4812 - DNA, 601 bp, Human
tgaggcgggaagttgctgggggcacacggtggagaaaacaagcagcaacgtggggaacaccctacgtgccacctggctgagccatcgtagtccttctgaaaaattccaggtggttttggttgattacagggtcagtgtgagccagtacgtggcacatgccccaaaggtgagccacacatgacctcagtgaagtctttggtgcttataaataaggttgttgtttcattatttagttgtaagagcagcatttaaagaagaacctgaaaaccttagggatggagaaacctccttgtaggacggrtatctgaaggacgcggggctcctggtttcggaaggggcaggagagggcgtacatgaagggctttctctggctgaggaaggtagacatagtatttgttcctctctagaggaggctttcacaagagcaagccttgactcagatatgagggagaggataactgggtgagcagactgagcggcgagctggtggttggaaggttcctgcagcgggtggacggcctctgtctctgaggaagttatagagggaggtgaggacgtgggctcgaaggccctggagatgtcttccagttgtgagactctg

SEQ ID NO: 4813 - DNA, 601 bp, Human
aaaaccttagggatggagaaacctccttgtaggacggatatctgaaggacgcggggctcctggtttcggaaggggcaggagagggcgtacatgaagggctttctctggctgaggaaggtagacatagtatttgttcctctctagaggaggctttcacaagagcaagccttgactcagatatgagggagaggataactgggtgagcagactgagcggcgagctggtggttggaaggttcctgcagcgggtggacggcctctgtctctgaggaagttatagagggaggtgaggacgtgggctygaaggccctggagatgtcttccagttgtgagactctggagtccagccttctccccgctgctggctaacaacaatgattggaatttagatggtgacttgtggaatcctgtccgcagtgaccactgcattagtcatggaaggagggtacctctgaaggaacacagaggtctgtgacttaactaacgtccaagtgttggcatgaatcatactttggttcagaggtatctgctatttaatttggctggcttttatagtcagccagtctgtgggccaacctgctggccgcatgcatctgtaagac

SEQ ID NO: 4814 - DNA, 601 bp, Human
gagggaggtgaggacgtgggctcgaaggccctggagatgtcttccagttgtgagactctggagtccagccttctccccgctgctggctaacaacaatgattggaatttagatggtgacttgtggaatcctgtccgcagtgaccactgcattagtcatggaaggagggtacctctgaaggaacacagaggtctgtgacttaactaacgtccaagtgttggcatgaatcatactttggttcagaggtatctgctatttaatttggctggcttttatagtcagccagtctgtgggccaacctgstggccgcatgcatctgtaagacatggggctgcagtttcatcagtggttctttaatcttttggttatcatagacatcagtaaaaataagaaggctgttttggatgatccctccaggaaaaggtacctttacataattttgcatacactgtttgggatgcccatacccccataaacctgtccgcaaacccaacctaccaagcaaaaaagctcagaccttgagcttaaatcttctaccaaatcaacacgatgacttcatctgtttcctcatctgtaaaatcctgcagagttgtaaggatgaaa

SEQ ID NO: 4815 - DNA, 601 bp, Human
aaaaggtacctttacataattttgcatacactgtttgggatgcccatacccccataaacctgtccgcaaacccaacctaccaagcaaaaaagctcagaccttgagcttaaatcttctaccaaatcaacacgatgacttcatctgtttcctcatctgtaaaatcctgcagagttgtaaggatgaaagatatttctacacgtatgtcatctccacagtgttcatggtagctactatctgaggctttagagaccatgtactttccaagggctgcttgtccctgagggtgaggctccaggatctygtgaaaccacaggagtcagcttgcttcccaggggctgtgccctccatggagttgggtgggggcagcgtgtgtttttaagtcatcactgtggtgagcgtggggtcatggggtatgacgtggcaaaaatgaagggctgaaagctgcttaccctggcaaaatgcacattctgtaatgtagcgagtcagattgctttgccaacatgaactcttcctccattaaaggatgtgaatataattgggagtaaaatttctaatagcttgtactccccatacaacaaatgttgaattcacctcttggctt

SEQ ID NO: 4816 - DNA, 601 bp, Human
tctctgatcaccttgattatttccttaggatagatttctggaagtgggattatccagaagaatgatacacattagtaaattggaaatgaaaatatgttttcagccgtttagttgggatgattctagaaataaagttctgaaaatggttctctctcacgagatgtccactaagtagagaccctgttaagaaacagggatgatgtttgatttgaagaaattgcattcccatgagatcatgcgccacaagtgaggtcggaaacaggtggcatgtacagccgacagccggaggaaatggtctccrctgtgcagagttgtgcacaacatcacaacattcgtgtcgtgacacacatttgagtagtaatcgtcatgtcatccgtctagggagagtctccaccaggctgctgccatagagaacatatgtctctccttaaacgctcccttcgccgagctgtctgcatggaaggttggaatgtggggtgtcagcaagtgcttttccctctgcctgattcccaagtggcctgtggtctggcctggagcaggggtttggagggtctttgttgggtcagcaaggaggctggggctgggtagccatgaggctggt

SEQ ID NO: 4817 - DNA, 601 bp, Human
tggaatgtggggtgtcagcaagtgcttttccctctgcctgattcccaagtggcctgtggtctggcctggagcaggggtttggagggtctttgttgggtcagcaaggaggctggggctgggtagccatgaggctggtgcaccctgccttcgttctgttatgctggtgacagcacttggtgttcaggttaatggtacatgcacttgactggaaggttgtacattgtcgctgtcttcagctcttagctcttatctaggctaagagctgaagatagcgacaatgtcattagcaaatgaagaaacrgtttttgctgtgggaggaagagcactggactcagagtcaggaaacccgagttcttgttccagctctgctgcaaactcactgtgtgaccttgagcaagtcatcaccctctctgagctttggtttccatgtttagactaggtcatctttcaggatccatggaatgaaaggactcagcagtgagtatagcagccctgaggaggtggggacaatgagacctgtgctgccctgtggcgattttgagagttgagagctggatgcagacaggggctttaaaacagagaaagtaggctgggcgtggtg

SEQ ID NO: 4818 - DNA, 601 bp, Human
gttcatccttttgcagggattgatgggtttcgtgcagtgaggtgggggagataaaggggtgatggcttagaattgagaagaaacgaagtcttgtcctagcatggtctctgtgactcagattcttattttccaaagtccctcccaggtcagtgattattggatctggatcattaatgagaattagagtttaagatacatttgaacaagggggaggtgagagtgtgagctctttttagaagaacagctttcacaattctgtaaataaaagctgatagacccagtttgagatctttccagaaastttattcccaagctatttattttaggttcctgttttaaggttgtttttggcaaaagaaaaacaaaggcactgaatgattttctgttctctagtaggaaaatcttcaccttggggtgatctgcagcagtgggtcagtcagtgccatgttaatcatggagggatggctgttgtcgtggtgggcaccgtgctaggtgttagaggaagacacggggcttatgggcttcagcaggaagcttcaagttcatttgcaggatgaaaaatacatctaaaaatccccaactaggccagtgcacaaagatt

SEQ ID NO: 4819 - DNA, 601 bp, Human
gagatctttccagaaactttattcccaagctatttattttaggttcctgttttaaggttgtttttggcaaaagaaaaacaaaggcactgaatgattttctgttctctagtaggaaaatcttcaccttggggtgatctgcagcagtgggtcagtcagtgccatgttaatcatggagggatggctgttgtcgtggtgggcaccgtgctaggtgttagaggaagacacggggcttatgggcttcagcaggaagcttcaagttcatttgcaggatgaaaaatacatctaaaaatccccaactagrccagtgcacaaagattcccactgacctcaactggtacagtgtgagcatcagaagacagtgctgattgcagtggatgaaagcactgtaaacgtaaatccatgagatgatgatggtgatgatgagccaaagaactaattgatcaccttggggttgctggggatcaatacatcgtttagaagatgtataaggacaagaatttttttttttttttttttgagaatagagtcttgctcttttgcccaggctagagtgcagtggtgcgatctctgcccactgcaacctccgctttctaggttcaag

SEQ ID NO: 4820 - DNA, 601 bp, Human
ttaggttcctgttttaaggttgtttttggcaaaagaaaaacaaaggcactgaatgattttctgttctctagtaggaaaatcttcaccttggggtgatctgcagcagtgggtcagtcagtgccatgttaatcatggagggatggctgttgtcgtggtgggcaccgtgctaggtgttagaggaagacacggggcttatgggcttcagcaggaagcttcaagttcatttgcaggatgaaaaatacatctaaaaatccccaactaggccagtgcacaaagattcccactgacctcaactggtacrgtgtgagcatcagaagacagtgctgattgcagtggatgaaagcactgtaaacgtaaatccatgagatgatgatggtgatgatgagccaaagaactaattgatcaccttggggttgctggggatcaatacatcgtttagaagatgtataaggacaagaatttttttttttttttttttgagaatagagtcttgctcttttgcccaggctagagtgcagtggtgcgatctctgcccactgcaacctccgctttctaggttcaagtgattctcctgcctcagcctcccgagtagctggaatta

SEQ ID NO: 4821 - DNA, 601 bp, Human
tttattatagactggctggtttcctttgaaagtgcctgacctagaagtgagggaattatattcaaccacattaatttaccagaatcacctgtgtcccctcccccattcctacccacggtttaaatcagaggtctgagatgggacggtggtgtctagagtttggtgaaaatccatgcatgcatttggcgtccagcagggattgagaaccactgtgccagagacccagagtccagattttcactctttcaggtgctactttgaggcctaatgatagtaaaatgccatgagatgtaagcacctsgtatgttttttctgctcaaacaacatgtgtgttgtctaatatttcaggcacacgacttcgtcgaagatgaatacaacttagtctgtcaactctaagcacatccgatgtatggggaacacatttgccagactatttcaatataacatgctgagtgcaaggataggagaggtgccaatgaaatacccagggtgtagggcagagtcatggaaggcttcctggaggaagcatgagtctgtaggatgcagaggagtttgggagggaagggcccctgggtagaggctgcatcctgagcagaggcac

SEQ ID NO: 4822 - DNA, 601 bp, Human
atgctgagtgcaaggataggagaggtgccaatgaaatacccagggtgtagggcagagtcatggaaggcttcctggaggaagcatgagtctgtaggatgcagaggagtttgggagggaagggcccctgggtagaggctgcatcctgagcagaggcactggagctgcaaagaccactgctgttgctgtattaaaaggagaaggagctgctgtgtggggctctgaatcagagtcctgggctgcaggctagagaggaatggggcatctgtggttgagtttctgggagggggctgagtctggtgasttgtgccatcatttggtgaaggaagagtcctcggagaggtggaaatgttgtgtgtccttggccatctcatctgatatgctgaggaccactggacgtgggcaagggcttcccctcttgcataccacacttgttctttgggatctgttgccggcaccacgggttgttgttgggataacgaagctatttctgttcctggtgcagcttgacttttctcagatttttcttctgctgatgtgttcagtgttattcacaaccgagaagaacctggtggggagtgagggtggcatgcctgagactcac

SEQ ID NO: 4823 - DNA, 601 bp, Human
tagggcagagtcatggaaggcttcctggaggaagcatgagtctgtaggatgcagaggagtttgggagggaagggcccctgggtagaggctgcatcctgagcagaggcactggagctgcaaagaccactgctgttgctgtattaaaaggagaaggagctgctgtgtggggctctgaatcagagtcctgggctgcaggctagagaggaatggggcatctgtggttgagtttctgggagggggctgagtctggtgagttgtgccatcatttggtgaaggaagagtcctcggagaggtggaaatkttgtgtgtccttggccatctcatctgatatgctgaggaccactggacgtgggcaagggcttcccctcttgcataccacacttgttctttgggatctgttgccggcaccacgggttgttgttgggataacgaagctatttctgttcctggtgcagcttgacttttctcagatttttcttctgctgatgtgttcagtgttattcacaaccgagaagaacctggtggggagtgagggtggcatgcctgagactcacagcacctccgtcattctgttgcagctcacgtggaaaatgaagagcag

SEQ ID NO: 4824 - DNA, 601 bp, Human
ggaattccaagaggatcatggcgaagggaagtcccagcggggctgccaagcagggggcctagaaagcagccagcccaggacggctgacgacgtaggagacgggtggaggcccgggttctgcttctcactcccagactgcccttttacctttattcagctgatatctagacctggattgtctcagctgtaacatggagataataataccatacctgattgtgtggatagattatagccagccggtgactcttacacaggatagcttacttaattcttatgacaatcccataaggtcagtcartgtcatccccactttacagattagataactgaggccctgaatggtttgaagagctaatatctggcccggcacagtggctcacatgtgtcatcccagcactttgggaggccaaggtgggcgggttgctttgaacccaggagttcaagaccagcctgggcaacatggggaacccctgtttctacaaaaaaatacaaaacttagccaggcgtggtggctcacggctgtagtccctgctactcgggaggctgaggctgaagaattgcttaagcccaggaagcggagattgcagtgagctgacat

SEQ ID NO: 4825 - DNA, 601 bp, Human
tggctaagactcacagtgctacctcttgtccagaaagaataacaattaccacctacctgcttggaggcgtgaaagaatgtttataaagcagttggaagatctccagagaaatgccagcttaatataaagcaagattttcttactaatgggtgagattctcacctgcagaagtctgtgaattttctctgcggtgatgcaggatgaaagggaaaaccagacggctccagaaatgtgacatgtgtgaaattaaagtgcttatgaagtcagcctagtttcaggggttcttttcctcttccccaawggatgtgagaatcctggaaagactccaagggccacctctgtgctgagaagtggctttctaatgaaaggctgcatttcagggcaggtttctgaaaggtttgttacagatatgtagtctctgtctccagtgttagaggattgttagtgaaagatgtcctcacggtctgcagaacccgctccacatgaagatcagcatccattgaaagcaggagccaatgggtgctgaggagaggacagagttgcagcatgagatctgaggtgaccctgggctaaggagttttccctcacccatgttgataga

SEQ ID NO: 4826 - DNA, 601 bp, Human
gtactgggattacaggtgtgagccaccacctgtaataccaaagtactgggattacaggtgtgagccaccacgcctggtcagaagacattatagctaaccttactagggaggtagtaaggttctgttgggacaagcagtagtttgtggctttctcatatgtgctgcacctggcagaggggcatcctggcttggctgcattggtactagtacagcaggactctgcccagtgctgtcaggcttaggttaagtgtgagctgattgtccatattagtaaggcttgtctcgtcactcaatatagacwtcttgctaccagaggtcctcaccctcagtacttccatagactttctcctaacttcttgtattgcaaatgtcttagattcttaaatgtcttactttgttttttaattaaacaagagcaatgatcatagtatcatctttttgggaggaagatttaagtcactgttttagacataaactaatgaactatgctgaaatctagagacatccccagtggcttggggtacgtgggaatatccgcccttggattagtcctggactattattaggtgtccgtttctgacatttgctttttaatattctg

SEQ ID NO: 4827 - DNA, 601 bp, Human
ttatagttggaaattccttatctaagacccaaaagacttcaacgctaagctatgttctatactcacaaatctctaaccaaaaacaaaagcacattgtttgatcgagacaatgaacaaataaggctggtgtcagatatctacattttggttgtggcatagccacataatagatttccattggacttggatactgtttctttttggggttgggagggaatgctgtgatacggtaacccccatacagagaaagtgggagaagccatattgggcaaagatagcatggtgaggccttgggcgtggragggagaactcacagagacgaggactgggcacctgctgggtgctatccatgcgctggtgctgtatggggcggtgacctctggcaactcctgcctgggcaggggacacagatgcttttattagaagacatgtgccgggacagccactggcagcctgcggagccctgagggtacagcattggaagcagggagcagtgactccccgccctgagccctgggtccctgcttccctggatccctgagggtggaggggcactgcagtatggcacttgtccatctgcacacaagcctgcttgcaaggt

SEQ ID NO: 4828 - DNA, 601 bp, Human; identical to SEQ ID NO: 2822

SEQ ID NO: 4829 - DNA, 601 bp, Human; identical to SEQ ID NO: 2823

SEQ ID NO: 4830 - DNA, 601 bp, Human; identical to SEQ ID NO: 2824

SEQ ID NO: 4831 - DNA, 601 bp, Human; identical to SEQ ID NO: 2825

SEQ ID NO: 4832 - DNA, 601 bp, Human; identical to SEQ ID NO: 2826

SEQ ID NO: 4833 - DNA, 601 bp, Human; identical to SEQ ID NO: 2827

SEQ ID NO: 4834 - DNA, 601 bp, Human; identical to SEQ ID NO: 2828

SEQ ID NO: 4835 - DNA, 601 bp, Human; identical to SEQ ID NO: 2829

SEQ ID NO: 4836 - DNA, 601 bp, Human; identical to SEQ ID NO: 2830

SEQ ID NO: 4837 - DNA, 601 bp, Human; identical to SEQ ID NO: 2831

SEQ ID NO: 4838 - DNA, 601 bp, Human; identical to SEQ ID NO: 2832

SEQ ID NO: 4839 - DNA, 601 bp, Human; identical to SEQ ID NO: 2833

SEQ ID NO: 4840 - DNA, 601 bp, Human; identical to SEQ ID NO: 2834

SEQ ID NO: 4841 - DNA, 601 bp, Human; identical to SEQ ID NO: 2835

SEQ ID NO: 4842 - DNA, 601 bp, Human; identical to SEQ ID NO: 2836

SEQ ID NO: 4843 - DNA, 601 bp, Human; identical to SEQ ID NO: 2837

SEQ ID NO: 4844 - DNA, 601 bp, Human; identical to SEQ ID NO: 2838

SEQ ID NO: 4845 - DNA, 601 bp, Human; identical to SEQ ID NO: 2839

SEQ ID NO: 4846 - DNA, 601 bp, Human; identical to SEQ ID NO: 2840

SEQ ID NO: 4847 - DNA, 601 bp, Human; identical to SEQ ID NO: 2841

SEQ ID NO: 4848 - DNA, 601 bp, Human; identical to SEQ ID NO: 2842

SEQ ID NO: 4849 - DNA, 601 bp, Human; identical to SEQ ID NO: 2843

SEQ ID NO: 4850 - DNA, 601 bp, Human; identical to SEQ ID NO: 2844

SEQ ID NO: 4851 - DNA, 601 bp, Human; identical to SEQ ID NO: 2845

SEQ ID NO: 4852 - DNA, 601 bp, Human; identical to SEQ ID NO: 2846

SEQ ID NO: 4853 - DNA, 601 bp, Human; identical to SEQ ID NO: 2847

SEQ ID NO: 4854 - DNA, 601 bp, Human; identical to SEQ ID NO: 2848

SEQ ID NO: 4855 - DNA, 601 bp, Human; identical to SEQ ID NO: 2849

SEQ ID NO: 4856 - DNA, 601 bp, Human; identical to SEQ ID NO: 2850

SEQ ID NO: 4857 - DNA, 601 bp, Human; identical to SEQ ID NO: 2851

SEQ ID NO: 4858 - DNA, 601 bp, Human; identical to SEQ ID NO: 2852

SEQ ID NO: 4859 - DNA, 601 bp, Human; identical to SEQ ID NO: 2853

SEQ ID NO: 4860 - DNA, 601 bp, Human; identical to SEQ ID NO: 2854

SEQ ID NO: 4861 - DNA, 601 bp, Human; identical to SEQ ID NO: 2855

SEQ ID NO: 4862 - DNA, 601 bp, Human; identical to SEQ ID NO: 2856

SEQ ID NO: 4863 - DNA, 601 bp, Human; identical to SEQ ID NO: 2857

SEQ ID NO: 4864 - DNA, 601 bp, Human; identical to SEQ ID NO: 2858

SEQ ID NO: 4865 - DNA, 601 bp, Human; identical to SEQ ID NO: 2859

SEQ ID NO: 4866 - DNA, 601 bp, Human; identical to SEQ ID NO: 2860

SEQ ID NO: 4867 - DNA, 601 bp, Human; identical to SEQ ID NO: 2861

SEQ ID NO: 4868 - DNA, 601 bp, Human; identical to SEQ ID NO: 2862

SEQ ID NO: 4869 - DNA, 601 bp, Human; identical to SEQ ID NO: 2863

SEQ ID NO: 4870 - DNA, 601 bp, Human; identical to SEQ ID NO: 2864

SEQ ID NO: 4871 - DNA, 601 bp, Human; identical to SEQ ID NO: 2865

SEQ ID NO: 4872 - DNA, 601 bp, Human; identical to SEQ ID NO: 2866

SEQ ID NO: 4873 - DNA, 601 bp, Human; identical to SEQ ID NO: 2867

SEQ ID NO: 4874 - DNA, 601 bp, Human; identical to SEQ ID NO: 2868

SEQ ID NO: 4875 - DNA, 601 bp, Human; identical to SEQ ID NO: 2869

SEQ ID NO: 4876 - DNA, 601 bp, Human; identical to SEQ ID NO: 2870

SEQ ID NO: 4877 - DNA, 601 bp, Human; identical to SEQ ID NO: 2871

SEQ ID NO: 4878 - DNA, 601 bp, Human; identical to SEQ ID NO: 2872

SEQ ID NO: 4879 - DNA, 601 bp, Human; identical to SEQ ID NO: 2873

SEQ ID NO: 4880 - DNA, 601 bp, Human; identical to SEQ ID NO: 2874

SEQ ID NO: 4881 - DNA, 601 bp, Human; identical to SEQ ID NO: 2875

SEQ ID NO: 4882 - DNA, 601 bp, Human; identical to SEQ ID NO: 2876

SEQ ID NO: 4883 - DNA, 601 bp, Human; identical to SEQ ID NO: 2877

SEQ ID NO: 4884 - DNA, 601 bp, Human; identical to SEQ ID NO: 2878

SEQ ID NO: 4885 - DNA, 601 bp, Human; identical to SEQ ID NO: 2879

SEQ ID NO: 4886 - DNA, 601 bp, Human; identical to SEQ ID NO: 2880

SEQ ID NO: 4887 - DNA, 601 bp, Human; identical to SEQ ID NO: 2881

SEQ ID NO: 4888 - DNA, 601 bp, Human
gccgggcgcagtgactcgcacctgcaatcccagcactttgggaggctgaggcgggtgaatcacttgaggtcaggagttcgagacgagcgtgggcaacatggtgaaaccctgtctcttctaaaaatagaaaaattagccagccacggtggcgggcgcctgtaatcccagctactcagggggctgaggcaggagaatcacttgaacccgggaggcagaggttgcagtgagctgaaatcgcgccactgcactttagcctagatgacagagtgcaacttggtctcaaaaaaaaaaaaaaaaaaaatcttggagcagcgttggagaagctccctctgtcccctctctactggctgctgcccctctgaaatggcctttcccttcccaacagatccttgagatttgtttagaagagtctggagagtgagcgcagaggctgactcactgcgtgaccttgctctgccagttaggagataaccttcccatagatgccactttccacatcagtagtttttttttttaagggaaggggagctgggggagaaggcttttggggccttcctactgtaaaagctcaagttccttacactcactgctttctctctat

SEQ ID NO: 4889 - DNA, 601 bp, Human
aaagggtgctcctcgcagatggaacaatggcgagagcagagcacacctgaacaaaggagggaagcaatttttttttaagacagagtcttgctctgtcgcccaggctagagcgcagtggagcgatctcagctcactgcaagctccgcctcctgggttcacaccattctcctgcctcagcctcccgagtagctgggactacgggcgcccaccaccactccaggctaatttttttgtatttttagtagagacggggtttcaccttgttagccagtatggtctcgatctcctgacctcgtgatcygcccacctcagcctcccaaagtgctgggattgcaggcgtgagccaccgcgcccagcccacgaagttagtttttaaaagaaactaatacttctaacacttatgatttattctttaatacccaccaaaaattaagagccattgttccttactcaaaagttgctaataggagagaagcttctagagcaagttggccagacaagtcaagtacaaactgaagagtaaatcaagctttgctaacaatttcagaaacatttattgggtcccaaagaagttgcctcccaatttcccctctgccaacag

SEQ ID NO: 4890 - DNA, 601 bp, Human; identical to SEQ ID NO: 3182

SEQ ID NO: 4891 - DNA, 601 bp, Human
tgtatttttagtagacacggggtttctccatgttggtcaggctggtctcaaactcctgacctcaggtgatccgcccacctcggcctcccaaagtgctgggattacaggcgtgagccccaccgtgcccggcctgaatttttttattttaatttttagatacagggtctcactctgttgcccaggctggagtgcagtgatgcgatcacagctcactgcagcctcaatctcctgggctcaagcgatcctcccacaggttagaccactggtgtgtgcgaccatgcccagggattttattttttttgtggagacaggggtctcaatattgcccaggctggttttgaactccagggctcaagtgatcctccttccttggcctccaaaagtgttgggatgacaggcatgagacactgtacccagccaataaaatgttccattctgttccttggccacagcagctctacttcaagtgctcaatactcacaggtggccgggcacagtggctcacgactataatcccagcattttgggaggctgaggtgggcggatcacccgaggtcaggagtttgagactagcccggccaacatggtaaaacctcgtctc

SEQ ID NO: 4892 - DNA, 601 bp, Human; identical to SEQ ID NO: 3183

SEQ ID NO: 4893 - DNA, 601 bp, Human
atagtcccagatacttgggggactgaagcaggagaattgcttgaacccgcaaagcggaagttgcagtgagccaagattgtgccactgcactccagtctggacaactgagcgagactccatttcaaaaaaaaaaaaaaaaaaagcagccctggcttagagccaggcgtccctgggctcaaatccgtggcaccacctgccaattcacaggccctggccaccagctcaacagccccgagcctcgatttccttgtagaatggagatggtgatgacgtgtcctgcccagaacagggctgatactcrctggatgcctcccagcccgcacctgccacaccaagaaggtgccacggggctccccgctgggtcccctggcctgcctaagatgggggctgaggaggggtcacctgagggctgggccgccccgggcctggcactcacttgaactccgaggagtggttgtccagcaggcccagcttgctcagctcctcgtccacaacatccatgacgtgcttggggaccacgagctccttcaggcgctcccggaacttctcctcgatggcatccttgtcgtccttctccaggcccagctccttcttgatgatc

SEQ ID NO: 4894 - DNA, 601 bp, Human
aaaattaaccaggcgtggtggtgcatgcctatagtcccagatacttgggggactgaagcaggagaattgcttgaacccgcaaagcggaagttgcagtgagccaagattgtgccactgcactccagtctggacaactgagcgagactccatttcaaaaaaaaaaaaaaaaaaagcagccctggcttagagccaggcgtccctgggctcaaatccgtggcaccacctgccaattcacaggccctggccaccagctcaacagccccgagcctcgatttccttgtagaatggagatggtgatgaygtgtcctgcccagaacagggctgatactcactggatgcctcccagcccgcacctgccacaccaagaaggtgccacggggctccccgctgggtcccctggcctgcctaagatgggggctgaggaggggtcacctgagggctgggccgccccgggcctggcactcacttgaactccgaggagtggttgtccagcaggcccagcttgctcagctcctcgtccacaacatccatgacgtgcttggggaccacgagctccttcaggcgctcccggaacttctcctcgatggcatccttgtcgtcc

SEQ ID NO: 4895 - DNA, 601 bp, Human
gccaggcatggtggctcgcgcctgtaatcctagcactttggcaggtcaaggcagccggatcatttgaggtcaggagttcgagaccagcctgaacaacatggtgaaaccccatgtctcctaaaaatacaaaaaattaaccaggcgtggtggtgcatgcctatagtcccagatacttgggggactgaagcaggagaattgcttgaacccgcaaagcggaagttgcagtgagccaagattgtgccactgcactccagtctggacaactgagcgagactccatttcaaaaaaaaaaaaaaaaaaagcagccctggcttagagccaggcgtccctgggctcaaatccgtggcaccacctgccaattcacaggccctggccaccagctcaacagccccgagcctcgatttccttgtagaatggagatggtgatgacgtgtcctgcccagaacagggctgatactcactggatgcctcccagcccgcacctgccacaccaagaaggtgccacggggctccccgctgggtcccctggcctgcctaagatgggggctgaggaggggtcacctgagggctgggccgccccgggcctggcactcacttgaac

SEQ ID NO: 4896 - DNA, 601 bp, Human; identical to SEQ ID NO: 3184

SEQ ID NO: 4897 - DNA, 601 bp, Human; identical to SEQ ID NO: 3185

SEQ ID NO: 4898 - DNA, 601 bp, Human
gggagctggggatgtttttagagaaggcagaaatgttcactttaaacctggactcaagtgaatgccttgcaggatggaaacacgtggtggactcagcagatgcctcacactcggctctcactgaggctacggtttccaaagaaccgctgtctacagaggctggcgaggagggaagccccagaaaagccgcgcccggctgcccacccaaagggtcaggtgggagggcgctgaactctgagggccgtggcccctgcttctgggcctgaggctggccgggacgagtgagcccacagaggcgccraggtttctctggtgtgcgcggcccggtcctcactggagaccgtctctcctgactccagcccacaggcttcggggtggggggtggagccgaccccacccctagtcctggggcatcagccacagcccacatagaccagcatctgcacggcaaacgccggccctgcagctctggcccgggcattgcaggtcctatgctggaactaccgggggtgtctgctgagggccggcccgagaagtctctctcccaggggtcaagccatggaggttcctgccagcgctgtttgagcacctggaatcagct

SEQ ID NO: 4899 - DNA, 601 bp, Human
cgggcctctccgcacgcacctcgtcgatgaggatcagggggttctccgtcttggtcttcttcaaacactggatgatcttcccgggcatggcgcccacgtaggtccgcctgtgggtgcacagcggggtcagaggtcacttggtagcctggctcggccacaacgacaccatgcaccctccagggccacaggggagaggccacctggagccccacaagatgtggccatgatgtgggaggcggaaatgctggcagccgccggatgtgtggcacctgcaggcacgctggtcacttgccctgactcrccagctcagattctggggtcactgattcaaagccagatctccctcagtcccatccctcagctgacaccatggtgaaagccagacaggcgctggcagcagaaggcccccactcctcactgagggacgccaggcacgcctcagccctcaagggctggggtgatactagccatggccagcactggctctcaggagggcttcctgcaagctctgtgctctgccccagcacaggggcccggcccgcgacagggacagaagaatcccaggccccacgagagacagtgaggaaggctctgtctgtgg

SEQ ID NO: 4900 - DNA, 601 bp, Human; identical to SEQ ID NO: 3186

SEQ ID NO: 4901 - DNA, 601 bp, Human; identical to SEQ ID NO: 1796

SEQ ID NO: 4902 - DNA, 601 bp, Human; identical to SEQ ID NO: 1797

SEQ ID NO: 4903 - DNA, 601 bp, Human; identical to SEQ ID NO: 1798

SEQ ID NO: 4904 - DNA, 601 bp, Human; identical to SEQ ID NO: 1799

SEQ ID NO: 4905 - DNA, 601 bp, Human; identical to SEQ ID NO: 1800

SEQ ID NO: 4906 - DNA, 601 bp, Human; identical to SEQ ID NO: 1801

SEQ ID NO: 4907 - DNA, 601 bp, Human; identical to SEQ ID NO: 1802

SEQ ID NO: 4908 - DNA, 601 bp, Human; identical to SEQ ID NO: 1803

SEQ ID NO: 4909 - DNA, 601 bp, Human; identical to SEQ ID NO: 1804

SEQ ID NO: 4910 - DNA, 601 bp, Human; identical to SEQ ID NO: 1805

SEQ ID NO: 4911 - DNA, 601 bp, Human; identical to SEQ ID NO: 1806

SEQ ID NO: 4912 - DNA, 601 bp, Human; identical to SEQ ID NO: 1807

SEQ ID NO: 4913 - DNA, 601 bp, Human; identical to SEQ ID NO: 1808

SEQ ID NO: 4914 - DNA, 601 bp, Human; identical to SEQ ID NO: 1809

SEQ ID NO: 4915 - DNA, 601 bp, Human; identical to SEQ ID NO: 1810

SEQ ID NO: 4916 - DNA, 601 bp, Human; identical to SEQ ID NO: 1811

SEQ ID NO: 4917 - DNA, 601 bp, Human; identical to SEQ ID NO: 1812

SEQ ID NO: 4918 - DNA, 601 bp, Human; identical to SEQ ID NO: 1813

SEQ ID NO: 4919 - DNA, 601 bp, Human; identical to SEQ ID NO: 1814

SEQ ID NO: 4920 - DNA, 601 bp, Human; identical to SEQ ID NO: 2320

SEQ ID NO: 4921 - DNA, 601 bp, Human
ggacacaggatctgaggcctcttcctctcctgatggagggtctctctgagcgctgtctccttcatgaagtctttccggattctgggttggaattaatcattcctttctctgaattcccatggcactttccccatcccatcatgggtatcttctaagactcatcactctctgctctgtcctaggagtatttgagtctgtctctttgtactctcccaagctgagagtcccttggccccttgaaagctgtctctccttctttatggttcccctccatggattctgatcactgtacctaagacayggccctcaatcaattttgttgactgtattgaacagatggaagaatagtcatctactagcacattgcagaaagggagctgttgggttcattgattttgtgtggttggaagggttgactctcagaaaaagagcacatacttcttccagacagtaggttggttgtggtcagatgtgtacatctggggcatgcatctgctctctccagtgtgcttggaggatgctgtctacacacaaacttctcgaaacttaaccccttctaaagttttatggatctccactccctttgaagaagaccatgctc

SEQ ID NO: 4922 - DNA, 601 bp, Human
tggggatttctccccaccggcaagctagcaatcagttcttcagtggacaccagctgggtgtcccccaattcaattccaacactatttacctggagatagcatcagatcccacatgttgagggacacaagactgccccctccttcccacgagtcatattaataagtccgtgcctccggaacttctgatggactggcttcaagttggggttcccatggtcccctctttgagtttaattaatttgctagaggagctcacagaactcagggaaacacctatttacatttactgtaagggttaggsttaggttcatgtaacacttccttacatttattatgaaggacattttcaaggatacaaataaacagccaggtgaaaagatatacagggcatagtccagaaaggtcctgagcacagaagcatctgtccccagggagtgggggcgcaccaccctcctggcacatggatgaattcttattcgcccacccagcagtgtgcagcagcctggtcctcatgcctcccatctttctcatgggtggacagtatgtctcatttgctcccacatcccctcctctagcgcagggcctgacactgggcacgtgc

SEQ ID NO: 4923 - DNA, 601 bp, Human
aacttctgatggactggcttcaagttggggttcccatggtcccctctttgagtttaattaatttgctagaggagctcacagaactcagggaaacacctatttacatttactgtaagggttagggttaggttcatgtaacacttccttacatttattatgaaggacattttcaaggatacaaataaacagccaggtgaaaagatatacagggcatagtccagaaaggtcctgagcacagaagcatctgtccccagggagtgggggcgcaccaccctcctggcacatggatgaattcttattygcccacccagcagtgtgcagcagcctggtcctcatgcctcccatctttctcatgggtggacagtatgtctcatttgctcccacatcccctcctctagcgcagggcctgacactgggcacgtgcccattaggttcatttagtgaaggagataccaaaggaaatggccttctcttctctagtgagcaactggccacgtcgaggtttcaagttgcagtcaggatgcatgctgggtgtgtgccccctactgcaccacccctgggggtcttggtctttgcaaggtctaggggccatgtagaggct

SEQ ID NO: 4924 - DNA, 601 bp, Human
ccctgggggtcttggtctttgcaaggtctaggggccatgtagaggctcctgcagcccacacttggggagatggtgtgggtggcaatggaggatgttccctttcaacaggggcagtctggaaaacactgcctctgtgttattctcactcatctcgccaactgcatgaccttgggcaagtccttttgctcatgtagtttatccctagaatagatctgtaaaaagacctcacacccatgttgtccatccctggcttttcacagatgacaaaactggaagggaaggagactcgctcaaggtcacrcaatgagtggctgagcctgggttttgactccatgtccactgttttctcagagcttcacttcccgattgtcttttctgccaaatcgggagagtcaggccattctgcttatttcataggattcctgttagagtcaaacgaaaaagcgtggctgtcaaagtgcattcagatgtacgcagggctaaatcactaaccaaactttgcccaaagagatgccacggcaatgccaggcagacaccagatgtcagtttccccttcactgagatacggaccccactcctgacccagtggccttggggcgag

SEQ ID NO: 4925 - DNA, 601 bp, Human
caaccccacctgagggtggcttctcagcccgtggtcctgtgacaagccctttctaccgcttcctctgcaggcccgctaatgagttcttcgttgtttgtgttgagaagaggcagctgaaggattggagtgtgctttcttctgaatttatcccattaggaagcagactatctcaaaagagaaaaaaaatgtcattaagacttcactgagcactgtgtaaggcttaagaaaggtcaggaaccacctcaagagtatgcggaggtcctgaggagcacgatgacagcttgactcacggtgagagtgygttgctccaggaagggccacctctcctcctaccatagagtcctcgctggggctgctggggggaccacccactacccttgcttgtagcacttattttaccctgggctcactaaacctgctcatctccactacaacattcaagaaccgtcaaactcctgatccagtaaccttctatgactagcgtgcatcatggcatttacagtaaagctagccctctacagctcacacctctgactgccaaaggcacatatagaggccccattgccgggtctatcgttcttgcagcagtacttctaaaatt

SEQ ID NO: 4926 - DNA, 601 bp, Human
atacaagttactttaattctaatcccctggcagaatttatagcatatccattcctcattctatctctctaagggataatcataacaagttctatttgcttctgacagactgacctaaaatcactcattgcagccgggcacagtggctcacgcctgtaatcccagcactttgggaggccaaggcagatggatcacaaggtcaggagttcaagaccatcctggctaacatggtgaaaccccgtctctcctaaaaatataaaaaattagccgggcgtggtggcgggcacctgtagtcccagctrcttgggaggctgaggcaggagaatggcgcaaaccccggaggtggagcttgcggtgagccgagatcgtgccactgcactccagcctgggctacagagcaagactccatctcaaaaaaaaaaaaaaaaaacactcattgcctattttttcataagccacatggcgcttgtctttcacatatccgcctttcaaaggggcagtaagcagaaaatacccaagaaggaaaggaagaggaaggtcccatcagaatttgggcaaaggctcatgtgttttggtggatcattcaagcaagtctgtttcct

SEQ ID NO: 4927 - DNA, 601 bp, Human
cttaaaaattaactagcaggccgggtgtggtggctcacgcctgcaatcccagcactctgggaagccgaggtgggcagatcacttgaggttaggagtttgagaccagcctggccaacatggtgaaaccctgtctctactaaaaatataaaaattagccaggcgtggtggtgtgtgcctgtagtttcagctactcaggaggctgaggtaggagaatcgcttgaacttgggaggtggaggttgcattgagccaagatcacaccactgcactccagtctgggcaacagagtgagactccgtctcaaaaaaaaaaaaaaaaaaatcaactagtgtagtggttctcaaagtgaggccccacaccagcagcctcagcttcacctaggaacttattagagatacagattcccaggttccatctcaaacaacagcccttagggtgaggcccagcaatctgtgttttcacaagcctccaagggattctgatgctcctgaacttttaagaaccattgacccaaagacatgggattgcttatctcaggacagaaagctgatgctcctgatgtgtttgctgacgcttggagctgtggctctcaaacttcagcac

SEQ ID NO: 4928 - DNA, 601 bp, Human
tgggcactctgtctttctttgatggcttcttgcctgagaaaaacacacagaaagctctcctaaagcacaaattctctccaagctgaaactaggaggagaaatattcaatctgtgactaaaatggggtctctgccggtgatcaagagagtgcccttttagtgtctgtgtgtttatattcaggtctccatagtgcagatggcaacccacagggtgcagggagtggagaaggattttcccaggaccccagagtaggaatggggtccacagggctggtgctgggagcagaacccagccatccgcrgaggctggatttcatgggaaaatgagcttgtggaagggcactttctgagggctcagctagcaggaaaggtcactttcttctgaagccactaagcatgttattccaaatcagtggagctgaaaagatttatttaaaaggctatgaaatatcccttttttaaagggaaaaatatgatcaaggggattagaacggaggctgtacttgagagtcaggtgtccctgaacacccaggcagacttggaaagctcattgtgttggcgttcagtgcctccctgtccccttcccatggcagaagaggatc

SEQ ID NO: 4929 - DNA, 601 bp, Human
tatctctttcatttctatattcctggcacctagcatagtatctgatccattgtatgagttcattcaatgctaattggctaatgaacaagccaagcctctgcctttctattgaataagcatggtcttcaagcataaattctcttcctcagggcagcattcaaggatttgaagtcatctaccatgtccctctaaatctcggtaggctagaagcccccctatacaaaaatattcaggtactcttctaagtgcttaatgggtgttaacctactaaatcctcataacaacctaataggtgctgttrttgcccccattgtctagatgaagacactaaggcacagagagtaacttatccagggtcacctgcctggtcaatggcagcgttggactgcaaagcccagtggcagctcagagactgtgctctcagccactgagctcagctgctttgatggccattcaggtgactgcatttccagagctcacactatcctgactgccctttcattgacctccttcttggcaaaccattttttttttttttttttgagacggagtttgctcttgtagcccagactggagtgcaatagtgcagtctcggctcact

SEQ ID NO: 4930 - DNA, 601 bp, Human
agtggcagctcagagactgtgctctcagccactgagctcagctgctttgatggccattcaggtgactgcatttccagagctcacactatcctgactgccctttcattgacctccttcttggcaaaccattttttttttttttttttgagacggagtttgctcttgtagcccagactggagtgcaatagtgcagtctcggctcactgcaacctccgcctcccgggttcatgcgattctcctgcctcagcctcccaagtagctgggactacaggcgcctgccaccaggcccagctaattttgkttttatttatttattttttttgagacagagtttcactctgttgccaggctggagtgcagtggcacgatcttggcacactgcaacctccacctcctgggttcacgtgattctcctgcctcagcttcccaagtagctgggactacaggcatgcaccaccttgcccagctaatttttatatttttagtagaggcggggtttcatcatgttggccaggatggtcttgatctcttgacctcgtgatctgcccgcctcagcctcccaaagtgctgggattactggtgtgagccaccacgcccagcc

SEQ ID NO: 4931 - DNA, 601 bp, Human
ggaaacatcaccactttagagagaacccaatgcatgaaaatctaaacttacaaaattatattggaggctagggtgtgcttaggtaaactatcattcatccactaaatagaattgttacacgagtatgttctatgatgtttttgaagagtttgcaataacatagacaattttgtgtaataatagtaagtttgaaaagcaagatacagaattatgaagatggtatgatcataagtttaaaacaaggagaaaataactaaacatttttttaaaatagacttgagtaagggtccccaacccctgrgctgaggaccaggactgtctgtggcctcttagaaaccaggccacacagcaggaggtgagtggctggtgagggagcatcctcacctgagctccgcctcctgccagatcagcagtggcattagagtctcataggagctctaaccctattgtgaactgcgcatacaaggaatctaggttgcacgctccttatgagaatctaatgcctgatgatctgagtgtaacagtttcatcccaaaaccatctcccagctcctcttcccggtccgtggaaaaattgttttccacgaaactgatccctggtg

SEQ ID NO: 4932 - DNA, 601 bp, Human
gagtggctggtgagggagcatcctcacctgagctccgcctcctgccagatcagcagtggcattagagtctcataggagctctaaccctattgtgaactgcgcatacaaggaatctaggttgcacgctccttatgagaatctaatgcctgatgatctgagtgtaacagtttcatcccaaaaccatctcccagctcctcttcccggtccgtggaaaaattgttttccacgaaactgatccctggtgccaaaaaggttggggactgctgggctagaagtaaaaactccaaaatgttaacaatgrttcgacaaggcatagccttctttcaataattcccaaaaatatgtaaaatgaacattcatggttttatcacagtaaccttttcaggtgggaagttgggaaagtttgctgcaacagtttacccattgcaaaaagagtggtaaacctggattattcggttactgaaagaaaagggtcaagcaccccagcgtgtggcccaggagtccacggacagggaccctcaactgccttctgctctgaggtgcccactgtgtcatgtgtgtaaggtttttttttgttgttttttttttgagacagggtccc

SEQ ID NO: 4933 - DNA, 601 bp, Human
agtctcataggagctctaaccctattgtgaactgcgcatacaaggaatctaggttgcacgctccttatgagaatctaatgcctgatgatctgagtgtaacagtttcatcccaaaaccatctcccagctcctcttcccggtccgtggaaaaattgttttccacgaaactgatccctggtgccaaaaaggttggggactgctgggctagaagtaaaaactccaaaatgttaacaatggttcgacaaggcatagccttctttcaataattcccaaaaatatgtaaaatgaacattcatggtttyatcacagtaaccttttcaggtgggaagttgggaaagtttgctgcaacagtttacccattgcaaaaagagtggtaaacctggattattcggttactgaaagaaaagggtcaagcaccccagcgtgtggcccaggagtccacggacagggaccctcaactgccttctgctctgaggtgcccactgtgtcatgtgtgtaaggtttttttttgttgttttttttttgagacagggtcccactctgttgctcaggctggagtgcagatcatagctcactgcagactccatctcccaagcaatcct

SEQ ID NO: 4934 - DNA, 601 bp, Human
tggctattttttattttattttatttttagtagagacaaggtctcgctatgttgctcaggctggtctcaaactcctgagctcaagcaatcttcctgcctctgcttcccaaagtgctgggattataggcatgagcccctgcacctcccaggtctataaatcttacctccccacccagagtggctgctctgcctcaggctgcagcctctgggaagaggagacttctggacaggctggtggggtgagggtgggttccatgcccccgggaaataggacaacctcctcataggtagagtgggcagstactaactagtgccatgtgagcctaagcaagttacttaacctccctcaggctggctccatcccctcataataactcaggtttctgtgttctcagatacctaaaattgtaccactaatagtaaattgtattggagtggttgaccatgtattagtttctcttctaagataccgataaagggagtgaagatgagtgggaacaagtcagaaaattcttactgtaatgaacttgtcaaaatggattaattaggaagcactgggctaggggaagggagttgaactcaaaaggagaccagaatacag

SEQ ID NO: 4935 - DNA, 601 bp, Human
tcaccaacacttttttttttttaaattttagccatcctagtggatgtgaagtggtgtttcattgtggttttgatttgcatttcccagatggctgatgacgttgaacatcttttcatgtgctaattggccattagtatatcttctctggagaactgtctatttagaccctttgttcatttttaattgggtttttaaaattattgaattataaaagttttttaaatattccaaatgtaagtcccttattagatggataattgcaaaaaaaatttcaacccaaattttcaactcaagttctttkgtgttgtctttttcacttccttgatgttgtcctttgaagcacagaagtttttcattttgatgatatctagtttatgtcctttttcttttgctgcttttgtttgtggcatcatatctaagaaaccactgtctaatccaaggtcatgaagatttatgcctatgatttcttcaatttttgtagttttagctcttcagtttaggtctttgatccattttttagttgatttttatacattgtatgagatagggggtccaacttcattcttttgcatgtgggtaatgatcccagcaccatctcttg

SEQ ID NO: 4936 - DNA, 601 bp, Human
tcctagtggatgtgaagtggtgtttcattgtggttttgatttgcatttcccagatggctgatgacgttgaacatcttttcatgtgctaattggccattagtatatcttctctggagaactgtctatttagaccctttgttcatttttaattgggtttttaaaattattgaattataaaagttttttaaatattccaaatgtaagtcccttattagatggataattgcaaaaaaaatttcaacccaaattttcaactcaagttcttttgtgttgtctttttcacttccttgatgttgtcctwtgaagcacagaagtttttcattttgatgatatctagtttatgtcctttttcttttgctgcttttgtttgtggcatcatatctaagaaaccactgtctaatccaaggtcatgaagatttatgcctatgatttcttcaatttttgtagttttagctcttcagtttaggtctttgatccattttttagttgatttttatacattgtatgagatagggggtccaacttcattcttttgcatgtgggtaatgatcccagcaccatctcttgaaaacactattttttcccattgaattgtcttgga

SEQ ID NO: 4937 - DNA, 601 bp, Human
tctagaaaatgcaaactaatctacagtgatggaaaacaaattagtggttgcctagggatggaaagggattacaaagaggaatgatgaatattttgaggatgatgaatatgttcttttttttttcttttgagacagaatcttgctctgttgcccaggctggagtgcagtggcgtgatctaagctcactgcaatctccatcccccaggttcaagtgattctcctgcctcagcctcccaagtagctgagattacaggcaagcaccaccatgcccagctaatttttatatttttttagtagagaygggagtctcaccatgttggccaggctggtcttgaactcctgacctcgagtgatccgcctgcctcaccctcccaaagtactgggattacaagcttgagctaccactcctgacctaatatgttcattatttttattggtgatggggtgtgtgtgtgtgtgtgtgtgtgtgtgtgtgtgtgtgtaaacttaccaaaatagcacactaaatatgtgcagttattgtatttcagttatacctcaatgaagctgttttaaaataaatacgtttattcaattaacaaatatttgaatgccaactatg

SEQ ID NO: 4938 - DNA, 601 bp, Human
gatggaaagggattacaaagaggaatgatgaatattttgaggatgatgaatatgttcttttttttttcttttgagacagaatcttgctctgttgcccaggctggagtgcagtggcgtgatctaagctcactgcaatctccatcccccaggttcaagtgattctcctgcctcagcctcccaagtagctgagattacaggcaagcaccaccatgcccagctaatttttatatttttttagtagagacgggagtctcaccatgttggccaggctggtcttgaactcctgacctcgagtgatccrcctgcctcaccctcccaaagtactgggattacaagcttgagctaccactcctgacctaatatgttcattatttttattggtgatggggtgtgtgtgtgtgtgtgtgtgtgtgtgtgtgtgtgtgtaaacttaccaaaatagcacactaaatatgtgcagttattgtatttcagttatacctcaatgaagctgttttaaaataaatacgtttattcaattaacaaatatttgaatgccaactatggtctaggtgttggagatacaaggctgaaacacaagactctagacaaggttcctgcc

SEQ ID NO: 4939 - DNA, 601 bp, Human
tgacctaatatgttcattatttttattggtgatggggtgtgtgtgtgtgtgtgtgtgtgtgtgtgtgtgtgtgtaaacttaccaaaatagcacactaaatatgtgcagttattgtatttcagttatacctcaatgaagctgttttaaaataaatacgtttattcaattaacaaatatttgaatgccaactatggtctaggtgttggagatacaaggctgaaacacaagactctagacaaggttcctgccttcgtggagtttatatttaagtggaaaacttatatagaccagattatttttragagtcctggaatttacccacacagctctttcagccccagaggagaagtttcctccctcccagagctgcaggagaactggcaacacagctggatgtagggtggcatggagctgggtgtagggtggcatggcgctggagtccagtgatagactaacagtggttagattgtctcgcttctctctggatgtcccccttaaggcgtctgatcaccatccatgctcccactcctgaccagcaggaagtgggtcaggtctgagaacagacccctgtggtcccttgtagtccttcatgtctgagaac

SEQ ID NO: 4940 - DNA, 601 bp, Human
caagggaggccagtgctgtttacttcacaccttccgacggtttgggaagagaatccaatgttgtaaagcctgccatcttcttgaatggcaccagatactgacactcggtacacgcagctctctggagcatgctgttttctcggtggcactgatctgctgccttcacagagagttctgatacaatcatggcatgcagaaaagagcaaaatatcaaggggccagagcaccacggttctcagacacacaatgggagagccaggtaaggacatagaaatcagccagccccctagaaaggcccccyagaagtaactcacctgaggtgatggtagagactggatttgctttcaggagtaaaccaaggaacagcaaaacaaaaataagcctcgttaggagtcgtgttactctttggtttttaacttcaaattaatttctcttctgaaccttctgcagaccaagctgccaaatgtaactccagttttccacacttctgcctatagccttgcaccgtagtgaactaaaattcagaaagactggaagctaaggaagtcactcagtcatcaaacattaaattctgttccctggcagctatgtacccaggcag

SEQ ID NO: 4941 - DNA, 601 bp, Human
ctccatcttaaaaaaaaaaaaaaaaaaaaaaaagctattctgctgcctggaattctgattcctcatgcgctggtgttccacctttgaggagatgggcagggggaatagatgttttagagaacagcactgaggactaagtcacaggatgttcaagttaacaaaattgcacatatttgctgacttttccttcaagggcctctaggttaaaaatgaggttgtccagccaggcgtggtagctcacgcctgtaatcccagcactttgagagaatcgcttgagcccaggagttcaagaccagcctcrgttgggcaacagagcgagaacccaccttgacaaaattttaaaaaaggggggctgttcttcttgaagactcaagtacataagctaataaaggctctgataagtcctgcaatttacaaaccagtttaactatatctcagatttctccaaatttgacatgaagtctattcactaggtaacatccaataacaataacaacaacactttaggaagattgagctagtgcaacctcttattgtaaatggtgtcttaggaattaataccgtgggtcctagaatctggtcatccttattagaaaggggt

SEQ ID NO: 4942 - DNA, 601 bp, Human
tagcctggagaattcctttgcaaaatagcttatcattttcaggttttgcctaaagattttcagcaggctctggccccagtgcacctttgtcaagggagcagctccaatagtttgtcaagagaataaaagtatcggcagccaggactggttttagccaaaactgcagagacggcagagtcttttcttgtaatctcccagtctcccatctgtctaccccttccctacctgagcactcagatctacactttggttacccccatctcctttcccatcccccctcacacccaccttctttcaaaaytctttgatagatcttaaaaagggagctggtgccagcctttacactttagtatgaatgtaactcagggtcacatagcttagaatgtctacattttaagttttattttggattatgaaaggggaggttgaatccctttccaggtaaaagattcttcaggcatcagctagcaggtagaggcagtggtttttgaacaacccttctgctgttgctccagaagccacactgcctcactgttgttagcctgtagcccaggtcctgggcattctcacccagaggctccatgcagggcctctctccgcg

SEQ ID NO: 4943 - DNA, 601 bp, Human
caggtagaggcagtggtttttgaacaacccttctgctgttgctccagaagccacactgcctcactgttgttagcctgtagcccaggtcctgggcattctcacccagaggctccatgcagggcctctctccgcgctctggagggaattggccctcattctccgtggaccaaatgatgcatatgagatctctggtgcaggccactgcattctttgtaggacagaatttcgacattcaggatcaagcagggcctcagattcactgttgagagcccaggggaaataatgctggacagtagcaggracgagccctggttctgttccttaagaattatgtgaccttaggcaagctatgtatccctctctaagctcagttttctgacctataaaaaggaaacaacagtgttgattttacagggttgttctaaggactaaatgagataaagaatgcgaagtgcttagcatagtgctgggcagggagagggccctcaataaatatgagctgtttgcagctcttattacttggtgggacagagctaggggcctgtgggaagaaagaaaacaaaagggccaaagcaggctagaagctggggttggagaactc

SEQ ID NO: 4944 - DNA, 601 bp, Human
cactgcattctttgtaggacagaatttcgacattcaggatcaagcagggcctcagattcactgttgagagcccaggggaaataatgctggacagtagcagggacgagccctggttctgttccttaagaattatgtgaccttaggcaagctatgtatccctctctaagctcagttttctgacctataaaaaggaaacaacagtgttgattttacagggttgttctaaggactaaatgagataaagaatgcgaagtgcttagcatagtgctgggcagggagagggccctcaataaatatgagytgtttgcagctcttattacttggtgggacagagctaggggcctgtgggaagaaagaaaacaaaagggccaaagcaggctagaagctggggttggagaactcagaataatgacacctgtttccatcagctccagctttgatcgtgtccttttacaggatccccaggcaggagaacaccgagttaggaatggtgactggcttcccagtagagtctgggttttgaactcatgagtaaggacagcagctcctccgttttgcaggggcatccacctgaaccacaggcaaggcagaagtgatccta

SEQ ID NO: 4945 - DNA, 601 bp, Human
cttcccagtagagtctgggttttgaactcatgagtaaggacagcagctcctccgttttgcaggggcatccacctgaaccacaggcaaggcagaagtgatcctaaggcgttaaatagatagtgcaggctaggcacggtggctcacgcctgtaatcccagcactttgggaggctgagatgggtggatcacttgaggccatgagttcgaaaccagcctggccaacatggtgaaaccctgtctctactaaaaaaaatacaaaaagtagcctggcatggtggcgcatgcctgtaatcccagctacycaggaggctgaggcaagagaatcacttgaacctgggaggtggaggttgcagtgagccacgatagcaccactgcactccagcctaggcaacagagagagactctatctcaaaaaaaaagatagtgcacagtctacaagcaaagtgaatatattttacctgtgcctgtgtgccctcactttatacacaattgtaataaacttcatcatgtggttgtcaaatccgcagcggactacgagcagcaaactagggactcaacaggcacaccaagcagagagcagtgatagctgacagtctgacaaa

SEQ ID NO: 4946 - DNA, 601 bp, Human
tcccagtagagtctgggttttgaactcatgagtaaggacagcagctcctccgttttgcaggggcatccacctgaaccacaggcaaggcagaagtgatcctaaggcgttaaatagatagtgcaggctaggcacggtggctcacgcctgtaatcccagcactttgggaggctgagatgggtggatcacttgaggccatgagttcgaaaccagcctggccaacatggtgaaaccctgtctctactaaaaaaaatacaaaaagtagcctggcatggtggcgcatgcctgtaatcccagctactcwggaggctgaggcaagagaatcacttgaacctgggaggtggaggttgcagtgagccacgatagcaccactgcactccagcctaggcaacagagagagactctatctcaaaaaaaaagatagtgcacagtctacaagcaaagtgaatatattttacctgtgcctgtgtgccctcactttatacacaattgtaataaacttcatcatgtggttgtcaaatccgcagcggactacgagcagcaaactagggactcaacaggcacaccaagcagagagcagtgatagctgacagtctgacaaaga

SEQ ID NO: 4947 - DNA, 601 bp, Human
aagcaaagtgaatatattttacctgtgcctgtgtgccctcactttatacacaattgtaataaacttcatcatgtggttgtcaaatccgcagcggactacgagcagcaaactagggactcaacaggcacaccaagcagagagcagtgatagctgacagtctgacaaagagacagaaaaaaatacaaaggcagactgagaattcaccaagagtcacagctctcaggctctttagagaggtttcttccgcccttcgacttctgagtgctgcactatgtgatgatccaaatcataactgatgttygaatcttgaccctgtaaaaggatattaaattatcgtcaattttaagcagccagttgtgtgaatgacagtagcctctgggtggagtggtgctttcaagcgtgcatgtgctttccgtgggtttgtttccacgtgtttgcttaccattggattcccgtggtaatcctgtggtataggaagggtgtgtattattttatagagagaaaaactaaggcctagagtggctaagagacttgcctgggcttatgaaacgagtgagtggtagatctgggcttgactccaggacttctgacttgaggctca

SEQ ID NO: 4948 - DNA, 601 bp, Human
cccttcgacttctgagtgctgcactatgtgatgatccaaatcataactgatgttcgaatcttgaccctgtaaaaggatattaaattatcgtcaattttaagcagccagttgtgtgaatgacagtagcctctgggtggagtggtgctttcaagcgtgcatgtgctttccgtgggtttgtttccacgtgtttgcttaccattggattcccgtggtaatcctgtggtataggaagggtgtgtattattttatagagagaaaaactaaggcctagagtggctaagagacttgcctgggcttatgaaacgagtgagtggtagatctgggcttgactccaggacttctgacttgaggctcaatgcattttccaccaaacacattttcaaaccctgttccttggatccccagggttctgccccagggccacaggagggttgcaggagctgctgtaggatgcagagaaggctcatgcacagggctgtggcttcttgcctctgattcagtgagaagcattcggtatttatctgaaagagacttgggatggggaaaatcaaaaaggtcctatgctgagaacatttctatccaaaatgactaaaatccaaag

SEQ ID NO: 4949 - DNA, 601 bp, Human
gggtggagtggtgctttcaagcgtgcatgtgctttccgtgggtttgtttccacgtgtttgcttaccattggattcccgtggtaatcctgtggtataggaagggtgtgtattattttatagagagaaaaactaaggcctagagtggctaagagacttgcctgggcttatgaaacgagtgagtggtagatctgggcttgactccaggacttctgacttgaggctcaatgcattttccaccaaacacattttcaaaccctgttccttggatccccagggttctgccccagggccacaggagggytgcaggagctgctgtaggatgcagagaaggctcatgcacagggctgtggcttcttgcctctgattcagtgagaagcattcggtatttatctgaaagagacttgggatggggaaaatcaaaaaggtcctatgctgagaacatttctatccaaaatgactaaaatccaaagaaagtcgtgggctgtgtgcatactgcgataaatctgctgctctctgaaaaacttggccatcagaatgacctccctcaaggatgccacaatcttgctggacacagattttctgaggacagccctagatgact

SEQ ID NO: 4950 - DNA, 601 bp, Human
aaaaactaaggcctagagtggctaagagacttgcctgggcttatgaaacgagtgagtggtagatctgggcttgactccaggacttctgacttgaggctcaatgcattttccaccaaacacattttcaaaccctgttccttggatccccagggttctgccccagggccacaggagggttgcaggagctgctgtaggatgcagagaaggctcatgcacagggctgtggcttcttgcctctgattcagtgagaagcattcggtatttatctgaaagagacttgggatggggaaaatcaaaaagktcctatgctgagaacatttctatccaaaatgactaaaatccaaagaaagtcgtgggctgtgtgcatactgcgataaatctgctgctctctgaaaaacttggccatcagaatgacctccctcaaggatgccacaatcttgctggacacagattttctgaggacagccctagatgactctcagcctccatcctccctcctcatgcacgtgggctcctcaggccacccagggccattactgcccttcataatccctatcccatgggccaaacacgtccccctcacctcagaagtcccctggct

SEQ ID NO: 4951 - DNA, 601 bp, Human
actccaggacttctgacttgaggctcaatgcattttccaccaaacacattttcaaaccctgttccttggatccccagggttctgccccagggccacaggagggttgcaggagctgctgtaggatgcagagaaggctcatgcacagggctgtggcttcttgcctctgattcagtgagaagcattcggtatttatctgaaagagacttgggatggggaaaatcaaaaaggtcctatgctgagaacatttctatccaaaatgactaaaatccaaagaaagtcgtgggctgtgtgcatactgcgrtaaatctgctgctctctgaaaaacttggccatcagaatgacctccctcaaggatgccacaatcttgctggacacagattttctgaggacagccctagatgactctcagcctccatcctccctcctcatgcacgtgggctcctcaggccacccagggccattactgcccttcataatccctatcccatgggccaaacacgtccccctcacctcagaagtcccctggctggtgtcctgttctctcaaagtcctgctgagagacaaatggcaaactcccaaatgaactccactaagaaagcat

SEQ ID NO: 4952 - DNA, 601 bp, Human
tctgaggacagccctagatgactctcagcctccatcctccctcctcatgcacgtgggctcctcaggccacccagggccattactgcccttcataatccctatcccatgggccaaacacgtccccctcacctcagaagtcccctggctggtgtcctgttctctcaaagtcctgctgagagacaaatggcaaactcccaaatgaactccactaagaaagcatgtttattttctcttgtatcttctccatccaccggagccctatgttaagctatttacagtgggctcatggctgtatctcccsagctgtgagtaattaatacttaatgaatgacagatgtcactctggtggacccagaatattaacccaaataatttattcttaatgtgggaatatcgggcccatgactggccctcaggaagttgtttgagtagagaggcctttggtgaccccatagaggtggtcacttattcatccaggaagattgggacctgcttgtctctttgccaacacccagctctccttgctcccttactctgcatccacaccaacctcagtgagagaggagagagcaaagaggcatccagatgttagtcattactc

SEQ ID NO: 4953 - DNA, 601 bp, Human
tccctatcccatgggccaaacacgtccccctcacctcagaagtcccctggctggtgtcctgttctctcaaagtcctgctgagagacaaatggcaaactcccaaatgaactccactaagaaagcatgtttattttctcttgtatcttctccatccaccggagccctatgttaagctatttacagtgggctcatggctgtatctccccagctgtgagtaattaatacttaatgaatgacagatgtcactctggtggacccagaatattaacccaaataatttattcttaatgtgggaatatcrggcccatgactggccctcaggaagttgtttgagtagagaggcctttggtgaccccatagaggtggtcacttattcatccaggaagattgggacctgcttgtctctttgccaacacccagctctccttgctcccttactctgcatccacaccaacctcagtgagagaggagagagcaaagaggcatccagatgttagtcattactccatcaccactgtcaccattgacagatgcttactgactgtgaaaagtctgtgctgggtattgcaggagggaaattatattattacttctttacctg

SEQ ID NO: 4954 - DNA, 601 bp, Human
gtcttgtatggaacactttcctttccattcctacctttctagccctgttttcccctatataaggggtcatttggagctggagggcattccgaggacagggcgcttgacgtgagccttgtgggttgtcaagatttaaagagggagggaggaggaggcactccaggtcagggtgatgacaagacagaaggtggcggatgccacgcgtgcagtagagagagctagagagagcgcctggggagccgagagtgagaaggctgcataggatgaggacggaggcagagggagcacctgagaaataagrctgcaggatttggacaaaatataacaagcaagaggaaaccatcaaagtctctatcaaaatggagattgcgaaagggagggcagagtgacatctattcagagctgggagcttctcctacattttctgtttcattctgacagcaaccctatgaagtagatattggctcctttaatgcagctgaggaaactgaggctcagagaggttaagaaagttgctttaagtcaccagcaaataagttgctgactcaggatttgaacccagcctcagagcttgtgttttcagcacagtactcaagggatc

SEQ ID NO: 4955 - DNA, 601 bp, Human
ttagcagactccccagggggttctgatgcatgcttaaggttgagaattgctgatgtagagcatagcatagctgttcaaaacaaaacctgggtttattcagttttcacacttaactagccactctcaccttctctttcccaagcctgactttactcatctgtaaaataggaataagaacagcaaacctaccggcgtagcatatgggtgtcacagaatgggagcttctctgcttggttcactgctctgtcccagcacccagaaaagtacctggagcagagtagaagctcaatagatatttgcyacattaataattcaataaatgtattcattgagatttttgatgtaaagtgttaacacagtgtttggcaggcataccgtaagtgcttttagtaatactgctgttattggtgatggtgatgattagttcctgttcagcaaaatgagagacttgactgaaatcactataacatctcttttagagaaggaggcaggtgatcagatccacagcctctgaggtttttaaccacacactaaaatatttaaatgggcaggggacaggggaagctgtcacttgggccacagaggggaaggtaggaagccg

SEQ ID NO: 4956 - DNA, 601 bp, Human
tagcagactccccagggggttctgatgcatgcttaaggttgagaattgctgatgtagagcatagcatagctgttcaaaacaaaacctgggtttattcagttttcacacttaactagccactctcaccttctctttcccaagcctgactttactcatctgtaaaataggaataagaacagcaaacctaccggcgtagcatatgggtgtcacagaatgggagcttctctgcttggttcactgctctgtcccagcacccagaaaagtacctggagcagagtagaagctcaatagatatttgctmcattaataattcaataaatgtattcattgagatttttgatgtaaagtgttaacacagtgtttggcaggcataccgtaagtgcttttagtaatactgctgttattggtgatggtgatgattagttcctgttcagcaaaatgagagacttgactgaaatcactataacatctcttttagagaaggaggcaggtgatcagatccacagcctctgaggtttttaaccacacactaaaatatttaaatgggcaggggacaggggaagctgtcacttgggccacagaggggaaggtaggaagccga

SEQ ID NO: 4957 - DNA, 601 bp, Human
gagaattgctgatgtagagcatagcatagctgttcaaaacaaaacctgggtttattcagttttcacacttaactagccactctcaccttctctttcccaagcctgactttactcatctgtaaaataggaataagaacagcaaacctaccggcgtagcatatgggtgtcacagaatgggagcttctctgcttggttcactgctctgtcccagcacccagaaaagtacctggagcagagtagaagctcaatagatatttgctacattaataattcaataaatgtattcattgagatttttgakgtaaagtgttaacacagtgtttggcaggcataccgtaagtgcttttagtaatactgctgttattggtgatggtgatgattagttcctgttcagcaaaatgagagacttgactgaaatcactataacatctcttttagagaaggaggcaggtgatcagatccacagcctctgaggtttttaaccacacactaaaatatttaaatgggcaggggacaggggaagctgtcacttgggccacagaggggaaggtaggaagccgaataacatcagccacccctgagcctgggcctaccagtacag

SEQ ID NO: 4958 - DNA, 601 bp, Human
aaaaaagaaagaaaacacctaaataatgcagtcactactaaaattgaatcagtagctaaaacttctcagaaagaaaacctcatgtccaatagttttatcaacttcaaccagactttcaattaacaaataatagaaaatagaaaaaaagcttctacctccctgcattatagccttggtaccaaaaccagacaagtgtaatatgaaaaaggaaaattgcgggccagtctcacttatgagactatatttgcaaaagccctgaaaacaatattgacaaacaaaattcagtaatatagccaagcayggcggctcacacctgtaatcccagcactttgggaggccaaggcaggcagatcacctgaggccaggagttcaagcctggccaacatggtaaaaccttgtctctactaaaaatacaaaaattagctaggtatagtggtgcacacctgtaatccccgctatctgggaggctgaggcaggagaatcacttgaacccaagaggcagaggctgcagtgagtcaagatcgtgccactgcactccagcctgggcaacagagcaagactctgtctcaaaaaaaaaataaaaattgagtaatatataaaa

SEQ ID NO: 4959 - DNA, 601 bp, Human
aaagaaagaaaacacctaaataatgcagtcactactaaaattgaatcagtagctaaaacttctcagaaagaaaacctcatgtccaatagttttatcaacttcaaccagactttcaattaacaaataatagaaaatagaaaaaaagcttctacctccctgcattatagccttggtaccaaaaccagacaagtgtaatatgaaaaaggaaaattgcgggccagtctcacttatgagactatatttgcaaaagccctgaaaacaatattgacaaacaaaattcagtaatatagccaagcacggyggctcacacctgtaatcccagcactttgggaggccaaggcaggcagatcacctgaggccaggagttcaagcctggccaacatggtaaaaccttgtctctactaaaaatacaaaaattagctaggtatagtggtgcacacctgtaatccccgctatctgggaggctgaggcaggagaatcacttgaacccaagaggcagaggctgcagtgagtcaagatcgtgccactgcactccagcctgggcaacagagcaagactctgtctcaaaaaaaaaataaaaattgagtaatatataaaatat

SEQ ID NO: 4960 - DNA, 601 bp, Human
ataagactgttgttattcacagatgatttgatcgtttaaataaaactcaaccaaattagtgacttaataaaaagactttagcaatattgctaaatataagatcaatatacaaaaatcaatttcatttgtgtatactgggggctaaaagcaaaaaacataaatagtataccatttataatagcacccaaatgatatttggcaatttgtcaattaagttctgcctcagaattagggcaaactttgcaggttaagagcagtcccacacaagggtgctctcacctcagtcagttgccacaagccygggggtccctaggtcacctgcacatctgacccaagagctacaaatttggagattctcatcttccctcggatttaatcattcacttgactggttcccagaactcagaaaagccctgcatttgttattatagttttattacaaaggattaaagtcaggaccagccaaaagaagagacctagaggatgaggtctgggaagctcccaaatgtgaagtttttgtgttctcaggacatgtcaccttcttagcacatgggtatgtatcatcaaccagggaagctcacttgagcttcagtgcccagag

SEQ ID NO: 4961 - DNA, 601 bp, Human
attcaaagagaatagaagttgagtcaccacataagaaaattagaaacgccccccaaatcttataggtcatgtacaaaagaacactaaatagaattatttcccaaatttgataatccagaaaacttataaggtaaaagaacttataaatatcagccatacaaggctgggcatggtggctcatgcctgtaatcccaacgctttgggaggccaaggcaggtggatcgaatcacttgagctcaggagtttgagaccagcctgggcaacatagtgaaaccctgtctctactaaaaacagaaaaaaytagctgggcatggtggtacacacctgtgttcccagctaccagaaaggctgaggtgggaggatcgcttgagcccaggaggcggaggttgcagtgagctgagatcacaccactgcactccagcctgggtgatggagagagattctgtctcaaaaaaaaaaaaaaaaaaaaaatcaaccattctaaagtatcaaccacactagaagaaagacttagttatctttttaactacctaactttcaaagactgagttatctttcaagctgggcgtggtggtgcatgcctgtagtcccagctactcag

SEQ ID NO: 4962 - DNA, 601 bp, Human
aatccagaaaacttataaggtaaaagaacttataaatatcagccatacaaggctgggcatggtggctcatgcctgtaatcccaacgctttgggaggccaaggcaggtggatcgaatcacttgagctcaggagtttgagaccagcctgggcaacatagtgaaaccctgtctctactaaaaacagaaaaaattagctgggcatggtggtacacacctgtgttcccagctaccagaaaggctgaggtgggaggatcgcttgagcccaggaggcggaggttgcagtgagctgagatcacaccacygcactccagcctgggtgatggagagagattctgtctcaaaaaaaaaaaaaaaaaaaaaatcaaccattctaaagtatcaaccacactagaagaaagacttagttatctttttaactacctaactttcaaagactgagttatctttcaagctgggcgtggtggtgcatgcctgtagtcccagctactcaggagcctgaggtcggaggatcacttgagcccagaagtttgaatctagcctaggcaacatagcaagaccctgtctcttaaaaaaataaagaagcatattacaaaattgtcaca

SEQ ID NO: 4963 - DNA, 601 bp, Human
ttttctgtttccttcttcatacagtgactgccccatcttcctgccctcatctggtgttgactgtgccctggtttcatgatagtctttgcagttgaaccagcatacttactgcccagagctggagtgtatgctccctgaagacagtcccctgattcagagtaccacaaacagggccggacctactggaaacactttataaaggcctgttaaaagagcatctgaaatgagactgtaattctctcgaacaggtgacccgggagctgcctcccagtatgtgggcacttcaaaagtggtgtatctkcctgcaacttgcaggttttcccagaatacaagagtttctgcagaaaagatgtggttccctgtgaatagtgtgatccaaaaagacctttcccaaagtcagggtcagacagggttactgagccaagagttggatttggaccctaacagaagcaactctggagacccctctcaaattgatctcaagacctttctgctgccctcctccccatgctcactccccttctccatccccactgcctgtacttcttccctgcctggccagcctgggcagtggtctcagtgctactcattcagcaggcac

SEQ ID NO: 4964 - DNA, 601 bp, Human
acccctctcaaattgatctcaagacctttctgctgccctcctccccatgctcactccccttctccatccccactgcctgtacttcttccctgcctggccagcctgggcagtggtctcagtgctactcattcagcaggcacctccttcctccagtaacctgcactctccaccttgcccagcctccctttcctaaccaaaacatccctgcttttccaaggggccagagcctctgtggagtgaaagtagctggcatttctaatggcttttataacacgcagccacctgccttcagcatcttctstctgcaggcaccaggcacaccaagaggtcccagcactcaggggctctcaggataagtgggggaggcagtgcgcctccattcacacagagcattcagcaggcgccataatattagtcttgctaacagaagacagtgggcttaacaggtcagtatgtttcctctcccaggtatcgagttgatatgttgacagggaccttacccagcattcctcacagcctgtcctgagaaagactggtccccatgatgcacttagaaaaaagtggataagtggtcaaagaggtttgacaagcactacatact

SEQ ID NO: 4965 - DNA, 601 bp, Human
ctgcctgtacttcttccctgcctggccagcctgggcagtggtctcagtgctactcattcagcaggcacctccttcctccagtaacctgcactctccaccttgcccagcctccctttcctaaccaaaacatccctgcttttccaaggggccagagcctctgtggagtgaaagtagctggcatttctaatggcttttataacacgcagccacctgccttcagcatcttctgtctgcaggcaccaggcacaccaagaggtcccagcactcaggggctctcaggataagtgggggaggcagtgcrcctccattcacacagagcattcagcaggcgccataatattagtcttgctaacagaagacagtgggcttaacaggtcagtatgtttcctctcccaggtatcgagttgatatgttgacagggaccttacccagcattcctcacagcctgtcctgagaaagactggtccccatgatgcacttagaaaaaagtggataagtggtcaaagaggtttgacaagcactacatactaaatccccatctagaagattctgagactttataaataagcttcactggttgttgccagcctgtcccaagggt

SEQ ID NO: 4966 - DNA, 601 bp, Human
atgagaggcctttctggaccacccaccccatcactctctatctccttaccctgctttatttccattccttgcacttatctccactagacatatcatccatttgtttgttcagctgtctttccatccaaagtgtgcacctcatgattacagggactttgttttgctcactgctgggatcagatctcagctctgccaattattagttaatttgatcttgctcaagttagccccatctctctacctgtttcacagggtcattttgataattaaatgcactattaataaagcagtacttggcacrgtgcctggcacatcataatttctcaataaacgatagctattattatgatcagtgatttttcagtaaatttttacttcctgtggttcagccatctggggaaaacctctgcggctactcaaggatttatcttatcctgaggggaggtagaaatagaaacctgtactcatccaggaaccatgaaaatactacttacctttccaaagcaggtgaactcaagacctctagagatgctggttctcaaatacagctacaccttggagtcacctggggagctgtaaaaaaatcactgatgcctggttc

SEQ ID NO: 4967 - DNA, 601 bp, Human
ttacttcctgtggttcagccatctggggaaaacctctgcggctactcaaggatttatcttatcctgaggggaggtagaaatagaaacctgtactcatccaggaaccatgaaaatactacttacctttccaaagcaggtgaactcaagacctctagagatgctggttctcaaatacagctacaccttggagtcacctggggagctgtaaaaaaatcactgatgcctggttcccacccccccgcctccgcccccacagattctgatgtgattggcacagcaggagtcctgaacgtcagttttkttttttttttaagttccctaggtgcttccagcctgtagcaggtctgagagcccgtgctctagagtgccaccagatttccccttgaaagccagcgtgacagatgtctatttgtggcttgacagttaatgcatcttactaaaagaagccatttgcacaaggactggcctattaaaaattaatcactttggcctagcagggcttctcacttaaagattgctgtccattgtcatgcagcaccccaggatgctaatgccccacagaggagaacttgtagcccctccagcagcaaaatcagataag

SEQ ID NO: 4968 - DNA, 601 bp, Human
gcccccacagattctgatgtgattggcacagcaggagtcctgaacgtcagtttttttttttttttaagttccctaggtgcttccagcctgtagcaggtctgagagcccgtgctctagagtgccaccagatttccccttgaaagccagcgtgacagatgtctatttgtggcttgacagttaatgcatcttactaaaagaagccatttgcacaaggactggcctattaaaaattaatcactttggcctagcagggcttctcacttaaagattgctgtccattgtcatgcagcaccccaggatrctaatgccccacagaggagaacttgtagcccctccagcagcaaaatcagataaggaaactgaggcagaagcagcccaaccaaatcatccctccacccacctctctacccagcccagccactggtcctggtgaggatggtggtaatggagctgccagtcctggtacatcactgaacaaacagaacatgttatcctgtctttgaactgtaataggattcagagttcttgatttggaccccatgaggataatgtccaaagcttttatcagacggtgagctctagctgaattagaagacaacca

SEQ ID NO: 4969 - DNA, 601 bp, Human
gtacatcactgaacaaacagaacatgttatcctgtctttgaactgtaataggattcagagttcttgatttggaccccatgaggataatgtccaaagcttttatcagacggtgagctctagctgaattagaagacaaccacatttcaccgaagtgctttttaaaaagaagcccaactccattgctcccactttcctgctgtttaaaagtaaggagaagtacattacgctaaatgaaataagccagatgcaaaaggacaaagcctgtatgattctgcttctgtgaggtccctagagccatcaracccatacagatagaaaggagcatggtggttgccagaggcagggggcaagaacaatggggagtcattgtttaagggggacagactttcagttttgcaagatgaaaagagttcttggctgggtacagtggctcatgcctgtaatcccagcactttgggaggctgaggaggcaggtggatcacttgagctcaggagttcaagagcagcctcggcaaaatggcaaaaccccatctctacaaaaaatacaaaaattagcaaggcatggtggcccgcacctgtagtcccagtcactctggggggt

SEQ ID NO: 4970 - DNA, 601 bp, Human
aacaatggggagtcattgtttaagggggacagactttcagttttgcaagatgaaaagagttcttggctgggtacagtggctcatgcctgtaatcccagcactttgggaggctgaggaggcaggtggatcacttgagctcaggagttcaagagcagcctcggcaaaatggcaaaaccccatctctacaaaaaatacaaaaattagcaaggcatggtggcccgcacctgtagtcccagtcactctggggggttaaagcccgaggatcgcttgcaagtcttactgggagactgcagtgagtcaygatcgtgccactgcactccagcctggtgacagagtgagcctctgtctcaaaaaaaaaaaaaaaaaaaaaaagttctggagatggatggtggcgatggttgtacagcattgtgaatatacttaatgccactgaaccgtatgcttaacagttaaaatggtgaactttatggtatgtgtattttattacaattaaattttttatggcaattttattataatttttttaaagtcaaagaaagtgaccacacagggcctggagtgtccaacaagggcctgcaggcctatgggaatttatatgagc

SEQ ID NO: 4971 - DNA, 601 bp, Human
attataatttttttaaagtcaaagaaagtgaccacacagggcctggagtgtccaacaagggcctgcaggcctatgggaatttatatgagcttttggttgatttccatggaaacctgggaagagatggtgaatttcaggatctgtccaggatcccccagagggtggagtggagaaggggcagccctgaaaggggatcagcagatcagcatttagggcatcttagaagtttatgaaaattcagtgcagctgatttagccaaacgatttcttcacccatgtttactttagctgcgtaatagaaygtgccagatgatttcccagtgattgcgatgtgagccaggctttgtgatgtgttccctccctcaatttgagagagtccctgctgcatgctttcctgcaaatgagtttaatggaatgagtttgctatttggctgtggtattattcctttttaaaaaaggtttctcacgtgcctcatatgtacattggcacaaataagaattatgccttcagagggagatgactacagaagagaggctgtatatgtctgcttcagcgggacctctgggaggatgttgttcttctaaatgatcttttgatgagt

SEQ ID NO: 4972 - DNA, 601 bp, Human
aatcataatttcttagggcaggccagtatcataaagaccatctaggaacttgctggtccaagtgtggtcatctgaaccgcaacatcagcatcaccttgtttagactgagaaatggaatctgcgcttaaccagtcgaggtcctcaagggatctgagagcaccccaaagtttgagaagccaagctttagggtctccaccaggaagacggttttggcacatctctccacgagactgtctgttctgtgcttggaccctctgcttgtctagacagcccaggcccccacagaaagccctggcagccytagaagtctctcttatgtgcgaggcagtggagccctctattcaggtcaaaggagctacatctgcacagcctggggttgaattccagctgtgccacttataggctgtgtgagtatggacaggctgcttacactctctgtgcctcagtttcctccctgtaaaataactatgatgagagtccctacctcatgggattgctgtgaggatgaaatgagttaatccatataaagcagataaaactgtctgaggagctcaataaatgttagctggtattatcatgttgcatagatttctgtctcaca

SEQ ID NO: 4973 - DNA, 601 bp, Human
ctgtgcttggaccctctgcttgtctagacagcccaggcccccacagaaagccctggcagccttagaagtctctcttatgtgcgaggcagtggagccctctattcaggtcaaaggagctacatctgcacagcctggggttgaattccagctgtgccacttataggctgtgtgagtatggacaggctgcttacactctctgtgcctcagtttcctccctgtaaaataactatgatgagagtccctacctcatgggattgctgtgaggatgaaatgagttaatccatataaagcagataaaacwgtctgaggagctcaataaatgttagctggtattatcatgttgcatagatttctgtctcacacattggctctcggctgtccccagagcctcagagaacaagcttagctcctcttctacatgacagccttgcaaatgtctacaggcagctctcacgcccaccccttccatgtcctccagactgaaattgccaggttctcgtgtgacaggcctttgatttccactgctcctccaccgggagggctcctgggaacccagtcccctgaaagaatcacagtctccctgccacagcctcacttttcc

SEQ ID NO: 4974 - DNA, 601 bp, Human
agcgtggtggcgtgtgcctgtagtctcagctacttgggaggctgaggtgggaggatcgcttgaatccgggaggcggaggttgcagagagccaagatggcaccactgcactccagcctgggcaacagagcgagaccctatctcaaataaataaataggccaggcgcggaggctcacgcctgtaatcccagcactttgggaggccgaggtggacagatcatgaggtcaggagatcgagaccatcctggctaacacagtgaaatcccatctctactaaaaatacaaaaaaaaattagccgggcrtggtggcaggcacctgcagtcccggctactcaggaggctgaggcaggagaatggcgtgaacccgggaggcggagcttgcagtgagcagagatagcgccactgcacgccagcctgggtgacagagtgagactccgtctctaaataaataaataaataaataaataaataaataaataaattcatcatacccctaagggattagtaggcacattatcattaaagggtgtagtagaaagtttattggattgagccttctcccccaaccttccaactcccacacgcaagagatcaggcagtggg

SEQ ID NO: 4975 - DNA, 601 bp, Human
tcccatgggctctgcgtgactctaaagggacagcaaaatgggtggatgggagcaatagctgacgaaagtcccaaggccccttaaaagggtctagaaaggaaaccatgttcatctgcctcccagtgggaacaaggtggcaggaggaaatagacgattaggaaggggccactcccatcttgtttcttgtgctctgagtggtggtcacagagaactgtgggagtgtgcacttcatgtcttctcagagcagtgatgttacaaagcctcacacaagaggctggccccagctggcctgcaacagccrcgtgcagacgcacccacttgtgcgccaagtgtgcctgctgtcctgctcactccctccttggccaccctgtgcatgggcatgccctgcctggggagaccaggtctgatcacagagacatgttcctctctacatccaaaagaagctgaaactatcctcaccctgcaggcttgggcagagggctatttggagattttttttgagccaatatacttattgatttatgagctcttttaataaaattgggtctcgacttctgggtattctttaaagtttttttttttttttgtagaaaattatcct

SEQ ID NO: 4976 - DNA, 601 bp, Human
aggctggccccagctggcctgcaacagccgcgtgcagacgcacccacttgtgcgccaagtgtgcctgctgtcctgctcactccctccttggccaccctgtgcatgggcatgccctgcctggggagaccaggtctgatcacagagacatgttcctctctacatccaaaagaagctgaaactatcctcaccctgcaggcttgggcagagggctatttggagattttttttgagccaatatacttattgatttatgagctcttttaataaaattgggtctcgacttctgggtattctttaaagtttttttttttttttgtagaaaattatcctgaatttcaccccatccactcgactgcaactcctctcttgaattctgatcaccagtaccatgttgtgggccccagagcctctcccattcggacacccagggctcagctcagctgacagcagggccctggtccactgtgtctgcccccagacctgggaatggagcttcccatatattcccatctccccttcctggggcttctcttgcaccagcttggcagaagacactgcaccttcccaaattcttctcagccttgtggcttctgaaacatat

SEQ ID NO: 4977 - DNA, 601 bp, Human
gtcctaactgtctcgccttgacccccaatggatctatacattttttttcttacattagaaagactgttctagggaattcaaatggacatttcccagatgtcactcttggcccagttttctgaattatgtagaaaacaatttctaaattccctgggtatattttcctaaatcatatatgggtatatgtcctcgctatataccataaggagggagtccatctcagaccacaaatcactgagccatgggcaaaatcagctagaacatttatcccccagaaagacacagtcagactccgagaatytcatggaccaacgaaagctgtgtccactttgttgttcaggactgcttccacatagcattttcctgcatccattatgaagatggtcttatctgttctcagcaagagcctggtgcctggctttgtggcagcattaattctgatcttcagtgtcaaagcaaccagcttgagttcaagcatatggctaattctgagattcatccactggatacagaaaacgccagagtctcatggttactctgttgctagcagtaatgaacttgagcagggctcctgtttctccatcttcttactagacaaggg

SEQ ID NO: 4978 - DNA, 601 bp, Human
agagcctggtgcctggctttgtggcagcattaattctgatcttcagtgtcaaagcaaccagcttgagttcaagcatatggctaattctgagattcatccactggatacagaaaacgccagagtctcatggttactctgttgctagcagtaatgaacttgagcagggctcctgtttctccatcttcttactagacaagggcagagttacatcaaggtggggtgggaaatcatttcttctaaaatattaataacctgaattcctttctataaaggagaaccctcggatctcgtaagattctcycaccaaagcatttcaaccccacaaaccaggcccagcccctctaaccagacgtctgttcactcatgctccttcaagatcaatgggaaaggggcaagaatgaaagggaccctgaaagaggtctgtttcatgggaggggaaactggaagaggcgtgggaggaagggtatccaaaaatgactgatcagtggaaccagaaattttgtctttcagggttatctgtcagaagggttggtaacaaagtggtaccgttccccacgactgctcctttcccccaataactacaccaaagccatcgacatgt

SEQ ID NO: 4979 - DNA, 601 bp, Human
ggcagcattaattctgatcttcagtgtcaaagcaaccagcttgagttcaagcatatggctaattctgagattcatccactggatacagaaaacgccagagtctcatggttactctgttgctagcagtaatgaacttgagcagggctcctgtttctccatcttcttactagacaagggcagagttacatcaaggtggggtgggaaatcatttcttctaaaatattaataacctgaattcctttctataaaggagaaccctcggatctcgtaagattctctcaccaaagcatttcaaccccamaaaccaggcccagcccctctaaccagacgtctgttcactcatgctccttcaagatcaatgggaaaggggcaagaatgaaagggaccctgaaagaggtctgtttcatgggaggggaaactggaagaggcgtgggaggaagggtatccaaaaatgactgatcagtggaaccagaaattttgtctttcagggttatctgtcagaagggttggtaacaaagtggtaccgttccccacgactgctcctttcccccaataactacaccaaagccatcgacatgtgggccgccggctgcatcctggc

SEQ ID NO: 4980 - DNA, 601 bp, Human; identical to SEQ ID NO: 2321

SEQ ID NO: 4981 - DNA, 601 bp, Human; identical to SEQ ID NO: 2322

SEQ ID NO: 4982 - DNA, 601 bp, Human; identical to SEQ ID NO: 2323

SEQ ID NO: 4983 - DNA, 601 bp, Human; identical to SEQ ID NO: 2324

SEQ ID NO: 4984 - DNA, 601 bp, Human; identical to SEQ ID NO: 2325

SEQ ID NO: 4985 - DNA, 601 bp, Human; identical to SEQ ID NO: 2326

SEQ ID NO: 4986 - DNA, 601 bp, Human; identical to SEQ ID NO: 2327

SEQ ID NO: 4987 - DNA, 601 bp, Human; identical to SEQ ID NO: 2328

SEQ ID NO: 4988 - DNA, 601 bp, Human; identical to SEQ ID NO: 2329

SEQ ID NO: 4989 - DNA, 601 bp, Human; identical to SEQ ID NO: 2330

SEQ ID NO: 4990 - DNA, 601 bp, Human
ccctttttctgcgagtgtagactccaggctggcccccactccccacccccatccggtcccgaccgcctctgctggtttcctgatcgcttaagaattggaagttgtttccaggtccccaggtgtgcaacttgcccgacgcgtttccccctgggacacagctcctccccaccctcccagctcccactgacataatttacttttgcctgggagtcgggaggagtagtttctcccggacccctccgaggaccgcgtgctatgcaacacccgccctgcagtccaggcgcctgggagaagcgcactsgcccgtgtctccaaactgctggacgccgccggctccgcgctcccgtggccaaaacgggcttctcagaactgctcctgacctcggcctcggagaccccagccaggccgcccgctcccttacgtgggtgacccgggcgcagcggcggcgctctccctgcgaccccggctcccggcacgtgtccctcctgcccggcgccgcgtcccctccccggcctgggcctgcgcgcaccgcgctcccgagggcaccgacgcccccgcacggcccggggagatggggcgcccggttccctccagctccacg

SEQ ID NO: 4991 - DNA, 601 bp, Human
acccgctttcttctcgaatacaccaagcgatcacagatctcttccccctttttctgcgagtgtagactccaggctggcccccactccccacccccatccggtcccgaccgcctctgctggtttcctgatcgcttaagaattggaagttgtttccaggtccccaggtgtgcaacttgcccgacgcgtttccccctgggacacagctcctccccaccctcccagctcccactgacataatttacttttgcctgggagtcgggaggagtagtttctcccggacccctccgaggaccgcgtgctrtgcaacacccgccctgcagtccaggcgcctgggagaagcgcactcgcccgtgtctccaaactgctggacgccgccggctccgcgctcccgtggccaaaacgggcttctcagaactgctcctgacctcggcctcggagaccccagccaggccgcccgctcccttacgtgggtgacccgggcgcagcggcggcgctctccctgcgaccccggctcccggcacgtgtccctcctgcccggcgccgcgtcccctccccggcctgggcctgcgcgcaccgcgctcccgagggcaccgacgccccc

SEQ ID NO: 4992 - DNA, 601 bp, Human
tgctactgttttcctccttcctctggctgccgggacaaaacccctaggaatcgctcattccgtcctccctgccgagatcagagctccgcgacccgctttcttctcgaatacaccaagcgatcacagatctcttccccctttttctgcgagtgtagactccaggctggcccccactccccacccccatccggtcccgaccgcctctgctggtttcctgatcgcttaagaattggaagttgtttccaggtccccaggtgtgcaacttgcccgacgcgtttccccctgggacacagctcctccycaccctcccagctcccactgacataatttacttttgcctgggagtcgggaggagtagtttctcccggacccctccgaggaccgcgtgctatgcaacacccgccctgcagtccaggcgcctgggagaagcgcactcgcccgtgtctccaaactgctggacgccgccggctccgcgctcccgtggccaaaacgggcttctcagaactgctcctgacctcggcctcggagaccccagccaggccgcccgctcccttacgtgggtgacccgggcgcagcggcggcgctctccctgcgaccccgg

SEQ ID NO: 4993 - DNA, 601 bp, Human
cgtggaatggctttggccagggcctgggcagactggcccgactggatgtaaattattcagggtctcgcttaaaaacacacacagatcatggcgttactaattcctatagagagtccatggatggccttcagtggggctttgaccccaaaatcatatgcacattttgtaactatgttcattcatgcatttttctgggggccgggggttcatagctttcatcagaccctccaagagctccctgactataaaaagataaagaagcgctgacaaggatagagctagaccctgctactgttttccyccttcctctggctgccgggacaaaacccctaggaatcgctcattccgtcctccctgccgagatcagagctccgcgacccgctttcttctcgaatacaccaagcgatcacagatctcttccccctttttctgcgagtgtagactccaggctggcccccactccccacccccatccggtcccgaccgcctctgctggtttcctgatcgcttaagaattggaagttgtttccaggtccccaggtgtgcaacttgcccgacgcgtttccccctgggacacagctcctccccaccctcccagctc

SEQ ID NO: 4994 - DNA, 601 bp, Human
tacaaaaattagccgggcgtagtggtgcaagcctgtagtcccagctactcaggaggctgaggcaggagaatcgcttgaacccaggaggcagaggtttcagtgagcagagatggagccactgcacttcagtctgggcaacagagtgagattctgtctcaaaataagtaaattaaaaataaataaaaattaaaaataaataaataaaaattaaaaattaaacacctgagaggtcaaggctgcagtgagctataatcatgctactgcactccagcttgggaaacaatggtgtgacattgtttcaaaaaaaaaaaaattaaacatacacctgccatataacacagccactctactcccaaccattctctacccatgagaaatgaaaacatgtgtccatacagaaacctgtatgtcagtgttcatagcagctttctttgtaatagtcccaaactggaaacaacccaaatgtcccttaacaagtgaatggctaaacaaatgatgggctagccatgggtagaatactactactcaatggtagaaactaatgaactacttatacaaattacaacatggataaattctcaggataattactgtctgtgaa

SEQ ID NO: 4995 - DNA, 601 bp, Human
cactttgggaggccaaagcaggcagatcccctgaggtcaggagttcgagaccagcctggccaacatggtgaaaccccatctctactaaaaatacaaaaattagccgggcgtagtggtgcaagcctgtagtcccagctactcaggaggctgaggcaggagaatcgcttgaacccaggaggcagaggtttcagtgagcagagatggagccactgcacttcagtctgggcaacagagtgagattctgtctcaaaataagtaaattaaaaataaataaaaattaaaaataaataaataaaaattraaaattaaacacctgagaggtcaaggctgcagtgagctataatcatgctactgcactccagcttgggaaacaatggtgtgacattgtttcaaaaaaaaaaaaattaaacatacacctgccatataacacagccactctactcccaaccattctctacccatgagaaatgaaaacatgtgtccatacagaaacctgtatgtcagtgttcatagcagctttctttgtaatagtcccaaactggaaacaacccaaatgtcccttaacaagtgaatggctaaacaaatgatgggctagccatgg

SEQ ID NO: 4996 - DNA, 601 bp, Human
attacaggcatgggctaccacagctggctaatttttgtatttttagtagagaaggggttttaccatgttgacctggctggtctcgaactcctggcctcaagtgatctgcccgcgttggcctcccaaagtgctgggattacaggtgtgagccaccacacccagctgatacaattcaatttttaagagagcaaaaaaaatataaacagatactaccagagaagatatatacatggcaaataagcacataacatcaccagctgtagaaaaatgcaaattaaaactacaaggggagaccccctamatacctagtagaatgggtaaaattaaaaagattcatcataccaagagctgacaagggtgtgaaggaactggaacttccctacactgctgtgggaatgtaaaatcgtataacaactttgggaaatggtttagcagtttctttaaaaattaaacttctgaggccaggtgcaatggctcacacctgtaatcccagcactttgggaggccaaagcaggcagatcccctgaggtcaggagttcgagaccagcctggccaacatggtgaaaccccatctctactaaaaatacaaaaattagccggg

SEQ ID NO: 4997 - DNA, 601 bp, Human
ggccttttaaataagaacagactggcaacaacttgttgtgcatagtagcacaagaaggagactttgcaccttagtgatattgatttgtccaacccatgaacatggtatatctctccattgattttgttccttaatttctctaagcaatgctttgtagttttccatatatgaaagatgtctttcacatcttttgttagatttatccgtaagtatctaatgctttttaatgttatttcaaatgactttttaaagttttttaatttctaattgttcattgtgaatgtatagaaatagaactgatttttgtgtagtggtgttttgtatactgcaaccaacttagacacatatggctgactgatgttcaaaaggtataagagaaggtcagtgaagataatcttttcaataaagggtgctggaataattggatatgcatatatagaaacaaacaaaatcccaaaacaacctttaattcatgcctcacattataaacaaaaattaattcaaaatggatcacagccataaatgtaaaccctaaagctataaaacttctagaggaacacatagaagtaaacctttgtaaccttaggctaggcaaatattt

SEQ ID NO: 4998 - DNA, 601 bp, Human
tcagtgaccttctacccaacataatggacgcccctgcacatcaggccttttaaataagaacagactggcaacaacttgttgtgcatagtagcacaagaaggagactttgcaccttagtgatattgatttgtccaacccatgaacatggtatatctctccattgattttgttccttaatttctctaagcaatgctttgtagttttccatatatgaaagatgtctttcacatcttttgttagatttatccgtaagtatctaatgctttttaatgttatttcaaatgactttttaaagtttttwaatttctaattgttcattgtgaatgtatagaaatagaactgatttttgtgtagtggtgttttgtatactgcaaccaacttagacacatatggctgactgatgttcaaaaggtataagagaaggtcagtgaagataatcttttcaataaagggtgctggaataattggatatgcatatatagaaacaaacaaaatcccaaaacaacctttaattcatgcctcacattataaacaaaaattaattcaaaatggatcacagccataaatgtaaaccctaaagctataaaacttctagaggaac

SEQ ID NO: 4999 - DNA, 601 bp, Human
aagaagtcagtgaccttctacccaacataatggacgcccctgcacatcaggccttttaaataagaacagactggcaacaacttgttgtgcatagtagcacaagaaggagactttgcaccttagtgatattgatttgtccaacccatgaacatggtatatctctccattgattttgttccttaatttctctaagcaatgctttgtagttttccatatatgaaagatgtctttcacatcttttgttagatttatccgtaagtatctaatgctttttaatgttatttcaaatgactttttaaarttttttaatttctaattgttcattgtgaatgtatagaaatagaactgatttttgtgtagtggtgttttgtatactgcaaccaacttagacacatatggctgactgatgttcaaaaggtataagagaaggtcagtgaagataatcttttcaataaagggtgctggaataattggatatgcatatatagaaacaaacaaaatcccaaaacaacctttaattcatgcctcacattataaacaaaaattaattcaaaatggatcacagccataaatgtaaaccctaaagctataaaacttctag

SEQ ID NO: 5000 - DNA, 601 bp, Human
tctaagaagtcagtgaccttctacccaacataatggacgcccctgcacatcaggccttttaaataagaacagactggcaacaacttgttgtgcatagtagcacaagaaggagactttgcaccttagtgatattgatttgtccaacccatgaacatggtatatctctccattgattttgttccttaatttctctaagcaatgctttgtagttttccatatatgaaagatgtctttcacatcttttgttagatttatccgtaagtatctaatgctttttaatgttatttcaaatgactttttraagttttttaatttctaattgttcattgtgaatgtatagaaatagaactgatttttgtgtagtggtgttttgtatactgcaaccaacttagacacatatggctgactgatgttcaaaaggtataagagaaggtcagtgaagataatcttttcaataaagggtgctggaataattggatatgcatatatagaaacaaacaaaatcccaaaacaacctttaattcatgcctcacattataaacaaaaattaattcaaaatggatcacagccataaatgtaaaccctaaagctataaaacttc

SEQ ID NO: 5001 - DNA, 601 bp, Human
tctgaaaaatggcttaaaaatacttaaagacacatgaaaagttgtgaaaacaaccccaagtgcacttacaccttacataaaaaaagcgaactgaaattggtggctagggatatttgtcttcaaacaaagcagtcttctcagttgcttctggccatcgcccgcaatctttcagactgaaatgctctctaagaagtcagtgaccttctacccaacataatggacgcccctgcacatcaggccttttaaataagaacagactggcaacaacttgttgtgcatagtagcacaagaaggagacttygcaccttagtgatattgatttgtccaacccatgaacatggtatatctctccattgattttgttccttaatttctctaagcaatgctttgtagttttccatatatgaaagatgtctttcacatcttttgttagatttatccgtaagtatctaatgctttttaatgttatttcaaatgactttttaaagttttttaatttctaattgttcattgtgaatgtatagaaatagaactgatttttgtgtagtggtgttttgtatactgcaaccaacttagacacatatggctgactgatgttcaa

SEQ ID NO: 5002 - DNA, 601 bp, Human
gaggcaaagaagcagtaacaactagataaaatggataggaaataaaaaataaaaggtttgggaaaagacccctaaagttctgaaaaatggcttaaaaatacttaaagacacatgaaaagttgtgaaaacaaccccaagtgcacttacaccttacataaaaaaagcgaactgaaattggtggctagggatatttgtcttcaaacaaagcagtcttctcagttgcttctggccatcgcccgcaatctttcagactgaaatgctctctaagaagtcagtgaccttctacccaacataatggacrcccctgcacatcaggccttttaaataagaacagactggcaacaacttgttgtgcatagtagcacaagaaggagactttgcaccttagtgatattgatttgtccaacccatgaacatggtatatctctccattgattttgttccttaatttctctaagcaatgctttgtagttttccatatatgaaagatgtctttcacatcttttgttagatttatccgtaagtatctaatgctttttaatgttatttcaaatgactttttaaagttttttaatttctaattgttcattgtgaatgtata

SEQ ID NO: 5003 - DNA, 601 bp, Human
gaatcatatgatgtctactacttgaaaacaactccattttatttactcagtcctccgctgtttaaaatttatgttgattttgacaaatctcatgttttatacactcacgttttcaccacttttttgctatcagtagaggcaaagaagcagtaacaactagataaaatggataggaaataaaaaataaaaggtttgggaaaagacccctaaagttctgaaaaatggcttaaaaatacttaaagacacatgaaaagttgtgaaaacaaccccaagtgcacttacaccttacataaaaaaagcraactgaaattggtggctagggatatttgtcttcaaacaaagcagtcttctcagttgcttctggccatcgcccgcaatctttcagactgaaatgctctctaagaagtcagtgaccttctacccaacataatggacgcccctgcacatcaggccttttaaataagaacagactggcaacaacttgttgtgcatagtagcacaagaaggagactttgcaccttagtgatattgatttgtccaacccatgaacatggtatatctctccattgattttgttccttaatttctctaagcaatgctt

SEQ ID NO: 5004 - DNA, 601 bp, Human
acttttcttattacaaaacaattcaaattatggcagaaaaataagaaagggcagacaactgcatacatgcccacatatgaccaacacatgacatcttccccattcaatgacaactacttcttgatcttcttctagtaaaaaaatgaatcatatgatgtctactacttgaaaacaactccattttatttactcagtcctccgctgtttaaaatttatgttgattttgacaaatctcatgttttatacactcacgttttcaccacttttttgctatcagtagaggcaaagaagcagtaacaactagataaaatggataggaaataaaaaataaaaggtttgggaaaagacccctaaagttctgaaaaatggcttaaaaatacttaaagacacatgaaaagttgtgaaaacaaccccaagtgcacttacaccttacataaaaaaagcgaactgaaattggtggctagggatatttgtcttcaaacaaagcagtcttctcagttgcttctggccatcgcccgcaatctttcagactgaaatgctctctaagaagtcagtgaccttctacccaacataatggacgcccctgcacatcaggcctttt

SEQ ID NO: 5005 - DNA, 601 bp, Human
agacatctggcctcttctgtctcctgcattgacaccgcctgtgttcaggatttcatcaccacccaccagaacgatttcaaaaacctcaatgcagctcctattctctggagtctcctgactacagttcattcttcacactctgaacaagagcaacctttccaccatgcagctccagtaatgctcccctgcacagaaaccctcagggactccccactgcacagaagggaatcatgcctttccaagaagaagcattcaaatcacatcaactatgtccaatgagcaacactgatatgactcccasgatatatactgaggagtttcatatatatttattcatttagatacatattattattactgttattatttttattgttatttttgagacagagtctcgctttgtcgcccaggctggaatgcagtggacaagtgtttgtgagttggacaagctttcgtaaagtcatgaaaacattgccagacaagatcagctataattaaagatgaattagaaaaaactccaaaattctggatcttaattgtgctatttcttttgtaattttatttatttacttttcttattacaaaacaattcaaattatgg

SEQ ID NO: 5006 - DNA, 601 bp, Human
agggctacaggttgaagagcaaatgaaaggaaagtaatgaaatacattctatagttttaggactcgagaagacatctggcctcttctgtctcctgcattgacaccgcctgtgttcaggatttcatcaccacccaccagaacgatttcaaaaacctcaatgcagctcctattctctggagtctcctgactacagttcattcttcacactctgaacaagagcaacctttccaccatgcagctccagtaatgctcccctgcacagaaaccctcagggactccccactgcacagaagggaatcawgcctttccaagaagaagcattcaaatcacatcaactatgtccaatgagcaacactgatatgactcccacgatatatactgaggagtttcatatatatttattcatttagatacatattattattactgttattatttttattgttatttttgagacagagtctcgctttgtcgcccaggctggaatgcagtggacaagtgtttgtgagttggacaagctttcgtaaagtcatgaaaacattgccagacaagatcagctataattaaagatgaattagaaaaaactccaaaattctggatc

SEQ ID NO: 5007 - DNA, 601 bp, Human
ttcttttctttctctctcagactcattaactgagcttcctgacccacctcttgtgtgccaggtgaatttctccataactcgaatccttaaataatgattattggagtcttgcaagagttgagggctacaggttgaagagcaaatgaaaggaaagtaatgaaatacattctatagttttaggactcgagaagacatctggcctcttctgtctcctgcattgacaccgcctgtgttcaggatttcatcaccacccaccagaacgatttcaaaaacctcaatgcagctcctattctctggagtctcctgactacagttcattcttcacactctgaacaagagcaacctttccaccatgcagctccagtaatgctcccctgcacagaaaccctcagggactccccactgcacagaagggaatcatgcctttccaagaagaagcattcaaatcacatcaactatgtccaatgagcaacactgatatgactcccacgatatatactgaggagtttcatatatatttattcatttagatacatattattattactgttattatttttattgttatttttgagacagagtctcgctttgtcgcccaggc

SEQ ID NO: 5008 - DNA, 601 bp, Human
acttccagtctctcccccaagcccttgtgctattgttctatgttttgctttgacatacgttataccccatgacacattgttattattttgctttaaacagttgattattgtttatcagctcaggattttaaaaggcatttgcactatattatttatcatttctgggtgtttttgtagcaggagggttttttggtatctactctgtcattttgctgagaaaggaagtctatcagtggttcttccattctgaacggtcctcaaaccaagataaatctgtgaatagttaatgtttgaatgtacmaggatatcaatgtactacagccaatccaaccaggcaaatggtggccagttacttactttataaagttggactgtctcataactatattggtgatattactaacactgtttcattttattattttatttttaaaatgattttattttatttcattattattttattttattttattttattttattttattttattttgagacagggtctagctctgtcacccaggctagagcacaatggcatgattatgccccgctgcagcctcaaactcctggcctcaagcaatcctcctgcctcagcc

SEQ ID NO: 5009 - DNA, 601 bp, Human
aatgcatctttgagcctggccaacatggtgacaccccatctttattaaaaatacaaaaaattagccgggcgtggtggcaggcgcctgtaatcccagctactggggaggctgaggcaggagaattgcttgaacctgggaggcagaggttgcagtgagccacgatcacaccactgcactctagcctgggagttggccaggctggtcttgaactcctaacctcaaatgatctgcccgcctcggcctcccaaagtgctgggattacaggtgtgagccaccatgccaggccctgaatttctattcyaatagtttttaactggatcaaattctcccacctccatctcaaaaatccactcccttgtgtgtgcacatgtgtgtgttagcttggcagtacttgcaagatcgggccttgccttgccttgccttgccttaccttgccttaccttgccttgcctttcttttttgagacggagtttcactctgtcaccaggctggagtgcagtggcacgatcttggctcactgcaacctccacctcctgggttcaagcgattctcctgcctcagcctcctgaatagctgtgactacaggtgcacaccaccacac

SEQ ID NO: 5010 - DNA, 601 bp, Human
ctcgcctgaagtgccagtcagccagcaaaactacagatgagggcgtggggagagggtcatcgatgaaacaccctctcccttcatttcccacccctctccaagccctcagtctctcttaaagtcttcacccctctccaccgtggacccagcctccaattctcactgaacgacagcaagtgcctccagataggccccctgcaggctctcccacaggtctctgcggccagcatcacctttagaaatgcatctttgagcctggccaacatggtgacaccccatctttattaaaaatacaaaaaaytagccgggcgtggtggcaggcgcctgtaatcccagctactggggaggctgaggcaggagaattgcttgaacctgggaggcagaggttgcagtgagccacgatcacaccactgcactctagcctgggagttggccaggctggtcttgaactcctaacctcaaatgatctgcccgcctcggcctcccaaagtgctgggattacaggtgtgagccaccatgccaggccctgaatttctattctaatagtttttaactggatcaaattctcccacctccatctcaaaaatccactcccttgtgt

SEQ ID NO: 5011 - DNA, 601 bp, Human
gcagaggacaggggacggtgaagaggtttccacttgtaagaggcgttctccaggcacacgcagcggtagtcagtgtccagcttatcctaggggtgcctcaggacaagccccaggtgccaggcacgtggaggatgtacaggaagagcatcctcacccagaagccttcctggagcctcgcctgaagtgccagtcagccagcaaaactacagatgagggcgtggggagagggtcatcgatgaaacaccctctcccttcatttcccacccctctccaagccctcagtctctcttaaagtcttcayccctctccaccgtggacccagcctccaattctcactgaacgacagcaagtgcctccagataggccccctgcaggctctcccacaggtctctgcggccagcatcacctttagaaatgcatctttgagcctggccaacatggtgacaccccatctttattaaaaatacaaaaaattagccgggcgtggtggcaggcgcctgtaatcccagctactggggaggctgaggcaggagaattgcttgaacctgggaggcagaggttgcagtgagccacgatcacaccactgcactctagcctggga

SEQ ID NO: 5012 - DNA, 601 bp, Human; identical to SEQ ID NO: 2012

SEQ ID NO: 5013 - DNA, 601 bp, Human; identical to SEQ ID NO: 2013

SEQ ID NO: 5014 - DNA, 601 bp, Human; identical to SEQ ID NO: 2014

SEQ ID NO: 5015 - DNA, 601 bp, Human; identical to SEQ ID NO: 2015

SEQ ID NO: 5016 - DNA, 601 bp, Human; identical to SEQ ID NO: 2016

SEQ ID NO: 5017 - DNA, 601 bp, Human; identical to SEQ ID NO: 2017

SEQ ID NO: 5018 - DNA, 601 bp, Human; identical to SEQ ID NO: 2018

SEQ ID NO: 5019 - DNA, 601 bp, Human; identical to SEQ ID NO: 2019

SEQ ID NO: 5020 - DNA, 601 bp, Human; identical to SEQ ID NO: 2020

SEQ ID NO: 5021 - DNA, 601 bp, Human; identical to SEQ ID NO: 2021

SEQ ID NO: 5022 - DNA, 601 bp, Human; identical to SEQ ID NO: 2022

SEQ ID NO: 5023 - DNA, 601 bp, Human; identical to SEQ ID NO: 2023

SEQ ID NO: 5024 - DNA, 601 bp, Human; identical to SEQ ID NO: 2024

SEQ ID NO: 5025 - DNA, 601 bp, Human
acttccagagtctcatgaggatgtagtcagagtttcaggggcattaacagtggagtagatccattgttcaggtttatttatgtttttcctcctcaacacaagccctacctgtaataaaagatccaagaaagataaaaccatggctctgggtttgtttactgactgtgagaagtattaatcaagtagaagggagagtttttcattattcggggagctcaagtcactggggaagcaaatgccttctgttgcctcaaataggggaaagggcccatgggctagaaccaccaggcttctctgccctaatcacttgctccctgggctgaggactggtactggtgggcagtgtccagaacttagacttggccaccaccataggtgtgactgatgaacatgagaggaaggagttctttcaaatcacccatgcacatagagagtggaatgactgaccatggagatttggaagggcgaggggggtggatgattagaaattacttaatgggtacaatgtgtgttacttgggtgatggataccttaaagccccaacttgaccactacacaatctatgctataacaaaattgcatgtgtacatcataaatttat

SEQ ID NO: 5026 - DNA, 601 bp, Human
cttcagtaacggtatttgctattcttatctcttaagccctaggggtgataatggcttcccatagttgttagcctgcagatgcccatcatccttgtttgttccgttaaccttgaccatatctctgcaaggagtcccttcattaaggtctcctcacatgacccatctggcttgaaggctgtttcctgctaggaccctaactgaacattcctgggctttgagggatattggctggaaaaggatatgagattatgaaagaagactcagtctacttgatatttatgcctagtgctagccctgagtrggagctatataccagtaatagatggggaaacacggggaagagatactgcagggttgtgggtcattactccaggaaatgtcaacataactccaatatcactttcagtgtgttgctttcatcaactccacagcctgcagttgactcctccttcctttgtgctcccatggctcctgttcacagttctgtaattttccatttacaaaaatcttctctttgaggctctccttaaagacagaaagagatatcttcatttttttcttatttctctggtatacctagtgcccaacaggcacttagtaa

SEQ ID NO: 5027 - DNA, 601 bp, Human
agccctgagtgggagctatataccagtaatagatggggaaacacggggaagagatactgcagggttgtgggtcattactccaggaaatgtcaacataactccaatatcactttcagtgtgttgctttcatcaactccacagcctgcagttgactcctccttcctttgtgctcccatggctcctgttcacagttctgtaattttccatttacaaaaatcttctctttgaggctctccttaaagacagaaagagatatcttcatttttttcttatttctctggtatacctagtgcccaacagrcacttagtaaatgtttgctgagtgaatttatgttcggaggtaatgtccctaagaaatcacagttatttgactgggagccatagagagctcgggcagtaataacgactgcaaattcaaaactgtggcttactgtagttgcaggatttgtattaaaaaggtgtttcatgcttttacaactcatcttgttcttcatttcagcctgtgtgaaactgtgaattggcgatatgggtgggtgtaatcagactgggggctggcatgagatttctcatgcattgccatatgtgatttgtatgtttcatc

SEQ ID NO: 5028 - DNA, 601 bp, Human
atacctactctgaaccctgccaaactgctacaccccagctccaggagcaaggagaaagaagtgctaacaatgattttaattgctgggcgtggtggctcacatctctaatcccagcactttgggaggccaaagtgggaggatcacttaaggccaggaatttgagaccagcctgggcaacacagaccctgtctctattaaaaagaagtggtgacgtgcttataatcccagctactcaggaggctgaggtgagaggaccacttaagcccaggaattcaaggctacagtgagctgtgatcatgcygctgcactccagctgggcaacagagtaaaaccctgtcatacacacacacacatatgcacacacatacatacactaactagtacaatcagttgctctgggagatacctctcagggcctcttgtttttcctagtatgcaaggtaagggtaccctggccttggggtggtcagttctgaaagataacctgcacattatgagttatttcataagcagttttagagaaaagaaaaatataaacaaacttgtagcacagaagctaatccaactattttgtgagctgattttttttttttgtctgatc

SEQ ID NO: 5029 - DNA, 601 bp, Human
ttttttttttttgtctgatcttttttttttttttttttttgagacagagtctcactctgtcgcccaggctggagtgcagtggcgtgatcttggctcactgcaagctccgcctcccgggttcacaccattctcctgcctcagcctcccaagtagctgggactacaggtgcctgccacaacgcctggctaattttttgtatttttagtagagacggggtttcaccatgttagccaggttggtctcgatctcctgacctcatgatccgcccgcgtcggcctcccaaagtgctgggattacaggmgtgagccactgcgcccggcctgatcttttttcttaactatatgcttataaatgaggaggaaggaatgaatatcattaagtggtattcacccttgcaagattctctatagtggcaagggccaggttagaagatctgaatgtaggggaggtcctaaaggtgatggcagcagcagggtgggcaatctggaaagactggggaagtgttgtgtagtacagctcttagacacaggcaagagaagcccctggatatggccccacattcagagagccccactctggccctctgctacccacatccttt

SEQ ID NO: 5030 - DNA, 601 bp, Human
ggagtacaagaccagcctgggcaagatggtgaaaccctgtctctactaaaaatacaaaaaaattagccaggcgtggtgaccagtgcctgttatcccagctattttggaggctggggcagagaattgcttgaacccggtaggcggaggttgcagtgagccgagtttgtgccactgcactccagcctgggcaacagagcaagactccatctcaaaaaaataaataaaataaaataaataaataaatttcggccaggcgcagtggctcatgcctataatcccagcactttgggaggccgaggtrtgcagatcatgaggtcaggagtttgagaccagcctggccaacatgatgaaacactgactctactaaaactacaaaaaattagccaggcgtggtggtgtgtgcctgtaatctcagctacctgggaggctggagcaggacaatcacttgaacccaggaggcggaggttgcagtgaacagagatcgtgccattgcactccagcctgggcaacagagcaagactccatctcaaaaaaaaaaaaatgctcagtgcatgtgtttgtgtgcctgtgtgtatatgcccacacgtgcacacacagaggt

SEQ ID NO: 5031 - DNA, 601 bp, Human
gagacccctgggctggcctccaataagcggatgctgaattgcacctgctgtagctttggcaaagcctgaggaatcaggttggtggagttcagggcctcccatctgcctgtgcatcttctggactgtccctctctcccccaggagcactctgtcatttgccccacccactcttccccatctctgtatccgtatctgcatcccatttccactcaggcttctgatatgcatctccttttccattctaaatttgcccattctgcgtctcacttcctggtagtcaggcctagtgacttgcttatgmgtatcgacagtaactttcccaggggtatttctggctcctgcatctctctccctcctccactgcagtcagaatagccacaaagtttatcagtcattcccattacaggataactccccaaggcgggaattagcacactcctttgacaggcagtaggtacttcacagatacctgctgacaggtgggcttccataagggggacctcctggggactcagcgatgccatggcaggcctggggggtgacataatgtagaccaaaggatgcttccagccatgcccctgctcccagcacttgagagccc

SEQ ID NO: 5032 - DNA, 601 bp, Human
actttgggaggctgaggcaggaggattgcttaaggccaggagtttaagactggcctgggtaacattgtgagaccctgtctctattaaaaaaaaaattagctgagcatggtggcacatgactgtagtcccagatactcaggaggctgaggtgggaggatctcttgagcctggaaggtcaaggctgcagtgagccatgatcatgatcagcctgggtcacagagcaagaccctatttaaaaaaaaaaaaaagtattaatgataagattcctttcagcaaagagctcctcttataccttaaagayatgattcagttggtcaacttttagttcatatagaacttttcatgtatggtcttgttattcaaaattaatcacacctgtatgatgctacaggaaactcctagatacaatgtgtgtgggaagagtatgggaagctcccctctccaggcctctgtctacattcagtgtcctaatggattttcaaccttttggtcaaaacacactcctaaaaaaacaaacaaaaaaaaaaaagaaaagaaaaaacacattcctagaaaaggatcttggattaatttcttacaggccctatcaaaaagcacagtc

SEQ ID NO: 5033 - DNA, 601 bp, Human
ctggcctgggtaacattgtgagaccctgtctctattaaaaaaaaaattagctgagcatggtggcacatgactgtagtcccagatactcaggaggctgaggtgggaggatctcttgagcctggaaggtcaaggctgcagtgagccatgatcatgatcagcctgggtcacagagcaagaccctatttaaaaaaaaaaaaaagtattaatgataagattcctttcagcaaagagctcctcttataccttaaagatatgattcagttggtcaacttttagttcatatagaacttttcatgtatgrtcttgttattcaaaattaatcacacctgtatgatgctacaggaaactcctagatacaatgtgtgtgggaagagtatgggaagctcccctctccaggcctctgtctacattcagtgtcctaatggattttcaaccttttggtcaaaacacactcctaaaaaaacaaacaaaaaaaaaaaagaaaagaaaaaacacattcctagaaaaggatcttggattaatttcttacaggccctatcaaaaagcacagtccctcctagtagcatttattttacttttaatgttggaaagcctttttcta

SEQ ID NO: 5034 - DNA, 601 bp, Human
caggaggctgaggtgggaggatctcttgagcctggaaggtcaaggctgcagtgagccatgatcatgatcagcctgggtcacagagcaagaccctatttaaaaaaaaaaaaaagtattaatgataagattcctttcagcaaagagctcctcttataccttaaagatatgattcagttggtcaacttttagttcatatagaacttttcatgtatggtcttgttattcaaaattaatcacacctgtatgatgctacaggaaactcctagatacaatgtgtgtgggaagagtatgggaagctccyctctccaggcctctgtctacattcagtgtcctaatggattttcaaccttttggtcaaaacacactcctaaaaaaacaaacaaaaaaaaaaaagaaaagaaaaaacacattcctagaaaaggatcttggattaatttcttacaggccctatcaaaaagcacagtccctcctagtagcatttattttacttttaatgttggaaagcctttttctactaccaaatatcatgcctcggtaaagagacaaggaaagcattgttggagtgaaggctcttctccgtattgggttggccgatgataag

SEQ ID NO: 5035 - DNA, 601 bp, Human
catcaattgagcttgatcctcagagcagcaacctttactcctgtcatgtggagcactgcggtgtccacatggttcttcaggtcccccagggtaaggacggggatcgtggctgtctagggagagagcctggagaaaggggtgagcaggaaaccatgctcgctgccagggaggggaggatagatcactgcctcactcagtgtgccttagaatgggtcttttaaataagtggttctcacactttttggaaccaggacgccttcatactattaaaaaattattgaggaccccagagagcttttgytgatgtgggttatatctattgctatttactacattacaaattaaaaatttaaaaattaaacacgaatgggtgcagtggctcatgcctgtaatcccagcactttgggaggctgaggcaggtggatcacttgaggtcaggagttcgagaccagcctggccaacatggtgaaaccccatctctactaaaaatacaaaaattagccaggcatggtggcgcatgcctgtaatcccagctcctggaggctgaggcaggagaatcgcttgaacctgggaggtggaggttgcagtgagccgagatcgc

SEQ ID NO: 5036 - DNA, 601 bp, Human
ctcctggaggctgaggcaggagaatcgcttgaacctgggaggtggaggttgcagtgagccgagatcgcaccactacactccagcctgtgcgaagggagcaagactccctctcaaaaaaacaaaaaaacaaaaaacaaaaaaacacaacccaggcgcagtggctcactcctgtaatgccagtactttgggaggctgacgcgagtgaactgcttgagcccaggagttcaagaccagcctgggcaacatactgagatctcatctctacaaaaaacacaacaattagctgggcatgatggcatgygcctgtagtcccagctactgaggaggctaaggtgggaggatcgcttgagcccaggaggttgaggctgcagtgagctataatggcaccactgcacttccacctggacgacagagtgagacgctgtctcaaaaaaaaaaaaaaaattaaacacaagaaaacacaagcagatattccattagtggtcagattgatgagtgagaagcaacagtaaggaaaatggtgttgggtttcctgatgatcacagggacaaaagtcccagaaagttaacacagaagggaaaggggacttgtggattttttc

SEQ ID NO: 5037 - DNA, 601 bp, Human
aaaaaacaaaaaaacacaacccaggcgcagtggctcactcctgtaatgccagtactttgggaggctgacgcgagtgaactgcttgagcccaggagttcaagaccagcctgggcaacatactgagatctcatctctacaaaaaacacaacaattagctgggcatgatggcatgcgcctgtagtcccagctactgaggaggctaaggtgggaggatcgcttgagcccaggaggttgaggctgcagtgagctataatggcaccactgcacttccacctggacgacagagtgagacgctgtctcaaaaaaaaaaaaaaaattaaacacaagaaaacacaagcagatattccattagtggtcagattgatgagtgagaagcaacagtaaggaaaatggtgttgggtttcctgatgatcacagggacaaaagtcccagaaagttaacacagaagggaaaggggacttgtggattttttctcatttgcttgctttcagaatcagaaactatccctcttgtgatgaaagctgtctctgggtccattgtccttgtcattgtgctggctggagttggtgttctagtctggagaagaaggccccgaggtgag

SEQ ID NO: 5038 - DNA, 601 bp, Human
acagtaaggaaaatggtgttgggtttcctgatgatcacagggacaaaagtcccagaaagttaacacagaagggaaaggggacttgtggattttttctcatttgcttgctttcagaatcagaaactatccctcttgtgatgaaagctgtctctgggtccattgtccttgtcattgtgctggctggagttggtgttctagtctggagaagaaggccccgaggtgagaggcacatggaagggatccagggggctgcagactctcctgcatctctccagttttattttctgcacctgctgctccmtcctccattcagaaatggcttggctctcaggctgggatcacagaaggacctgggacaaccctcccaccatgtaggggacacaaagcatggataaagcttacagggagagtggtctcttttcataggtgatgcctgacatcaacaaactagtacatctgtccaggggaactgtccccctagaagttgggtcagagaagatatggggatcttgatttgtctttttccaaaccatctttttattattaattactattgacttctggggcagtgtcctttgtttcaagacttcagtcagttttc

SEQ ID NO: 5039 - DNA, 601 bp, Human
cttagagtaaggaaaaggggaggagaagtaggagatatataggctcttgataatgtggaataacataaattcattcagtaagtatacattaatgacctactgtgctccaggcactgtactggttgctgggatataacaatgaacaagacagatacgatccctgttttcatagagcttacaatagagcctggtaaggttatctcctggctctggcttcactaattgctcaaattgatcacaggatagtaccgatgagaccatgctttgaacccaaagtggaccagaagtttggttttccttyatagacatagacctcaactccaattcaggtgataactgtacaaaagcatgttgttagatcaaagtaaaaccaacccttttactagaaaatcagctcagaggccgggcgtggtggcttacaacttgtaatcccagcactttgagaggccgaggcaggcggatcacttgaggtcaggagttcgagatcagcctggccaacatggtgaaaccctgcctctactgaaaatattaaaaaaaaaaaaattagctgggcgtggtggcacatgcctgtaatctcagctactcaggaggctgagacagg

SEQ ID NO: 5040 - DNA, 601 bp, Human
acattaatgacctactgtgctccaggcactgtactggttgctgggatataacaatgaacaagacagatacgatccctgttttcatagagcttacaatagagcctggtaaggttatctcctggctctggcttcactaattgctcaaattgatcacaggatagtaccgatgagaccatgctttgaacccaaagtggaccagaagtttggttttccttcatagacatagacctcaactccaattcaggtgataactgtacaaaagcatgttgttagatcaaagtaaaaccaacccttttactaraaaatcagctcagaggccgggcgtggtggcttacaacttgtaatcccagcactttgagaggccgaggcaggcggatcacttgaggtcaggagttcgagatcagcctggccaacatggtgaaaccctgcctctactgaaaatattaaaaaaaaaaaaattagctgggcgtggtggcacatgcctgtaatctcagctactcaggaggctgagacaggagaatcgcttgaacctgggaggcggaggttgccgtgagcaaagatcgctccattgcactccagcctgggcagcaagagcgagact

SEQ ID NO: 5041 - DNA, 601 bp, Human
gctccaggcactgtactggttgctgggatataacaatgaacaagacagatacgatccctgttttcatagagcttacaatagagcctggtaaggttatctcctggctctggcttcactaattgctcaaattgatcacaggatagtaccgatgagaccatgctttgaacccaaagtggaccagaagtttggttttccttcatagacatagacctcaactccaattcaggtgataactgtacaaaagcatgttgttagatcaaagtaaaaccaacccttttactagaaaatcagctcagaggcygggcgtggtggcttacaacttgtaatcccagcactttgagaggccgaggcaggcggatcacttgaggtcaggagttcgagatcagcctggccaacatggtgaaaccctgcctctactgaaaatattaaaaaaaaaaaaattagctgggcgtggtggcacatgcctgtaatctcagctactcaggaggctgagacaggagaatcgcttgaacctgggaggcggaggttgccgtgagcaaagatcgctccattgcactccagcctgggcagcaagagcgagactctgtctcaaaaaagaaaa

SEQ ID NO: 5042 - DNA, 601 bp, Human
attgatcacaggatagtaccgatgagaccatgctttgaacccaaagtggaccagaagtttggttttccttcatagacatagacctcaactccaattcaggtgataactgtacaaaagcatgttgttagatcaaagtaaaaccaacccttttactagaaaatcagctcagaggccgggcgtggtggcttacaacttgtaatcccagcactttgagaggccgaggcaggcggatcacttgaggtcaggagttcgagatcagcctggccaacatggtgaaaccctgcctctactgaaaatattaaaaaaaaaaaaattagctgggcgtggtggcacatgcctgtaatctcagctactcaggaggctgagacaggagaatcgcttgaacctgggaggcggaggttgccgtgagcaaagatcgctccattgcactccagcctgggcagcaagagcgagactctgtctcaaaaaagaaaaaagaaaagaaaagaaaagaaaatcagctcagagagttaatgggttgttaatgttttctttatagataaagtacagcactaatcctaatccaataaatgatagtgaaacaaacaaaaaatttttttac

SEQ ID NO: 5043 - DNA, 601 bp, Human; identical to SEQ ID NO: 2410

SEQ ID NO: 5044 - DNA, 601 bp, Human; identical to SEQ ID NO: 2411

SEQ ID NO: 5045 - DNA, 601 bp, Human; identical to SEQ ID NO: 2412

SEQ ID NO: 5046 - DNA, 601 bp, Human; identical to SEQ ID NO: 2413

SEQ ID NO: 5047 - DNA, 601 bp, Human; identical to SEQ ID NO: 2414

SEQ ID NO: 5048 - DNA, 601 bp, Human; identical to SEQ ID NO: 2415

SEQ ID NO: 5049 - DNA, 601 bp, Human; identical to SEQ ID NO: 2416

SEQ ID NO: 5050 - DNA, 601 bp, Human; identical to SEQ ID NO: 2417

SEQ ID NO: 5051 - DNA, 601 bp, Human; identical to SEQ ID NO: 2418

SEQ ID NO: 5052 - DNA, 601 bp, Human; identical to SEQ ID NO: 2419

SEQ ID NO: 5053 - DNA, 601 bp, Human; identical to SEQ ID NO: 2420

SEQ ID NO: 5054 - DNA, 601 bp, Human; identical to SEQ ID NO: 2421

SEQ ID NO: 5055 - DNA, 601 bp, Human; identical to SEQ ID NO: 2422

SEQ ID NO: 5056 - DNA, 601 bp, Human; identical to SEQ ID NO: 2423

SEQ ID NO: 5057 - DNA, 601 bp, Human; identical to SEQ ID NO: 2424

SEQ ID NO: 5058 - DNA, 601 bp, Human; identical to SEQ ID NO: 2425

SEQ ID NO: 5059 - DNA, 601 bp, Human; identical to SEQ ID NO: 2426

SEQ ID NO: 5060 - DNA, 601 bp, Human; identical to SEQ ID NO: 2427

SEQ ID NO: 5061 - DNA, 601 bp, Human; identical to SEQ ID NO: 2428

SEQ ID NO: 5062 - DNA, 601 bp, Human; identical to SEQ ID NO: 2429

SEQ ID NO: 5063 - DNA, 601 bp, Human; identical to SEQ ID NO: 2430

SEQ ID NO: 5064 - DNA, 601 bp, Human; identical to SEQ ID NO: 2431

SEQ ID NO: 5065 - DNA, 601 bp, Human; identical to SEQ ID NO: 2432

SEQ ID NO: 5066 - DNA, 601 bp, Human; identical to SEQ ID NO: 2433

SEQ ID NO: 5067 - DNA, 601 bp, Human; identical to SEQ ID NO: 2434

SEQ ID NO: 5068 - DNA, 601 bp, Human; identical to SEQ ID NO: 2435

SEQ ID NO: 5069 - DNA, 601 bp, Human; identical to SEQ ID NO: 2436

SEQ ID NO: 5070 - DNA, 601 bp, Human; identical to SEQ ID NO: 2437

SEQ ID NO: 5071 - DNA, 601 bp, Human; identical to SEQ ID NO: 2438

SEQ ID NO: 5072 - DNA, 601 bp, Human; identical to SEQ ID NO: 2439

SEQ ID NO: 5073 - DNA, 601 bp, Human; identical to SEQ ID NO: 2440

SEQ ID NO: 5074 - DNA, 601 bp, Human; identical to SEQ ID NO: 2441

SEQ ID NO: 5075 - DNA, 601 bp, Human; identical to SEQ ID NO: 2442

SEQ ID NO: 5076 - DNA, 601 bp, Human; identical to SEQ ID NO: 2443

SEQ ID NO: 5077 - DNA, 601 bp, Human; identical to SEQ ID NO: 2444

SEQ ID NO: 5078 - DNA, 601 bp, Human; identical to SEQ ID NO: 2445

SEQ ID NO: 5079 - DNA, 601 bp, Human; identical to SEQ ID NO: 2446

SEQ ID NO: 5080 - DNA, 601 bp, Human; identical to SEQ ID NO: 2447

SEQ ID NO: 5081 - DNA, 601 bp, Human; identical to SEQ ID NO: 2448

SEQ ID NO: 5082 - DNA, 601 bp, Human; identical to SEQ ID NO: 2449

SEQ ID NO: 5083 - DNA, 601 bp, Human; identical to SEQ ID NO: 2450

SEQ ID NO: 5084 - DNA, 601 bp, Human; identical to SEQ ID NO: 2451

SEQ ID NO: 5085 - DNA, 601 bp, Human; identical to SEQ ID NO: 2452

SEQ ID NO: 5086 - DNA, 601 bp, Human; identical to SEQ ID NO: 2453

SEQ ID NO: 5087 - DNA, 601 bp, Human; identical to SEQ ID NO: 2454

SEQ ID NO: 5088 - DNA, 601 bp, Human; identical to SEQ ID NO: 2455

SEQ ID NO: 5089 - DNA, 601 bp, Human; identical to SEQ ID NO: 2456

SEQ ID NO: 5090 - DNA, 601 bp, Human; identical to SEQ ID NO: 2457

SEQ ID NO: 5091 - DNA, 601 bp, Human; identical to SEQ ID NO: 2458

SEQ ID NO: 5092 - DNA, 601 bp, Human; identical to SEQ ID NO: 2459

SEQ ID NO: 5093 - DNA, 601 bp, Human; identical to SEQ ID NO: 2460

SEQ ID NO: 5094 - DNA, 601 bp, Human; identical to SEQ ID NO: 2461

SEQ ID NO: 5095 - DNA, 601 bp, Human; identical to SEQ ID NO: 2462

SEQ ID NO: 5096 - DNA, 601 bp, Human; identical to SEQ ID NO: 2463

SEQ ID NO: 5097 - DNA, 601 bp, Human; identical to SEQ ID NO: 2464

SEQ ID NO: 5098 - DNA, 601 bp, Human; identical to SEQ ID NO: 2465

SEQ ID NO: 5099 - DNA, 601 bp, Human; identical to SEQ ID NO: 2466

SEQ ID NO: 5100 - DNA, 601 bp, Human; identical to SEQ ID NO: 2467

SEQ ID NO: 5101 - DNA, 601 bp, Human; identical to SEQ ID NO: 2468

SEQ ID NO: 5102 - DNA, 601 bp, Human; identical to SEQ ID NO: 2469

SEQ ID NO: 5103 - DNA, 601 bp, Human; identical to SEQ ID NO: 2470

SEQ ID NO: 5104 - DNA, 601 bp, Human; identical to SEQ ID NO: 2471

SEQ ID NO: 5105 - DNA, 601 bp, Human; identical to SEQ ID NO: 2472

SEQ ID NO: 5106 - DNA, 601 bp, Human; identical to SEQ ID NO: 2473

SEQ ID NO: 5107 - DNA, 601 bp, Human; identical to SEQ ID NO: 2474

SEQ ID NO: 5108 - DNA, 601 bp, Human
cgggaggcagaggttgcggtgagccaagatcacaccactgcactccagcctgggcaacaagagtgaaactccgtctcaaaaaaaaaaaaaaaaaagtcactggaggaggtgtgaagagtgggccaggagacaatgtgagggggttattgcaatggttaagataatagatgagaacctgggagacagaggttgcagtgagctgaaattgtgccactgcacgccagcctgggtgacagagagattccgtctcaaaaaaaggagatgttagtagcttagaacaggtgatggcagtacaatggayagtactagacatatgtgctaggcacttaagagatgagatcaataggaattggccatgggtttgtaagatgtgtaggttggggagacagctgtgagggtatagactcagcaaccagcataaccccaagagataggtcttactcacctgtcagggtggccctggtggttggaccaatgcccttggggaccagtacctcatgatattgctcacccgccagggtgctgtacacaaccttgtactcctgaacttcggcttcactgttatcccactcgaggtcaaggctggttgctgtgcgagaac

SEQ ID NO: 5109 - DNA, 601 bp, Human
acacaaaattagccgggcgtggtggcagatgcctgtaatcctagctacttgggaggctgaggcaggagaatcgcttgaacccgggaggcagaggttgcggtgagccaagatcacaccactgcactccagcctgggcaacaagagtgaaactccgtctcaaaaaaaaaaaaaaaaaagtcactggaggaggtgtgaagagtgggccaggagacaatgtgagggggttattgcaatggttaagataatagatgagaacctgggagacagaggttgcagtgagctgaaattgtgccactgcackccagcctgggtgacagagagattccgtctcaaaaaaaggagatgttagtagcttagaacaggtgatggcagtacaatggacagtactagacatatgtgctaggcacttaagagatgagatcaataggaattggccatgggtttgtaagatgtgtaggttggggagacagctgtgagggtatagactcagcaaccagcataaccccaagagataggtcttactcacctgtcagggtggccctggtggttggaccaatgcccttggggaccagtacctcatgatattgctcacccgccaggg

SEQ ID NO: 5110 - DNA, 601 bp, Human
ggcataatcaaaaatgtactttgaaaaagtcactggaaggccaggtgcagtggctcacacctgtaatcccagcactttgagaagccgaggtgggcggatcacctgaggtcgggagtttgtgaccagcctgaccaacatggagaaaccctgtctctactaaaaacacaaaattagccgggcgtggtggcagatgcctgtaatcctagctacttgggaggctgaggcaggagaatcgcttgaacccgggaggcagaggttgcggtgagccaagatcacaccactgcactccagcctgggcaayaagagtgaaactccgtctcaaaaaaaaaaaaaaaaaagtcactggaggaggtgtgaagagtgggccaggagacaatgtgagggggttattgcaatggttaagataatagatgagaacctgggagacagaggttgcagtgagctgaaattgtgccactgcacgccagcctgggtgacagagagattccgtctcaaaaaaaggagatgttagtagcttagaacaggtgatggcagtacaatggacagtactagacatatgtgctaggcacttaagagatgagatcaataggaattggccatg

SEQ ID NO: 5111 - DNA, 601 bp, Human
agagcagtgggaattccctggaatatctgcacagtgcaatggcataatcaaaaatgtactttgaaaaagtcactggaaggccaggtgcagtggctcacacctgtaatcccagcactttgagaagccgaggtgggcggatcacctgaggtcgggagtttgtgaccagcctgaccaacatggagaaaccctgtctctactaaaaacacaaaattagccgggcgtggtggcagatgcctgtaatcctagctacttgggaggctgaggcaggagaatcgcttgaacccgggaggcagaggttgcrgtgagccaagatcacaccactgcactccagcctgggcaacaagagtgaaactccgtctcaaaaaaaaaaaaaaaaaagtcactggaggaggtgtgaagagtgggccaggagacaatgtgagggggttattgcaatggttaagataatagatgagaacctgggagacagaggttgcagtgagctgaaattgtgccactgcacgccagcctgggtgacagagagattccgtctcaaaaaaaggagatgttagtagcttagaacaggtgatggcagtacaatggacagtactagacatatgtg

SEQ ID NO: 5112 - DNA, 601 bp, Human
gaacatgggtgggaggtgagcctggagagggcaggggaaaccaggcagggcctggtgtccacactaagggtctgggcttatcctaagagcagtgggaattccctggaatatctgcacagtgcaatggcataatcaaaaatgtactttgaaaaagtcactggaaggccaggtgcagtggctcacacctgtaatcccagcactttgagaagccgaggtgggcggatcacctgaggtcgggagtttgtgaccagcctgaccaacatggagaaaccctgtctctactaaaaacacaaaattagcygggcgtggtggcagatgcctgtaatcctagctacttgggaggctgaggcaggagaatcgcttgaacccgggaggcagaggttgcggtgagccaagatcacaccactgcactccagcctgggcaacaagagtgaaactccgtctcaaaaaaaaaaaaaaaaaagtcactggaggaggtgtgaagagtgggccaggagacaatgtgagggggttattgcaatggttaagataatagatgagaacctgggagacagaggttgcagtgagctgaaattgtgccactgcacgccagcctgggtga

SEQ ID NO: 5113 - DNA, 601 bp, Human
gtggaaagggaagcctgcattggctagatgaagaggttcccatcaggcagagggaacagcatttgccagtcctatatagcaggagggaaaacgtatttgagaaatggaaagaagcagacttgtgggcctggagcccagaaaacatcagggaacatgggtgggaggtgagcctggagagggcaggggaaaccaggcagggcctggtgtccacactaagggtctgggcttatcctaagagcagtgggaattccctggaatatctgcacagtgcaatggcataatcaaaaatgtactttgaaaragtcactggaaggccaggtgcagtggctcacacctgtaatcccagcactttgagaagccgaggtgggcggatcacctgaggtcgggagtttgtgaccagcctgaccaacatggagaaaccctgtctctactaaaaacacaaaattagccgggcgtggtggcagatgcctgtaatcctagctacttgggaggctgaggcaggagaatcgcttgaacccgggaggcagaggttgcggtgagccaagatcacaccactgcactccagcctgggcaacaagagtgaaactccgtctcaaaaaaa

SEQ ID NO: 5114 - DNA, 601 bp, Human
aacaatatcaaatttgaccactaaagctccctaaagtggggagtaacctgggagtggaaagggaagcctgcattggctagatgaagaggttcccatcaggcagagggaacagcatttgccagtcctatatagcaggagggaaaacgtatttgagaaatggaaagaagcagacttgtgggcctggagcccagaaaacatcagggaacatgggtgggaggtgagcctggagagggcaggggaaaccaggcagggcctggtgtccacactaagggtctgggcttatcctaagagcagtgggaaktccctggaatatctgcacagtgcaatggcataatcaaaaatgtactttgaaaaagtcactggaaggccaggtgcagtggctcacacctgtaatcccagcactttgagaagccgaggtgggcggatcacctgaggtcgggagtttgtgaccagcctgaccaacatggagaaaccctgtctctactaaaaacacaaaattagccgggcgtggtggcagatgcctgtaatcctagctacttgggaggctgaggcaggagaatcgcttgaacccgggaggcagaggttgcggtgagccaagatc

SEQ ID NO: 5115 - DNA, 601 bp, Human
tgccacacatgtaaaatgataacctgaggagtgctaagaagtgaatggaaactggcaagatgaagctgccggacagaatgaatggaactctctcaggaacaatatcaaatttgaccactaaagctccctaaagtggggagtaacctgggagtggaaagggaagcctgcattggctagatgaagaggttcccatcaggcagagggaacagcatttgccagtcctatatagcaggagggaaaacgtatttgagaaatggaaagaagcagacttgtgggcctggagcccagaaaacatcagggracatgggtgggaggtgagcctggagagggcaggggaaaccaggcagggcctggtgtccacactaagggtctgggcttatcctaagagcagtgggaattccctggaatatctgcacagtgcaatggcataatcaaaaatgtactttgaaaaagtcactggaaggccaggtgcagtggctcacacctgtaatcccagcactttgagaagccgaggtgggcggatcacctgaggtcgggagtttgtgaccagcctgaccaacatggagaaaccctgtctctactaaaaacacaaaattagccg

SEQ ID NO: 5116 - DNA, 601 bp, Human
tttagcttaatttttgtgactgtttctagctctctgcgaggccctatgccagctggtctatcctttctctgcttaattcacccccgttaatctgcttggtcagcatatcttctcatctccttgctgtgcctttaggagtgcgtctgtctggaaaaggcatttattatatttactttaactggctgtgtttggcaaggtggtctgggatttcaacttgggaggaaaactgctttgattatactgcccttgtttaccgtatgcactctttgctgtgtatcccttgtctatcaagacagcaaayacttttgcaggaatccaagacacaaattaaacaaaatctctgtctgtgagcacattggcagctcctggtccatgactgttctgcacagcatctcctttatctgaaaaccacacccccatttccagtcttctactctttggtgagtttgggaagggaggttttcttggatgggtgagccagaggccccaggagtggtgttgcctgggtctcacactcccaggggacagggaacacttcccagccaggtatcatggtgaccgaggacactgccttagtccatgccatcatcatctccctttg

SEQ ID NO: 5117 - DNA, 601 bp, Human
agttccctcctgtatcatttcagggttttttttttttttttttggatttagcttaatttttgtgactgtttctagctctctgcgaggccctatgccagctggtctatcctttctctgcttaattcacccccgttaatctgcttggtcagcatatcttctcatctccttgctgtgcctttaggagtgcgtctgtctggaaaaggcatttattatatttactttaactggctgtgtttggcaaggtggtctgggatttcaacttgggaggaaaactgctttgattatactgcccttgtttacygtatgcactctttgctgtgtatcccttgtctatcaagacagcaaatacttttgcaggaatccaagacacaaattaaacaaaatctctgtctgtgagcacattggcagctcctggtccatgactgttctgcacagcatctcctttatctgaaaaccacacccccatttccagtcttctactctttggtgagtttgggaagggaggttttcttggatgggtgagccagaggccccaggagtggtgttgcctgggtctcacactcccaggggacagggaacacttcccagccaggtatcatgg

SEQ ID NO: 5118 - DNA, 601 bp, Human
gggggtacttgctgccagccagctctgggaatgtctcagagaccaggagagtcaggaagggcctggattccacaacaaagaggaaaatggtggcctcagagacaacggcttctgcagggaatggcaaatacaggtgccatagagctttaagtgttgagtcaacagtgagagtaaagggggcctgaccttgtgcccagcaaaggccaggctgccacggcttcaggtctgagctttgtgaggattaataccaataaaaaattgaatgggtattgagtgcttactgtgtgccaggctccatccyaagttcttgaatagggatatatgtatgatttcatttaattctcgctacaacccaatgaggtagataggatgtcttttagatgagagaactaaagtgcaggaaatttaagaaatttgctcaaggatgcacttttcatgaagctggtctcccccctgagtggggtacttccacagctgtgctctaagtgagtgcttctcactcatagatttccttgaagcaggggtcctaaaatgcaggctctgggttggtagttctcgggggaagaggcctccaacatctctgggcgtaatgcccaggctg

SEQ ID NO: 5119 - DNA, 601 bp, Human
tgtttttttttttgttgctgcccagaaagcagaatggtattgtaccctgttacatggtgccaggttctaatctggctggtaagatgtgtaacactcaaggacccctttgggactataggtatggtgcacaggccaaacagacatcatacaggctaagtgactgagactaaaacagacttattaaggacacagaagccactagagcagagagaaaaagtcattgcagacattgagtctgttgttcagaaacaaattcatatcccagaaggaattctctggacattgcctacagagaataatggggggggagtgtttgaattttgggcaccagcctggactctgtgtggcagagggcaacatttgtaaagagggaggtcaagagggggtacttgctgccagccagctctgggaatgtctcagagaccaggagagtcaggaagggcctggattccacaacaaagaggaaaatggtggcctcagagacaacggcttctgcagggaatggcaaatacaggtgccatagagctttaagtgttgagtcaacagtgagagtaaagggggcctgaccttgtgcccagcaaaggccaggctgccacggctt

SEQ ID NO: 5120 - DNA, 601 bp, Human
gtgtttgtgcactggcccatcagggagtgcagacatagcgaggtggacatcgagtgccgtggtcagtgctgacttgccagctggactccctctggagtctcagatttcttcccctgcagacaagcacgtggcctgccagtgtaccctgaggagccaaccttctcaccactagatccccatttgggccagaaaccttgaaggcggcaactcccaaagcatgatcaggacgtacttgcaggcatcagcctagcgtgtgtgagtgtgtgtacgtgtgagggtatgtgaaagtgtagtgtgtacrtatgagggcatgagcatgtgtggtgtgtatgactatgagtgtgtgcatgtgtgtatgagtatgtgtgtatgtgcatgtgagtgtgcgtatgtgcttaagtgtaagtgcaagagtctgtaggtgtgtttgtgtgtacatgtgtgcatgtggtgagtgtgagtgcatcatgtgtggctggctgtaagtctctgttttcttgcagtcctatgttgtatcacatctgtagaaactgtaaagcttctggatttcctaggccctgttggcaatttttcagcttgtcaactggagatagagatagtc

SEQ ID NO: 5121 - DNA, 601 bp, Human
tgccttaccaaagtgaccacttggggtcactgtgacttcgcccaaaggaggctgagcactgtctggcccgggaccccaggccctgtgcctggtcctttcctcctcagaagagctgcagggcgttgaaggtctggtgctgggtttggtgtttgtgcactggcccatcagggagtgcagacatagcgaggtggacatcgagtgccgtggtcagtgctgacttgccagctggactccctctggagtctcagatttcttcccctgcagacaagcacgtggcctgccagtgtaccctgaggagccraccttctcaccactagatccccatttgggccagaaaccttgaaggcggcaactcccaaagcatgatcaggacgtacttgcaggcatcagcctagcgtgtgtgagtgtgtgtacgtgtgagggtatgtgaaagtgtagtgtgtacgtatgagggcatgagcatgtgtggtgtgtatgactatgagtgtgtgcatgtgtgtatgagtatgtgtgtatgtgcatgtgagtgtgcgtatgtgcttaagtgtaagtgcaagagtctgtaggtgtgtttgtgtgtacatgtgtgcatgtggtgagt

SEQ ID NO: 5122 - DNA, 601 bp, Human
aggtatgtggaagcctttgtcctttctttcctcctcttcaacttgggtctctgcagcccactccccagcttcccgcccctggaaggtgacaccatgtttagagggtgccttaccaaagtgaccacttggggtcactgtgacttcgcccaaaggaggctgagcactgtctggcccgggaccccaggccctgtgcctggtcctttcctcctcagaagagctgcagggcgttgaaggtctggtgctgggtttggtgtttgtgcactggcccatcagggagtgcagacatagcgaggtggacatygagtgccgtggtcagtgctgacttgccagctggactccctctggagtctcagatttcttcccctgcagacaagcacgtggcctgccagtgtaccctgaggagccaaccttctcaccactagatccccatttgggccagaaaccttgaaggcggcaactcccaaagcatgatcaggacgtacttgcaggcatcagcctagcgtgtgtgagtgtgtgtacgtgtgagggtatgtgaaagtgtagtgtgtacgtatgagggcatgagcatgtgtggtgtgtatgactatgagtgtgtgcatgt

SEQ ID NO: 5123 - DNA, 601 bp, Human
atgtagtatagtgagaaaacatgcacagaagcagcatggtgctggtggcagtagcggtggtggtggggagtgttggggagactccgaagagaggatatctggactgggttttgaaggacccatggacatctggtggcagggagggcatcccagacaaaggaaacagggcatgcaaaggcagctctggcaaaataattcatgaaaacccagggactaatatagggtccctcatagagaaatttcccatcagtggaatttggagaccagaggtttcatgggggagatatgtggagaatatctytggagagcccctgaaatcacaccagataggcaccaatctactttttagttaaatggagatctgagcagtcagcctccccacacttatctctttggattatgacaggtgcatcttcaggattcctggaatgagtcaggctttcgaggccatctccctgcttttttgggtgtgcatgatgttcaagtttcaagagaagcagccaattccatcctgatttaaaggaagggactggcctaacaagcccatttttgataagaaaaataatacttctaaggcctgtttccagatggaactttctta

SEQ ID NO: 5124 - DNA, 601 bp, Human
tctctcattgtgtgatgcgcgggctactcctccggcttcccgcatgattgtaagctttccgaggccctcaccagaagcagattctggcaccatgtttcctgtacactctgcagaactgtaagccagtcaaacctcctttctttataaattacccaccctcaggtattcctttatagtaatgcaaatggactaatgcaggaccaaagcagaggctgctaactaagaggacaagatcagcatgggactaagaggacacgatcagcagggagaagatcagcatgggctgtaatagtcagataartctttccagagaaggcatttgagttggaacttaaagctggctaagataaggaaagatagagggaaggaaatatggaattctctagtggccagaatggggcataatgagcattcatagattaattagggctagaaaggaacaggagttagcacattctcacctgcagtgcaaggactgtggtgataaaggcagaatgactcacttagccctgttttgggaacctattcttcatgcctgctgtcgctagcagggaaagtggtagggagaaggaggcccaaggaactgagattgctgtctctt

SEQ ID NO: 5125 - DNA, 601 bp, Human
agattcacacgttatttaatttccctgaagcactactgatagggtattgcagatgagcaaacaggggctccaagaagtctattccttggccaaggtcacaaaactgatacatgatacaactaggtttggaacccaagtctcttgttattttctgactcatgatagcatggttcccatccctgagtcttacaggccaggaggaaggagtggagtaagcaacttggtattcgagagtgatttggtacctgttatagtttggatgcttgtcccctccaaatctcatattgaattgccatccccmatgttggtggtggggcccagtgggaggtgtttgggtcatgggggtggatccctcatgaatggcttggagctgtcctccagatagtgagtgagttctcgtgagatctggttgtttaaaagtgtgtggcacctccccccaacccttgctccctctctcattgtgtgatgcgcgggctactcctccggcttcccgcatgattgtaagctttccgaggccctcaccagaagcagattctggcaccatgtttcctgtacactctgcagaactgtaagccagtcaaacctcctttctttataaatt

SEQ ID NO: 5126 - DNA, 601 bp, Human
atagaactttctttgttcaacttggaggttgatgcttttctcaactctttcacctcacacccattcttcttggaacccctaaagcacagtcatacattcaacaaatattaagggcctcctttgtgtcagacacaaggtggtgtgagctgaacaagacattagccttgccttttgggggtgaaaaggaatctgtgctaaaaaagtaaaataattatttagtgagcacccataatatgcctagcactaagctacatggaaaagaataatgacgaaggggagggaagaaaaagagaagtaaaaratgaagactttttgagtgtctgatggtaaagagttatgcaagtattactgagcttcttaaagattcacacgttatttaatttccctgaagcactactgatagggtattgcagatgagcaaacaggggctccaagaagtctattccttggccaaggtcacaaaactgatacatgatacaactaggtttggaacccaagtctcttgttattttctgactcatgatagcatggttcccatccctgagtcttacaggccaggaggaaggagtggagtaagcaacttggtattcgagagtgattt

SEQ ID NO: 5127 - DNA, 601 bp, Human
attatacgttgccaaacagatctaacatgtaacattttcatcccagtttcttatttatgaagcttaaatgaaatgttcaataatttacaatggaatcatcttctcccagaaaactgcagagcagaatttaatgtgttctgttcccaggttttctgtctagaggatggaaaagtgggacttgcttataggtttgtgcctgctgctttcctttgattttcagcagctttcttccatgctacaagtgaattgttgctctttgccagcaggttagacacagttctgctggaaaaaaaaaaaaaamcacatgtatccgaggcatagccagtgcacttagatatcagcactctgagtactcctagggatttctcactttttaaagaccccattgctctctatcaatgccccctttatctctccatccaactcctgcaagtggtaacatataaatggccctgttccctttcttaacaatagcacagaaaattcatcccataggaaatcactactctctgttccttatagaactttctttgttcaacttggaggttgatgcttttctcaactctttcacctcacacccattcttcttggaacccctaaa

SEQ ID NO: 5128 - DNA, 601 bp, Human
ggagtaagacagaaattatacgttgccaaacagatctaacatgtaacattttcatcccagtttcttatttatgaagcttaaatgaaatgttcaataatttacaatggaatcatcttctcccagaaaactgcagagcagaatttaatgtgttctgttcccaggttttctgtctagaggatggaaaagtgggacttgcttataggtttgtgcctgctgctttcctttgattttcagcagctttcttccatgctacaagtgaattgttgctctttgccagcaggttagacacagttctgctggaaaaaaaaaaaaaaacacatgtatccgaggcatagccagtgcacttagatatcagcactctgagtactcctagggatttctcactttttaaagaccccattgctctctatcaatgccccctttatctctccatccaactcctgcaagtggtaacatataaatggccctgttccctttcttaacaatagcacagaaaattcatcccataggaaatcactactctctgttccttatagaactttctttgttcaacttggaggttgatgcttttctcaactctttcacctcacacccattcttc

SEQ ID NO: 5129 - DNA, 601 bp, Human
ttcagtgagttccaggtacatccttggttgcagaaatgagattacctttgggacataaactacttttatcaggcaactgattaagaccttcaattgcctataatgaagtagaaattctccaacatagatgaagggtgacagatggagggagtaagacagaaattatacgttgccaaacagatctaacatgtaacattttcatcccagtttcttatttatgaagcttaaatgaaatgttcaataatttacaatggaatcatcttctcccagaaaactgcagagcagaatttaatgtgttctsttcccaggttttctgtctagaggatggaaaagtgggacttgcttataggtttgtgcctgctgctttcctttgattttcagcagctttcttccatgctacaagtgaattgttgctctttgccagcaggttagacacagttctgctggaaaaaaaaaaaaaaacacatgtatccgaggcatagccagtgcacttagatatcagcactctgagtactcctagggatttctcactttttaaagaccccattgctctctatcaatgccccctttatctctccatccaactcctgcaagtggtaac

SEQ ID NO: 5130 - DNA, 601 bp, Human
ttgcttaagcatggcagagcttaccaggccggtttctctcccaggaatgcagtcccgaagccctgtctgggtaggcattcgaatcagccctcttttttctcttcttaaaccagctccctttctttcccaacccttaattctttctttctctaaagtggcaacaccagtggaggtaaactttgaagtttgacagactttgacgtctgacatatctatatttggtctctttcactttttacctgtgtaattttgattacttaacatctatgaacctcaatttctgaagaatgagaataaaaayagcatctatatcagagggtcatcatgaggattatatgagtcaaagtgtttaaagtccagtgcctggatcttagcggtagtagctagtattttattactttgcacagagaactattcctggattttgagtactttttttttttttttttttttttttttttttggtgagtggtctcatcaactacaaaaaccgccccaggcaagtacaggccggtcctgggtgcacctgttgacttgttgttattggtttgctgaggcttagcctgttggctctgttggaaaccagtgattcagggagtcc

SEQ ID NO: 5131 - DNA, 601 bp, Human
ctcagggcagctgtgatttctctggaatccctgattttgatcggaaatactttgagcaacattcctttaacaaatggcttggcttggtcaagaggaatgctgcctggcagccagggggttcttcatccccttcctcagtaggctttcgtggagtccatgcaataaatgttgcttaagcatggcagagcttaccaggccggtttctctcccaggaatgcagtcccgaagccctgtctgggtaggcattcgaatcagccctcttttttctcttcttaaaccagctccctttctttcccaaccmttaattctttctttctctaaagtggcaacaccagtggaggtaaactttgaagtttgacagactttgacgtctgacatatctatatttggtctctttcactttttacctgtgtaattttgattacttaacatctatgaacctcaatttctgaagaatgagaataaaaacagcatctatatcagagggtcatcatgaggattatatgagtcaaagtgtttaaagtccagtgcctggatcttagcggtagtagctagtattttattactttgcacagagaactattcctggattttgagtact

SEQ ID NO: 5132 - DNA, 601 bp, Human
cagagttcagggcttttaggaggaatgggacatcctattacttccttccactgctcagggcagctgtgatttctctggaatccctgattttgatcggaaatactttgagcaacattcctttaacaaatggcttggcttggtcaagaggaatgctgcctggcagccagggggttcttcatccccttcctcagtaggctttcgtggagtccatgcaataaatgttgcttaagcatggcagagcttaccaggccggtttctctcccaggaatgcagtcccgaagccctgtctgggtaggcattygaatcagccctcttttttctcttcttaaaccagctccctttctttcccaacccttaattctttctttctctaaagtggcaacaccagtggaggtaaactttgaagtttgacagactttgacgtctgacatatctatatttggtctctttcactttttacctgtgtaattttgattacttaacatctatgaacctcaatttctgaagaatgagaataaaaacagcatctatatcagagggtcatcatgaggattatatgagtcaaagtgtttaaagtccagtgcctggatcttagcggtag

SEQ ID NO: 5133 - DNA, 601 bp, Human
gaccagctagagatgccccccggattctggtctcagagttcagggcttttaggaggaatgggacatcctattacttccttccactgctcagggcagctgtgatttctctggaatccctgattttgatcggaaatactttgagcaacattcctttaacaaatggcttggcttggtcaagaggaatgctgcctggcagccagggggttcttcatccccttcctcagtaggctttcgtggagtccatgcaataaatgttgcttaagcatggcagagcttaccaggccggtttctctcccaggartgcagtcccgaagccctgtctgggtaggcattcgaatcagccctcttttttctcttcttaaaccagctccctttctttcccaacccttaattctttctttctctaaagtggcaacaccagtggaggtaaactttgaagtttgacagactttgacgtctgacatatctatatttggtctctttcactttttacctgtgtaattttgattacttaacatctatgaacctcaatttctgaagaatgagaataaaaacagcatctatatcagagggtcatcatgaggattatatgagtcaaagt

SEQ ID NO: 5134 - DNA, 601 bp, Human
acaaaacaaaaaaacccaacaaaatcaagtgatcaccctgagggcctccagtggtcagtctgagtccttccggtaggctctttttggggctttgtgtgggctcatggctgattggaatggtattctgtatttatataacatctgtgcttttcaaaatggattgtgttttagagtctcatcacaaccttgggaggaaggtgggataagcagtcttttctccatctacattagcttcctgtggatgctgttataaattaccacacacagtgtggcttaaaacagacatgtgtcctcccacggytctgaagtctggaagtccgaaatcaaggtgtcgccaggaccatgcttcctctgaaggctctaggagacctaggttctggtggttgccagcactccctggcattccttggcttgtagttgcgtcaccccagtctctgcctctgtagacacatgtgtgtctgtgtcttcccctcttcttataaacacaccagtcacattgaatttaggggccaccctaatccagtatgacctcatcttaactctactgcatctctaaagaccttatttggaaataagggtttggggtggacatgcattttga

SEQ ID NO: 5135 - DNA, 601 bp, Human
aaaacaaaacaaaaaaacccaacaaaatcaagtgatcaccctgagggcctccagtggtcagtctgagtccttccggtaggctctttttggggctttgtgtgggctcatggctgattggaatggtattctgtatttatataacatctgtgcttttcaaaatggattgtgttttagagtctcatcacaaccttgggaggaaggtgggataagcagtcttttctccatctacattagcttcctgtggatgctgttataaattaccacacacagtgtggcttaaaacagacatgtgtcctcccayggttctgaagtctggaagtccgaaatcaaggtgtcgccaggaccatgcttcctctgaaggctctaggagacctaggttctggtggttgccagcactccctggcattccttggcttgtagttgcgtcaccccagtctctgcctctgtagacacatgtgtgtctgtgtcttcccctcttcttataaacacaccagtcacattgaatttaggggccaccctaatccagtatgacctcatcttaactctactgcatctctaaagaccttatttggaaataagggtttggggtggacatgcattt

SEQ ID NO: 5136 - DNA, 601 bp, Human
aaacaaacattattctgtgtatggggcagggctaggaaggctgaaagtgggaagaaaatgatcttagactcctattcataccttgtgtttagtcctccttgaatcctctcctaatttgaactattaagaaatcccaatttcactatttaggaatcccaagtcaataggacgaaccagcccacgcagagcttccttcttgcaggcaggctctctgggaaggcagtgaggctgccttgtcagtgaccttcagaggtgtgctcacataagtatacaaggactccttgtatgcttagcgtctcargttggcttgaaccagcgagaggatttcttgcttaaattgtgaatttcgggagtatgtaatcaagagagacagtgtggacatagacctgaaaagcattccttgaatgttatatacaaggaccaagctacaccttttacaggagctgaggccatatggggactcctgggtcccttctagggggaacagtggatggacttttttttctaagcacagggctgtcgagtaggagcatgcagaagtcctgttgctgtaggccccccgccaagttcagtaattcaggcctcagggtatctaaagctg

SEQ ID NO: 5137 - DNA, 601 bp, Human; identical to SEQ ID NO: 2475

SEQ ID NO: 5138 - DNA, 601 bp, Human; identical to SEQ ID NO: 2476

SEQ ID NO: 5139 - DNA, 601 bp, Human; identical to SEQ ID NO: 2477

SEQ ID NO: 5140 - DNA, 601 bp, Human; identical to SEQ ID NO: 2478

SEQ ID NO: 5141 - DNA, 601 bp, Human; identical to SEQ ID NO: 2479

SEQ ID NO: 5142 - DNA, 601 bp, Human; identical to SEQ ID NO: 2480

SEQ ID NO: 5143 - DNA, 601 bp, Human; identical to SEQ ID NO: 2481

SEQ ID NO: 5144 - DNA, 601 bp, Human; identical to SEQ ID NO: 2482

SEQ ID NO: 5145 - DNA, 601 bp, Human; identical to SEQ ID NO: 2483

SEQ ID NO: 5146 - DNA, 601 bp, Human; identical to SEQ ID NO: 2484

SEQ ID NO: 5147 - DNA, 601 bp, Human; identical to SEQ ID NO: 2485

SEQ ID NO: 5148 - DNA, 601 bp, Human; identical to SEQ ID NO: 2486

SEQ ID NO: 5149 - DNA, 601 bp, Human; identical to SEQ ID NO: 2487

SEQ ID NO: 5150 - DNA, 601 bp, Human; identical to SEQ ID NO: 2488

SEQ ID NO: 5151 - DNA, 601 bp, Human; identical to SEQ ID NO: 2489

SEQ ID NO: 5152 - DNA, 601 bp, Human; identical to SEQ ID NO: 2490

SEQ ID NO: 5153 - DNA, 601 bp, Human; identical to SEQ ID NO: 2491

SEQ ID NO: 5154 - DNA, 601 bp, Human; identical to SEQ ID NO: 2492

SEQ ID NO: 5155 - DNA, 601 bp, Human; identical to SEQ ID NO: 2493

SEQ ID NO: 5156 - DNA, 601 bp, Human
acttgcagaaaacctgaactggaaggaacctgattttttaaatttttatttatttttttttttttgagacggagtctcactttttcacccaggctggagtacagtggcacgatctcagctcactgcaacctctgcttcctaggttcaagtgattctcttgcctcagcctcctgagtagctgggattacaggcacacaccaccatgcccaactaatttttgtattttcagtagagacagggttttatcatgttggacaggctggtctcaaactcctgacctcaggtaatctgcccatctagrcccccgaagtgctgggattataggtgtgagtcaccgcacccagccagaacctgatgtctttacttggtgcatttaattggtccgggtggatcagggagttgtactgctggttcctgcggttaccttgttagtgagaggtttcctggtaggggcttggacaggggaaaagaaggaggaggcaactgagcttttttgataaactgctcccagggcaagtctcagcagaggctgctgatgagccaaacatcaggaagtggagaagaaggcatcaaagtggccatgctccctcacctgtggtga

SEQ ID NO: 5157 - DNA, 601 bp, Human
tagccatgtaagtctttggtttctgtgccccttggtttcatcacctgtggaatggggatcataggccttcctgaccagttgttatataagaactgagtgagatcataggaatgcaaaagtcctttgtgtatggaaaagagctgcaggtttaatgttgagggtttactactgctgcttttactaagtgagtctctgattacaggtagcagaggaaggaggaagagaaagataaactttgctggaaaaccacttgcagaaaacctgaactggaaggaacctgattttttaaatttttatttatttttttttttttgagacggagtctcactttttcacccaggctggagtacagtggcacgatctcagctcactgcaacctctgcttcctaggttcaagtgattctcttgcctcagcctcctgagtagctgggattacaggcacacaccaccatgcccaactaatttttgtattttcagtagagacagggttttatcatgttggacaggctggtctcaaactcctgacctcaggtaatctgcccatctaggcccccgaagtgctgggattataggtgtgagtcaccgcacccagccagaacct

SEQ ID NO: 5158 - DNA, 601 bp, Human
gggatggaggaagaggctctgaggcatggacgggaatccagtcattctggtgctctgacatggcaggcaggatgtggctgagtatatgggacatgctcaggtttgcctcacatgtatgcacccacacccccataatgtgggccagggagagaattcaaagtcggggctgggcagccttacattatggactgtagagaggcacagtgggaggtggtagagagaaacattagtaacacagaccccagagctgaaacatctggcgtcaaattccagctcccttacttaagagctatgggatctygggtgagttacctcacctctctgtggcccaatttcctcatttgtaaaaaatagagatgatagtgcataccacataggctgttgtgaggattacattaggtaatacatgtaatgcagttaaacagtacttggcaagtaactctcaaaagtcagatattaggttatttcctgttatagagattaggaattttttttatcctttagcagcgtttttcaagtatcttctgctgacttaaggagggaaggcagccggaacagctgcatttagaagtagaagacctgggttcaaggtctgactcag

SEQ ID NO: 5159 - DNA, 601 bp, Human
tcaatttaaccagtgtctattatgtctggtatgtgccaggctttgtgcaagatactttcacatgcattatttctgcccaagaatctttcattctgcaaccagtcatttcagtgggttctgataaatctccaagacaaagccagcagagtttggtatacatgagtgacttacatttaaatttgagctttccagtaaaactgcgaaagcttccaaacacagacatatctttaccatgtaccacagaagtaataatacaaactctacatggaacacctcagtcagtagctacactcaccgcatrggaaattgggctcttctgttttcccctttctgagctggtattggtcatgccccaagagcctggtgtcaactggagtcttgtaaacacaaacaaacaacctaaatacatcctgatagtcccctgcactgtccaccaaatgaagccattattctgcctcctctccagatttccatgtgtgttgttaatcttctgcttatttgatcctactgaggccccaggtggatttgggatcccagatccaaaaaactgtacactgcttggcgcagctgcatctaagagagggcagtgaggggcacagaa

SEQ ID NO: 5160 - DNA, 601 bp, Human
ctgtgctctgcagctgagatttgactattcaatttaaccagtgtctattatgtctggtatgtgccaggctttgtgcaagatactttcacatgcattatttctgcccaagaatctttcattctgcaaccagtcatttcagtgggttctgataaatctccaagacaaagccagcagagtttggtatacatgagtgacttacatttaaatttgagctttccagtaaaactgcgaaagcttccaaacacagacatatctttaccatgtaccacagaagtaataatacaaactctacatggaacasctcagtcagtagctacactcaccgcataggaaattgggctcttctgttttcccctttctgagctggtattggtcatgccccaagagcctggtgtcaactggagtcttgtaaacacaaacaaacaacctaaatacatcctgatagtcccctgcactgtccaccaaatgaagccattattctgcctcctctccagatttccatgtgtgttgttaatcttctgcttatttgatcctactgaggccccaggtggatttgggatcccagatccaaaaaactgtacactgcttggcgcagctgcat

SEQ ID NO: 5161 - DNA, 601 bp, Human
attaaaaatcgccttaggctttattttatcagagacccctcttctgtgctctgcagctgagatttgactattcaatttaaccagtgtctattatgtctggtatgtgccaggctttgtgcaagatactttcacatgcattatttctgcccaagaatctttcattctgcaaccagtcatttcagtgggttctgataaatctccaagacaaagccagcagagtttggtatacatgagtgacttacatttaaatttgagctttccagtaaaactgcgaaagcttccaaacacagacatatctttrccatgtaccacagaagtaataatacaaactctacatggaacacctcagtcagtagctacactcaccgcataggaaattgggctcttctgttttcccctttctgagctggtattggtcatgccccaagagcctggtgtcaactggagtcttgtaaacacaaacaaacaacctaaatacatcctgatagtcccctgcactgtccaccaaatgaagccattattctgcctcctctccagatttccatgtgtgttgttaatcttctgcttatttgatcctactgaggccccaggtggatttggg

SEQ ID NO: 5162 - DNA, 601 bp, Human
gagaggtggcacaggcaacgagagctcattaatattaccatgcaaatgactatgtagcctagtggaatttattcagggaaatttgcattgaggtggctgacagagcctgaaattagagggaatttgggcatcacatcatactcttgaaggttatacctctttgcctgtcttatccctacaaggggtattaaaaatcgccttaggctttattttatcagagacccctcttctgtgctctgcagctgagatttgactattcaatttaaccagtgtctattatgtctggtatgtgccaggcttygtgcaagatactttcacatgcattatttctgcccaagaatctttcattctgcaaccagtcatttcagtgggttctgataaatctccaagacaaagccagcagagtttggtatacatgagtgacttacatttaaatttgagctttccagtaaaactgcgaaagcttccaaacacagacatatctttaccatgtaccacagaagtaataatacaaactctacatggaacacctcagtcagtagctacactcaccgcataggaaattgggctcttctgttttcccctttctgagctggtattg

SEQ ID NO: 5163 - DNA, 601 bp, Human
caattaggtaagtcaacctcgaaatgaaaactaaggaaaactgttttaccatatattaatgtattaagttatagctataaaagcacaatgtggtatttatggaataccatatggaaaaacagacctgagagtagaatagggagttcagaggtcaaacagagatccatgtacttatgggaacttaatatacaatgaggcaccacaaaccaatacagaacagatggattatttaataaatgatgttaggagaactggttcactatagaaagaaaaatgaaactgtatcctcaactaataccartataaaataggctaaatatagagaaataaatctagaaagttaatagcggaacatattgaagaaaaccttttggctgaaaagcaaagaaagacttcttaagaaaggtttcaaaagctcaaataataatagctaatatttagtacaggaacccggtggaaaattgacaaactatatgagcaggaaatttagaggaaaataacactcaaaggactaaaaaacatatgaagagatgtttaaactcaaactaatgattaaagacattcaactagaaaaatgagatataaattatctctatgagat

SEQ ID NO: 5164 - DNA, 601 bp, Human
gaggtatacacaagaaaaaaatatacaggtcagtttcatttatgactgtagatgtgaaaagtctaaacggatagtagctaaccatatataacagtgcattaacaaatcatattcaggagagatttctctaaggattgtaattaatatatcgagaaagaagctattaatataactcacctcattagtatactaactgataaaagtcatataataaattaaataggtattataaaaaccatttgataaagtttaacaacaaagcttattacaaaaactcttaacttagaagaaaattctataycttgataaatgttttaaacctcaaatctaaacaaacactatttgtgtttattcaagattagccaattatatattttctttattttagaaaaaattaaataggcttttttgtttgtttgttttattatttatttatttatttttgagacagggtcttgctctgttgctcaggttggagtgcagtggtgtcatctcggctcacagcagcctccgcctcccagggtcaagcgattctcctgtctcagcctcctgagtagctggaattataggtgtgcaccaccatgcccagctaacttatgta

SEQ ID NO: 5165 - DNA, 601 bp, Human
ttgatatctgattaaattacaatttcaatgtatgaaaaaaaccacaaaagttccttgggcatatgaaattacggaaggtttgccttacaaaatccattactgaaaatttagagaacacaaataagagtgacaagttctagagatgtgaaaagtaagaatgattaactacttggaaaaactttatttatattgtcttaaataaaaggctataattaacagagagaaaagagaaagcctatccataagaatccagagccaaaacctagacagagcttgtttgtggggaggtgaagcgggtagrgaggaaagagtctagagggatttgagagggtgctcaagtacttggattgttacacaaagatgccatattgacacatttaagaaaggaggagggataaataaacaggactatgtatctgaaatctaaagtctggttctttgaaaatattaataaaagaaatatatcactaggaagactgagaagtaaagacagaatatgaaaaaaaataaaatgaaaaagggaaaatagctacagatgcagtagagataataaaacaatgaaaagtcttttgaagaattttatgctactaaattctggaaa

SEQ ID NO: 5166 - DNA, 601 bp, Human
ctcattcattgcagccagcattagtctgataaaaaaacaaaaacagaaccaaaaacaaacaagaccagccttgccaacatggtgaaaccctgtctctactaaaaatacaaaaagttagctgggcgtagtggcgggtgcctgtaatcccagctatccgggaggctgaggcaggagaatctcttgaacccgggagacggaggttgcagtgagccgagatcaagccactgcactccagcccaggtgacagagtgagactctgtcaaaaaaacaaacaaaacaaaacaaaacaacaacaaaaaamccccacaaaaccaaacagcaccaaaaaaagagagaggaaggcttggaagaaagttttgaaaaagtctgttttgcttgtctttcatattgccatggagtaatcactgccaatccttcacatgtctgtggcctttttctaatacctgcattaccaagcagaggagccgataaccccaaagggacacgagctcacaggccagaatatccattcactgaagagtaagactactgtgaaagaaagaccacaaccattatgagattgatcatctggtacagaattattagaacagaatttaaatta

SEQ ID NO: 5167 - DNA, 601 bp, Human
caccttcaacccatggtgttactggaaggcaggcctcgagtacaagatgtccaggtttttggcgtttttgaacaacgaattggacaaaatgcacaaacaaagtaacacaggaatgaaacgcaggaatgaagcagagaaagcagggatttattaaagcaagaaagcactccacaaggtgagagtgcacctgggcaagtggctcaagggcctgcttacaaagtttcctgggttttaagtactccttttgagatctctatcggctaccccttatctgaatgaaggctttggtttgtggctaacwaaaggctggggtgaattgaatgcagacgaagggatggccggtgcttagggtggccaatccaggacactttccctttccatctgagatgtggtggatggcggggagttgtagggagagcaggctttgaacctttgttactaggcatggggagatggggttttttcttttggtttaactttaggaagttgacactaattggccttagggttcctgccttcatacccaggtattttccttttgatccagctttgggaagtcagcacgaattggtcttagattccctgcctccagaccctattc

SEQ ID NO: 5168 - DNA, 601 bp, Human
atcatttctcttattattcctttgatccacttatatcagaagacccaatttcatggcagattagattgatcacagactggcagttgccagcctggcccctgtctgtggctcttgattcaacatggcaagggagggctgggtcctgatgacacttcctactggtctccctgctgccattctggtcccacctgcattcattctccacactttagccagagtgacctttttatagtgtgaatgtgatctgatttcatcctatcttttacttgcccaaaacccttcaatggcttctttattgcarttagaataaaatccagaatccctaccatggcctacaaagccctgtacgctccgtctctgtcctgcactcctccccactttcactattcttcagcctcattagctttcttgtaacagatggaaaaggccaaacttactcctccctcagggtgtagtaattactcgtccctaggcctggaatgctcttctttgtggattcactctcattattcaagtcttggctcacaggtctcaggtaaagagacacctgttctgacgaccctagttgagaccagggtctgggatcggtggaggaagtggc

SEQ ID NO: 5169 - DNA, 601 bp, Human
gatccttgtggctgtgtggatgaatactgtagattgaatgtctgtctctctctcccacttgccccctttcctcctctttccctctccccctctttccctttcccagtaggtatgtcttgagtgggctggttccaagaattggattgagtgcgataggaaggagaggggataagagattgcatttagcctggagtctaagctttgtgtcctagtatttattgttttgttctgctttgggggttattggactttgcttagctaataataaagaacacactggttcctgttctgctgtattcartgtgaacgtactggggctttatacattttaggagactgtcagggcaaatttcaggccctcctagctctctggatgtcacaccatttaatattatcagaaactcgcctctgaccccaacatatatcagctcagtaatttttcccaaagcaaaatcttaagaccaagagcaaaactggaaggtttttcttccttttggtgcaataactggagcctagaccgatggagaatcttttaatttttattttttttagcacaggctgtggtgattactaagttaagagaaaagccacaacaagtgct

SEQ ID NO: 5170 - DNA, 601 bp, Human
ctgcatttatcttacaagcaaaaaaaccccaaagattaaagatctcaaaaatttctatgttcaaatcaaatatccataccctctcaaactgatttccttaatagctgcagaaaagctaactgtcatctgcagagtgtcctagaactcttcatagttcctgatcccacctacccctagaggctacagttacatttcaggagacaggtgtgagctgtctctgtctccttccctgctgatttgggagcactgctattatctcctcattcttgacctggcctctggaacaaccagcctgtctgcytttctttctcccctttcatctcactgtttgagtttctcattttagaagatcagcaattagtgcccttggtctttagcttactcctaaggtatgcactaatagccccttttcctgaagaaaggtttcttcatgcaataaactcagcttcttgaaggagccagaaccccaaatttctttccaatatccaatgtatccccaacaaaacatctccccacaaatctcaaaatgacagtctcatacaaatacacatataaatctaaacatcagaatggggaaacaaacgatctcatgcaggcttct

SEQ ID NO: 5171 - DNA, 601 bp, Human
tctgaactgcaggagctgctagagcaagctaaaggcagagcttgctgtgtgggaaagggtggtttgggtgctctgtaaatagtatgatcttctgggttgatgaagagcatgctgcgattgatctagttctgcatccttgaactgttgcagtcaggaagagaggctggggagggaccgcacgtgtcagttactgcagtataccctagtggcagaaccggtgcactacaggtgtgacacagggcccgctggtgggtcagagtaagtgacagcacctacccaaggatggcaacatagcaacctyaccgaaaaccctgagcacctaagaccccatcatagatcaccagtgaagcctcctgtgtcaggaagaggtggttagagtcggtttatggaaggcccccctggagatgtgttaactgcccccgcaccaggactgcccttcaacttgctgccacacacccgtcgagggcgcactggcctaacgtagtttagaacaaaggcattgcctactgcaggcatggttataccagggaatgacaataaatttctatagaacctatcctttaccaagtgtttttatttccatttaattcttgcaagaaac

SEQ ID NO: 5172 - DNA, 601 bp, Human
gcaagaagatgaattatctattccttgtacaaaatacatcctgattggactaaacaatcaagtagccatgttttacagttcagtttaagtttaaggagagggcaggggaagtaaattgcagctcatctttcagagacaacagcccaatttgtagaacaatatctaattagctgaaagaggagcttaaatcctgtgtcttgaagagcttagcttcagggcaaattttaatgctgagcaggcaagccaagaagcagaaagcccaccggaggagcttttctgaactgcaggagctgctagagcragctaaaggcagagcttgctgtgtgggaaagggtggtttgggtgctctgtaaatagtatgatcttctgggttgatgaagagcatgctgcgattgatctagttctgcatccttgaactgttgcagtcaggaagagaggctggggagggaccgcacgtgtcagttactgcagtataccctagtggcagaaccggtgcactacaggtgtgacacagggcccgctggtgggtcagagtaagtgacagcacctacccaaggatggcaacatagcaacctcaccgaaaaccctgagcacctaagac

SEQ ID NO: 5173 - DNA, 601 bp, Human
agcaagaagatgaattatctattccttgtacaaaatacatcctgattggactaaacaatcaagtagccatgttttacagttcagtttaagtttaaggagagggcaggggaagtaaattgcagctcatctttcagagacaacagcccaatttgtagaacaatatctaattagctgaaagaggagcttaaatcctgtgtcttgaagagcttagcttcagggcaaattttaatgctgagcaggcaagccaagaagcagaaagcccaccggaggagcttttctgaactgcaggagctgctagagyaagctaaaggcagagcttgctgtgtgggaaagggtggtttgggtgctctgtaaatagtatgatcttctgggttgatgaagagcatgctgcgattgatctagttctgcatccttgaactgttgcagtcaggaagagaggctggggagggaccgcacgtgtcagttactgcagtataccctagtggcagaaccggtgcactacaggtgtgacacagggcccgctggtgggtcagagtaagtgacagcacctacccaaggatggcaacatagcaacctcaccgaaaaccctgagcacctaaga

SEQ ID NO: 5174 - DNA, 601 bp, Human; identical to SEQ ID NO: 2494

SEQ ID NO: 5175 - DNA, 601 bp, Human; identical to SEQ ID NO: 2495

SEQ ID NO: 5176 - DNA, 601 bp, Human; identical to SEQ ID NO: 2496

SEQ ID NO: 5177 - DNA, 601 bp, Human; identical to SEQ ID NO: 2497

SEQ ID NO: 5178 - DNA, 601 bp, Human; identical to SEQ ID NO: 2498

SEQ ID NO: 5179 - DNA, 601 bp, Human; identical to SEQ ID NO: 2499

SEQ ID NO: 5180 - DNA, 601 bp, Human; identical to SEQ ID NO: 2500

SEQ ID NO: 5181 - DNA, 601 bp, Human; identical to SEQ ID NO: 2501

SEQ ID NO: 5182 - DNA, 601 bp, Human; identical to SEQ ID NO: 2502

SEQ ID NO: 5183 - DNA, 601 bp, Human; identical to SEQ ID NO: 2503

SEQ ID NO: 5184 - DNA, 601 bp, Human; identical to SEQ ID NO: 2504

SEQ ID NO: 5185 - DNA, 601 bp, Human; identical to SEQ ID NO: 2505

SEQ ID NO: 5186 - DNA, 601 bp, Human; identical to SEQ ID NO: 2506

SEQ ID NO: 5187 - DNA, 601 bp, Human; identical to SEQ ID NO: 2507

SEQ ID NO: 5188 - DNA, 601 bp, Human; identical to SEQ ID NO: 2508

SEQ ID NO: 5189 - DNA, 601 bp, Human; identical to SEQ ID NO: 2509

SEQ ID NO: 5190 - DNA, 601 bp, Human; identical to SEQ ID NO: 2510

SEQ ID NO: 5191 - DNA, 601 bp, Human; identical to SEQ ID NO: 2511

SEQ ID NO: 5192 - DNA, 601 bp, Human; identical to SEQ ID NO: 1744

SEQ ID NO: 5193 - DNA, 601 bp, Human; identical to SEQ ID NO: 1745

SEQ ID NO: 5194 - DNA, 601 bp, Human; identical to SEQ ID NO: 1746

SEQ ID NO: 5195 - DNA, 601 bp, Human; identical to SEQ ID NO: 1747

SEQ ID NO: 5196 - DNA, 601 bp, Human; identical to SEQ ID NO: 1748

SEQ ID NO: 5197 - DNA, 601 bp, Human; identical to SEQ ID NO: 1749

SEQ ID NO: 5198 - DNA, 601 bp, Human; identical to SEQ ID NO: 1750

SEQ ID NO: 5199 - DNA, 601 bp, Human; identical to SEQ ID NO: 1751

SEQ ID NO: 5200 - DNA, 601 bp, Human; identical to SEQ ID NO: 1752

SEQ ID NO: 5201 - DNA, 601 bp, Human; identical to SEQ ID NO: 1753

SEQ ID NO: 5202 - DNA, 601 bp, Human
ttccgtagatgtgggttgaattaagatactggtatcatgtgggatgtatttagagggtttaccattcattagggcttatccttaattgtactgacctaattctttggaaatatcagtagttctgtttcagtgagtggtcctgggatgggcagtacaagaactaggaaggtaagggagtgatttgcatatctcaggtgactgaggatcaccattgtgcctggattgggaggtggcaggcatggtggggcagggggcagtgggagagacaaagctggagctgtaggctcgatgaagtggaaaycaagttgtaatgttggaagctgttttcttgtaaaccatattttatgttttggagtgattcttactggatggctcatgacaggtggtgctacagtcccgagactacaatgcactctccatgtctgtgatggcattcgtggcaatgatctacccactggaatatatgtttcctgtcatcccgctgctacccacctgcatggcatcagcagagcaggtgagtctcaaggcgacttccggctttctcacctctgtcttcctgagggaggaggcttaatgctcaaagaagttgtaagtgagtgct

SEQ ID NO: 5203 - DNA, 601 bp, Human
aagggcctttagaaatctttttctgtgttgtctgaagtacttagtagtatctctagatgctatgtttgggtttaaatgggtcattgtgtttcatccctctcacctcagttgcttcatcactgctaatataatatgataccttgttactgcagagtctagtgggaattttaagttcagaaagttctctagctgccttcacttgctgtgttttcagtcttgatgattgctttagtatgactaatgagatggagaggttaataaatggaattatatttaattaaattaattaattaattaattwatttattttgagatggagtcccactctgtcacccaggctggagtgcagtggcacaatcttggctcactgcattctctgcctcccaagttcaagcgaatctcttgcctcagcctcctgagtagctgggattccaggcacacaccactgtgcccagctaatttgtttgtatttttagtagagctggggtttcatcatgttggccaggctggtctcaaactcctaacttcaggtgatccacttgccttggcctcccaaagtattgggattacaggcatgagccaccgtgcccagccagaatta

SEQ ID NO: 5204 - DNA, 601 bp, Human
atgtttgtaggagctaagatccttggactcattgatcctgtgttctaactcctgctattcaaagtgtggtttgtgaaccagcaacattagcatcactcgggcttgttaaagtgcaggatcactccaggcatattgaatcgggatctgcattttaacagcctcccctggtgattcttctcctcactcacatttgagaagcactgctgctctcgaccagtggtcttcacgctgccccattgagcctctgaggggccgatttagcttgggagccctgagcatttgaggctctgcttcctgtgtycttcagagcagctctgttttcaaatttccattctatataatttcacatagattccaattttaaaaaacatttaatgactataataattttgcaaacgactgtcgtggacttcagataagatcaagttgccttgagctaggttgtcttaagatggagagctacatatttcaaactgttttctaaaggctagaatattgggatttttatttcaaagatgaaaggtctgaaatgggttggccgtgatttgcaaattagcaccgttctttgttgcagaactttttgaccagagaatacgaggta

SEQ ID NO: 5205 - DNA, 601 bp, Human
gatttgcaaattagcaccgttctttgttgcagaactttttgaccagagaatacgaggtagcagaccttaggaaggccttttccttggagttaagattggctagctgcccagggacgttccttgtgtaaggaattttcttgttgttccacaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaaygatgtggattctgtggatgttgcaaccaggtaagaccaagccgactgtataatcacaagttcttaaattaatttctttgctctctaagggaccttggggcagactatttctctgaaccagggttcctttttttttttttttttttttgagatagattctcactcttgttggagtgcaatggcataatctcagctcactgcaacttccacctcccgggttcaagtgattctcctgcctcagcttcctgagtggctgggattacaggcgcctgccaccacgcctggctaatttttacatttt

SEQ ID NO: 5206 - DNA, 601 bp, Human
tataatcacaagttcttaaattaatttctttgctctctaagggaccttggggcagactatttctctgaaccagggttcctttttttttttttttttttttgagatagattctcactcttgttggagtgcaatggcataatctcagctcactgcaacttccacctcccgggttcaagtgattctcctgcctcagcttcctgagtggctgggattacaggcgcctgccaccacgcctggctaatttttacatttttagtagagacggggtttcaccatgttggccaggctggtctggaactcytgacctcagttgatccacccgccttgtcctcccaaagtgctgggattacagccgtgagccaccgcacccagcccagggtttctttatgtataaaatatatactatatttggttgttattttccaccttagtaaaatcaaagtgaagaaatagtaaaccacgtgctcaggatgaagagggggctgatgattctttaagatatctctccccttgatgttggaagcctgttaagtgatggctttgggaggtgttctaagactttggatcatgggaatccttaccctatgggtctcagattatc

SEQ ID NO: 5207 - DNA, 601 bp, Human
ccttgtgatctgcccgcctcggcctcccaaagtgctgagaatacaggcgtgagccaccgcgcccggccttatttatttatttttgtatgtatgtgacagagtcttgctgctctgtcacgcggtctggagtgcagtggtgccgtctcagctcactgcaagttctccctcccaggttcaagtgattctcctgcctccgcctcccaagtagctgggactacaggtgctgccaccttgcctggctaatttttgtatatatatattttttgagatggagtcttgctctgtcgcccaggctagagcrcagtggcgtgatctgggctcactgcaacctccgcctctcgggttcaagcgattctcttgccccagccacccgagtagctgggattacaggcacatgccatcacgcccagctaattttttgtgtttttagtagagacaaggtttcaccatgttggccaggctggtttcaaactcatgccttcaagcaattcgcctgcctcggcctcccaaagtgctaggattacaggcgcgagccactgcacccggctactttttgtatttttagtagagatggtgtttcaccatgtttgccaggctggtc

SEQ ID NO: 5208 - DNA, 601 bp, Human
cagctcactgcaagttctccctcccaggttcaagtgattctcctgcctccgcctcccaagtagctgggactacaggtgctgccaccttgcctggctaatttttgtatatatatattttttgagatggagtcttgctctgtcgcccaggctagagcgcagtggcgtgatctgggctcactgcaacctccgcctctcgggttcaagcgattctcttgccccagccacccgagtagctgggattacaggcacatgccatcacgcccagctaattttttgtgtttttagtagagacaaggtttcmccatgttggccaggctggtttcaaactcatgccttcaagcaattcgcctgcctcggcctcccaaagtgctaggattacaggcgcgagccactgcacccggctactttttgtatttttagtagagatggtgtttcaccatgtttgccaggctggtctcaaactccagacctcaggtgatccacccgccttagcgtcccaaagtgcttggattacaggcatgggccactgtcccggcccccatatcagtctttatgctttggttgactgtttttcttggcttctttatttgatttgttccct

SEQ ID NO: 5209 - DNA, 601 bp, Human
tatatagtttgtggggacagagaacgggtgctacagagatcatttcccacacattccttaggctagaaatctgacaggcctggtccagccctgccaaactgggattacaggaaggtaccattgggcaccaggtaaccacttttaatttcatgcggcctttaggaacctgctgactctacggagatggatgataaggcagcagtaggcgtctccaagcccctcccttccgtgcctcccagcattggcaaatcgaacgtggacagacgtcaggcagaaattggagaggggtcagtgcgccggygaatctatgacaatccatacttcgagccccaatatggctttccccctgaggaagatgaggatgagcagggggaaagttacactccccgattcagccaacatgtcagtggcaatcggtgagagcctgggcatcccttctagatgggtgactgaaggacctcacctcagtggaccctgggcaagggttaatcagaaagtctgagaagtctgaatgctctcgtggtcctgccatccccagaggatggtgttctgatccaggggcttaggaattacgggaagggagtggcaactgtagtatagc

SEQ ID NO: 5210 - DNA, 601 bp, Human
taaaagttctcaggcagaggtggggtggttcctctacagaactttagggatgctcaagagtgggagagaagctctcaatggggtagatgtaatcaatttcttgccagcacttctcattctggcttgatctccatgcaactgaaagcttacagtgttgaggggggttaatcagcagcggtgggtatttggacaaatcgcgtgctccagagaggtggggatgtggtgcacttggacattcagagacatggctttgtgttttacccctggaggcagacatctagtctgggtgaaaggtgggggktgctctgcaaaggagctgatgaccacagaagcggtgtgtggaccctgtagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggtcagtgttgggggtagggaatcggagtaactggagagagggatgtgaacaccacaggcaatt

SEQ ID NO: 5211 - DNA, 601 bp, Human
actcctggcccctccttttatttacgtctgcatttcttcacatagtggagagaattcctggaagtgctcaggaagtttatagatgcatctttgggctataaaattatgacatttgtgtctctgaagccagtgtcctcccatccaaccattatactcctctggaatgtgctcctctggggcatgcctggcaaccccatttccctgggttctggatctttgaggtataggtttccaagtcagttctttaaatgcttcttcactggacttgattataatctcgtttacatttggtgtttctccrttcccacaaaggcagtgccttagtgagctttctaggcatcacctctgtttggctcactccctgcttgaccttgagtcatcgaggttggatctttctttttctggttctaggtccctaggcactctgcttccagctgacatctcattgccatggccattagcagttgccatatgctcccataaatggtgacatggaaccagattcctttttaggggagctacacttccctagccagcagaatattattctagtagcagtcaactcctggctttctcctgcctcatgtgatgttgtagaaaa

SEQ ID NO: 5212 - DNA, 601 bp, Human
tcatcgggcccaaccttttctacctcctttagacacatttgtttgggaagcattaagggacctggggaccattaaatggtttcaggtaccagtgaagctcagactcttgagtgccatggaatgtggtttagacatttgttcgtggagcttttctttttttttttttttgagatggagtcttgctctgctgctcaggctggagtgcagtggtacgatcttgcctcactgcaacctctgcctccagggctcaagcaattgtcgtgcctcaacctcccgagtagctgagattacaggtgtgcaycaccacgcccggctaatttttgtattttttggtagagacagggtttcatcatgttggccaggctggtctcaaactcctgacttcaggtgatctacctgcctcagcctcccaaagtgctgggattacagtcgtgagccaccatgcccagccttgtggagcttctctgttttaagatgatttgctcagaattttctcaggttgagaagatggctggagaacccattgagaccaggtctgatttgtcctacttggttcttaaggcatctggggtcctctttttccagtgggtcctgagtgggg

SEQ ID NO: 5213 - DNA, 601 bp, Human
tcccgagtagctgagattacaggtgtgcatcaccacgcccggctaatttttgtattttttggtagagacagggtttcatcatgttggccaggctggtctcaaactcctgacttcaggtgatctacctgcctcagcctcccaaagtgctgggattacagtcgtgagccaccatgcccagccttgtggagcttctctgttttaagatgatttgctcagaattttctcaggttgagaagatggctggagaacccattgagaccaggtctgatttgtcctacttggttcttaaggcatctggggwcctctttttccagtgggtcctgagtggggggtagtccttggaaaggtgactaggatgggctgaacgggtctgggaacagcctgtgctgccgtcccaccccctttaccagcctgcccctagcctttgtgcacggagtaacagaagtcttcccctactcagggcctgaagtaatcaaacctgtctttgaccttggtgagacagaggagaaaaagtcccagatcagcgcagacagtggtgtgagcctgacgtctagttcccaggtttgtgacaaccttgttgaaatttgcaagtattaaatat

SEQ ID NO: 5214 - DNA, 601 bp, Human
ggtgggcggaggttgtggtgagccgagattgtgctgttgcactccagcctgggcaacaaaggtgaaactccatctcaaaaaaaaataaaaataaaaataaaaataaaatagccaggtgcggtggttcatgcctgtaatcacaggactttgggaggccgaggcaggtgggtcacttgaggtcaggagttggagttggagaccagcctggccaacgtagtgaaaccccgtctctactaaaaatacaaaagttagctgggtgtggtggcgggcacctgtaatcccagctacttaggaggctgasgcaggagaatcactggaacccgggaggcagaggttgcagcgagctgagattgcgccactgcactccagcctgtgccgcagagtgagactccgtctcaaaaaaaaaaaaaaaaaaaaaaaatgaacaacctcaaaacaatataaataactaatgataagggaattattaaataagtataatagatccatgtaatgcaatattagtatccattaaagattgtgttttcaaaaatttagtgacatgggaaactgtttaacaaagctacctatagtgtgactccaattttatttttaaaatgta

SEQ ID NO: 5215 - DNA, 601 bp, Human
tagctgggactgtaggcatgcaccaccgtgcccagctgatttttgtattctttgtagagacaaggtgttgccatgttgcccaggctggtctagaactcctgggctcaagcagtccacccgccttggccacccaaagtgctaggattaacaggtgtgaagcacaacacccagcctaattttagggacagtttgacttccttctgtccaagttggatgccctttatttctttctctggccaattgctttgattagcatttccagttgaataaaagtggtggaagtagacatccttgtcttgcyacagattgtagaggaaaaactttcatctttccccattcagtatgatgttggttgtgggtttgtcatatatgacttttattgttttgaggtatgttcgctctgtacctaacttgttgagagcttttatcatgaaggaatgttgacttttatcaaatacttttgtatttggtattcgttcttctttaaatgtttttagaattctgcattgaagctattgggtcctgaggctttcttttcttttttctttcttttttttttttttttttaagacggagtcttgctctgttgcccaggctggag

SEQ ID NO: 5216 - DNA, 601 bp, Human
ttctgcattgaagctattgggtcctgaggctttcttttcttttttctttcttttttttttttttttttaagacggagtcttgctctgttgcccaggctggagtgcagttgtgcgatctcggctcactgctacccccgcctcccgggttcaagcagttctcctgcctcagtctcccaagtagctgggattacaggcgcccacgaccacgcctggctaatttttgtattttcagtagagacagggtttcaccatgttggccagggtggtctcgaactcctgacctcaagtgatctaccccccscccgccccaaagtgctgggattacaggcgtgagccactgcgcccagctttttttctttgagacagagtctcgctctgttgctcaggctggagtgcaatggtgtgatgttggctcactgcaacctctgcctcccaggttcaagcaattctcatacctcagcctcttgagtagctgggattacaggtattcaccaccatgcctggctaatttttgtatttttagtagagacagagtttcaccacgttggccaggctagtcttgaactccaggcctcaagtgatctgcccgcctcagcctccc

SEQ ID NO: 5217 - DNA, 601 bp, Human
tgcattgaagctattgggtcctgaggctttcttttcttttttctttcttttttttttttttttttaagacggagtcttgctctgttgcccaggctggagtgcagttgtgcgatctcggctcactgctacccccgcctcccgggttcaagcagttctcctgcctcagtctcccaagtagctgggattacaggcgcccacgaccacgcctggctaatttttgtattttcagtagagacagggtttcaccatgttggccagggtggtctcgaactcctgacctcaagtgatctaccccccgcctgccccaaagtgctgggattacaggcgtgagccactgcgcccagctttttttctttgagacagagtctcgctctgttgctcaggctggagtgcaatggtgtgatgttggctcactgcaacctctgcctcccaggttcaagcaattctcatacctcagcctcttgagtagctgggattacaggtattcaccaccatgcctggctaatttttgtatttttagtagagacagagtttcaccacgttggccaggctagtcttgaactccaggcctcaagtgatctgcccgcctcagcctcccaaa

SEQ ID NO: 5218 - DNA, 601 bp, Human
gattacaggcgtgagccactgcgcccagctttttttctttgagacagagtctcgctctgttgctcaggctggagtgcaatggtgtgatgttggctcactgcaacctctgcctcccaggttcaagcaattctcatacctcagcctcttgagtagctgggattacaggtattcaccaccatgcctggctaatttttgtatttttagtagagacagagtttcaccacgttggccaggctagtcttgaactccaggcctcaagtgatctgcccgcctcagcctcccaaagtgctgggattatagrcgtgaaccaccgtgccctgtgatgggaagctttttattacagattcaatctcattacttgaaattggactattcaggtttctgtttcttggttaaatcttggtaggttgtctatgtctaaatttatccgtttctaatttgttggcatatagttatagtctccagtgattttttgtttttctgtgatgtcaattgtaatgtttacttttttgtttttggtgttttcttggtggaggtcttttcactctctctctttttttttttttggttagtctagctctaatggtttgtggattttgtt

SEQ ID NO: 5219 - DNA, 601 bp, Human
tttacttttttgtttttggtgttttcttggtggaggtcttttcactctctctctttttttttttttggttagtctagctctaatggtttgtggattttgtttatctttacaaagatgaacttttcattttgttgattattaatttatttattttgagatggagttttgctcttgttgcccaggctggagtgcagtggtgcaatcttggctcactgcagtctccacctcccaggttcaagtgattcttctgcctcagcttcccaagtagctgagattacaggtgcccaccaccacaaccggmtaaatttttttttgtatttttagtagagatggggttttgccatgttggccaggctggtctcaaactcctggcctaaggtgatccacccatctcagcctcccaaaatgctgggattataggcatgagccaccacgcccggcctatttttttaagtctcaagttttatttctgctctgatcttgattatttcttctaattttgggtttggtttgttcttgctttcacaattctttgagctgcatcattaagttgatttgaaatcttcctacttttttgatgtgacgtttattgctataagct

SEQ ID NO: 5220 - DNA, 601 bp, Human
gtaatgtaccttggagaggccttttttttttttttttttgagacagtctcactctgtcacccaggctggagtgtagtagtgtgatctcagctcactgcaacctgcgccgcttgggttcaagcttttctcctgcctcagcttcctgagtagctgggattacaggcatgcaccaccacgctcggctaatttttttgtatttttagtagagataggatttcaccgtgttggtcaggctggtctcgaactcctgacttcaaatgatctgcccgccttggcctcccaaagtgctgggattacaggygtgagccaccgcatctggctggagaggacttttttgggttgaatctgtttggggacttttgagcttcctggatctggctgtccatctctctccccagacttgggaagttttcagctattatttcattaaataagttttttatgcctttccccttctctctttggaaatccaataatatgaatatttgtttacttaatgagatcccctaagtgttgtagaccttcttgactgttttccattctaacttttttccctctgactaatttcgaatgacttatcttcaaatatagagtcattctt

SEQ ID NO: 5221 - DNA, 601 bp, Human
gatctgaggcacccgctagcagctcaggcccaggggactggctcataactgtgattctaatactgggggataggccatagcactggccttactctgtggaagaaggggtgctctggaggtttgggcctagggagcagggtacagctgcaattcagggatctgagccaatagggctcagtggcagctcaggtcccacggaatgaggcaccatgtagtagtgactctagactccaggatggtggggcttggctgtatcctagactctgtgaagccaagtgcaatggcagcgaataccccagcrtggcagagcacagctgtcatttgggccctgggggtcagggagcagcacagcaatgactccactccccaggaagagggtatcttagcagctcagactctaggggcaagtccagttccagggaagcagggtactggagttgtttggctagggcaaggtatctcagctcagccactgctctgtttcctgggacatggggtactgtgtcagctcagccctggaatgcgtagctgctcagcttggccagccaccaattcccctggggacaatgtgctgctttagcacaggcctagtgtgggcatg

SEQ ID NO: 5222 - DNA, 601 bp, Human
tcaggcccaggggactggctcataactgtgattctaatactgggggataggccatagcactggccttactctgtggaagaaggggtgctctggaggtttgggcctagggagcagggtacagctgcaattcagggatctgagccaatagggctcagtggcagctcaggtcccacggaatgaggcaccatgtagtagtgactctagactccaggatggtggggcttggctgtatcctagactctgtgaagccaagtgcaatggcagcgaataccccagcgtggcagagcacagctgtcatttkggccctgggggtcagggagcagcacagcaatgactccactccccaggaagagggtatcttagcagctcagactctaggggcaagtccagttccagggaagcagggtactggagttgtttggctagggcaaggtatctcagctcagccactgctctgtttcctgggacatggggtactgtgtcagctcagccctggaatgcgtagctgctcagcttggccagccaccaattcccctggggacaatgtgctgctttagcacaggcctagtgtgggcatgactgttctgggtgacccaggcac

SEQ ID NO: 5223 - DNA, 601 bp, Human
agcgaaaccttgtctctaaaaaaaaagaagcttctgcttcccaagttctggtgtagtgttaaagaagaatacgtctatttatctgaaaaggctatgaaaatcctcttccattttccaaatacgtatctctgaggtcaagtttttttcatatacctcaaccaaagcaacatactgcaacagactcaatgcagaggcagataggagaatgcaactatttgattctaagccaaacattaaagagatttgcaaaaatgtgaaacagtgccttttttttgaaaatatagttattttattaaaaatstttatattactatgtaatgggttatattaatcaattattaattgtttttataattaatcatttgagaaatttctgtttaaatttctagtatgtaaatatctataaatataactcacataaacaaaagctctttggaatcttcaataaattttaagagatatagggcctctgagaccaaaacatctgaaaccacttccctggtgaccagtggccagcagatgagactgtgctgaggaagccgatatgaatttgattgctggatggggaattcttggcccagagccctctgagagggatgta

SEQ ID NO: 5224 - DNA, 601 bp, Human
gaatgatataaagaaaaatctgcaataaatgaaggactctaggttcatgcttcacgctctctgtgtggaactcacggttttccagagactgaggcgtctgtgggcaggaggaccaagaggagaagaaccagacttggatgaaggagtttgttcttccccatgttgcagaaagaaggagctggaggagaacagactgtattgtaccctactccctacaatccatctggtcccaaacacttcccaaagcaactgggctttatgctgctctgtgtgcaaacaggaagttccacccacacaagayctctaaacaaagttgaggtctctgaacattctctggaaaggtcattgatggcctatttatagtcaaggttaattcctggcgggctaaatagaatccctggagggctaaaactacattcccattcccgtaagagctcacttttaccgtacagcagctaataagcttttcaacctcttctctccctcactcccccacaactcctcacaacgccttttatggtgcttctcacatctcttgtatgaatagctggcaaggaaaactacaatttaagcaacactgggcaggctcaaaatagatatt

SEQ ID NO: 5225 - DNA, 601 bp, Human
gagagttggggaagaatgattaaaagtaagcaagtaatgagtaaactagatttgtaaaatctggaaggaatcttagagataagaagatgacagtatcataggaaagaaaaaggaatgatataaagaaaaatctgcaataaatgaaggactctaggttcatgcttcacgctctctgtgtggaactcacggttttccagagactgaggcgtctgtgggcaggaggaccaagaggagaagaaccagacttggatgaaggagtttgttcttccccatgttgcagaaagaaggagctggaggagamcagactgtattgtaccctactccctacaatccatctggtcccaaacacttcccaaagcaactgggctttatgctgctctgtgtgcaaacaggaagttccacccacacaagatctctaaacaaagttgaggtctctgaacattctctggaaaggtcattgatggcctatttatagtcaaggttaattcctggcgggctaaatagaatccctggagggctaaaactacattcccattcccgtaagagctcacttttaccgtacagcagctaataagcttttcaacctcttctctccctcact

SEQ ID NO: 5226 - DNA, 601 bp, Human; identical to SEQ ID NO: 859

SEQ ID NO: 5227 - DNA, 601 bp, Human; identical to SEQ ID NO: 860

SEQ ID NO: 5228 - DNA, 601 bp, Human; identical to SEQ ID NO: 861

SEQ ID NO: 5229 - DNA, 601 bp, Human; identical to SEQ ID NO: 862

SEQ ID NO: 5230 - DNA, 601 bp, Human; identical to SEQ ID NO: 863

SEQ ID NO: 5231 - DNA, 601 bp, Human; identical to SEQ ID NO: 864

SEQ ID NO: 5232 - DNA, 601 bp, Human; identical to SEQ ID NO: 865

SEQ ID NO: 5233 - DNA, 601 bp, Human; identical to SEQ ID NO: 866

SEQ ID NO: 5234 - DNA, 601 bp, Human; identical to SEQ ID NO: 867

SEQ ID NO: 5235 - DNA, 601 bp, Human; identical to SEQ ID NO: 868

SEQ ID NO: 5236 - DNA, 601 bp, Human; identical to SEQ ID NO: 869

SEQ ID NO: 5237 - DNA, 601 bp, Human; identical to SEQ ID NO: 870

SEQ ID NO: 5238 - DNA, 601 bp, Human; identical to SEQ ID NO: 871

SEQ ID NO: 5239 - DNA, 601 bp, Human; identical to SEQ ID NO: 872

SEQ ID NO: 5240 - DNA, 601 bp, Human; identical to SEQ ID NO: 873

SEQ ID NO: 5241 - DNA, 601 bp, Human; identical to SEQ ID NO: 874

SEQ ID NO: 5242 - DNA, 601 bp, Human; identical to SEQ ID NO: 875

SEQ ID NO: 5243 - DNA, 601 bp, Human; identical to SEQ ID NO: 876

SEQ ID NO: 5244 - DNA, 601 bp, Human; identical to SEQ ID NO: 877

SEQ ID NO: 5245 - DNA, 601 bp, Human; identical to SEQ ID NO: 878

SEQ ID NO: 5246 - DNA, 601 bp, Human; identical to SEQ ID NO: 879

SEQ ID NO: 5247 - DNA, 601 bp, Human; identical to SEQ ID NO: 880

SEQ ID NO: 5248 - DNA, 601 bp, Human; identical to SEQ ID NO: 881

SEQ ID NO: 5249 - DNA, 601 bp, Human; identical to SEQ ID NO: 882

SEQ ID NO: 5250 - DNA, 601 bp, Human; identical to SEQ ID NO: 883

SEQ ID NO: 5251 - DNA, 601 bp, Human; identical to SEQ ID NO: 884

SEQ ID NO: 5252 - DNA, 601 bp, Human; identical to SEQ ID NO: 885

SEQ ID NO: 5253 - DNA, 601 bp, Human; identical to SEQ ID NO: 886

SEQ ID NO: 5254 - DNA, 601 bp, Human; identical to SEQ ID NO: 887

SEQ ID NO: 5255 - DNA, 601 bp, Human; identical to SEQ ID NO: 888

SEQ ID NO: 5256 - DNA, 601 bp, Human; identical to SEQ ID NO: 889

SEQ ID NO: 5257 - DNA, 601 bp, Human; identical to SEQ ID NO: 890

SEQ ID NO: 5258 - DNA, 601 bp, Human; identical to SEQ ID NO: 891

SEQ ID NO: 5259 - DNA, 601 bp, Human; identical to SEQ ID NO: 892

SEQ ID NO: 5260 - DNA, 601 bp, Human; identical to SEQ ID NO: 893

SEQ ID NO: 5261 - DNA, 601 bp, Human; identical to SEQ ID NO: 894

SEQ ID NO: 5262 - DNA, 601 bp, Human; identical to SEQ ID NO: 895

SEQ ID NO: 5263 - DNA, 601 bp, Human; identical to SEQ ID NO: 896

SEQ ID NO: 5264 - DNA, 601 bp, Human; identical to SEQ ID NO: 897

SEQ ID NO: 5265 - DNA, 601 bp, Human; identical to SEQ ID NO: 898

SEQ ID NO: 5266 - DNA, 601 bp, Human; identical to SEQ ID NO: 899

SEQ ID NO: 5267 - DNA, 601 bp, Human; identical to SEQ ID NO: 900

SEQ ID NO: 5268 - DNA, 601 bp, Human; identical to SEQ ID NO: 901

SEQ ID NO: 5269 - DNA, 601 bp, Human; identical to SEQ ID NO: 902

SEQ ID NO: 5270 - DNA, 601 bp, Human; identical to SEQ ID NO: 903

SEQ ID NO: 5271 - DNA, 601 bp, Human; identical to SEQ ID NO: 904

SEQ ID NO: 5272 - DNA, 601 bp, Human; identical to SEQ ID NO: 905

SEQ ID NO: 5273 - DNA, 601 bp, Human; identical to SEQ ID NO: 906

SEQ ID NO: 5274 - DNA, 601 bp, Human; identical to SEQ ID NO: 907

SEQ ID NO: 5275 - DNA, 601 bp, Human; identical to SEQ ID NO: 908

SEQ ID NO: 5276 - DNA, 601 bp, Human; identical to SEQ ID NO: 909

SEQ ID NO: 5277 - DNA, 601 bp, Human; identical to SEQ ID NO: 910

SEQ ID NO: 5278 - DNA, 601 bp, Human; identical to SEQ ID NO: 911

SEQ ID NO: 5279 - DNA, 601 bp, Human; identical to SEQ ID NO: 912

SEQ ID NO: 5280 - DNA, 601 bp, Human; identical to SEQ ID NO: 913

SEQ ID NO: 5281 - DNA, 601 bp, Human; identical to SEQ ID NO: 914

SEQ ID NO: 5282 - DNA, 601 bp, Human; identical to SEQ ID NO: 915

SEQ ID NO: 5283 - DNA, 601 bp, Human; identical to SEQ ID NO: 916

SEQ ID NO: 5284 - DNA, 601 bp, Human; identical to SEQ ID NO: 917

SEQ ID NO: 5285 - DNA, 601 bp, Human; identical to SEQ ID NO: 918

SEQ ID NO: 5286 - DNA, 601 bp, Human; identical to SEQ ID NO: 919

SEQ ID NO: 5287 - DNA, 601 bp, Human; identical to SEQ ID NO: 920

SEQ ID NO: 5288 - DNA, 601 bp, Human; identical to SEQ ID NO: 921

SEQ ID NO: 5289 - DNA, 601 bp, Human; identical to SEQ ID NO: 922

SEQ ID NO: 5290 - DNA, 601 bp, Human; identical to SEQ ID NO: 923

SEQ ID NO: 5291 - DNA, 601 bp, Human; identical to SEQ ID NO: 924

SEQ ID NO: 5292 - DNA, 601 bp, Human; identical to SEQ ID NO: 925

SEQ ID NO: 5293 - DNA, 601 bp, Human
ggagggaggggacccagacgtgcctctgccctgcctgtggtctgccgctggtatcctctgcccagggacccctggcgggaccttcccttttaaccccaaggagtccggaagcttctccaccctcccctacccccacccccgggctccctccctttccctctgtctaattgtaccgtgggtgaggctggcactcctgggtcccagattcctgctctgggaggggccctggaatacaggcttctcccagtgcccgaaacgcccccttttcatcccttttggaactggcttccgtggggattcyccgggtcccggtgccaagaaggcttcccaggcgcggggagagggttcacgtccccagcaaggctaggggtggcaggatgagaggccactgagcaagaggaaatcaatgggaagtgcatacctagagtgacaatgtgagaagccagactgtggaagaggaaggaggaaggcctagagataaagcaggttgagtaggagggacagaggctggcttgaaaagggagattgtaacaaaccaaggctaaaagagccagagagagagagagagagagagagagagagagagagagggagggaggga

SEQ ID NO: 5294 - DNA, 601 bp, Human; identical to SEQ ID NO: 2332

SEQ ID NO: 5295 - DNA, 601 bp, Human; identical to SEQ ID NO: 2333

SEQ ID NO: 5296 - DNA, 601 bp, Human; identical to SEQ ID NO: 2334

SEQ ID NO: 5297 - DNA, 601 bp, Human; identical to SEQ ID NO: 1222

SEQ ID NO: 5298 - DNA, 601 bp, Human; identical to SEQ ID NO: 1223

SEQ ID NO: 5299 - DNA, 601 bp, Human; identical to SEQ ID NO: 1224

SEQ ID NO: 5300 - DNA, 601 bp, Human; identical to SEQ ID NO: 2663

SEQ ID NO: 5301 - DNA, 601 bp, Human; identical to SEQ ID NO: 2664

SEQ ID NO: 5302 - DNA, 601 bp, Human; identical to SEQ ID NO: 2665

SEQ ID NO: 5303 - DNA, 601 bp, Human; identical to SEQ ID NO: 2666

SEQ ID NO: 5304 - DNA, 601 bp, Human; identical to SEQ ID NO: 2667

SEQ ID NO: 5305 - DNA, 601 bp, Human; identical to SEQ ID NO: 2668

SEQ ID NO: 5306 - DNA, 601 bp, Human; identical to SEQ ID NO: 2669

SEQ ID NO: 5307 - DNA, 601 bp, Human; identical to SEQ ID NO: 2670

SEQ ID NO: 5308 - DNA, 601 bp, Human; identical to SEQ ID NO: 2671

SEQ ID NO: 5309 - DNA, 601 bp, Human; identical to SEQ ID NO: 2672

SEQ ID NO: 5310 - DNA, 601 bp, Human; identical to SEQ ID NO: 2673

SEQ ID NO: 5311 - DNA, 601 bp, Human; identical to SEQ ID NO: 2674

SEQ ID NO: 5312 - DNA, 601 bp, Human; identical to SEQ ID NO: 2675

SEQ ID NO: 5313 - DNA, 601 bp, Human; identical to SEQ ID NO: 2676

SEQ ID NO: 5314 - DNA, 601 bp, Human; identical to SEQ ID NO: 2677

SEQ ID NO: 5315 - DNA, 601 bp, Human; identical to SEQ ID NO: 2678

SEQ ID NO: 5316 - DNA, 601 bp, Human; identical to SEQ ID NO: 2679

SEQ ID NO: 5317 - DNA, 601 bp, Human; identical to SEQ ID NO: 2680

SEQ ID NO: 5318 - DNA, 601 bp, Human; identical to SEQ ID NO: 2681

SEQ ID NO: 5319 - DNA, 601 bp, Human; identical to SEQ ID NO: 2682

SEQ ID NO: 5320 - DNA, 601 bp, Human; identical to SEQ ID NO: 2683

SEQ ID NO: 5321 - DNA, 601 bp, Human; identical to SEQ ID NO: 2684

SEQ ID NO: 5322 - DNA, 601 bp, Human; identical to SEQ ID NO: 2685

SEQ ID NO: 5323 - DNA, 601 bp, Human; identical to SEQ ID NO: 2686

SEQ ID NO: 5324 - DNA, 601 bp, Human; identical to SEQ ID NO: 2687

SEQ ID NO: 5325 - DNA, 601 bp, Human; identical to SEQ ID NO: 2688

SEQ ID NO: 5326 - DNA, 601 bp, Human; identical to SEQ ID NO: 2689

SEQ ID NO: 5327 - DNA, 601 bp, Human; identical to SEQ ID NO: 2690

SEQ ID NO: 5328 - DNA, 601 bp, Human; identical to SEQ ID NO: 2691

SEQ ID NO: 5329 - DNA, 601 bp, Human; identical to SEQ ID NO: 2692

SEQ ID NO: 5330 - DNA, 601 bp, Human; identical to SEQ ID NO: 2693

SEQ ID NO: 5331 - DNA, 601 bp, Human; identical to SEQ ID NO: 2694

SEQ ID NO: 5332 - DNA, 601 bp, Human
ctctgcatttaccactttcaaaaaatgtgcagcgcggccaggtgcagtggcttatgcctgtaatcccaccactttgggaggccaaggtgagaggatgacttgaggccaggagtttgagaccagcctgggcaacatagcaagatcagatctctacaaattacaaaacaaaggtgcaatgcgattcagcagcgtggagtaattgttgatattttttgtttatttccttacctttttatacttcccttcattaaaaaaaatggggtatagttataggaaaggaagaaaatgggtggaaagtgawccttgtctaggtaagtatttgacaagtgatcaaagaggagccaaaagcagagaaaaataggagaatcagttcctaaacaggcgtggaggaaggagacagtgactcacaacaattcagggaattcctcacttcacacagcatcacaaaagaaatggcacctacgttccactggtgtatgctacaaaccaaatcattctttaaaagtccacaaaaaattaggtaggatcatcttattttatcctgaaggaaagaacttaaaaaaaaacaaatgtgtgtccagatttcacacctactcaatgt

SEQ ID NO: 5333 - DNA, 488 bp, Human
aaaataaaaaatgaaaaaaagtttccttggcagtgtattatatgtaaagtaatccctgtaatgtaaacaaaatgtacatacgcttgtatgaatatacatggcatatgcataaagatttctacaaagaatcacaagaaattatctgttgtattcacctgaatgaagaagggctgggggctggaggaagtgttaggggactaccactatgactcagcacctttgttttttttttgtttttgtttttgttttgagatggagtctgactctgtagcccaggctggagtgcagtggcgtgatctcrgctcactgcaggctccgcctcacgggttcacgccattctcctgcctcagcctcccgagtagctgggactacaggcacccgctaccacgcccggctaattttttgtatttttagtagcaggtggggtttcaccatgttggccaggatggtctccatctcttgaccttgagatccaccctcctcggcct

SEQ ID NO: 5334 - DNA, 601 bp, Human
gatgaagacaatgtggcatatatacaccataggttaccacacagccataaaaaagaatgaaatcatattgtttgcagccacatggatgaagctggaggccatcatcctaagtgaattaatgtaggaacgcaaaaccaaatactgcgtgttctcatttataagtagtagctaaacatcaggtacttacgaccataaagatggcaacaatagacactggggactaccagggcggggagggagcgagaggaggaaggggtgaaaaactaactgttggatactgtgcccacaacctggataaaaycattcatacctcaaatttcagcatcaaacaaacttacatatgtaccccctgaatcaaaataaatttgaaaaaggaaaaataaaaaatgaaaaaaagtttccttggcagtgtattatatgtaaagtaatccctgtaatgtaaacaaaatgtacatacgcttgtatgaatatacatggcatatgcataaagatttctacaaagaatcacaagaaattatctgttgtattcacctgaatgaagaagggctgggggctggaggaagtgttaggggactaccactatgactcagcacctttgttt

SEQ ID NO: 5335 - DNA, 601 bp, Human
atagaaaagaaaacaaatctgctgggcgcggtggctcacacctgtaatcccagcactttgggaggccgaggtggatggatcacgaggtcaggaattcaagaccagcctgcccaagacggtgaaaccccgtctctactaaaaatacaaaaaattagccgggtatggtggcacatgcctgtaatcccagctactctggaggctgaggcagagaactgcttaaacctggaggggcggaggttgcagtgagccgagattgtgccactgcactccagcctgggtgacagagcgagactccctctcaaaaaaaaaaagggaaaacaaatcattctaccaaaagacaccactatccataatagcagtgacatggaatcaacctaggttcccatcaacagtggattggatgaagacaatgtggcatatatacaccataggttaccacacagccataaaaaagaatgaaatcatattgtttgcagccacatggatgaagctggaggccatcatcctaagtgaattaatgtaggaacgcaaaaccaaatactgcgtgttctcatttataagtagtagctaaacatcaggtacttacgaccataaagatggc

SEQ ID NO: 5336 - DNA, 601 bp, Human
cagaattacaaggttatccaactcataatggatacaaaatactaaacagccataagaaacaggaataatttatttgaagaggaacacaaatcacaactcagttaccataaaatacttgacaccaaatgttatctcctttgataaggaaatactgaatattaataaaatattcagtgtttctagattaatttttaattttaaagcgaattgataaaacggcaactgaggtttttcgggagggaaggatggaggaaatcttttaattctaaattttatctgggtaaaataatacattttgaaraagtatggaagaggtgtttgctcttttggatgttaaaaaacattagaaagttcccattggaacatgcctcaaaatggtaagagccatctatgacaaacccacagccaacatcatactgaatgggccaaagctggaagcattccccttgagaactggaacaaggcaaggatgctcacgctcaccactcccattcaacatagtactggaagtcctagtcagagcactcaggcaagagaaagaaagaaaaggcatccagatatgaaatgaagaagtgaaaactcttcatggacgatatgattc

SEQ ID NO: 5337 - DNA, 601 bp, Human
aatattgttctgaaaggtctggcctaggcaacaagatggaaaattaaaatgaggcaagacttttggaagagggcagacacaataatcattattttcaacgtcatttaaaacccctaagatgaaactacaatattgaaatagaaatgtatgtctggaggaatgttaaaaacatagcaaatgcaataaattagcaaacagaattacaaggttatccaactcataatggatacaaaatactaaacagccataagaaacaggaataatttatttgaagaggaacacaaatcacaactcagttacmataaaatacttgacaccaaatgttatctcctttgataaggaaatactgaatattaataaaatattcagtgtttctagattaatttttaattttaaagcgaattgataaaacggcaactgaggtttttcgggagggaaggatggaggaaatcttttaattctaaattttatctgggtaaaataatacattttgaagaagtatggaagaggtgtttgctcttttggatgttaaaaaacattagaaagttcccattggaacatgcctcaaaatggtaagagccatctatgacaaacccacagc

SEQ ID NO: 5338 - DNA, 601 bp, Human
tataggcctgtgtaattatcccctgatcaagacatagaaactgccacaccccagaaagtccccttctgccccatctaatcaactcccacccaccctcacaagaaatgatcacttccttccagaattcttaccagcagagtctcggcagactatatatgagagcacccaggaaaacctaacaaaatgatttatcccaagactgtaaatgatctttgatcatcagtactctaccatatcaatagcgtaattaaataaaatggcagtctctatggaggctggaaagacatttggtaaaattaarcagcaattctgatttttttcaaacccttttagaatagtaagctgtgttcttgatgatgagaatttctatatgaaaccaaaagtgaatgccattgctaagagtgacactttggaggccttccccagaaatcaaatcaggacccaaacacctgccttccctaagcacagctgaatattgttctgaaaggtctggcctaggcaacaagatggaaaattaaaatgaggcaagacttttggaagagggcagacacaataatcattattttcaacgtcatttaaaacccctaagatgaaactacaa

SEQ ID NO: 5339 - DNA, 601 bp, Human; identical to SEQ ID NO: 1964

SEQ ID NO: 5340 - DNA, 601 bp, Human; identical to SEQ ID NO: 1963

SEQ ID NO: 5341 - DNA, 601 bp, Human; identical to SEQ ID NO: 1962

SEQ ID NO: 5342 - DNA, 601 bp, Human; identical to SEQ ID NO: 1961

SEQ ID NO: 5343 - DNA, 601 bp, Human; identical to SEQ ID NO: 1960

SEQ ID NO: 5344 - DNA, 601 bp, Human
aaggctggctttgataattttattatatgtgtactttaaaaatccccatctgctcttaggcttttgggtttgcagaaagtatcctactttagatatgttctgagcttcagaataaaataaacccataaacacttgtataagagtattcaaatattctagtgctttttttttttttttttgagacaatgtctcactcccatcaccaggctgcagtgcagtagcacaattacagctcactgcagcttgaacttcccaggctcaggtaattctcccacctcagcctcccgagtagctgggactrgagatggcaccatcatgcctagctaatttttttatttttagtacagatagtgttttgccatgttgcccaggctgagctcaaagggatctgcccacctcagactcccaaagtgttgggattacaggcatgagccaccgcgcccagccctagtgctatgatttgatatacgcttgcaaacattattggctcacccacacctaatgcaaacttccctgacgtctatgtaatgtcacagaaacatgacaggaacatttatgacagacggagttctttaacaatcacatatttcttcttctacta

SEQ ID NO: 5345 - DNA, 601 bp, Human
aatcccaccaagagataactaccatgaacattttggtggatattcttgcaaaattttttatacatgtattatataactttacattgtataaatatacacacttttctattttacaaagatgggatcatgtaagtgagaaatgttttataacctttttcacttaacactacatagtggacatcttcataagttaatatatagagagtaattccttgtagcctttgctcaaattcacctcctcatagagatcttccctaaccaccctgtgtttcttatacccctttactgattttttttttttctacaacacttaacaccttctaaaataggctagcaaacattttctgtaaagggccagataataaatattttagatttcgtgggctttaagttctctcttgcaattagttaactccgttattaaagtgcaaaagcagccatacacaatatgtaaataagtgggcataggtatattcccatgcaactttatttataaaaatggctgcaagctggatttggcttatgggctatagtttgccaacccctgttctaaatacaatataattaaattaattttctttttgtttgttatgggctgaac

SEQ ID NO: 5346 - DNA, 601 bp, Human
taggcagcatgtggttgtatccaatctgataatctctgctttccaattgggtgttcagaccatttacatttaatataatttgtgatatgattaggtttaaagctatcagcttcatatttgttttcttcttgactgttctttgttcctgtttacttttctgcatttatttttcttaattattttttattctcttttccttgttagctaataagctataattctttgttttcttattggttgctttaggtttatagtgtacatctttaacttttcacaatctatcttcaagtaatattatgtyacctcaggcatagtatataatagtatacttccatttctccccccagacctttgtgctattttagcatatattttacttttgcatatattaaaacttcacattggtagctcccacctgaaatcccatcactctgggaggccaaggcaggaggatcacttaagcccagaagtttaagatcaggttgggcaatatagtaagactctcgcctctacaaaaaataaaaagttagacagctgtggtggtgcatgcctgttgtcccagctactcaggaggctgaggtgagaggactgcttgagcctt

SEQ ID NO: 5347 - DNA, 601 bp, Human
tccaatctgataatctctgctttccaattgggtgttcagaccatttacatttaatataatttgtgatatgattaggtttaaagctatcagcttcatatttgttttcttcttgactgttctttgttcctgtttacttttctgcatttatttttcttaattattttttattctcttttccttgttagctaataagctataattctttgttttcttattggttgctttaggtttatagtgtacatctttaacttttcacaatctatcttcaagtaatattatgtcacctcaggcatagtatatwatagtatacttccatttctccccccagacctttgtgctattttagcatatattttacttttgcatatattaaaacttcacattggtagctcccacctgaaatcccatcactctgggaggccaaggcaggaggatcacttaagcccagaagtttaagatcaggttgggcaatatagtaagactctcgcctctacaaaaaataaaaagttagacagctgtggtggtgcatgcctgttgtcccagctactcaggaggctgaggtgagaggactgcttgagccttggaggtcgaggctgcagtg

SEQ ID NO: 5348 - DNA, 601 bp, Human
aaaaaagactgagcagatcaatcaaccttagagcaaagggtgaagctgattgcttaaaagaaaatgaaactttggaggcagaacattccaaatgtaacagggcaacagatttacagtgctgaaaggaatgaatctcctgctctggatatgtatacacacagctttaaaacaatcatctatatactatagccatttttcagccaatgtagctctcttattcacgatcaatcagctaatttcttattaaatcttactaagatacactagatagccgcaaagtttaaaaaaaaaagaagaagaagagactgtagccattttgactatatatatcacaagtgtttctgaagcctttcacattgttgaccatccctggttcttgaatttctcctatatcctggtttctatgtaaccagataatgtagttgaattctttcctttatcctctttcttgtctcctttactgaattctctgctagcttttatctccaggctatgaaggtacccaaagataaagtactgggcatcgacttttctttttaaataccaacttctttgaagacatgacttcaactactaccttcaaacaaaataatttcaagaa

SEQ ID NO: 5349 - DNA, 601 bp, Human
agtcatttacattaggtatatctcctaatgctatccctcccccctccccctaccccatgacaggccctggtgtgtgatgttctccaccctgtgtccaagcgttctcattgttcaattctcacctatgagtgagaacatgcggtgtttggttttctgtccttgcaacagtttgctcagaatgatggtttctagcttcatccatgtccctacaaaggacatgaactcatccttttttacggctgcatagtattccatggtgtatatgtgccacattttcttaatccagtctatcattgatggrcatttgaattggttccaagtctttgctattgtgaatagtgctgcaataaacatacgtgtgcatgtatgtctttatagcagcatgatttataatcctttgggtatatgcccagtaatgggatgaatgcccacacactttttaaaaagtcacaaggacttaccatttttccctatctacaaacaactcatcctcttcaactgcctaagtcaatggagtccatcgtttctctcatctatgcagtacattttagcttttctcagttacaaatcttatcctgtcttctctcccataatatctttc

SEQ ID NO: 5350 - DNA, 601 bp, Human
tacattaggtatatctcctaatgctatccctcccccctccccctaccccatgacaggccctggtgtgtgatgttctccaccctgtgtccaagcgttctcattgttcaattctcacctatgagtgagaacatgcggtgtttggttttctgtccttgcaacagtttgctcagaatgatggtttctagcttcatccatgtccctacaaaggacatgaactcatccttttttacggctgcatagtattccatggtgtatatgtgccacattttcttaatccagtctatcattgatggacatttgrattggttccaagtctttgctattgtgaatagtgctgcaataaacatacgtgtgcatgtatgtctttatagcagcatgatttataatcctttgggtatatgcccagtaatgggatgaatgcccacacactttttaaaaagtcacaaggacttaccatttttccctatctacaaacaactcatcctcttcaactgcctaagtcaatggagtccatcgtttctctcatctatgcagtacattttagcttttctcagttacaaatcttatcctgtcttctctcccataatatctttcccaccca

SEQ ID NO: 5351 - DNA, 601 bp, Human
acattaggtatatctcctaatgctatccctcccccctccccctaccccatgacaggccctggtgtgtgatgttctccaccctgtgtccaagcgttctcattgttcaattctcacctatgagtgagaacatgcggtgtttggttttctgtccttgcaacagtttgctcagaatgatggtttctagcttcatccatgtccctacaaaggacatgaactcatccttttttacggctgcatagtattccatggtgtatatgtgccacattttcttaatccagtctatcattgatggacatttgarttggttccaagtctttgctattgtgaatagtgctgcaataaacatacgtgtgcatgtatgtctttatagcagcatgatttataatcctttgggtatatgcccagtaatgggatgaatgcccacacactttttaaaaagtcacaaggacttaccatttttccctatctacaaacaactcatcctcttcaactgcctaagtcaatggagtccatcgtttctctcatctatgcagtacattttagcttttctcagttacaaatcttatcctgtcttctctcccataatatctttcccacccat

SEQ ID NO: 5352 - DNA, 601 bp, Human
ttccaatccttaaatgctcactccaatccttaaacgatcattccctaattttaatatctacaggattttctgcatcactctgcatttaattaaaactgctttgcatccttgtagtttttttcgtataagtttgtcaatccaattattataaactctttgaaggtcctgattacatctcctgcacctttgtgagttcgtacagcaggtagtaattgcttagtatttgctgtgtaaaataataaagcacaataggaacctcaactctgatcattctgcctttgcaatcaaagaaacggagaarctgtgagaacattccatgcttctctaggagccaagctgcaaatgtattagggccagagaattctgactcccattaaaatgagcagctctgaaaggagggagcggggaatccctccctgccactgtagaggatttatgggttgcccttaagttcccaaaccaaattgtggcactggggtttttatgagaaacgtgtcaacatgacaaaatgattcagagcacaggatttggagtcacacagatctagttttcagcgagactcctgtttccttctctataaaggggacattttaacacctac

SEQ ID NO: 5353 - DNA, 601 bp, Human
aataggaacctcaactctgatcattctgcctttgcaatcaaagaaacggagaagctgtgagaacattccatgcttctctaggagccaagctgcaaatgtattagggccagagaattctgactcccattaaaatgagcagctctgaaaggagggagcggggaatccctccctgccactgtagaggatttatgggttgcccttaagttcccaaaccaaattgtggcactggggtttttatgagaaacgtgtcaacatgacaaaatgattcagagcacaggatttggagtcacacagatctagktttcagcgagactcctgtttccttctctataaaggggacattttaacacctacttcacatgtatttaactttcgccctaacactgaactgaagtgcaaagccttggaaacaaatttaaataaattgaaaatactgcaattcacaaataagagtgagaacaacatttttagttacgtaagactatattatattaaattaggtggcagcagtatttataataatctaaattgcctgtgagaaaattaaactggtattgtcaatacatacttaaaataagaaaaaaatcccactacagtctgt

SEQ ID NO: 5354 - DNA, 601 bp, Human
acctcaactctgatcattctgcctttgcaatcaaagaaacggagaagctgtgagaacattccatgcttctctaggagccaagctgcaaatgtattagggccagagaattctgactcccattaaaatgagcagctctgaaaggagggagcggggaatccctccctgccactgtagaggatttatgggttgcccttaagttcccaaaccaaattgtggcactggggtttttatgagaaacgtgtcaacatgacaaaatgattcagagcacaggatttggagtcacacagatctagttttcagmgagactcctgtttccttctctataaaggggacattttaacacctacttcacatgtatttaactttcgccctaacactgaactgaagtgcaaagccttggaaacaaatttaaataaattgaaaatactgcaattcacaaataagagtgagaacaacatttttagttacgtaagactatattatattaaattaggtggcagcagtatttataataatctaaattgcctgtgagaaaattaaactggtattgtcaatacatacttaaaataagaaaaaaatcccactacagtctgtccttttt

SEQ ID NO: 5355 - DNA, 601 bp, Human
gggagcggggaatccctccctgccactgtagaggatttatgggttgcccttaagttcccaaaccaaattgtggcactggggtttttatgagaaacgtgtcaacatgacaaaatgattcagagcacaggatttggagtcacacagatctagttttcagcgagactcctgtttccttctctataaaggggacattttaacacctacttcacatgtatttaactttcgccctaacactgaactgaagtgcaaagccttggaaacaaatttaaataaattgaaaatactgcaattcacaaataaragtgagaacaacatttttagttacgtaagactatattatattaaattaggtggcagcagtatttataataatctaaattgcctgtgagaaaattaaactggtattgtcaatacatacttaaaataagaaaaaaatcccactacagtctgtcctttttgacactttctccttcctgtaatttttttctttcactcaagattaaaaacaaacgttcaagattatccctaaagagaaatagttggaaagcacaatttaatagcaagttggttctataaatgtaatatttcagttcatagttca

SEQ ID NO: 5356 - DNA, 601 bp, Human; identical to SEQ ID NO: 3807

SEQ ID NO: 5357 - DNA, 601 bp, Human; identical to SEQ ID NO: 3808

SEQ ID NO: 5358 - DNA, 601 bp, Human; identical to SEQ ID NO: 3809

SEQ ID NO: 5359 - DNA, 601 bp, Human; identical to SEQ ID NO: 3810

SEQ ID NO: 5360 - DNA, 601 bp, Human; identical to SEQ ID NO: 3811

SEQ ID NO: 5361 - DNA, 601 bp, Human; identical to SEQ ID NO: 3812

SEQ ID NO: 5362 - DNA, 601 bp, Human; identical to SEQ ID NO: 3813

SEQ ID NO: 5363 - DNA, 601 bp, Human; identical to SEQ ID NO: 3814

SEQ ID NO: 5364 - DNA, 601 bp, Human
cgcttctcaaggatctattgtggcaaaatggatgaactggggactcagggtctggcactgggcacaggtcattctccatgacaggaagcagggaggcagggcgttggatcttgccatctggccattgggtttttctaattggcacttggacagccaattagacaggaacttggacagccatgggttcctgtcaccctctcacagcccacatctgtttcctcacaccctgcaccacccacttcatagagaaaatgatcatgaagtgaatgcctgccaacacatacctttgctcttgctaatmcctgaatatattatttagaggtcctttggtagaatttagcagaaactcaacttgaactggattaagaaaaaaaatctattggctcatataacttaaacaaaaatgagggtagtggaattcagtcatggctggatccagggtttctgttatatcatcaggattctgtctctctccattcctcatctctcatttctcatctctcatttctcattccatgctgtcttttgggaaggattcacttttagccaagagatgacaaagatggtttccagaagcttctctcttccaagctcagcagca

SEQ ID NO: 5365 - DNA, 601 bp, Human
gagatgacaaagatggtttccagaagcttctctcttccaagctcagcagcatcagcaaaaagagagcttgcaaaataatgtctcattatgcatcccaagttgtgtgcccatcctgaaccaattatgtattcagaggaattcattatttggcttggctaggtctggctcatagatcacccccacggagccagagagtgcagttagccttattcaacctacattggataggaagtgggaggtagagaaggatatagaatgttgaccactaaaagagagaaaggacactgtacaagcaaaaccaaaatatatggttttgggcagggggtggttcttggcatcatttcaaccccctagtatgcattccttattatagagcctgcaaagcgaaaatacttccagactcccttgcagctaaacttctgtaggccaattaggtttcatccattagaagcatgagaagtgggtggtggaagaaggtggaattaatcttcctgttatgctggtagaggcagctgctaagcacaattgggagacactggattttcctgcaggaatgttcctgtttccaattgtgagaacaacccgtttttgttgagagtcc

SEQ ID NO: 5366 - DNA, 601 bp, Human
ttgtttttgtttttgttttgagatggagcctcgctctgttgcccaggctggagtgcagtggtacaatctcagctcactgcaacctccacctcctggattcaagcaattctcctgcttcagcctccagagtaactgggattacaggcacatgccatcacgcccagctagttttttgtatttttagtagagacagggtttcactatgttggccaggctggtcttgaactcctgacctcaagtgatgtgccttccttggcctcccaaagggataggattacaggggtgagccattgctcccagccgggaggtggtgttttgtagcaagtcattctatcggctttccctagatccctattctccagccttggttctgtaagcaccaagttccctggttttggttctcatttcctgcaactaaaccgtgattgatatgtgcttggaagattcattccctttatctgtctgaagagaacctcataattcacgaagccccaatactccaagctattcatgacctacctactcagtactccctcctggaccatgctggaaacatctctttaacaggaaccttcctgactcactgagctccagtgaagca

SEQ ID NO: 5367 - DNA, 601 bp, Human
agccttggttctgtaagcaccaagttccctggttttggttctcatttcctgcaactaaaccgtgattgatatgtgcttggaagattcattccctttatctgtctgaagagaacctcataattcacgaagccccaatactccaagctattcatgacctacctactcagtactccctcctggaccatgctggaaacatctctttaacaggaaccttcctgactcactgagctccagtgaagcacccaccactgggatacatcctctccatacattaattccttgagttcttacaacaaccctrtagggtaggcactgttatcccccatttaaaaatgcaggccaggtgcagcagctcatacctataatcccagcactttgggaggcagaggactgcagatcacttgagcccaggagtttgagaccagcctggcaacatggcaaaaccccatctctacaacaaatacaaaaagtagctaggcatggtggcttgcgcctgtagtactagctacttggaaggctgaggagggaagatcgtttgagcccaggaggtcgaggctgcagtgagctgcaattgcaccactgccctccagcctgggtgaca

SEQ ID NO: 5368 - DNA, 601 bp, Human
ctgtctctaataaataaataaatgaaaactttgaggctcagagaggttaagtaatttgcccgaggtcacccagctataaagggcagacacaggattcagactcagttccatctgactcaaagccaacctattgaccgggtgcagtggctggcacctgtattcccagcactttaggagaccaaggtgggaggatcacttgagcccaggagttctaggctgcagtgacctgtgatggtgccactgtactccagcctgggtgacagagtaagaccttgtctcttttctttttttcaaaaaaagaaaaaaaaaaaggaagtagttggggtctcgcccaggtaattctttttttttttgggggggagatggagtcttgctcagtcgcccaggctggagtgcagtggcgcgatctcggttcactgcaagctctgcctcctgggttcacaccattctcctgcctcagcctcccgagtagctgggactaccggcacctgccaccacgcccagctaatttttttgtatttttagtagagacagggtttcaccatgttagccaggatggtctcgatctcctgacctcgtgatccacccaccttggcctccc

SEQ ID NO: 5369 - DNA, 601 bp, Human
gaggttaagtaatttgcccgaggtcacccagctataaagggcagacacaggattcagactcagttccatctgactcaaagccaacctattgaccgggtgcagtggctggcacctgtattcccagcactttaggagaccaaggtgggaggatcacttgagcccaggagttctaggctgcagtgacctgtgatggtgccactgtactccagcctgggtgacagagtaagaccttgtctcttttctttttttcaaaaaaagaaaaaaaaaaaggaagtagttggggtctcgcccaggtaattctttttttttttgggggggagatggagtcttgctcagtcgcccaggctggagtgcagtggcgcgatctcggttcactgcaagctctgcctcctgggttcacaccattctcctgcctcagcctcccgagtagctgggactaccggcacctgccaccacgcccagctaatttttttgtatttttagtagagacagggtttcaccatgttagccaggatggtctcgatctcctgacctcgtgatccacccaccttggcctcccaaagtgctgggattacaggcatgagccactatgcccaacctc

SEQ ID NO: 5370 - DNA, 601 bp, Human
ggtgggaggatcacttgagcccaggagttctaggctgcagtgacctgtgatggtgccactgtactccagcctgggtgacagagtaagaccttgtctcttttctttttttcaaaaaaagaaaaaaaaaaaggaagtagttggggtctcgcccaggtaattctttttttttttgggggggagatggagtcttgctcagtcgcccaggctggagtgcagtggcgcgatctcggttcactgcaagctctgcctcctgggttcacaccattctcctgcctcagcctcccgagtagctgggactacyggcacctgccaccacgcccagctaatttttttgtatttttagtagagacagggtttcaccatgttagccaggatggtctcgatctcctgacctcgtgatccacccaccttggcctcccaaagtgctgggattacaggcatgagccactatgcccaacctcacccaggtaattcttttaattaatgagagcccatctctactaaaaataaaaaattatctgagcatggtgccttgtgcctgtagtctcacctactctggaagctgaagcaggagaattgcttgagcctgagagattgaggc

SEQ ID NO: 5371 - DNA, 601 bp, Human
aacacactcttgcacagacacgcaaacagaagcatggaatttgtacagagcacgctcacagtgtctgatccataactcagacacggagtcacgcccacaaaggcacagtagaggcagagttcacacacaaacagacccgcggggacccacgacacagccctctgacacgaggacgccaggccagggcagcgtgggaatgaggctgcaaggagggagtgaggtggagaggatgactcaggaggcctctctgggggaggaggagggaagggggaggagggcaggcatccagcgcatgtggttyctattaggggcctgggaattgaggcatgagctggcgggacaaggagacccaggaacgcttcccagccttaccaaagcaggaaggagcagggccctgatctaaggccatgcggccggaacttggctcagaaccacagccgttctaaggcagagtggtctgccccaagccaggcccagcagggggctcatttcaacccctgcgatagtcctggagaagatttctttttattttttcttctttctttctttcttttttttttttttctgagacagagtttcgctcttgttgcccaggctgcag

SEQ ID NO: 5372 - DNA, 601 bp, Human
ataataataataataataataataaaactacctggtcatggtgatttgcgccttctatttgggaggatgaggtgggagaatcacttgagcccaggagttgaaggctgcagtgagctatcattgcaccgctgcaccccagcctgggcaagagcaagaccctgtctcttaaaaaaaaaaaagacacatggctgggccgggtgcagtggcccatgcctgtaaccccagcactttgggaggccaaggtgggtggatcacaaggtcaggagtttgagaccagcctggccaacatggtgaaaccccygtctctactaaaaatacaaaaattagcagggcgtggtggtgcgcacctgtagtcctagctactcaggaggctgaggcaggagaatcgcttgaacccgcaaggcggaggttgcagtgagccgagatcaggccactgcattccagcctgggtgacagacggacaatctgtcccaaaaaaaaaaaaaaaagacacatggccaggcacagtggctcttgcctgtaatcccagcactttgggaggccaaggtgggtggatcacgaggtcaggagatcgataccatcctggctaacacggtgaaac

SEQ ID NO: 5373 - DNA, 601 bp, Human
ctgcagtgagctatcattgcaccgctgcaccccagcctgggcaagagcaagaccctgtctcttaaaaaaaaaaaagacacatggctgggccgggtgcagtggcccatgcctgtaaccccagcactttgggaggccaaggtgggtggatcacaaggtcaggagtttgagaccagcctggccaacatggtgaaacccccgtctctactaaaaatacaaaaattagcagggcgtggtggtgcgcacctgtagtcctagctactcaggaggctgaggcaggagaatcgcttgaacccgcaaggcrgaggttgcagtgagccgagatcaggccactgcattccagcctgggtgacagacggacaatctgtcccaaaaaaaaaaaaaaaagacacatggccaggcacagtggctcttgcctgtaatcccagcactttgggaggccaaggtgggtggatcacgaggtcaggagatcgataccatcctggctaacacggtgaaaccccatctctactaaaaatagaaaaaattagctgggcatggtggcgggcgcctgtagtcccagctactcaggaggctgaggcaagagaatggcgtgaacccggga

SEQ ID NO: 5374 - DNA, 601 bp, Human
aaaaaaagacacatggctgggccgggtgcagtggcccatgcctgtaaccccagcactttgggaggccaaggtgggtggatcacaaggtcaggagtttgagaccagcctggccaacatggtgaaacccccgtctctactaaaaatacaaaaattagcagggcgtggtggtgcgcacctgtagtcctagctactcaggaggctgaggcaggagaatcgcttgaacccgcaaggcggaggttgcagtgagccgagatcaggccactgcattccagcctgggtgacagacggacaatctgtcccaaaaaaaaaaaaaaaagacacatggccaggcacagtggctcttgcctgtaatcccagcactttgggaggccaaggtgggtggatcacgaggtcaggagatcgataccatcctggctaacacggtgaaaccccatctctactaaaaatagaaaaaattagctgggcatggtggcgggcgcctgtagtcccagctactcaggaggctgaggcaagagaatggcgtgaacccgggaggcggagcttgcagtcagccgagatagcgccactgcactccagcctgggtgaaagagcgagactctgt

SEQ ID NO: 5375 - DNA, 601 bp, Human
aaaaatctgccaaatcatgtgtgtcatccatggatacagcagtccatatgcagtacatttggaaaagcattctgggaacagccattcccacactcagaggggtgggataatggggaaagagtgtttcatggggacagtagttcagtctgggaagatgagaacattctggagatgagtggtggtgatggttgcacagtaatgcgatcgtactcaagccactggactatacacttgaaactagttacaatggaaaacgttatgttatatacatatatatatatttatttatttatttatttatttatttatttgagacgttgtctgcctttgtcaccaggctggagtgtagtggcaccatctcagctcactacaacctccgcctcccgggttcaagcaattcttctgcctcagcctcctgagtagctgggactacaggtgcacaccaccacacccacctaatttttgtttttttagtagagacggggtttcaccgtgttggccaggatggtctcaatctcttgacttcatgatctgtccacctcggcctcccaacgtgttgggcatgagccaccgcgcccagccctatgttatgcatatttta

SEQ ID NO: 5376 - DNA, 601 bp, Human
aagaaagagatgcagtcggataaatgtatacaaggggcatcaattatgtgcaaagcgttatttctcaggtgggtgtgtgagtaggtgagagttcatgataagagttctctctattattttctatttatgtattaattaattaacttttttttgagacggagtctcactctgtcacccagcgtggagtgcattggcatgatctcagctcactgcagcctccgcctcctgggttcaagcgattctcctgcctcagcctcctgagtagctgggattgcaggtgcacaccaccatgcccaactamtttttgtatttttagtagagacggggtttcaccatgttggccaagctggtctcgaactcctgacctcagatgatctggcctccttgacttcccaaagtgctgggattacaggcgtgagccaccatgcctggctggttattataaatagtgctgctatgcacatgggtgtacaaatatgtctttgagctttcgctctcaattcttttgctatatacccagaagtgggattgctctgcctggtacatttcttgttaaaattttgttttcattgaggcatatattatacacaataaaattcac

SEQ ID NO: 5377 - DNA, 601 bp, Human
cgctctcaattcttttgctatatacccagaagtgggattgctctgcctggtacatttcttgttaaaattttgttttcattgaggcatatattatacacaataaaattcactaatctctatttttttttttttttttttagacagggtctcattctatcatccaggctggaacgcagtggcccagtcatggctcactgcagccttgacctcctgggctcaagtgatactgttgcctcagccgccctagaagctgggactacaggcacatgccattacacctggctaaagttttaagtttttktagaaacagggtctcactatgttgccagggctaatcttgaactcctggcctcaagcgatcctcccaccttggcctcccaaagcgctaggattacaaacttgagccaccacccctggactcccctagcttttcttcatagcaccacttgatattatatatatacatatatatacacacatatatgtgtgtgtatatatacatatatgtgtgtgtgtgtgtgtgtatatgtgtgtgtgtgtatgtgtgtgtgtgtatatatatatgtatatatttgcttactgcctgtcaaccatcctaaag

SEQ ID NO: 5378 - DNA, 601 bp, Human
gacctcctgggctcaagtgatactgttgcctcagccgccctagaagctgggactacaggcacatgccattacacctggctaaagttttaagtttttgtagaaacagggtctcactatgttgccagggctaatcttgaactcctggcctcaagcgatcctcccaccttggcctcccaaagcgctaggattacaaacttgagccaccacccctggactcccctagcttttcttcatagcaccacttgatattatatatatacatatatatacacacatatatgtgtgtgtatatatacatatrtgtgtgtgtgtgtgtgtgtatatgtgtgtgtgtgtatgtgtgtgtgtgtatatatatatgtatatatttgcttactgcctgtcaaccatcctaaagtgttaactccagcagggcaaggatctttgtttgtttcatggctgtctccccagagcctacgccattgcactctagtgcctggagcatagtaggtgctgaacaaatatttgttgaatgttatatgtgctgggatggggcctctgatatgtctacaagccagttttttggggtttttgttgtcgttgttgtcgtttttgagatgga

SEQ ID NO: 5379 - DNA, 601 bp, Human
atactgttgcctcagccgccctagaagctgggactacaggcacatgccattacacctggctaaagttttaagtttttgtagaaacagggtctcactatgttgccagggctaatcttgaactcctggcctcaagcgatcctcccaccttggcctcccaaagcgctaggattacaaacttgagccaccacccctggactcccctagcttttcttcatagcaccacttgatattatatatatacatatatatacacacatatatgtgtgtgtatatatacatatatgtgtgtgtgtgtgtgtgaatatgtgtgtgtgtgtatgtgtgtgtgtgtatatatatatgtatatatttgcttactgcctgtcaaccatcctaaagtgttaactccagcagggcaaggatctttgtttgtttcatggctgtctccccagagcctacgccattgcactctagtgcctggagcatagtaggtgctgaacaaatatttgttgaatgttatatgtgctgggatggggcctctgatatgtctacaagccagttttttggggtttttgttgtcgttgttgtcgtttttgagatggagtctcgctctgttgcccag

SEQ ID NO: 5380 - DNA, 601 bp, Human
gcagtgagctgtgatggcaccattgcacttcagcctgggcaacacaacgagaccctatctccaaaaagaaattcttttaagaaaaaaaattagagtgggcacaatggctcatacctgtaatcccacactttgggaggtcaaggcgggcagatcacttgaggccaggagttcaagaccagcctggccaacatggtgaaaccccatctctactaaaaatacaaaaaattagccgaatgtggcagcatgtgcctgtaatcccagctacttgggaggctcaggtatgagaatcgcttgaactcgrgaggcagaggttgcaatgaaccgagatcacatcattgcactccagcctgggtgacaaagcaagactccatctcaaagaagagaaaaaaattaaaacaaatttaaggggaaaaagcaaaaaggaggggaaggaggaagggaaaaataggggagagagtaggcaatgaggcaagtggtttcattcatgtgaggctttgattaccgcttagtgaatctgcattttacatgtgaaaagagaggggtagattatgcaatcggctccagctcagtaaatctacattttacgtaagacagagtaagc

SEQ ID NO: 5381 - DNA, 601 bp, Human
cagctcagtaaatctacattttacgtaagacagagtaagcaagtgaaattacagctatctccttcggaacaaaaggaaagcagttttcgcctgactcagttcccaagcttcacttttcccttttgccacagttgagtttggagccccaagttgcaattttcctttcacagctgggagtgtgtgactgtgtgtgtgccctgctattggtgccagtgtgtctgaacctggctgaggatgtgggtgtgtgtacgggagtttggaacatgacctgcagccgtggcaggggtgacaagagaaaagyctgactttgagggtccttggttctgatatataattgtgtgtgagtgtccccatcaaagttgtggccgggcacggtggctcatgcctgtaatcccagcactttgagaggtcaaggcaggcggatcgcctgaggtcaggagtttgagactagcctcgccaacattgccaaaccccgtctctaataaaaatttaaaaaaaaaaaaaaaaaagctaggaatggtggcacacacctgtagtcccagctactcaggaggctgagtcagaggaattgcttgaacctgggaggcggaggttgcagtga

SEQ ID NO: 5382 - DNA, 601 bp, Human
tgccagtgtgtctgaacctggctgaggatgtgggtgtgtgtacgggagtttggaacatgacctgcagccgtggcaggggtgacaagagaaaagtctgactttgagggtccttggttctgatatataattgtgtgtgagtgtccccatcaaagttgtggccgggcacggtggctcatgcctgtaatcccagcactttgagaggtcaaggcaggcggatcgcctgaggtcaggagtttgagactagcctcgccaacattgccaaaccccgtctctaataaaaatttaaaaaaaaaaaaaaaaaagctaggaatggtggcacacacctgtagtcccagctactcaggaggctgagtcagaggaattgcttgaacctgggaggcggaggttgcagtgagccaagattgtgccactgccactgcattccagcctgggcaacagggcaagacttcatctcaaacaaaacaaaacgaagttatgggtatgcgtgtgtaaaattccctgctaggcccggcaccctggctaacacctgtcatcccagcactttgagaggctgaggcaggagaaccgcttgagctcaggagttccagaccagcctgggcaa

SEQ ID NO: 5383 - DNA, 601 bp, Human
gttgaataaacacaaggagcttagcaaggcccagaattcccttctcacacctttgtcaattaacgtttcatttatggggttgggtttctcattcattaacgagctttgggctcattaaagagtcctcattaaactctataaatcgtccctcctttccaaaacgcctgcactgggatgggaatggagttgcaaaaccgagacaggccgacctgcattcaaacgcctggctgtgtactgtgggcagacgcctcccctctctgaacctgtttccttcctgtaaaatgcaagcaaacagacatgsgggcatgggggcaagcgccctgtggctcatgcctataatctcaacactttgggaggccaaggcgggaggatcgcctgaggacaggagtttgagaccagcctgggcaacatagcaagaccctttctctacaaaaaaaatttgaaaattagctgagcatggtgaagcgcacctgtagtcccagctactcaggaggtggaggcaagagggttggttgagcccaggtgttggaggctgcagtgagctatgatcgtgtgactgcactccagcctgggcaacagagcaagatcctgtttcaaaaaa

SEQ ID NO: 5384 - DNA, 601 bp, Human
ctctctctgttcctcagtttctttatctgcaccacagagataataatagaacatccctcaaaggttgttatgtgggataattaaattaatcgaggtaaaacatttgatgaacagtgtctggcatatgagtaataaatggcaactatgattaagattaatagtgttagttgaggctgggcatggtgtctcacgcctgtaatcccagcactttgggaagctgaggctgaatgatcccttgagcccaggagcttgagaccagcctgggcaacacagtgagaccttgtcttttttttttttttttgagacagagtctcgctctgtcacccaggttggagtgcagtggcacaatcttggctcactgcaacctccacctccctggttcaagcaattctcatagctcagcctccacagcagctgggactacaggcacatgccaccatgcccagctaatttttgtatttttagtagagacggggtttcaccatattggccaggctggtctcaaactcctgacctcatgatccacccgccttggcctcccaaagtgctgggattacaggtgtgagccactgtgcccagccgagaccctgtctctctgttt

SEQ ID NO: 5385 - DNA, 601 bp, Human
agtttctttatctgcaccacagagataataatagaacatccctcaaaggttgttatgtgggataattaaattaatcgaggtaaaacatttgatgaacagtgtctggcatatgagtaataaatggcaactatgattaagattaatagtgttagttgaggctgggcatggtgtctcacgcctgtaatcccagcactttgggaagctgaggctgaatgatcccttgagcccaggagcttgagaccagcctgggcaacacagtgagaccttgtcttttttttttttttttgagacagagtctcgytctgtcacccaggttggagtgcagtggcacaatcttggctcactgcaacctccacctccctggttcaagcaattctcatagctcagcctccacagcagctgggactacaggcacatgccaccatgcccagctaatttttgtatttttagtagagacggggtttcaccatattggccaggctggtctcaaactcctgacctcatgatccacccgccttggcctcccaaagtgctgggattacaggtgtgagccactgtgcccagccgagaccctgtctctctgtttttttttttttaatta

SEQ ID NO: 5386 - DNA, 601 bp, Human
aaactcaatccaacagtgcccatcaacgatgaatgaattagctgaaggtgggagatgactgaatattacttggcaataaaaaggaatgaagtactgatgcatgctgcaaataaacctggaaaccagccaggcactgtggttaatgtctgtaatctcagcactttgggagatcgaggtgggtgaatcacttgaggccaggggttcgagaccagcctggccgacatggtgaaactccgtttctactaaaaatacaaaaattagccagggatggtggtgcgtgcctgtagtcccagctactcgsgaggctgagaaaggagaattgcttgaaccctggagggggaggttgcagtgagccgagattgtgctactgcactccagcctgggtgacagagcgagactctgcccacaaaacaaaaaactcctggaaaccgttttgctgaaaatgccagatacaaagggccatatatcattatatcatttatttgtatttattccttttttttttttttttttagagacaaggtctcactctgtttcccaggctggagtgcagtggtgagatcacagctcactgcagcctccaactcctggcctccagtga

SEQ ID NO: 5387 - DNA, 601 bp, Human
cagcactttgggagatcgaggtgggtgaatcacttgaggccaggggttcgagaccagcctggccgacatggtgaaactccgtttctactaaaaatacaaaaattagccagggatggtggtgcgtgcctgtagtcccagctactcgggaggctgagaaaggagaattgcttgaaccctggagggggaggttgcagtgagccgagattgtgctactgcactccagcctgggtgacagagcgagactctgcccacaaaacaaaaaactcctggaaaccgttttgctgaaaatgccagatacaargggccatatatcattatatcatttatttgtatttattccttttttttttttttttttagagacaaggtctcactctgtttcccaggctggagtgcagtggtgagatcacagctcactgcagcctccaactcctggcctccagtgattctcccgcctcagcctcttgggtagctgggactacagatatgcaccactgtacctggctaatgtttttattttcatttttgtagagatggggtcttgctatgttgcctaggctggtctggaactcctggcctcaagcgatcctcctgccttggc

SEQ ID NO: 5388 - DNA, 601 bp, Human
agatcccaagacagatatgggccacatcagatgaaagagatcaagagctgggtgaggtggctcgtacctgtaatctcagcagctcaggaggctgaggtgggaggattgcttgaggctagtagtttgagacaagcctgggcaacaaagaaagacaccatctgtacacaaacacacacacacacacacacacacaaaacaacccagctgggtgtgatggtgcatgcctgtggtcccaggtactcaggaggctgaagaaggaggatcactcgagtcccagagttggaggctgcagtgagccatkatcatgcccttgcactccagactgggcgacagagtgagacccagtctctaaaaacgagcaaacaagggctgagcgtggtggctcacatctgtaatcccagcactttgggagatcaaggcgggcggatcacctgaagtcaggagttcaagaccagcctggccaacaaggtgaaatcccatctctactaaaattataaaaattagccgggtgtggtggtgcatatctgcaaccccagcttctagggaggctgaggcaggagaattgtttgaacccgggaggcggaggttgcagtgagccaag

SEQ ID NO: 5389 - DNA, 601 bp, Human; identical to SEQ ID NO: 3806

SEQ ID NO: 5390 - DNA, 601 bp, Human; identical to SEQ ID NO: 1835

SEQ ID NO: 5391 - DNA, 601 bp, Human; identical to SEQ ID NO: 1836

SEQ ID NO: 5392 - DNA, 601 bp, Human; identical to SEQ ID NO: 1837

SEQ ID NO: 5393 - DNA, 601 bp, Human; identical to SEQ ID NO: 1838

SEQ ID NO: 5394 - DNA, 601 bp, Human; identical to SEQ ID NO: 1839

SEQ ID NO: 5395 - DNA, 601 bp, Human; identical to SEQ ID NO: 1840

SEQ ID NO: 5396 - DNA, 601 bp, Human; identical to SEQ ID NO: 1841

SEQ ID NO: 5397 - DNA, 601 bp, Human; identical to SEQ ID NO: 1842

SEQ ID NO: 5398 - DNA, 601 bp, Human; identical to SEQ ID NO: 1843

SEQ ID NO: 5399 - DNA, 601 bp, Human; identical to SEQ ID NO: 1844

SEQ ID NO: 5400 - DNA, 601 bp, Human; identical to SEQ ID NO: 1845

SEQ ID NO: 5401 - DNA, 601 bp, Human; identical to SEQ ID NO: 1846

SEQ ID NO: 5402 - DNA, 601 bp, Human; identical to SEQ ID NO: 1847

SEQ ID NO: 5403 - DNA, 601 bp, Human; identical to SEQ ID NO: 1848

SEQ ID NO: 5404 - DNA, 601 bp, Human; identical to SEQ ID NO: 1849

SEQ ID NO: 5405 - DNA, 601 bp, Human; identical to SEQ ID NO: 1850

SEQ ID NO: 5406 - DNA, 601 bp, Human; identical to SEQ ID NO: 1851

SEQ ID NO: 5407 - DNA, 601 bp, Human; identical to SEQ ID NO: 1852

SEQ ID NO: 5408 - DNA, 601 bp, Human; identical to SEQ ID NO: 1853

SEQ ID NO: 5409 - DNA, 601 bp, Human; identical to SEQ ID NO: 1854

SEQ ID NO: 5410 - DNA, 601 bp, Human; identical to SEQ ID NO: 1855

SEQ ID NO: 5411 - DNA, 601 bp, Human; identical to SEQ ID NO: 1856

SEQ ID NO: 5412 - DNA, 601 bp, Human; identical to SEQ ID NO: 1857

SEQ ID NO: 5413 - DNA, 601 bp, Human; identical to SEQ ID NO: 1858

SEQ ID NO: 5414 - DNA, 601 bp, Human; identical to SEQ ID NO: 1859

SEQ ID NO: 5415 - DNA, 601 bp, Human; identical to SEQ ID NO: 1860

SEQ ID NO: 5416 - DNA, 601 bp, Human; identical to SEQ ID NO: 1861

SEQ ID NO: 5417 - DNA, 601 bp, Human; identical to SEQ ID NO: 1862

SEQ ID NO: 5418 - DNA, 601 bp, Human; identical to SEQ ID NO: 1863

SEQ ID NO: 5419 - DNA, 601 bp, Human; identical to SEQ ID NO: 1864

SEQ ID NO: 5420 - DNA, 601 bp, Human; identical to SEQ ID NO: 1865

SEQ ID NO: 5421 - DNA, 601 bp, Human; identical to SEQ ID NO: 1866

SEQ ID NO: 5422 - DNA, 601 bp, Human; identical to SEQ ID NO: 1867

SEQ ID NO: 5423 - DNA, 601 bp, Human; identical to SEQ ID NO: 1868

SEQ ID NO: 5424 - DNA, 601 bp, Human; identical to SEQ ID NO: 1869

SEQ ID NO: 5425 - DNA, 601 bp, Human; identical to SEQ ID NO: 1870

SEQ ID NO: 5426 - DNA, 601 bp, Human; identical to SEQ ID NO: 1871

SEQ ID NO: 5427 - DNA, 601 bp, Human; identical to SEQ ID NO: 1872

SEQ ID NO: 5428 - DNA, 601 bp, Human; identical to SEQ ID NO: 1873

SEQ ID NO: 5429 - DNA, 601 bp, Human; identical to SEQ ID NO: 1874

SEQ ID NO: 5430 - DNA, 601 bp, Human; identical to SEQ ID NO: 1875

SEQ ID NO: 5431 - DNA, 601 bp, Human; identical to SEQ ID NO: 1876

SEQ ID NO: 5432 - DNA, 601 bp, Human; identical to SEQ ID NO: 1877

SEQ ID NO: 5433 - DNA, 601 bp, Human; identical to SEQ ID NO: 1878

SEQ ID NO: 5434 - DNA, 601 bp, Human; identical to SEQ ID NO: 1879

SEQ ID NO: 5435 - DNA, 601 bp, Human; identical to SEQ ID NO: 1880

SEQ ID NO: 5436 - DNA, 601 bp, Human; identical to SEQ ID NO: 1881

SEQ ID NO: 5437 - DNA, 601 bp, Human; identical to SEQ ID NO: 1882

SEQ ID NO: 5438 - DNA, 601 bp, Human; identical to SEQ ID NO: 1883

SEQ ID NO: 5439 - DNA, 601 bp, Human; identical to SEQ ID NO: 1884

SEQ ID NO: 5440 - DNA, 601 bp, Human; identical to SEQ ID NO: 1885

SEQ ID NO: 5441 - DNA, 601 bp, Human; identical to SEQ ID NO: 1886

SEQ ID NO: 5442 - DNA, 601 bp, Human; identical to SEQ ID NO: 1887

SEQ ID NO: 5443 - DNA, 601 bp, Human; identical to SEQ ID NO: 1888

SEQ ID NO: 5444 - DNA, 601 bp, Human; identical to SEQ ID NO: 1889

SEQ ID NO: 5445 - DNA, 601 bp, Human; identical to SEQ ID NO: 1890

SEQ ID NO: 5446 - DNA, 601 bp, Human; identical to SEQ ID NO: 1891

SEQ ID NO: 5447 - DNA, 601 bp, Human; identical to SEQ ID NO: 1892

SEQ ID NO: 5448 - DNA, 601 bp, Human; identical to SEQ ID NO: 1893

SEQ ID NO: 5449 - DNA, 601 bp, Human; identical to SEQ ID NO: 1894

SEQ ID NO: 5450 - DNA, 601 bp, Human; identical to SEQ ID NO: 1895

SEQ ID NO: 5451 - DNA, 601 bp, Human; identical to SEQ ID NO: 1896

SEQ ID NO: 5452 - DNA, 601 bp, Human; identical to SEQ ID NO: 1897

SEQ ID NO: 5453 - DNA, 601 bp, Human; identical to SEQ ID NO: 1898

SEQ ID NO: 5454 - DNA, 601 bp, Human; identical to SEQ ID NO: 1899

SEQ ID NO: 5455 - DNA, 601 bp, Human; identical to SEQ ID NO: 1900

SEQ ID NO: 5456 - DNA, 601 bp, Human; identical to SEQ ID NO: 1901

SEQ ID NO: 5457 - DNA, 601 bp, Human; identical to SEQ ID NO: 1902

SEQ ID NO: 5458 - DNA, 601 bp, Human; identical to SEQ ID NO: 1903

SEQ ID NO: 5459 - DNA, 601 bp, Human; identical to SEQ ID NO: 1904

SEQ ID NO: 5460 - DNA, 601 bp, Human; identical to SEQ ID NO: 1905

SEQ ID NO: 5461 - DNA, 601 bp, Human; identical to SEQ ID NO: 1906

SEQ ID NO: 5462 - DNA, 601 bp, Human; identical to SEQ ID NO: 1907

SEQ ID NO: 5463 - DNA, 601 bp, Human; identical to SEQ ID NO: 1908

SEQ ID NO: 5464 - DNA, 601 bp, Human; identical to SEQ ID NO: 1909

SEQ ID NO: 5465 - DNA, 601 bp, Human; identical to SEQ ID NO: 1910

SEQ ID NO: 5466 - DNA, 601 bp, Human; identical to SEQ ID NO: 1911

SEQ ID NO: 5467 - DNA, 601 bp, Human; identical to SEQ ID NO: 1912

SEQ ID NO: 5468 - DNA, 601 bp, Human; identical to SEQ ID NO: 1913

SEQ ID NO: 5469 - DNA, 601 bp, Human; identical to SEQ ID NO: 1914

SEQ ID NO: 5470 - DNA, 601 bp, Human; identical to SEQ ID NO: 1915

SEQ ID NO: 5471 - DNA, 601 bp, Human; identical to SEQ ID NO: 1916

SEQ ID NO: 5472 - DNA, 601 bp, Human; identical to SEQ ID NO: 1917

SEQ ID NO: 5473 - DNA, 601 bp, Human; identical to SEQ ID NO: 3628

SEQ ID NO: 5474 - DNA, 601 bp, Human; identical to SEQ ID NO: 3629

SEQ ID NO: 5475 - DNA, 601 bp, Human; identical to SEQ ID NO: 3630

SEQ ID NO: 5476 - DNA, 601 bp, Human; identical to SEQ ID NO: 3631

SEQ ID NO: 5477 - DNA, 601 bp, Human; identical to SEQ ID NO: 3632

SEQ ID NO: 5478 - DNA, 601 bp, Human; identical to SEQ ID NO: 3633

SEQ ID NO: 5479 - DNA, 601 bp, Human; identical to SEQ ID NO: 3634

SEQ ID NO: 5480 - DNA, 601 bp, Human; identical to SEQ ID NO: 3635

SEQ ID NO: 5481 - DNA, 601 bp, Human; identical to SEQ ID NO: 3636

SEQ ID NO: 5482 - DNA, 601 bp, Human; identical to SEQ ID NO: 3637

SEQ ID NO: 5483 - DNA, 601 bp, Human; identical to SEQ ID NO: 3638

SEQ ID NO: 5484 - DNA, 601 bp, Human; identical to SEQ ID NO: 3639

SEQ ID NO: 5485 - DNA, 601 bp, Human; identical to SEQ ID NO: 3640

SEQ ID NO: 5486 - DNA, 601 bp, Human; identical to SEQ ID NO: 3641

SEQ ID NO: 5487 - DNA, 601 bp, Human; identical to SEQ ID NO: 3642

SEQ ID NO: 5488 - DNA, 601 bp, Human; identical to SEQ ID NO: 3643

SEQ ID NO: 5489 - DNA, 601 bp, Human; identical to SEQ ID NO: 3644

SEQ ID NO: 5490 - DNA, 601 bp, Human; identical to SEQ ID NO: 3645

SEQ ID NO: 5491 - DNA, 601 bp, Human; identical to SEQ ID NO: 3646

SEQ ID NO: 5492 - DNA, 601 bp, Human; identical to SEQ ID NO: 3647

SEQ ID NO: 5493 - DNA, 601 bp, Human; identical to SEQ ID NO: 3648

SEQ ID NO: 5494 - DNA, 601 bp, Human; identical to SEQ ID NO: 3649

SEQ ID NO: 5495 - DNA, 601 bp, Human; identical to SEQ ID NO: 3650

SEQ ID NO: 5496 - DNA, 601 bp, Human; identical to SEQ ID NO: 3651

SEQ ID NO: 5497 - DNA, 601 bp, Human; identical to SEQ ID NO: 3652

SEQ ID NO: 5498 - DNA, 601 bp, Human; identical to SEQ ID NO: 3653

SEQ ID NO: 5499 - DNA, 601 bp, Human; identical to SEQ ID NO: 3654

SEQ ID NO: 5500 - DNA, 601 bp, Human; identical to SEQ ID NO: 3655

SEQ ID NO: 5501 - DNA, 601 bp, Human; identical to SEQ ID NO: 3656

SEQ ID NO: 5502 - DNA, 601 bp, Human; identical to SEQ ID NO: 3657

SEQ ID NO: 5503 - DNA, 601 bp, Human; identical to SEQ ID NO: 3658

SEQ ID NO: 5504 - DNA, 601 bp, Human; identical to SEQ ID NO: 3659

SEQ ID NO: 5505 - DNA, 601 bp, Human; identical to SEQ ID NO: 3660

SEQ ID NO: 5506 - DNA, 601 bp, Human; identical to SEQ ID NO: 3661

SEQ ID NO: 5507 - DNA, 601 bp, Human; identical to SEQ ID NO: 3662

SEQ ID NO: 5508 - DNA, 601 bp, Human; identical to SEQ ID NO: 3663

SEQ ID NO: 5509 - DNA, 601 bp, Human; identical to SEQ ID NO: 3664

SEQ ID NO: 5510 - DNA, 601 bp, Human; identical to SEQ ID NO: 3665

SEQ ID NO: 5511 - DNA, 601 bp, Human; identical to SEQ ID NO: 3666

SEQ ID NO: 5512 - DNA, 601 bp, Human; identical to SEQ ID NO: 3667

SEQ ID NO: 5513 - DNA, 601 bp, Human; identical to SEQ ID NO: 3668

SEQ ID NO: 5514 - DNA, 601 bp, Human; identical to SEQ ID NO: 3669

SEQ ID NO: 5515 - DNA, 601 bp, Human; identical to SEQ ID NO: 3670

SEQ ID NO: 5516 - DNA, 601 bp, Human; identical to SEQ ID NO: 2332

SEQ ID NO: 5517 - DNA, 601 bp, Human; identical to SEQ ID NO: 2333

SEQ ID NO: 5518 - DNA, 601 bp, Human; identical to SEQ ID NO: 2334

SEQ ID NO: 5519 - DNA, 601 bp, Human
accagccccattctggcctttccaggagcctgtcctgtgcactcacacctctgctcctctgtcacacaggtccccctcccgggacaccccttccagttcagatgtcacctgctccatgaagctttctctcgtctctccagcttggagagagcccctgcctggcatatttctacctctccaaggacgtgccaaaaagtctgaggaccagtgcagacgtttatggcctggtggaagctcccataacactgtttattcagtcaattctttcctccctcacatggggtttggcttagagtaagtrttcaacacgtcctggctaaatgacagacgaaagtatcacggtctcctccctacaacatgataaactttcattcgtcttccagaccagcaaataggtggcctctgtccctgtgctggaaaagccagcccatagccctggacagatggatgacagacttttgttttggattccagagacaacccctggggcaaataggttagatgttaggtagaacttcccagcgtgggctcaagcttggaaaagaaaactaagcagtactgaagcaaagcactctcacttgggttatctcaccctttggag

SEQ ID NO: 5520 - DNA, 601 bp, Human
aaatgctgggactacaagcgtgagccactgcccccggactccctcacattcttaatagttcccacagtgtttctacatacattgtaccctcacaatatctggagaagtggagcaaatctgccccactttgtaggaaagggggcacagagccggggaatggctgacccaaggtcacacagcaagctggtagtacatcaggattcaaaccaaaaccctgggccctgttctcaactcaactgctgtatagtaaagagcattcccaaccctcagcggtagcctcaactcagccccagcttggaawgtgaaggaacattctcaaggtgccacagctgcagatgggggatgatgggttgggtctccttcccccaactgtctgccaggttacccctccaaaagtccaggaggtttgtgcctgttctggtactatcttgctctgtgaccctgggcaacctccttcacctctctgtgcctgctgcagggtggtttgagtacaaccggaggcaggagacataaaaagcctcctcagaaccctcggcccacggcttgcactgggagaaaacagggggagacggtccatccgaggcccttaagaacagcactg

SEQ ID NO: 5521 - DNA, 601 bp, Human
atttcagagcgatctgggaacttgttctttctcctctattaaaggctctggagaccagggccctcggctggttatctgcctgaaaggatgaggggaagggtcaatacattcaggagaaggggctgtctgggacctctgtctggggccacagcctccttctgtcttcactgactgctctgggcagcatgccaggggcgtggtttgggctagaggaggactggatggtgcctgcagcaccacctttctcccagggccacttcaggtgcctcctcactggtttcccagccttcggcctcactcyttctactcaatcaccacaaagcagcctgtgaccatctcagaatgcaaatccgaccgtgtcactcccctgactctaaactcctcagtaggctgggtgcggtggctcacacctgtaatcccagcactgtgggaggctgaggcgggtggatcacttgaggtcagcagtccaagaccagcctgggcaacatggcgaaacccggtgtctactaaaaaaatacagaagttagtcgcatggtggcacgcctgtaatcccagctactcgggagactgaggagaatcacttgaaccagggaggctgagg

SEQ ID NO: 5522 - DNA, 601 bp, Human
gctgggtgtagtggtgcacctgtggtaccagctactcaggaggctgaggtgggaagatcacttgagcccataagttcaaggctgcagtgagctgtgttcatgccactgtactccagcctgggtgacagagtgagagaccctgtctcaaaaccaaaacaacaaaaaacattcactgaggccgggcgtggtggctcacacctgtaatcccagcactttgggaggacgaggtgggcagatcacctgaggtcaggagttcgagaccaggctggccaacatggtgaaaccccgtctctactaaaamtacaaaaaattagtcggctgtggccgggcgcggtggctcacacctgtagtaatcccagcactttcggaggccgaggtgggcggatcacgaggtcaggagattgagaccatcctggctaacacagtgaaaccctgtctcaactaaaaatacaaaaaattagccaagcgtggtggcgggcacctgtagtcccagctactcaggaggctgaggcaggagaatggcgtgaacccaaaaggtggagcttgcagtgagccgagatcgcgccactgcactccagcttgggcgacagagcgagactcc

SEQ ID NO: 5523 - DNA, 601 bp, Human
tccctccaccctccactgcctctgcccggccacaccagcgttcaccccctacatgtgccaaacttgctgttccggcagccgggaactctcatctcccccgcccccgtctttgcccggctgccccctcctcaaccttcatgtcccagctcagacatcacctcctttcctggccgctcctctagagcggccccctcccctcacagccactctccaccacatcgccctgttttgtctcctttcttctctcggagcgatccttctggtgggtggctttgcctgtttggtctccagcttcctcccstagagtgcagctccttaggggcaggcatgtgactgctccattctcttctgtccccacaatgaggcagggcctccttgggtgctcacaaccctgaagatgaggacgctgcagccctgagaggtggattgagccgcccaaagtcccagagccagggaatagcagggttcagaccgagggcgacctgatgccaagcctcagtgggtggggggctctcacggctgggggcctactctggagggctctcacccagggtggacagagtcgcagtgaggctcttagggcgggtaccaagaatgaagg

SEQ ID NO: 5524 - DNA, 601 bp, Human
agagaaacaattgggacatgtgtcaacactgttacaatattagtgccatccaattcttggagtctagcaccagatatgcaccatgcatgctctgagtgctgctcctctcactgaatatttgcagtcttcctgggagggacttatcctcacttcacagatgggaaatccaaggctcagagaggaagacacgcctgctaaaagtccttggtgacaattcaatggcagatccagggttcaagctcaagttgatcccatggcccttggtcttaaccactaggtcacactgaacaaacaggtattrgtggtgcgtggtagggatctgatgcagaaggtggggggagctgcccagtttttcacccgggacctgcacttagtgcctccgcctcccccacccctatttgggctgaaggcagacagcacagctccagcccaccagagccgtggggggggcgggggggtgggtgggtagtagtgtggcctggctaaggagtctctcaaatatagtggggaaataaaataagtagcagagagatgggccaaccatggcccattctcatcttccctccctaaccgcgttcatcagaaaacagcatatgtgagg

SEQ ID NO: 5525 - DNA, 601 bp, Human
gaggggaggaaacaggaggagagcggaggagacaggaggagaggggaggagaggggagaggaggtgagggaggggaggggaggggaggggaggggaggggaggggaggggagggggagaaagatttcagtccaaggtgaccctgagagaagtcagtcaggcgaggagttagagggaagggggctgcgggaacacaggatgggggtggggtgggccggatgggtaagtaagtttctaagaacagctatggaaagagaaacaattgggacatgtgtcaacactgttacaatattagtgccatycaattcttggagtctagcaccagatatgcaccatgcatgctctgagtgctgctcctctcactgaatatttgcagtcttcctgggagggacttatcctcacttcacagatgggaaatccaaggctcagagaggaagacacgcctgctaaaagtccttggtgacaattcaatggcagatccagggttcaagctcaagttgatcccatggcccttggtcttaaccactaggtcacactgaacaaacaggtattggtggtgcgtggtagggatctgatgcagaaggtggggggagctgcccagt

SEQ ID NO: 5526 - DNA, 601 bp, Human
gacaggcagagtgagacttcgctaaaaaaaagaaaaaaaaaagcatagactctgtagccaaaactgcccaggttccactctagctctgccaattactgactgagaggagagatacattacctctctgtccctcagttttcccacctacaaaacaggaataacaataataagtacctcacagggttgatgtgaagattaagtaaatttataacataaaatatttagtgctgtacctggcacacagcaaacactcaagaaacgctattattattactgctaagactagtaaaacaccgcgggmaggaaagaatggaggattactgaataaagccctaatgcagacagaagttactactatgtcactcccacaaggaaacatcaaacatcaccactcccaggagcctcctcagaagcaacctgccagccctgggctggtcattctctgatagtatcagggccgttttgtcccactttcctccgtggacttgagctcactaagggcagccttactgcaccctcccccaccccatcctcagcacccagtggtgtgcagcagggttgtgggaaatatctgccagacagacatgcttaagatgtggcc

SEQ ID NO: 5527 - DNA, 601 bp, Human
tgagccgagatcgtgccactgcactccagactggcgacagagtgagactctgtctcaaaaaaattaaaaaattaaaaaataaaaacttagccgggtatggtggtgcacgcttgtagtctcagttactcgagaggctgaggtgggaggatcgcttgagtctgggaggttgaggttgcagtgagccatgatgcacgatggtgccattgcattccagccagggtgacaggcagagtgagacttcgctaaaaaaaagaaaaaaaaaagcatagactctgtagccaaaactgcccaggttccactytagctctgccaattactgactgagaggagagatacattacctctctgtccctcagttttcccacctacaaaacaggaataacaataataagtacctcacagggttgatgtgaagattaagtaaatttataacataaaatatttagtgctgtacctggcacacagcaaacactcaagaaacgctattattattactgctaagactagtaaaacaccgcgggcaggaaagaatggaggattactgaataaagccctaatgcagacagaagttactactatgtcactcccacaaggaaacatc

SEQ ID NO: 5528 - DNA, 601 bp, Human
ttgagcccgaagtttgagaccagcctaggcaacatagcaaaccctgtctctacaaaaaaattaggccaggcacggtggctcatgcctgtaatcccagcactttgggaggccgaggcgggtggatcacttgaggtcaggagatcgagacgaccctggccaacatggtgaaaccccatctctactaaaaatccaaaaattagccgggcgtggtggtgcagcgcctgtagtcccagctactcaggaggctgaggcagaggaatcgcttgaacccaggaggtgacaattgcaatgagccgagatygtgccactgcactccagactggcgacagagtgagactctgtctcaaaaaaattaaaaaattaaaaaataaaaacttagccgggtatggtggtgcacgcttgtagtctcagttactcgagaggctgaggtgggaggatcgcttgagtctgggaggttgaggttgcagtgagccatgatgcacgatggtgccattgcattccagccagggtgacaggcagagtgagacttcgctaaaaaaaagaaaaaaaaaagcatagactctgtagccaaaactgcccaggttccactctagctctgcca

SEQ ID NO: 5529 - DNA, 601 bp, Human
caaactttgggggtccgaggcaggacgatcgcttgagcccgaagtttgagaccagcctaggcaacatagcaaaccctgtctctacaaaaaaattaggccaggcacggtggctcatgcctgtaatcccagcactttgggaggccgaggcgggtggatcacttgaggtcaggagatcgagacgaccctggccaacatggtgaaaccccatctctactaaaaatccaaaaattagccgggcgtggtggtgcagcgcctgtagtcccagctactcaggaggctgaggcagaggaatcgcttgaamccaggaggtgacaattgcaatgagccgagatcgtgccactgcactccagactggcgacagagtgagactctgtctcaaaaaaattaaaaaattaaaaaataaaaacttagccgggtatggtggtgcacgcttgtagtctcagttactcgagaggctgaggtgggaggatcgcttgagtctgggaggttgaggttgcagtgagccatgatgcacgatggtgccattgcattccagccagggtgacaggcagagtgagacttcgctaaaaaaaagaaaaaaaaaagcatagactctgtagcc

SEQ ID NO: 5530 - DNA, 601 bp, Human
tgagactggctgatcataaggactacgaccagctgggtagaagtcagttatggaggaagcacaagttggattcagccaggggtggtggttcacgcctgtcatcccaaactttgggggtccgaggcaggacgatcgcttgagcccgaagtttgagaccagcctaggcaacatagcaaaccctgtctctacaaaaaaattaggccaggcacggtggctcatgcctgtaatcccagcactttgggaggccgaggcgggtggatcacttgaggtcaggagatcgagacgaccctggccaacatgrtgaaaccccatctctactaaaaatccaaaaattagccgggcgtggtggtgcagcgcctgtagtcccagctactcaggaggctgaggcagaggaatcgcttgaacccaggaggtgacaattgcaatgagccgagatcgtgccactgcactccagactggcgacagagtgagactctgtctcaaaaaaattaaaaaattaaaaaataaaaacttagccgggtatggtggtgcacgcttgtagtctcagttactcgagaggctgaggtgggaggatcgcttgagtctgggaggttgaggttgc

SEQ ID NO: 5531 - DNA, 601 bp, Human
tgcttcctaggctaatccttcttcctccccctgactcaggtcctttcctttctgggtcttaaacttccacacccccttccttgaaggtccctatccgctcacccctgagctgatgctgaacacaggctgtacaggaagacctaagattaatttcttccctttgctggctgcaaaggactctcatggaaggtgaggcactcagagtccatgagactggctgatcataaggactacgaccagctgggtagaagtcagttatggaggaagcacaagttggattcagccaggggtggtggttcaygcctgtcatcccaaactttgggggtccgaggcaggacgatcgcttgagcccgaagtttgagaccagcctaggcaacatagcaaaccctgtctctacaaaaaaattaggccaggcacggtggctcatgcctgtaatcccagcactttgggaggccgaggcgggtggatcacttgaggtcaggagatcgagacgaccctggccaacatggtgaaaccccatctctactaaaaatccaaaaattagccgggcgtggtggtgcagcgcctgtagtcccagctactcaggaggctgaggcagagg

SEQ ID NO: 5532 - DNA, 601 bp, Human
aactcctggcctcaagtgacccacccatcgcagcctcccaaagttctgggattacaggtgtgagctaccgcccctagctgacctcaccaaatactattcagcaatttacctgctaatttatctatctctcccacaggcctgggagctcctggaaggcacagacactgccatgcctggcacaggaaacgtactcagcaaatgttgcttcagtttgaattccaactttttcagccttctgagtttcctttctctccccattaaatgcttcctaggctaatccttcttcctccccctgactcargtcctttcctttctgggtcttaaacttccacacccccttccttgaaggtccctatccgctcacccctgagctgatgctgaacacaggctgtacaggaagacctaagattaatttcttccctttgctggctgcaaaggactctcatggaaggtgaggcactcagagtccatgagactggctgatcataaggactacgaccagctgggtagaagtcagttatggaggaagcacaagttggattcagccaggggtggtggttcacgcctgtcatcccaaactttgggggtccgaggcaggacg

SEQ ID NO: 5533 - DNA, 601 bp, Human
gggagatggaggttgcagtgagttgaggtcactccactgtactccagcctgagcaacaagagcgaacctccatctcgaaaaaaaaaaaaaaaaaaaaaagaatctctgtgtggaagtctgcaaaagcaaccacgttgggtattaggaggaacacaggcctcggctgctgagggtctgctttctaatcccagctctgccaccacaagctttgggcaaggtaccgcctctctgagcctcagtttccttatccaattgatctaaaggtggaatggacatgctggctgttcatcatgactgctgsgaatctctctctagactcccacctccctttgcatccattccccctaccaggcgatgttctgatggctgaagtgaccaaataaaatgcccaggatagtgttggacccagagaagacatgtaataaattagatttctagcatattctatggtccaccagcatcagaatcaggcattctgctggaaatgtaggttcctggaccctccccccgacacttactgagttagaacctctaggatgagggcaatgaaacttgcatttgtaaccagcattcctgatgattctcatgcacatgtccgttg

SEQ ID NO: 5534 - DNA, 601 bp, Human
aggagttccagaccagcctggccaacatggtgaaaccatgtctctactaagaatacaaaaaattagccaggcatggtggcgggcgcctgtgatcccagctactcaggaggttgaggcagaagaatcgcttgaacctgggagatggaggttgcagtgagttgaggtcactccactgtactccagcctgagcaacaagagcgaacctccatctcgaaaaaaaaaaaaaaaaaaaaaagaatctctgtgtggaagtctgcaaaagcaaccacgttgggtattaggaggaacacaggcctcggcygctgagggtctgctttctaatcccagctctgccaccacaagctttgggcaaggtaccgcctctctgagcctcagtttccttatccaattgatctaaaggtggaatggacatgctggctgttcatcatgactgctgcgaatctctctctagactcccacctccctttgcatccattccccctaccaggcgatgttctgatggctgaagtgaccaaataaaatgcccaggatagtgttggacccagagaagacatgtaataaattagatttctagcatattctatggtccaccagcatcaga

SEQ ID NO: 5535 - DNA, 601 bp, Human
caagaccatgcctgcttgctaaccattctagaccttgtgcctggcacatagtgggtcctcagtaaatggtagatattgccaccactgatcatcccacatttacctatgctgatatttggcagatgtccccaagaatctgtgtgtaggccaggtgcagtggctcacgcctgtaatcccagcactttgggaggccgaggtgggtggatcacctgaggtcaggagttccagaccagcctggccaacatggtgaaaccatgtctctactaagaatacaaaaaattagccaggcatggtggcgggygcctgtgatcccagctactcaggaggttgaggcagaagaatcgcttgaacctgggagatggaggttgcagtgagttgaggtcactccactgtactccagcctgagcaacaagagcgaacctccatctcgaaaaaaaaaaaaaaaaaaaaaagaatctctgtgtggaagtctgcaaaagcaaccacgttgggtattaggaggaacacaggcctcggctgctgagggtctgctttctaatcccagctctgccaccacaagctttgggcaaggtaccgcctctctgagcctcagtttccttat

SEQ ID NO: 5536 - DNA, 601 bp, Human
tcccatagcaacctgcttatagttagagatctgtgcaactgtccaagaccatgcctgcttgctaaccattctagaccttgtgcctggcacatagtgggtcctcagtaaatggtagatattgccaccactgatcatcccacatttacctatgctgatatttggcagatgtccccaagaatctgtgtgtaggccaggtgcagtggctcacgcctgtaatcccagcactttgggaggccgaggtgggtggatcacctgaggtcaggagttccagaccagcctggccaacatggtgaaaccatgyctctactaagaatacaaaaaattagccaggcatggtggcgggcgcctgtgatcccagctactcaggaggttgaggcagaagaatcgcttgaacctgggagatggaggttgcagtgagttgaggtcactccactgtactccagcctgagcaacaagagcgaacctccatctcgaaaaaaaaaaaaaaaaaaaaaagaatctctgtgtggaagtctgcaaaagcaaccacgttgggtattaggaggaacacaggcctcggctgctgagggtctgctttctaatcccagctctgccaccacaa

SEQ ID NO: 5537 - DNA, 601 bp, Human
tctgccagggatggctcctctgacataaactcccatagcaacctgcttatagttagagatctgtgcaactgtccaagaccatgcctgcttgctaaccattctagaccttgtgcctggcacatagtgggtcctcagtaaatggtagatattgccaccactgatcatcccacatttacctatgctgatatttggcagatgtccccaagaatctgtgtgtaggccaggtgcagtggctcacgcctgtaatcccagcactttgggaggccgaggtgggtggatcacctgaggtcaggagttccasaccagcctggccaacatggtgaaaccatgtctctactaagaatacaaaaaattagccaggcatggtggcgggcgcctgtgatcccagctactcaggaggttgaggcagaagaatcgcttgaacctgggagatggaggttgcagtgagttgaggtcactccactgtactccagcctgagcaacaagagcgaacctccatctcgaaaaaaaaaaaaaaaaaaaaaagaatctctgtgtggaagtctgcaaaagcaaccacgttgggtattaggaggaacacaggcctcggctgctgagggtc

SEQ ID NO: 5538 - DNA, 601 bp, Human
taactaaggtgatgaatctaactaacatgaactgaggtggaacagtttcatgtacctcagatcatcgggcttagttagattctcataagggaaaccattcttcacaccctgtccatggaaaaattgtcttccacgaagcctggcaccaaaaaggttggagattgctgctataggtcactcaccccaggacctttgcacatgctgttctcacagcctagactctttttctctccatttatttgcctggttaacacttaacacatctttcagatctcttctcaaatccttcttcctcagggaygtcttccctgctcctgctctctgccagggatggctcctctgacataaactcccatagcaacctgcttatagttagagatctgtgcaactgtccaagaccatgcctgcttgctaaccattctagaccttgtgcctggcacatagtgggtcctcagtaaatggtagatattgccaccactgatcatcccacatttacctatgctgatatttggcagatgtccccaagaatctgtgtgtaggccaggtgcagtggctcacgcctgtaatcccagcactttgggaggccgaggtgggtggatca

SEQ ID NO: 5539 - DNA, 601 bp, Human
accgggccgcacagcaggaggtgagctgtgggtggacattaccgcctgagctctgccttcggtcagatcagcggtggcattagattctcgtaggagcgcgaaccctattgtgaactgcacgtgcgagggatctaggctgtgcattcctatgagaatctatgagaatctaactaaggtgatgaatctaactaacatgaactgaggtggaacagtttcatgtacctcagatcatcgggcttagttagattctcataagggaaaccattcttcacaccctgtccatggaaaaattgtcttccaygaagcctggcaccaaaaaggttggagattgctgctataggtcactcaccccaggacctttgcacatgctgttctcacagcctagactctttttctctccatttatttgcctggttaacacttaacacatctttcagatctcttctcaaatccttcttcctcagggatgtcttccctgctcctgctctctgccagggatggctcctctgacataaactcccatagcaacctgcttatagttagagatctgtgcaactgtccaagaccatgcctgcttgctaaccattctagaccttgtgcc

SEQ ID NO: 5540 - DNA, 601 bp, Human
gccttttcttactttgagggcacaaatggagtcttttggtatagaggaaaataaagcctcacctggtctgcacggccctgcgggacccagccctgaccacccttcagcttcacccttcctctctactccagctacacagctggggtccccagccccccgggcctcagaccagtaccagtccatggcctgttaggaaccgggccgcacagcaggaggtgagctgtgggtggacattaccgcctgagctctgccttcggtcagatcagcggtggcattagattctcgtaggagcgcgaacccyattgtgaactgcacgtgcgagggatctaggctgtgcattcctatgagaatctatgagaatctaactaaggtgatgaatctaactaacatgaactgaggtggaacagtttcatgtacctcagatcatcgggcttagttagattctcataagggaaaccattcttcacaccctgtccatggaaaaattgtcttccacgaagcctggcaccaaaaaggttggagattgctgctataggtcactcaccccaggacctttgcacatgctgttctcacagcctagactctttttctctccatttat

SEQ ID NO: 5541 - DNA, 601 bp, Human
ctccggtggctcatgcaacctttctgggctctgttttctcatttgtcaaagcgatgggctgatcccctgccccactccaatcaatcaccaggccctgcccactctactcagtttctctgtctgcctctccctcaccactaccactggcctgggcaaagccaccaccattttctgatgccactcttgccctccccactcaagtcaagttggatcatcttagctccctgctgacaccccttcgagagccgggagacctccaccctgcttgttacacatttttgccttttcttactttgagggyacaaatggagtcttttggtatagaggaaaataaagcctcacctggtctgcacggccctgcgggacccagccctgaccacccttcagcttcacccttcctctctactccagctacacagctggggtccccagccccccgggcctcagaccagtaccagtccatggcctgttaggaaccgggccgcacagcaggaggtgagctgtgggtggacattaccgcctgagctctgccttcggtcagatcagcggtggcattagattctcgtaggagcgcgaaccctattgtgaactgcacgtgcga

SEQ ID NO: 5542 - DNA, 601 bp, Human
gccctgggatgggaggctccagcttagcgtctggctctaacgcttggactgtgtgactccggtggctcatgcaacctttctgggctctgttttctcatttgtcaaagcgatgggctgatcccctgccccactccaatcaatcaccaggccctgcccactctactcagtttctctgtctgcctctccctcaccactaccactggcctgggcaaagccaccaccattttctgatgccactcttgccctccccactcaagtcaagttggatcatcttagctccctgctgacaccccttcgagarccgggagacctccaccctgcttgttacacatttttgccttttcttactttgagggcacaaatggagtcttttggtatagaggaaaataaagcctcacctggtctgcacggccctgcgggacccagccctgaccacccttcagcttcacccttcctctctactccagctacacagctggggtccccagccccccgggcctcagaccagtaccagtccatggcctgttaggaaccgggccgcacagcaggaggtgagctgtgggtggacattaccgcctgagctctgccttcggtcagatca

SEQ ID NO: 5543 - DNA, 601 bp, Human
ggaaagaatttggaggtcacagcactgccctccctgtagatgcttcaaagcaccccactcccttgaagctgccagactctgcaggcagcagggcatggggagggacgaagccaccaggagactgggaagagggactctgccagagcagctgccaggaatctggggcctggagtccatgtttggctggaaggccctgggatgggaggctccagcttagcgtctggctctaacgcttggactgtgtgactccggtggctcatgcaacctttctgggctctgttttctcatttgtcaaagcgaygggctgatcccctgccccactccaatcaatcaccaggccctgcccactctactcagtttctctgtctgcctctccctcaccactaccactggcctgggcaaagccaccaccattttctgatgccactcttgccctccccactcaagtcaagttggatcatcttagctccctgctgacaccccttcgagagccgggagacctccaccctgcttgttacacatttttgccttttcttactttgagggcacaaatggagtcttttggtatagaggaaaataaagcctcacctggtctgcacgg

SEQ ID NO: 5544 - DNA, 601 bp, Human
ccccagcctttggcccctgcgtctcctttctcttcatgacagggcatcagctcgggtccctggaaacacccccgctccccagcaaggggctgtgtttgcacagtggctctggcccctaaaccccacctctgtggactccgtcaaagcctggggagggcagggtcctgagggccctggtctcgctggggtcgcataggtcacatggaaagaatttggaggtcacagcactgccctccctgtagatgcttcaaagcaccccactcccttgaagctgccagactctgcaggcagcagggcatgrggagggacgaagccaccaggagactgggaagagggactctgccagagcagctgccaggaatctggggcctggagtccatgtttggctggaaggccctgggatgggaggctccagcttagcgtctggctctaacgcttggactgtgtgactccggtggctcatgcaacctttctgggctctgttttctcatttgtcaaagcgatgggctgatcccctgccccactccaatcaatcaccaggccctgcccactctactcagtttctctgtctgcctctccctcaccactaccactggcctgg

SEQ ID NO: 5545 - DNA, 601 bp, Human
tcaggagggggatggtttggagcagcgtagggaggtggggcgaggcctgcagagctaagaatccatttaactgagcagcatctcagaggtcttaggtgccaactggggtgacatcagggaagaaaacagaaatcctaagacagcagccagcagcctgcagttacggagcctggatggggaagcagctccccgctgctggggagaccccactgagcacagagagggtctccccagcctttggcccctgcgtctcctttctcttcatgacagggcatcagctcgggtccctggaaacaccccsgctccccagcaaggggctgtgtttgcacagtggctctggcccctaaaccccacctctgtggactccgtcaaagcctggggagggcagggtcctgagggccctggtctcgctggggtcgcataggtcacatggaaagaatttggaggtcacagcactgccctccctgtagatgcttcaaagcaccccactcccttgaagctgccagactctgcaggcagcagggcatggggagggacgaagccaccaggagactgggaagagggactctgccagagcagctgccaggaatctggggcctgg

SEQ ID NO: 5546 - DNA, 601 bp, Human
ctgggggttagagaaacctgggagaccgtggggtgtgtgtgtcgggggtgctggtctctaagacagcagagcctccagtccccagagagggatcagacccaggtccagggtctaagggtgaagaaggggtccagggagaagaaggtgcctaagcaggaagcaggtcctagaacctagtgagaaaaaaggggggcctgaaccccaaagagagatccaaatcttaaggaaaataggggctcaggttcgaggagatgaggttcataataggggggttatatttctggtttcaggagggggatgstttggagcagcgtagggaggtggggcgaggcctgcagagctaagaatccatttaactgagcagcatctcagaggtcttaggtgccaactggggtgacatcagggaagaaaacagaaatcctaagacagcagccagcagcctgcagttacggagcctggatggggaagcagctccccgctgctggggagaccccactgagcacagagagggtctccccagcctttggcccctgcgtctcctttctcttcatgacagggcatcagctcgggtccctggaaacacccccgctccccagcaagg

SEQ ID NO: 5547 - DNA, 601 bp, Human
ctgctccacggagcagacatgaaacaggtacgagaagcaacgagaaggggcggcagcagagcatcaacacacagggagtcctgcctactgtcccgacgccacccagaggctcaaggggtgccccggctgctctccgaagctgccggtggcactttcgccagccaccttgtttccaaacttgctgccagcttcccctagcgcagtgatttccacaacggagctcccggctgtgggaagggggctttctttgacttgtcctaaaatggcctcacctggacccagtggggtgtggggaccaggrggctgggcctggacctatgagcatgtttcctgcctcctctcagcccccatccttctgccgccccacgttctcagccaacaatagctgcttcccagactcagctgccacacagcacgagctccctgagcaaaaatacccatgcgggggagggtggggaggtacaggaggggccacaaatggggagggctgggagaaggggtggcaggatcaagcttgtctcttgagtgcctactgtgtgtcaagctgagaagggtgaagcccctgggggttagagaaacctgggagaccgtggggtgtgtg

SEQ ID NO: 5548 - DNA, 601 bp, Human
ctcagcctcctcacctattaaatggggacacaataggacccacttccttggagttgactgaggtatgaattgagtcaatgcattcattgctcagcacacagcttagctcaaagttaatgctcaataaattgtggttcccacctcctgctccacggagcagacatgaaacaggtacgagaagcaacgagaaggggcggcagcagagcatcaacacacagggagtcctgcctactgtcccgacgccacccagaggctcaaggggtgccccggctgctctccgaagctgccggtggcactttcrccagccaccttgtttccaaacttgctgccagcttcccctagcgcagtgatttccacaacggagctcccggctgtgggaagggggctttctttgacttgtcctaaaatggcctcacctggacccagtggggtgtggggaccagggggctgggcctggacctatgagcatgtttcctgcctcctctcagcccccatccttctgccgccccacgttctcagccaacaatagctgcttcccagactcagctgccacacagcacgagctccctgagcaaaaatacccatgcgggggagggtgggg

SEQ ID NO: 5549 - DNA, 601 bp, Human
gtgccagttcctcatccagattgaaatttgcttccagctgcctgtccccacaccagaaagggcactccctgctccccatgcaggcttctcatcctcttttgctggcctcctccctcctcgctgtccctggtctttttcagccacaagcaaaacacactcagccttgaagtcagatgctctacagaagcctgcaaaaacagagtcaggagttgtgtggccttggccgagtcacctcacctcaccaagcctcagcctcctcacctattaaatggggacacaataggacccacttccttggagytgactgaggtatgaattgagtcaatgcattcattgctcagcacacagcttagctcaaagttaatgctcaataaattgtggttcccacctcctgctccacggagcagacatgaaacaggtacgagaagcaacgagaaggggcggcagcagagcatcaacacacagggagtcctgcctactgtcccgacgccacccagaggctcaaggggtgccccggctgctctccgaagctgccggtggcactttcgccagccaccttgtttccaaacttgctgccagcttcccctagcgcagtgatttc

SEQ ID NO: 5550 - DNA, 601 bp, Human
aagaaaaattcctctggactttcctgaacgagctttatggctgactcactgccacctggagcctgcaagaaaagtcacaaatcacgaaagaaggagaaaaacagttctcgttaagccatgtcttcaatggaggtatcagaggtcgccaggaggaaagcacacatgttttgttgtgggtttccttctctaaagaaacacgttacacaatagaggggggttgagactggttgcaaaactgcaaaatccaattttgtgtactggattcaatttcttcattagctgacactaaacacagagacgkggcccttgtgactagatgaaccataaactggctccaggaccaccaacctggtacctgatggcttgtttctgctccccactctttccctccatgcatctttctctgagcttctgctcaaggcaggtgccaggacaagccagcgtctcgagcggttccccttcagcggtgagaagtaacgtcacaattaaggggcaagaggggccagaggacagaacagtgccagttcctcatccagattgaaatttgcttccagctgcctgtccccacaccagaaagggcactccctgctccccatgcagg

SEQ ID NO: 5551 - DNA, 601 bp, Human
ctgacagggacactccacccactcagcccagtgtgcttctgtccagggagactccaacggctgccacagctgtggtttactgacttcaggtctgactgccctctccagagctgccctagaatccctttgtctgtggctgaagtgtccctcagagctgaggaacaagtttggagaggaccaggaggggctctccccacccccgcccctttcccacatgaagagaaacatttcagggttgaaaaaatgactcattctccccagagagggctggagctgagctgagtcaggcagaaggagcccrcgggtcacttaatcggcctccctgctctggcagagatggctctgggccccaggaagccagggacaaatggaggcggaggtggcagagataagcagctagtggagtgtgccagcctctccttccccaaccgagtgtgtcactgggcgtcacccagcactgctcaagttgaacctgatgcagaagaaaaattcctctggactttcctgaacgagctttatggctgactcactgccacctggagcctgcaagaaaagtcacaaatcacgaaagaaggagaaaaacagttctcgttaagccatg

SEQ ID NO: 5552 - DNA, 601 bp, Human
gcaatggtgcaatctcggctcactgcaacctccaccacccgggtttcaagctattttcctgcctcagcctccttgagtagctgggattacaggtatgcaccaccatgcccggctaatttttttgtatttttagtagagatgggtttttgccatgttggtctggctgacctcaaactcctgacctcaagtgatccacctgcctcagcctcccaaagtgctgggattacaggcatgagccacttcacccggcctgttttgtttttaaagagacaaggtctcactctgttgcccaagctggagygcggccttgaccatagcccatgcagcctcgaccatagctcatgcagccttgacctcctgggctcaagcgatcctcttgcctcagcctcccaagtagctgggactacagatgtgcaccaccacacccgggctcatatagcttcttaactgggtgggcagaggaagcagggggcagaggcccatccccaagggagaaaccatccatcagtgcgggactgacagggacactccacccactcagcccagtgtgcttctgtccagggagactccaacggctgccacagctgtggtttactgactt

SEQ ID NO: 5553 - DNA, 601 bp, Human
gcactttggaaggctgagatgggaggatcacctgagcctgggagttcgagactgcaaagagctgtgattgtgccactgcactccagcttgggtaacggagtggcaccccgtcccaaaaaactaaaaataaaataaaataaaataaaataagccttgccttcatgaaacttatatgctagtaggagacagaataaataagacaaatcaaatatgcagcatgttagactgtgggaggggctaaggggagcaatgaggtagtgaagggagacagaaaatgggagatgggggcaattttctttcttttttttttttttttgagacatagtttcactccattgcccaggctggagtgcaatggtgcaatctcggctcactgcaacctccaccacccgggtttcaagctattttcctgcctcagcctccttgagtagctgggattacaggtatgcaccaccatgcccggctaatttttttgtatttttagtagagatgggtttttgccatgttggtctggctgacctcaaactcctgacctcaagtgatccacctgcctcagcctcccaaagtgctgggattacaggcatgagccacttcacccggc

SEQ ID NO: 5554 - DNA, 601 bp, Human
ttttcctcttaccctctttaaaatcgtgtgcctactacgtgttagcactgttctcgacagatatagcaggaaacaaaacagacaaaatccttgcctttgggccaagtgcagtgttcatgcctgtaaccccagcactttggaaggctgagatgggaggatcacctgagcctgggagttcgagactgcaaagagctgtgattgtgccactgcactccagcttgggtaacggagtggcaccccgtcccaaaaaactaaaaataaaataaaataaaataaaataagccttgccttcatgaaactyatatgctagtaggagacagaataaataagacaaatcaaatatgcagcatgttagactgtgggaggggctaaggggagcaatgaggtagtgaagggagacagaaaatgggagatgggggcaattttctttcttttttttttttttttgagacatagtttcactccattgcccaggctggagtgcaatggtgcaatctcggctcactgcaacctccaccacccgggtttcaagctattttcctgcctcagcctccttgagtagctgggattacaggtatgcaccaccatgcccggctaattt

SEQ ID NO: 5555 - DNA, 601 bp, Human
gtatgagaagctcaaatataaaaattaagcatgaaacctcaagagtggataagctgaccttgagggcgtaggtggagaaaggccctagcctcccagaacaacacagctggaaccggcggggggagggttatggatcaaaatacacaatagccctgactgcaggccggatactctgccaggggctcacatccattcactcattcattttcctcttaccctctttaaaatcgtgtgcctactacgtgttagcactgttctcgacagatatagcaggaaacaaaacagacaaaatccttgcctktgggccaagtgcagtgttcatgcctgtaaccccagcactttggaaggctgagatgggaggatcacctgagcctgggagttcgagactgcaaagagctgtgattgtgccactgcactccagcttgggtaacggagtggcaccccgtcccaaaaaactaaaaataaaataaaataaaataaaataagccttgccttcatgaaacttatatgctagtaggagacagaataaataagacaaatcaaatatgcagcatgttagactgtgggaggggctaaggggagcaatgaggtagtgaaggga

SEQ ID NO: 5556 - DNA, 601 bp, Human
cctttttattttatgatgcaagtaccctactctgatccccagggcaatctcacacactggtatgagaagctcaaatataaaaattaagcatgaaacctcaagagtggataagctgaccttgagggcgtaggtggagaaaggccctagcctcccagaacaacacagctggaaccggcggggggagggttatggatcaaaatacacaatagccctgactgcaggccggatactctgccaggggctcacatccattcactcattcattttcctcttaccctctttaaaatcgtgtgcctactaygtgttagcactgttctcgacagatatagcaggaaacaaaacagacaaaatccttgcctttgggccaagtgcagtgttcatgcctgtaaccccagcactttggaaggctgagatgggaggatcacctgagcctgggagttcgagactgcaaagagctgtgattgtgccactgcactccagcttgggtaacggagtggcaccccgtcccaaaaaactaaaaataaaataaaataaaataaaataagccttgccttcatgaaacttatatgctagtaggagacagaataaataagacaaatca

SEQ ID NO: 5557 - DNA, 601 bp, Human
aaatgcttccattcccacaaccatgggcaccttgtggaggacttggtagcccttagcccagcagacgcccaggcagcctggctgcacagttgccatggaaacaccagtgggttctttgggggcaggagagcaaccagcccttctcacctggccagtgcaaggcgcaggctgaggcacaggttggggctgtgccaggccccccacatgtgtcacactccagggccccaggcctgtgaccaaaatggcagtgccactgctggcataggggatggggacaccagtgtggtggcactgtttggcmctgaggggttggaagttgatctaaccacctagctggggaaaaggacaagaaaacccagcgatggagaggagaggcacaggaaagggggcagacagacaagggcctcttgtcaggaaggacaagaggttctgatctagcactctgctgagagaaagaaacggggaggccgggaagggaagtgggcatggcccccggaagaggacgcacatggatccgccctctgctggaatttgtgcatgtttggtgaaaacccctcactggggctttggagggagggcaggtcccagggctcaggggttg

SEQ ID NO: 5558 - DNA, 601 bp, Human
tggggatgggggtgtggataaaaccaggagaccccacaccccacctgagcccggagtgcagctccctccctaacggctggggacaggtcagtgccacccacctctagcaaatgcttccattcccacaaccatgggcaccttgtggaggacttggtagcccttagcccagcagacgcccaggcagcctggctgcacagttgccatggaaacaccagtgggttctttgggggcaggagagcaaccagcccttctcacctggccagtgcaaggcgcaggctgaggcacaggttggggctgtgcsaggccccccacatgtgtcacactccagggccccaggcctgtgaccaaaatggcagtgccactgctggcataggggatggggacaccagtgtggtggcactgtttggccctgaggggttggaagttgatctaaccacctagctggggaaaaggacaagaaaacccagcgatggagaggagaggcacaggaaagggggcagacagacaagggcctcttgtcaggaaggacaagaggttctgatctagcactctgctgagagaaagaaacggggaggccgggaagggaagtgggcatggcccc

SEQ ID NO: 5559 - DNA, 601 bp, Human
tgcttcctcaggatctaagaccgcttggaaggggccagttggtgtgattcccaggtccgaatgaaacagagctgcgtccccggccaccctttggtctggtcttgtctccctcctcctctgcctgaagctccctcactgctgccccacctggctcatgtcgggagctggaacaacttctgaagtcagcattatatgccccttttacagatgaagaaacaggggctcagaaagaagtggcaaggcggcttctcagtgagatggagtggggatgggggtgtggataaaaccaggagaccccacwccccacctgagcccggagtgcagctccctccctaacggctggggacaggtcagtgccacccacctctagcaaatgcttccattcccacaaccatgggcaccttgtggaggacttggtagcccttagcccagcagacgcccaggcagcctggctgcacagttgccatggaaacaccagtgggttctttgggggcaggagagcaaccagcccttctcacctggccagtgcaaggcgcaggctgaggcacaggttggggctgtgccaggccccccacatgtgtcacactccagggccccaggc

SEQ ID NO: 5560 - DNA, 601 bp, Human
agcgattctcctgcctcagtctccgaagtagctggaattagaggcacgtgccaccacacccggctaatttttgtatttttagtagagacagggttttaccatgttggccaggctgatctcgaactcctgacctcaagtgatccacccaccttggcctcccaaagtgctgggattacaggcatgagccaccgtgcccaccctattttcattttagagaaggagaaactgaggctgagagagggaagaatgcttcctcaggatctaagaccgcttggaaggggccagttggtgtgattcccargtccgaatgaaacagagctgcgtccccggccaccctttggtctggtcttgtctccctcctcctctgcctgaagctccctcactgctgccccacctggctcatgtcgggagctggaacaacttctgaagtcagcattatatgccccttttacagatgaagaaacaggggctcagaaagaagtggcaaggcggcttctcagtgagatggagtggggatgggggtgtggataaaaccaggagaccccacaccccacctgagcccggagtgcagctccctccctaacggctggggacaggtcag

SEQ ID NO: 5561 - DNA, 601 bp, Human
ttaatactgttttatgagtaattgaagagtttggccagaagtcagtgggtcctgagaatacaacctaaaaataaatagaaaattcttggccagactgtgctaagcactttccatgtattatcaacgcctcgcagcaaccccaggagatatggtatgccatcatccttcatttgcatagacagggaactgaggctcagagaggttgagtcactcacagggggtcacacagctccctgaaggacgcacgtgtctgttccagagcctgtgctcttatcttccacactcacccaagctcctatargggccgcagcctcatctctgtgtctttcttccccacccttccttcattctgcggagggttcctgaggtccccagcctcctctaggccatggagtcctgggagctgccagcagcgtggagctcggctgtgcagcctcccctgcctactgccgaggtggtgccttgaggagctgtgatggtcttcccttgccctgggtctgagcctctaggatcctgctgctgcagaacctcctggtttggaaaaggggaaaggagctgtctgtaactcatcatttaacccatgccaggcaccgcgcagata

SEQ ID NO: 5562 - DNA, 601 bp, Human
ccagccgtcaacagctgtatgggctcaaacaggtcaccggacttctcatttataaaatggggatggtgacagggccaaccccacagaggactgctacgatcaaatgggataatgagaggtaggcgctaagcacgttgcctgcagggctcatggaaggtgctggagaaataagctttttaaaaaaaatttaatactgttttatgagtaattgaagagtttggccagaagtcagtgggtcctgagaatacaacctaaaaataaatagaaaattcttggccagactgtgctaagcactttccakgtattatcaacgcctcgcagcaaccccaggagatatggtatgccatcatccttcatttgcatagacagggaactgaggctcagagaggttgagtcactcacagggggtcacacagctccctgaaggacgcacgtgtctgttccagagcctgtgctcttatcttccacactcacccaagctcctataggggccgcagcctcatctctgtgtctttcttccccacccttccttcattctgcggagggttcctgaggtccccagcctcctctaggccatggagtcctgggagctgccagcagc

SEQ ID NO: 5563 - DNA, 601 bp, Human
tggtgagacactaaccccgcccacgactatctccaggctccagccgtcaacagctgtatgggctcaaacaggtcaccggacttctcatttataaaatggggatggtgacagggccaaccccacagaggactgctacgatcaaatgggataatgagaggtaggcgctaagcacgttgcctgcagggctcatggaaggtgctggagaaataagctttttaaaaaaaatttaatactgttttatgagtaattgaagagtttggccagaagtcagtgggtcctgagaatacaacctaaaaataartagaaaattcttggccagactgtgctaagcactttccatgtattatcaacgcctcgcagcaaccccaggagatatggtatgccatcatccttcatttgcatagacagggaactgaggctcagagaggttgagtcactcacagggggtcacacagctccctgaaggacgcacgtgtctgttccagagcctgtgctcttatcttccacactcacccaagctcctataggggccgcagcctcatctctgtgtctttcttccccacccttccttcattctgcggagggttcctgaggtccccag

SEQ ID NO: 5564 - DNA, 601 bp, Human
ccgcaggttggacaagctcattcacagattctccccatggattctgtttgaggtttgctgcgtccagctgatacctggtgagacactaaccccgcccacgactatctccaggctccagccgtcaacagctgtatgggctcaaacaggtcaccggacttctcatttataaaatggggatggtgacagggccaaccccacagaggactgctacgatcaaatgggataatgagaggtaggcgctaagcacgttgcctgcagggctcatggaaggtgctggagaaataagctttttaaaaaaaatttaatactgttttatgagtaattgaagagtttggccagaagtcagtgggtcctgagaatacaacctaaaaataaatagaaaattcttggccagactgtgctaagcactttccatgtattatcaacgcctcgcagcaaccccaggagatatggtatgccatcatccttcatttgcatagacagggaactgaggctcagagaggttgagtcactcacagggggtcacacagctccctgaaggacgcacgtgtctgttccagagcctgtgctcttatcttccacactcacccaagctcctata

SEQ ID NO: 5565 - DNA, 601 bp, Human
tgcggcccacgggccgcaggttggacaagctcattcacagattctccccatggattctgtttgaggtttgctgcgtccagctgatacctggtgagacactaaccccgcccacgactatctccaggctccagccgtcaacagctgtatgggctcaaacaggtcaccggacttctcatttataaaatggggatggtgacagggccaaccccacagaggactgctacgatcaaatgggataatgagaggtaggcgctaagcacgttgcctgcagggctcatggaaggtgctggagaaataagctttttaaaaaaaatttaatactgttttatgagtaattgaagagtttggccagaagtcagtgggtcctgagaatacaacctaaaaataaatagaaaattcttggccagactgtgctaagcactttccatgtattatcaacgcctcgcagcaaccccaggagatatggtatgccatcatccttcatttgcatagacagggaactgaggctcagagaggttgagtcactcacagggggtcacacagctccctgaaggacgcacgtgtctgttccagagcctgtgctcttatcttccacactcac

SEQ ID NO: 5566 - DNA, 601 bp, Human
agctaaaaaacaaaggttcatgcataaatctcagaatgttttaagaaagtttatgaatctgtggtgagccgcattcaaagccatcccaggtcacatgcggcccacgggccgcaggttggacaagctcattcacagattctccccatggattctgtttgaggtttgctgcgtccagctgatacctggtgagacactaaccccgcccacgactatctccaggctccagccgtcaacagctgtatgggctcaaacaggtcaccggacttctcatttataaaatggggatggtgacagggccaamcccacagaggactgctacgatcaaatgggataatgagaggtaggcgctaagcacgttgcctgcagggctcatggaaggtgctggagaaataagctttttaaaaaaaatttaatactgttttatgagtaattgaagagtttggccagaagtcagtgggtcctgagaatacaacctaaaaataaatagaaaattcttggccagactgtgctaagcactttccatgtattatcaacgcctcgcagcaaccccaggagatatggtatgccatcatccttcatttgcatagacagggaactgagg

SEQ ID NO: 5567 - DNA, 601 bp, Human
taagaaatattgtcttgggtcacacataaaatacaccaacgatagccgatcagctaaaaaacaaaggttcatgcataaatctcagaatgttttaagaaagtttatgaatctgtggtgagccgcattcaaagccatcccaggtcacatgcggcccacgggccgcaggttggacaagctcattcacagattctccccatggattctgtttgaggtttgctgcgtccagctgatacctggtgagacactaaccccgcccacgactatctccaggctccagccgtcaacagctgtatgggctcaracaggtcaccggacttctcatttataaaatggggatggtgacagggccaaccccacagaggactgctacgatcaaatgggataatgagaggtaggcgctaagcacgttgcctgcagggctcatggaaggtgctggagaaataagctttttaaaaaaaatttaatactgttttatgagtaattgaagagtttggccagaagtcagtgggtcctgagaatacaacctaaaaataaatagaaaattcttggccagactgtgctaagcactttccatgtattatcaacgcctcgcagcaacccc

SEQ ID NO: 5568 - DNA, 601 bp, Human
ccctagtttgtcttggtcccccagagggccaacaagcagtctgggtgtttacattagttcagctgagacaggctgaacaaacacacgcggtcccatggcttctagtgccagcccccacacaccactcgccacccaggctgtcttgagtccacaggtgtccccaccccactccagatcttctgtttacactcggcaggagcgtcccatcttttgacttccctgggccacaatgtaagaaatattgtcttgggtcacacataaaatacaccaacgatagccgatcagctaaaaaacaaaggtkcatgcataaatctcagaatgttttaagaaagtttatgaatctgtggtgagccgcattcaaagccatcccaggtcacatgcggcccacgggccgcaggttggacaagctcattcacagattctccccatggattctgtttgaggtttgctgcgtccagctgatacctggtgagacactaaccccgcccacgactatctccaggctccagccgtcaacagctgtatgggctcaaacaggtcaccggacttctcatttataaaatggggatggtgacagggccaaccccacagaggactgcta

SEQ ID NO: 5569 - DNA, 601 bp, Human
gctcgtaatccaagcactttgggaagccaaggtgggtggattgcctgagcttaggagttcgagaccagcttgggcaacatggtgaaaccccgtctccactaaaatacaaaaaagtagccaggcgtggtggtgtgcgtctataatcccagctacttgggaggctgaggtgggacaatcgcttgaacccgggaagtggaggttgcagtgagccgagatcgcatcactgctttccagcctgggagacagagcgagactccgtctcaaaataataataatcataatcataatcataatcataatmataaagtggactacgcagggcttttctagagacatgataagacctcgtgtctaaatggcctggtacatactagggcctccataaatgccggctccatgctgcccccacctctgtccaccagggcacccccggcaccaagggccagactccctctgctgcccccaatctgcttctcagactttctgctcctggccttcctgggagccctccaagccagcagctgtgccctcccctctgtgaactgggcaggaaagccaggctccatccctgtccaactctcctcagcctctcctgagacct

SEQ ID NO: 5570 - DNA, 601 bp, Human
aataaagtgaggccaggcacggtggctcaagctcgtaatccaagcactttgggaagccaaggtgggtggattgcctgagcttaggagttcgagaccagcttgggcaacatggtgaaaccccgtctccactaaaatacaaaaaagtagccaggcgtggtggtgtgcgtctataatcccagctacttgggaggctgaggtgggacaatcgcttgaacccgggaagtggaggttgcagtgagccgagatcgcatcactgctttccagcctgggagacagagcgagactccgtctcaaaataatmataatcataatcataatcataatcataatcataaagtggactacgcagggcttttctagagacatgataagacctcgtgtctaaatggcctggtacatactagggcctccataaatgccggctccatgctgcccccacctctgtccaccagggcacccccggcaccaagggccagactccctctgctgcccccaatctgcttctcagactttctgctcctggccttcctgggagccctccaagccagcagctgtgccctcccctctgtgaactgggcaggaaagccaggctccatccctg

SEQ ID NO: 5571 - DNA, 601 bp, Human
tgagcccctgctccccaactcaaggtggggtcctaaccaccttgcatccaaacagatcctctggagacgcacgagtgggtcagggcagtcaagagctgtgcaggctcagacaggtcatgtgacttctgtaggtccctggctttagcaggtgtggccgaaggtgtggggtgccagtgtctgtctcctggttcaaatccaggctcggggtgtgaccccaatgttcttgaacttaaatcagagccaccgcgatctctttctcgaagtggggacaaaacacatgcaaagcagggcctgcccctcmaaggtgcaccttgaaggtatcagacggcatggacgaggtcccctcgctggctgctgtgacggttaaacgattcttcccagctctgcacaactcaagtgatagctgttggactcggagatgaacaagagtgagggaaacggtgggggagagcagtgggcaagacctggcgtggcaagtggggagcaggaggccctcgtgtggactcgcagagacccaaacccaatgaaacaagtaccctgctggcgcatgtgcaggaactgatcagcgttcctgagggcccaaggacatttccagggcaca

SEQ ID NO: 5572 - DNA, 601 bp, Human
ctctcctgagcccctgctccccaactcaaggtggggtcctaaccaccttgcatccaaacagatcctctggagacgcacgagtgggtcagggcagtcaagagctgtgcaggctcagacaggtcatgtgacttctgtaggtccctggctttagcaggtgtggccgaaggtgtggggtgccagtgtctgtctcctggttcaaatccaggctcggggtgtgaccccaatgttcttgaacttaaatcagagccaccgcgatctctttctcgaagtggggacaaaacacatgcaaagcagggcctgyccctccaaggtgcaccttgaaggtatcagacggcatggacgaggtcccctcgctggctgctgtgacggttaaacgattcttcccagctctgcacaactcaagtgatagctgttggactcggagatgaacaagagtgagggaaacggtgggggagagcagtgggcaagacctggcgtggcaagtggggagcaggaggccctcgtgtggactcgcagagacccaaacccaatgaaacaagtaccctgctggcgcatgtgcaggaactgatcagcgttcctgagggcccaaggacatttccag

SEQ ID NO: 5573 - DNA, 601 bp, Human
ggcctctcctgagcccctgctccccaactcaaggtggggtcctaaccaccttgcatccaaacagatcctctggagacgcacgagtgggtcagggcagtcaagagctgtgcaggctcagacaggtcatgtgacttctgtaggtccctggctttagcaggtgtggccgaaggtgtggggtgccagtgtctgtctcctggttcaaatccaggctcggggtgtgaccccaatgttcttgaacttaaatcagagccaccgcgatctctttctcgaagtggggacaaaacacatgcaaagcagggcytgcccctccaaggtgcaccttgaaggtatcagacggcatggacgaggtcccctcgctggctgctgtgacggttaaacgattcttcccagctctgcacaactcaagtgatagctgttggactcggagatgaacaagagtgagggaaacggtgggggagagcagtgggcaagacctggcgtggcaagtggggagcaggaggccctcgtgtggactcgcagagacccaaacccaatgaaacaagtaccctgctggcgcatgtgcaggaactgatcagcgttcctgagggcccaaggacatttc

SEQ ID NO: 5574 - DNA, 601 bp, Human
cggcctctcctgagcccctgctccccaactcaaggtggggtcctaaccaccttgcatccaaacagatcctctggagacgcacgagtgggtcagggcagtcaagagctgtgcaggctcagacaggtcatgtgacttctgtaggtccctggctttagcaggtgtggccgaaggtgtggggtgccagtgtctgtctcctggttcaaatccaggctcggggtgtgaccccaatgttcttgaacttaaatcagagccaccgcgatctctttctcgaagtggggacaaaacacatgcaaagcagggyctgcccctccaaggtgcaccttgaaggtatcagacggcatggacgaggtcccctcgctggctgctgtgacggttaaacgattcttcccagctctgcacaactcaagtgatagctgttggactcggagatgaacaagagtgagggaaacggtgggggagagcagtgggcaagacctggcgtggcaagtggggagcaggaggccctcgtgtggactcgcagagacccaaacccaatgaaacaagtaccctgctggcgcatgtgcaggaactgatcagcgttcctgagggcccaaggacattt

SEQ ID NO: 5575 - DNA, 601 bp, Human
aagcccggttccattcctgcccagttctcttcggcctctcctgagcccctgctccccaactcaaggtggggtcctaaccaccttgcatccaaacagatcctctggagacgcacgagtgggtcagggcagtcaagagctgtgcaggctcagacaggtcatgtgacttctgtaggtccctggctttagcaggtgtggccgaaggtgtggggtgccagtgtctgtctcctggttcaaatccaggctcggggtgtgaccccaatgttcttgaacttaaatcagagccaccgcgatctctttctcraagtggggacaaaacacatgcaaagcagggcctgcccctccaaggtgcaccttgaaggtatcagacggcatggacgaggtcccctcgctggctgctgtgacggttaaacgattcttcccagctctgcacaactcaagtgatagctgttggactcggagatgaacaagagtgagggaaacggtgggggagagcagtgggcaagacctggcgtggcaagtggggagcaggaggccctcgtgtggactcgcagagacccaaacccaatgaaacaagtaccctgctggcgcatgtgcaggaact

SEQ ID NO: 5576 - DNA, 601 bp, Human
tatttaacagatgggggtgataaggctcagaaaggttaagaggcttgcctaaaatcacacagctaataagtggcagatctgtaatttgagcccaggtctgctcatgtcccaagcaaataattctttggttggttcaggctgccacctccatccaactgcagctgaatccgatgcctactggggtcccaacctttgcagttccccaatggatcaacctcagagatgagctgtcactcagccccaatgtctggggtatcccaggccaaaggtgatctaccagctggtgccacctcaccctcayggcgtctaggacaacctggaaagtcctaggggcttgtatataggcaactaggcattaaaagctgctcctggccgggcatgggggctcaggtttgtagtcccagcactttgggaggccaaggcaggcagatcacttgaggtcaggagtttgagaccagcctggccaacatggtgaaactccatctctactaaaaatacaaaaattagacaggtgtggtagcgcatgcctgtaatcccagctacttgcgaggctgaggtgtgagaatcacttgaacccaggaggcagaggttgcagtgagct

SEQ ID NO: 5577 - DNA, 601 bp, Human
gtgctgaggctgcagctgctaaacggtaacaccaacgacatggcaccagcaaaagccacatcttgagcaatgacttcattctaggttccgtgctaagcactttacgtgtgttttctaattaaccataacagcaaccccacgtgaaagatgtggaataagagacacagagaggttaagtaacaagtccaaggttgcacagctggtaaaaagatgggatcaaatttgaacccaatttctacccgatactcaggcattatgggagcctgcagaatggcgtgggagttctgggaagggggcgctrgctaggcccttcctgggacactcacgcagccacattcccaaaccccctcccgggcccccaaattcctggctcggtagtgatacagcctgagctcctcctctccctccagggcttggctcagttcagtcccattcgggagccaatctgccattgcacaattaacaattaggaacaacttttcttttcttccaaggcagggatcggccccagccctggtgacagggacacagtggggcttctgacagaacctactaggtatgtccccagccccttgccaagctgggtgacccctttcctaac

SEQ ID NO: 5578 - DNA, 601 bp, Human
ggctgcagtgagctgtgattgcatccctgcactccagcctgaaagacagagtaaaatcctgtctcaaaaaaataattttaaaaatttaaaaaattagcctggtgtggtggcacacacctatcatcctagccactcaggaggctgaggcaggaggatcgcttgagctcagggaggtcaaggttactgtgagctatgattgcgccacttctctctggccttagtgacaaagcaagaccctgtctcttaaataaataaataaaaagagcaagcagcatccccagctgacacagcacgtgtcccrtgtgctgtcctgtcactgagaggtaggaggatgcagcaggctggagtgtggtggacatgggtctataccgcctgtattcaaatcccagctctgcctactactatttgtttgacttgggcaagtgatatgacctccctgtgccttggtttatcattaaaaaaacaaagctaataatagccccactctcataggtagctatgagaattaaaatagttcaaagacacaaagtattgtgatcaccagcactgctatttgatcctctcatgcagatgtaaggtaaatactatcattgtctctcat

SEQ ID NO: 5579 - DNA, 601 bp, Human
ttttttaattagtctggtgtggtggcacatacctatcgtcctagctactcaggaggctaaggcgggaggatcgcttgagctcaggagttcaagaccagcctggaaaacaatgcaaaaccttgtctctacaaaaaatataaaaattagctgggcatggtggggggcacctgtagtcccagctactcaggaggctgaggtgggaggattgcttgagccccaggaggctgaggctgcagtgagctgtgattgcatccctgcactccagcctgaaagacagagtaaaatcctgtctcaaaaaaataattttaaaaatttaaaaaattagcctggtgtggtggcacacacctatcatcctagccactcaggaggctgaggcaggaggatcgcttgagctcagggaggtcaaggttactgtgagctatgattgcgccacttctctctggccttagtgacaaagcaagaccctgtctcttaaataaataaataaaaagagcaagcagcatccccagctgacacagcacgtgtcccatgtgctgtcctgtcactgagaggtaggaggatgcagcaggctggagtgtggtggacatgggtctataccgcc

SEQ ID NO: 5580 - DNA, 601 bp, Human
ttttaaatttaaaaaattggccggatacagtggctcacacctgtaatcccagcactttgggaggctgaggcgggcagatcacttgaggtcaggagttcaagaccagcctggccaaatggtgaaaccccatctctattagaaatataaaaattagccgggcatggcagtgcatgcctctaattccagctactggggaggctgaggcacaagaattgcttgaacccaggaggcggaggttgcagtgaactgagatcatgccactgcactccagcctgagcgacagagtgagattctgtctcaaaaaaaaaaaaaaaaaattttttttttaattagtctggtgtggtggcacatacctatcgtcctagctactcaggaggctaaggcgggaggatcgcttgagctcaggagttcaagaccagcctggaaaacaatgcaaaaccttgtctctacaaaaaatataaaaattagctgggcatggtggggggcacctgtagtcccagctactcaggaggctgaggtgggaggattgcttgagccccaggaggctgaggctgcagtgagctgtgattgcatccctgcactccagcctgaaagacagagt

SEQ ID NO: 5581 - DNA, 601 bp, Human
gatggtctcgatctcctgacctcgtgtcgtgatccacccgcctcggcctcccaaagtgctgggattacaggcgtgagccactgtgccaggccccagctggattttctaacaaaacaaacatcttggctcacattgcctcagagggagggagggaggatcatcaggcaggagacgatccaggagttcagatgctgctgctagatttctctcccctgcctcatcttccatgcctcatcttccccttgtgtgttaccttcactctcatctctgagattagacatccttcacacccagagaattyggccaggcttaccttgtggtagctgagagccctagagaaaaaaaaccttctctctccctgggctgaattagaaagtcccagggaagaactctgattggccaggcctgtttcctgtgccctcccctgtgacttagtagaggtggggcctgatgctgtgattgacagcctggttaatcggctaaactcagtaggcgtgtcccatgcaccacaaggaattggggaggaacaattcccaaaggaaggaggttgctgttagcagaagaaaggcaaaacaacctgtgtccacatcatccctcctgc

SEQ ID NO: 5582 - DNA, 601 bp, Human
ggctatttcttgtatttttagtagagacggggtttcaccgtgttagccaggatggtctcgatctcctgacctcgtgtcgtgatccacccgcctcggcctcccaaagtgctgggattacaggcgtgagccactgtgccaggccccagctggattttctaacaaaacaaacatcttggctcacattgcctcagagggagggagggaggatcatcaggcaggagacgatccaggagttcagatgctgctgctagatttctctcccctgcctcatcttccatgcctcatcttccccttgtgtgtyaccttcactctcatctctgagattagacatccttcacacccagagaattcggccaggcttaccttgtggtagctgagagccctagagaaaaaaaaccttctctctccctgggctgaattagaaagtcccagggaagaactctgattggccaggcctgtttcctgtgccctcccctgtgacttagtagaggtggggcctgatgctgtgattgacagcctggttaatcggctaaactcagtaggcgtgtcccatgcaccacaaggaattggggaggaacaattcccaaaggaaggaggttgc

SEQ ID NO: 5583 - DNA, 601 bp, Human
aagaggccctgcccccttgagagggaggccctgcccccttgagaggttggccccgccttgagcatccttgtcaggcagagatctgggcaggacagaagagaggaggtgcctggctcagttttgctgcgatcccaatgggtcacacgccttctggatccccccagaaggtctagaatggggtcacccctcaaaacctccctggctcactcttagcttggaaccatgaacgagcttgctcccacccacatggaaagcagctgcccttcccctggagacattttccacttctctacctccagayctctgctcatgctgtttcctccacctggtaaacctcactctctgctgtgctgtcagaaaatggccaaccttttgagtctcagctgaaatggcactccctttgccccagctttagtttaacaagcatttgtgcatgctctggagatgggctgtcctgccctcatacaccctgctagggcctagccaatgagggacaaccggaagtcttaccctccagcccccaccccggagaccacctgtgtaggacccccaggggttgccaggatcctccccacaaacggcaaagcactctctatttggg

SEQ ID NO: 5584 - DNA, 601 bp, Human
ttaccccagcccgggccctgtaatgctggctttaacatttccaaagcgggctcgttccctttaattcacttttgctcttcacagcgactctggggggctggagctagcatctccacatcatgggtggaagatagatctcaaggtcagacacatttggctgcttagcagctgtgtgatgttgagcgagtcatgtcacctctcggagcctcaatttcctccctctgcatggtgagggtggcagtggcttccttgccgggggttatgagcatctagtgagacaccactagagtctgtgtaaagygccaagcacagtggctggcacatattaagtatttcataaaaagcaagttttaaacatgatcactacagtcattgatgtgaggacgtcagcagcagaggggcctccagaggacattttcttgcaccccaggaggcattcctgtcatttgtccccactgggtctggggctggggcttctttgtacctctgaggtacaaagtggaagctctgcctggctggcaagaccagacctgttgtggcggccaggctgtacccacgcagggccactgctcctagggcactgggctccagacagaaaatg

SEQ ID NO: 5585 - DNA, 601 bp, Human
gacttgagtgaatcccaactcaggcctccgacaactgtaaatgttccagcaaacctctcctctgagttttcgttttctctgtatagagaatggcataacaatctgtccctcactctcaaaactgggcacatacaccaacgtcctcagggtcgctcagaccaccggggccaagaaggactcacaggagaaccgctgtgtcagcagtcccatctggaaattctagaacaggagggaggcaagggagctgtgtaaggggcagtgggagcatttcagttcgtgagagtggcctctggaaagggcrggtacgggtggtaaagagacaacaggctgggctccactctgtgggtttgggagggagggctgctgagcacagggaaaaatctacgttcgcccccatgcctggtggctggaatctgagctggaaaacagcatcagacacccacaaataccgctgtggtcatggtggcaggacagggagccacctcgatccccagagagaaccctctgttctgagtggaatggaccccccatcagggcagactgatacagggcctgccccaagggctgctaggaacaaagagggctggctgggccctgagca

SEQ ID NO: 5586 - DNA, 601 bp, Human
actaatagagagcacttaggacaggacctgaaacaaaggaagcactcaggaaataccagctgtgattattactaacattccaactggcccaaggcagaactcacaaactggccatctggcccacagatgtgaattatttggcctacggcactaggaattttgttgttgttgttgttttttgagacagggtctcaatctgtccctcaggctggagtacaggggcaccatctcagctcgctgcaacctccgactcctaggctcaagcaatgctcctgcctcagccttccgagtagctgggacyaggaggcatgcgccatcatacctggctaattttttgtatttttaatagatagggggttttgccatgttggccaggctggtctcgaactcttgacctcaagtgatctgcctgcctcgacctcccaaagtgttgggattacaggcatgagtcaccgtgcctggcttagaaaagtttttgaaatgtaacactttggggatattatttcaaaaaaatgaatagtttccattttccttaaaaaaaaaaaagggccgggcgcagtggctcacgcctgtaatcccagcactctgggaggctgaggca

SEQ ID NO: 5587 - DNA, 601 bp, Human
atgcacagaacgccagagtgggagccagaagtcctggcatgagttcaagccgagtgctccctgggcctcagtttcctcccctggcccgccctgccccctttggaggtggaaggtgatgacggaaatgtagcagtgttttgcctggtgatgtttatattcccctcccgtaccttccccaaatgacaggcttgtccagatgaatcaccagggggcaggaatgccccagctgttggcccctgggcagcagcagcctgccgtggccctgggcctgggctggctgatttctctatcctcatctccmgctctcccctgccaccccccgggcctgggctctacccagccaggctcctgctatttctgcccccacttgcccagtgctttctatgcctctcatggctcctcatccactaggcttccatctacccagccccaccactggctgctttcccagaactccctaaaactgggctccaccaactgatagccaaggtgcccagacatgcaaagtgcccgagccagggcaatcccagcagggtggggccgtggtactctctcctcacctgttcagggaggtggcaccgtggtggctgtcaaagctccg

SEQ ID NO: 5588 - DNA, 601 bp, Human
atgtggagctgcaggaaagcacgtgaggcccaagtgcggcccaaaactgcatggcattctagcaggcagtgcattctcagagtggggagacccagcgggtattaggtcttagtcagaaaccaaccttagccccaaaggaaccagcagcttaacaggctaagttccccacgtccagccccacgccacctgttccaggaggccctctttgaacagtcctgccacctccccctcttctggcccaggccccacaccaagccccttgctgtgcaccagggtggtgctaagcgccctacacacatcactctttttaatcctgccaacaactttctggctctgtgacccggggagtctacctgtctgagcctcgactttctcattggtgaaacggtgatgataacagctcgtatctcagaactgggtgtgaggatcaaattaggaaaatccgttaataatggcaaatacttatttggcacttactgcatatcaggccctgactcggtgacttacaagtaagataagggccagagaggatctggatgtgtctgctggccccttcctgccatgccccttctcaggctccagaaatgaccacagacccttt

SEQ ID NO: 5589 - DNA, 601 bp, Human
gatgtggagctgcaggaaagcacgtgaggcccaagtgcggcccaaaactgcatggcattctagcaggcagtgcattctcagagtggggagacccagcgggtattaggtcttagtcagaaaccaaccttagccccaaaggaaccagcagcttaacaggctaagttccccacgtccagccccacgccacctgttccaggaggccctctttgaacagtcctgccacctccccctcttctggcccaggccccacaccaagccccttgctgtgcaccagggtggtgctaagcgccctacacacatcactctttttaatcctgccaacaactttctggctctgtgacccggggagtctacctgtctgagcctcgactttctcattggtgaaacggtgatgataacagctcgtatctcagaactgggtgtgaggatcaaattaggaaaatccgttaataatggcaaatacttatttggcacttactgcatatcaggccctgactcggtgacttacaagtaagataagggccagagaggatctggatgtgtctgctggccccttcctgccatgccccttctcaggctccagaaatgaccacagaccctt

SEQ ID NO: 5590 - DNA, 601 bp, Human
ggaggtggaggttgccgtgagccgagattgcaccactgtacttcagcctgggtgacagagtgagaccctgtctcagaaaaaaaaaaaaaaaaaaaaaaaaaaaggccaattcaacagccatctcctgcaagttctgtgatgccaggccctcaccacaaccctgtgtggtaggtagcactgttcccatttgacagatgaggagactgaggctcagagaggtgacatggccaccttgaggccagaccgccccttccaggccaggctcactaggctcccctgatgtggagctgcaggaaagcaygtgaggcccaagtgcggcccaaaactgcatggcattctagcaggcagtgcattctcagagtggggagacccagcgggtattaggtcttagtcagaaaccaaccttagccccaaaggaaccagcagcttaacaggctaagttccccacgtccagccccacgccacctgttccaggaggccctctttgaacagtcctgccacctccccctcttctggcccaggccccacaccaagccccttgctgtgcaccagggtggtgctaagcgccctacacacatcactctttttaatcctgccaaca

SEQ ID NO: 5591 - DNA, 601 bp, Human
gctcacccactggaggcagcacatgggggctgtgggacacgcagggttccctgctgctggcctgctggctgccaccattccagctggacaacagtatccccaggaggcggctgagaagcagggagaagaacaccaggcttggagtcaggtgggtggctctgggcaggtcgtgtccctctctggggcccattttcctcacctctaagagagggatggtaacactgcactcatcaggggtcctaaggacaaaattgcatcacacatgtgaaaaggctttgcaacggaaagactgccctgaatracttttttttttttgagacagagtcttgctctgttgccctagctggagtgtagtagtgcaaactcagctcactccaacctccgcctcctgggctcaagcaattctcctacctcagcctcccaagtagctgggaccacagacatgttccaccacacccggctaattttttatatttttcatagagatgaggttttgccatgttggccaggctggtctcaaactcctgacctcaagtgatctgcccgccttggcctcccaaagtgcttggattacaggcgtgagccaccgtgcccagccctg

SEQ ID NO: 5592 - DNA, 601 bp, Human
cactctagcttgggtgacagagcaagaccctgtctcaactacaaaaaaaagagagagaaataaaataaaataaagtaaaacaaaacaaaacagagtcattgaccttgacattgcccagttctcaaggctcttttactcttgtgtcttacaatcaccatgtgggataagtcctgggatccccattttacagatgcagagactgaggctcagagaaaggaagcagcttgccagagctggagcccaaacccagatcttcctggttatctcagggcctcacctcctttttttgtgcctcctaccyggggcctggctctgtaggctaacttcctttagaggctacgggccacccatctgggatgtgggaaatagggacagatataactgctggggcctggagagggagactcccctttgtaccaagggctcagatggaactgagggcctgtgcaggggaaggcagcaggtgggcaggggctggggaggcctcaaggtgagactcagggagacactggaaggccaagggcacagggcagaggtaggaggtcaaggttgctaactgccccttggagaaggcagcagccctgccagcctgtgagccaac

SEQ ID NO: 5593 - DNA, 601 bp, Human
aaagtgcttggctgggcatggtgactcatgcctgcaatcccagcacctggggagacccaggccggaggattgtttgaggccaggagttcaagaccagcctgggaaacacagcaaaaccctgtctcaaaaaaacaaaaacaaaaacaaacccaagtaacacaactttgggcaagggataagatataaaaatatggctatcatttctaaagatatgccacttgacatttattattattacattatccattatatttcccagtatttttcaccagagaaatttccatgtgattagcttattttwaaatttactatgaagttcctgaaagtgtaaactgcttctttactttttaataacaggaatcagcttgtatctcttttttctttggctgccaggaaactcatagccaaatcagaaactcgcctatgggcactttcttggcctttaggttcagctttttccttgtccacattttccactctgttttccgtgattctgattttccatttggtattgcatgtcgttttactgaatgtattttatttataacctatcatgaatcctttgtggaacagagttagaaacaacatttatcaggcaatt

SEQ ID NO: 5594 - DNA, 601 bp, Human
gccaaaggcgggggattgttaagtcatcttggggtgatgaggtggaaaagggaagccccacatgtgaaattctgaggcctgggactgagccacaccctccacagctactttcacattgtctctaagcctcagctccttagagacgctgccctttgtggccgaagtccccatcagttactacttttggtgctggtaattggctgggatctgttcaatctttacatgtcatctaaaacacactcatattatctggtagctaaacacttatatttcacagatgctataatgtagtgggtaaaakctctggatctaaacctcatttcagatccccagtctgaacttcccaactctgtgaccctgagcaagtgactcagcctctctgtgcctcagtactcatctgtcaaatgaggaggatgatgataacaatagtacctccctcataggactgtggtgacacttaaatgagttaatatagataaagtgcttggctgggcatggtgactcatgcctgcaatcccagcacctggggagacccaggccggaggattgtttgaggccaggagttcaagaccagcctgggaaacacagcaaaaccctgtct

SEQ ID NO: 5595 - DNA, 601 bp, Human
ccacccttgtaaatcaaaggcctgtggtgagcagaaacgagaaatataaacacgcacaggtttctggcgacaaaagcctcctggcctggtagcacctgggcatgaccccctttgcccagacgacattagtcactcatatggctcttgcgtttggttggccaaaggcgggggattgttaagtcatcttggggtgatgaggtggaaaagggaagccccacatgtgaaattctgaggcctgggactgagccacaccctccacagctactttcacattgtctctaagcctcagctccttagagaygctgccctttgtggccgaagtccccatcagttactacttttggtgctggtaattggctgggatctgttcaatctttacatgtcatctaaaacacactcatattatctggtagctaaacacttatatttcacagatgctataatgtagtgggtaaaagctctggatctaaacctcatttcagatccccagtctgaacttcccaactctgtgaccctgagcaagtgactcagcctctctgtgcctcagtactcatctgtcaaatgaggaggatgatgataacaatagtacctccctcatagg

SEQ ID NO: 5596 - DNA, 601 bp, Human
aacttcataatgcctacagaaacagggaacacatctaaaggtcacaggccctggggaggcagggtgcatgggaaagctctgaattctggagacttctgcctcactcccactgggtggaggagtttccattacccatcccagagagagaggggactctgaggctgcttcacttactgctgggttgcagctgggctttttctagaacaggacacttggttacactacgttaccaggtgtcgattgccagaggaaaagacttttgaaaaagaagttcagttcacagaacatctccccggggcaygtgggtggtgtaagggattcacccggctggtgtacgggatttgtcagttcttttataccatctcttttaagcttctcacccttccctcagaagcaggtatcactggttccttttacagagaatgaaactgaggcttggggaagttaactcgcccaggtgtggttaagcgatggctcctcctccttctgtctcatttcagagatttcccccttctggcaagctctcctgaccaccctccagggaccccagacagcatttggtccctggctctgtgtccccacacagccaccctaccccatg

SEQ ID NO: 5597 - DNA, 601 bp, Human
gcaggacgtggtggtatgcgcctgtagtcccagctacttgggaggcttaggtgggagaatcgcttgaagccaggaggtggcggctacagtgagctgtgattgcaccactgcactccagcgtggacgacacaacaagatcttgtctgagtaaataaataaaataaaaaaaaattctgatattaccactcccttgcttaaaaaccctccactgtcctggaatgaaatccaaacccttcaccaggccccatggcccctgcccactctgggccctcatcttgtgctgccagcgccccctcccccmccaacctcctcacacaactcctcagtttctacaagtttcttcttcccccaagacctttgtagctgctgttgtctctatctggaacattttttcctcctctctactcttcccatggtcagctccaacttcagatctcagcctaccagctcctcaaatgtcccaggaaccctaagcagtcccccaaattctctgttacagcatcctgtttgttttcctttacagtacttgttgcagactgttttgtttccatgtctttatcatcactgtctctgtccctctccagaatccacagctttactg

SEQ ID NO: 5598 - DNA, 601 bp, Human
caaaaaatcagctgggcctggtggcatgcatctgtaatcctagctactcaggaggctgaggcagaagaatcgcttgaacccaggaggtcgaggttgcagtgagctgagattgtgccactgtactctagcctgggtgacagagtgagactccatctcaaacaaacaaaccacagaaatctggctgggttcagtggttcacacctgtaatcccagcactttgggaggctgaggcaggagatcacttgagtctaattctaggccagcctgggcaacacggaccccatctctacaaaaagaaaaaatatatatatatatttatatattatatatttttaattagcaggacgtggtggtatgcgcctgtagtcccagctacttgggaggcttaggtgggagaatcgcttgaagccaggaggtggcggctacagtgagctgtgattgcaccactgcactccagcgtggacgacacaacaagatcttgtctgagtaaataaataaaataaaaaaaaattctgatattaccactcccttgcttaaaaaccctccactgtcctggaatgaaatccaaacccttcaccaggccccatggcccctgcccact

SEQ ID NO: 5599 - DNA, 601 bp, Human
aaaaaaaaaaaaaaaaaaaggctgggcacagtggctcatgcctgcaatcccagcactttggaaggccgaggcaggtggatcacctgaggtcgggagtttgaggccaggctggccaacatggtaaaactccatctctactaaaaatacaaaaattagtcacgcatggtggcgcacgcctgtaatcccagctactggggaggctgaggtgggagaattgcttgaacccaggaggtggaggttgcagtgagctgagattgtgccactgcactacagcctggacaacaagcaagactctgtctcaaaaaaaaaaaaaaaaaagagaagagaagagagccctgtgcaaggtgggaaaaaaatgagaaaactataactaagaatttaatatctcacctttctttttttcttaacaacaacaaaaaaagatttttagaagtaattgaatgaatttcaaaggttttggtagacatggccatctgctcctcagttcaggctgcaggtgtaacttcagctatatcccttcctgccgctgaaaatggtgtatgttcaggtgtgggaagatcaggcagctggctttggcagagcaagaggcttcagagcaaaa

SEQ ID NO: 5600 - DNA, 601 bp, Human
ctgattgaggtcccaggtgtgacttctcagactctcaaacctcaaggctatataataggcaaacagagttgataacaactccaggtaaacagacatgtctttttaaagtattgagcgggcttgtccctgaaatcaccctggaaagacagctttggccaggcatgacggctcatatctgtaatcccagcactctgggaggccaatgtgagaggatcgcttgagcccaggaattcaaggctgcagtgagccatgatcacgccactgcactccagcctgggcaacagagcaagaccctgcctcaaaaaaaaaaaaaaaaaaaaggctgggcacagtggctcatgcctgcaatcccagcactttggaaggccgaggcaggtggatcacctgaggtcgggagtttgaggccaggctggccaacatggtaaaactccatctctactaaaaatacaaaaattagtcacgcatggtggcgcacgcctgtaatcccagctactggggaggctgaggtgggagaattgcttgaacccaggaggtggaggttgcagtgagctgagattgtgccactgcactacagcctggacaacaagcaagactctgtctc

SEQ ID NO: 5601 - DNA, 601 bp, Human
tgccttgcctagggacactgacgtatgtgtcctgctgcccctaatttgtttcatccttcctcctttaggcttctcatgtccccattatcatggctcagctcacagggcacaaggaggccgtgagacagtgttttgttttgttttgttttgttttgtttgagatggagtctccctctgttacccaggctggagtgcaatggcacgatctcggctcactgcaacctctgcctcccgggttcaagcgattctcctgcctcagtctcctgagtagctgagattacaggcatgtgctaccacgccyggctaatttttgtatttttagtagagacagggtttcaccatgttggtcaggctgatctcgaactcctaacatcgtgatccacccgcctcagcctcccaaagtgctggactgcacctggatgagaccttggtttaagaggtacccatcagccaggcatggtggctcatgcctataatctcaacactttgggaggctgaggcaggaggatggcttgagcccaggagttcaagaccagcctgggcaacacagtcagaccccatctcttaaaaaaaattaaattaaattagctaggcatggtgg

SEQ ID NO: 5602 - DNA, 601 bp, Human
gctcagctgctcggatctgctcccaaacatcagagagtcaagcagctcggccccgacaggcttgtttttttgtgtcactcgatatgagtggaaggaaaaaactacagcttttccctgtttctccagtgaggagttcaaaaaagaacaggatgtttggacttgcaggcatccagtgagtacccagctgggctctctgcagagcccccacatcagcggggtcagggacaagggtgacacagccatggctcacacttcccagaagcacagacatccttagctcattaaaccctcataatcccaygcaaaaacacgcgagccaccttgttatttttctttttacaagtgaggaaactgaggtccagagaggtgagaccctggcttctcaccacccagctgaatggggacagctgggattggaacccaaagctgttgatgcccgagcccaccagtggatcagaggtggatcctgggagatgttggcagagatgcaaggagaaatagctccattcaggtcctgaaagggaggaaaaatccctccagcctaacagtctagctaaacaggaagggaggcacaatgagaggaagtgcagggtgtggcagg

SEQ ID NO: 5603 - DNA, 601 bp, Human; identical to SEQ ID NO: 1616

SEQ ID NO: 5604 - DNA, 601 bp, Human; identical to SEQ ID NO: 1617

SEQ ID NO: 5605 - DNA, 601 bp, Human; identical to SEQ ID NO: 1618

SEQ ID NO: 5606 - DNA, 601 bp, Human; identical to SEQ ID NO: 1619

SEQ ID NO: 5607 - DNA, 601 bp, Human; identical to SEQ ID NO: 1620

SEQ ID NO: 5608 - DNA, 601 bp, Human; identical to SEQ ID NO: 1621

SEQ ID NO: 5609 - DNA, 601 bp, Human
cttaaattgttaattgtccatttagaatcatttcctgtctcttaagattcgtgtccctttaagaagatctgtccccttttgggtatcttctattgtacctgcctttgaatatcttaaagttttttaaaacaatcagtatttgtcggatctaggttctgttgttgatggataaattgactgacttttcagaatgcagcctctcccagcatttagggtcccaggatggagcaggggacagcagcagagggagacagccatggtcccagctgtgggagggttaaggtgggcagctttatggtayagcacaggtgtcatgatttcacactgggggaggagcccagtgggcagacgggaatccaacaaacattaactaaggatacagctgcaaacaagacaacgtggagctctaatctgaggaaaaaccatcaacacaggggtgaactagaggtgcccaaggcctagtgaagtgcaaagagaactctgaccagagggcttatcgtgcaagcccgatcaccgtgaggctaaggatgattcccgcctacactgaataactaatcctctgataagctgttgttagaactttcattggatcacaacctta

SEQ ID NO: 5610 - DNA, 601 bp, Human
tccactgtcctgccccatcccctctaaatgctaactgctccccagagagtgagcccctcaccattttggactggtggtatatccttgacaaagtcacttaacctctgggagcctcagttgctgcatctataaaatgggaacaacaattccgaagtctggggttgtgaggattaaggaagcagtggctctaaagagcatggtacagtgcacagcgcacggcggacatccgtgtctctccttccttcaggccctcaggctctgcgccccctgcaggttcttgcaggcactgcggaaagggagmtaatgtctgtcccttgtacctgaaggaggtggtgtgggacagaggaaagggcacaagaccaggcatcaagcaagtctcagctctgccactcactagcctatcatgaggacctctccggatctcgctttcctcatctaccaacagagtgagcaacaccttcccagcttccaccctgcaggatcaagtgggatggtgtctacaaaacagctctgtaacctgtcaaatgctgtgcaaaggtcaagggtgaataacagtagcatcaatacaaacagcagccaccacaacatgccaagcctaggc

SEQ ID NO: 5611 - DNA, 601 bp, Human
cagcccatgctggccacttgggggagtggcagagtgaggtgcgaggcatctgtgtgtcctgcagctgaggtcagcatccccagctggcagactgccaggtcatgccacagtggcacctggcctagttcggcccacctgctacagaactgcctggattgcctctgaggagcctagcatgaattcacctggcagagaaatgcatggcttgcccaaggtcacacaagcagatggtaataactatcttgccggatcggctgacacaatccacactggcactctaaatgtcccttctcccctctcygcctagagggaagccctcgcctcagcaggtcagagtggcctgggcacctccggcttgttcccgtgcccatcagctctggctcccttccgacgcctgttggctgacccctttgtcttggagacgctgaacccagcctggccttaagcccaagaatgcactggcccacactcctgcatttttttgtcacccactcacctgccatctgcctcttcaggagtttccatgtatcaaagtcccaggtatcaagcccacaggtgaggggccatttccagactagttccgaggactgagccttgaggg

SEQ ID NO: 5612 - DNA, 601 bp, Human
cagggtgacatgattaattgccacatcaccgacatggacacgtttaacgctattggaatattgtatgtctatctcccagggagactggaaggcagactgctagttttttctttatggaatctgtgttgcttgaattgtcacaatgagcacgcattgatttttttgtatgcgttcatcttacagtataaaatacagtaaagcaaacaggacaggtgcacacagtgtacttgtagctcaagcctagagaggccctttggtagccacagaagacaatggaggcagcaggtttgagaaaagtctyggaggctttggagggggtggtgtaggctctctagctggtagaataatctgagctacaagcacagttggaaagtccaaggcagggccaagtctaagggctgaagggcctggctgcttccttcctctgatgaagtgaggccacccactctcatctccccaaaacctacaaggacagcccatgctggccacttgggggagtggcagagtgaggtgcgaggcatctgtgtgtcctgcagctgaggtcagcatccccagctggcagactgccaggtcatgccacagtggcacctggcctagttcg

SEQ ID NO: 5613 - DNA, 601 bp, Human
gacacagccaaaccatatcatccagtctgtggtattttgttacaatagcacaaacagactaagaatcaatcaatccacgtaaccattccccaaacaggaaggcagcacccactcctgtagacaccatactggatagaaagcattcatgatgcagatgctgtccatagatggcttccttccaatatgcgcaggaagatgaaactcaattagacagcaggtattaggaaaatatgtcaaaataaaaatacgagcgatgtcacagggtgacatgattaattgccacatcaccgacatggacacrtttaacgctattggaatattgtatgtctatctcccagggagactggaaggcagactgctagttttttctttatggaatctgtgttgcttgaattgtcacaatgagcacgcattgatttttttgtatgcgttcatcttacagtataaaatacagtaaagcaaacaggacaggtgcacacagtgtacttgtagctcaagcctagagaggccctttggtagccacagaagacaatggaggcagcaggtttgagaaaagtctcggaggctttggagggggtggtgtaggctctctagctggtag

SEQ ID NO: 5614 - DNA, 601 bp, Human
ctgccaccgctcacagcatctacagcaggccctgtgctgctgtcacaacctcaccctggtcccctgaggcggatatcaccatcccatttcagagacaaggaaaatgaggcccaggtgcgtgaagaaactggcctatcaaggcagagctagtgggtagcatgctggacttctaagccttcctgagaaagtgaactgcttcctctgagatgggcataggcatggctgtgtgtgcatcttgtcctgaccattccacagtggctgttatcacactccatttacaagtaagaggttgggtaactcrtcctaggtcgcaaaagtggctgtggccaggactggagcctaagccttttctgcttccctgtcctttcctgcaggttggctcagaaaaccggaggtgaagctgaagcagcccagctggccctaagaagccctggacgctccctcccatcctcacatcgttgagtcaatgctattatttgaatgtctgtgtcccctccaaaattcatgttggaacttaatccttaaggagcagttttaagagatggggcctttaggtcatgagggctctgctctatgaatggattagtgtcttataaaaggg

SEQ ID NO: 5615 - DNA, 601 bp, Human
ctccacaccagggcaggaccagtgtttgttttagataaaactagactccgttcagacagtcacaggcctcaggagccccatcctgtgctggggggaaggggtgctgataaaggagacgccttgctctgcagaacaaaaataattccaccactgccaccgctcacagcatctacagcaggccctgtgctgctgtcacaacctcaccctggtcccctgaggcggatatcaccatcccatttcagagacaaggaaaatgaggcccaggtgcgtgaagaaactggcctatcaaggcagagctagygggtagcatgctggacttctaagccttcctgagaaagtgaactgcttcctctgagatgggcataggcatggctgtgtgtgcatcttgtcctgaccattccacagtggctgttatcacactccatttacaagtaagaggttgggtaactcgtcctaggtcgcaaaagtggctgtggccaggactggagcctaagccttttctgcttccctgtcctttcctgcaggttggctcagaaaaccggaggtgaagctgaagcagcccagctggccctaagaagccctggacgctccctcccatcct

SEQ ID NO: 5616 - DNA, 601 bp, Human
ggtgtctgggaatcccccacgcgctgctgggataggggtgtctgggaatcccccacatgctgctgggataggggtgtctgggaatcgtgcggcctcccttgatgcagtgggaccatctggccaggagcctgtggggccctgactccacaccagggcaggaccagtgtttgttttagataaaactagactccgttcagacagtcacaggcctcaggagccccatcctgtgctggggggaaggggtgctgataaaggagacgccttgctctgcagaacaaaaataattccaccactgccaccrctcacagcatctacagcaggccctgtgctgctgtcacaacctcaccctggtcccctgaggcggatatcaccatcccatttcagagacaaggaaaatgaggcccaggtgcgtgaagaaactggcctatcaaggcagagctagtgggtagcatgctggacttctaagccttcctgagaaagtgaactgcttcctctgagatgggcataggcatggctgtgtgtgcatcttgtcctgaccattccacagtggctgttatcacactccatttacaagtaagaggttgggtaactcgtcctaggt

SEQ ID NO: 5617 - DNA, 601 bp, Human
tttggagacagcagcacttctgcggcctccttgtgctatgaagatcttttggcagcctagggccacacaacagagctccacactgcctgggtacttccttctaggggccccgagttccagaagcttcctcagtccctaccccaaagtcccagagaggaagacagagcaccatttcatcggccgcttcttcctctgggagttttcattggaatgccctctccacatcactcctcagggaggaaatgaacgcccaggcaggcagagctgtggggtatgataggggtgtctgggaatcccccgyatgctgctgggataggggtgtctgggaatcccccacgcgctgctgggataggggtgtctgggaatcccccacatgctgctgggataggggtgtctgggaatcgtgcggcctcccttgatgcagtgggaccatctggccaggagcctgtggggccctgactccacaccagggcaggaccagtgtttgttttagataaaactagactccgttcagacagtcacaggcctcaggagccccatcctgtgctggggggaaggggtgctgataaaggagacgccttgctctgcagaacaaaaataa

SEQ ID NO: 5618 - DNA, 601 bp, Human
aagcaatgcctggcacacagaaagtgtctgatgcataattggtgagtgaataaaggaatgaatgacagagaaacgtagcactctagcctgcgggaggtgactgggcttcaaagtgaaatgagtggctcatgtctgtaatcccagcactttgggaggccaaggtgggtggatcacttgaggtcaggagtttgagaccagcctggccaacctggtgaaaccctgtctctactaaaaatacaaaagttatccgggtgtggtggcgggtgcttgtagtcccagctactcggcaggctgaggcacragaatcgcttgaacccagatggcggaggttgcagtgagccgagatagcgccactgtactccagcctgggcgacagatcgagacttggtttcaaacaaaacaaaacaaagtgaaatcaggcacagacctttttctgaataagaaaaaggtctctaggactgtgccaaccctccatagcccctcgttcaggcccccaaccttgcctctcaaggggtgctcgtctcggtatcttttttcagactagccccaggctggcactgtcccctttcggggctgtcactctgagttcagcaagaccagg

SEQ ID NO: 5619 - DNA, 601 bp, Human
aatgtaacttccacaagaaaagactgtcttattcctacataatccccagccccaagcaatgcctggcacacagaaagtgtctgatgcataattggtgagtgaataaaggaatgaatgacagagaaacgtagcactctagcctgcgggaggtgactgggcttcaaagtgaaatgagtggctcatgtctgtaatcccagcactttgggaggccaaggtgggtggatcacttgaggtcaggagtttgagaccagcctggccaacctggtgaaaccctgtctctactaaaaatacaaaagttatycgggtgtggtggcgggtgcttgtagtcccagctactcggcaggctgaggcacaagaatcgcttgaacccagatggcggaggttgcagtgagccgagatagcgccactgtactccagcctgggcgacagatcgagacttggtttcaaacaaaacaaaacaaagtgaaatcaggcacagacctttttctgaataagaaaaaggtctctaggactgtgccaaccctccatagcccctcgttcaggcccccaaccttgcctctcaaggggtgctcgtctcggtatcttttttcagactagcccc

SEQ ID NO: 5620 - DNA, 601 bp, Human
tctgtagagtgcattgtcttgaactccttttagtccaaataggcactggaatataccaattcccccccccctttttttttttgacactgagtctcgctctgtcgcccaggctggagtgcagtggcacgaacttggctcactgcaacctccgtctcctgggttcaagtgattctcctgcctcagcctcccgagtagctgggattacaggcatcctccatcacgcccggctaatttttgtatttttagtagagacagggtttcactgtgttggccaggctgttctcaaactcctgacctcagrtggtctgcctgtctcggcctcccaaagtgctgggattacaggcgtcagccaccgcacccagccccaattcctgaaattggccagaaggctctatatcacgcatccccaacaggggcaatactgcccccaggaatttattcttgcaggacaaagcatctcacgctttttactctgtgtatacagactaagaatagcaacagacatccagagtacctgtggcattaacatttcatggaggcgtaatgataactgcaggctgagaaatgccaccctgggtgacggggtctgcgctcccacctg

SEQ ID NO: 5621 - DNA, 601 bp, Human
tttctttggcctgagtgagaagctgctgacactggggaaccgcagcctgaggatgaggggcaggcttaggaaggagcttcagtgcacacagctactgcctaaagctcagctccagacactcgaagtttgaggcctctatgagacacccaaggggagccctggtctggggagtctgtagagtgcattgtcttgaactccttttagtccaaataggcactggaatataccaattcccccccccctttttttttttgacactgagtctcgctctgtcgcccaggctggagtgcagtggcacgawcttggctcactgcaacctccgtctcctgggttcaagtgattctcctgcctcagcctcccgagtagctgggattacaggcatcctccatcacgcccggctaatttttgtatttttagtagagacagggtttcactgtgttggccaggctgttctcaaactcctgacctcaggtggtctgcctgtctcggcctcccaaagtgctgggattacaggcgtcagccaccgcacccagccccaattcctgaaattggccagaaggctctatatcacgcatccccaacaggggcaatactgccccca

SEQ ID NO: 5622 - DNA, 601 bp, Human
gagaagggggcgagaagtatttggaacatgagagaaaggagagtcaagaatggagtcaagtttctttggcctgagtgagaagctgctgacactggggaaccgcagcctgaggatgaggggcaggcttaggaaggagcttcagtgcacacagctactgcctaaagctcagctccagacactcgaagtttgaggcctctatgagacacccaaggggagccctggtctggggagtctgtagagtgcattgtcttgaactccttttagtccaaataggcactggaatataccaattccccccccsctttttttttttgacactgagtctcgctctgtcgcccaggctggagtgcagtggcacgaacttggctcactgcaacctccgtctcctgggttcaagtgattctcctgcctcagcctcccgagtagctgggattacaggcatcctccatcacgcccggctaatttttgtatttttagtagagacagggtttcactgtgttggccaggctgttctcaaactcctgacctcaggtggtctgcctgtctcggcctcccaaagtgctgggattacaggcgtcagccaccgcacccagccccaatt

SEQ ID NO: 5623 - DNA, 601 bp, Human
gaggctgctgcaggggaccaggtgagcaaaggtgggcgcttggccaggatggcggcagagaagggggcgagaagtatttggaacatgagagaaaggagagtcaagaatggagtcaagtttctttggcctgagtgagaagctgctgacactggggaaccgcagcctgaggatgaggggcaggcttaggaaggagcttcagtgcacacagctactgcctaaagctcagctccagacactcgaagtttgaggcctctatgagacacccaaggggagccctggtctggggagtctgtagagtgcrttgtcttgaactccttttagtccaaataggcactggaatataccaattcccccccccctttttttttttgacactgagtctcgctctgtcgcccaggctggagtgcagtggcacgaacttggctcactgcaacctccgtctcctgggttcaagtgattctcctgcctcagcctcccgagtagctgggattacaggcatcctccatcacgcccggctaatttttgtatttttagtagagacagggtttcactgtgttggccaggctgttctcaaactcctgacctcaggtggtctgcctgt

SEQ ID NO: 5624 - DNA, 601 bp, Human
tttttttttttttgagacagagtctcgctctgtcactaggctggagcgcaggggcgcaatctcggctcactgcaacctccacctcctgggttcaagtgattctcctgcctcagcctcccgagtagctgggactacaggcgtgtaccaccacgcctggctaatttttgtatttttagtagagactgggtttcaccatgttggccaggatggtctcaatctcttgacgtgtgatctgcccacttcagcctccccaaatgctgggattacaggcgtgagccaccatgcttggccaagattccctttttttttttaaaggaaatcgggcaggtggggcaggagtggacaggatgagggggccccgccaggagttggtgttcatgccccctctgtgtgtgtcatcagtatccccactgccaatgctggctggggcaggagccctggtagaaggtacggttcctcttcctccccctggttccaggagcccacggggacaacccacggcacactctcccacctcttctttttcctcctcactcagggagcacctactatcctgcaggctccaggggacaagagcccaagtgaggctgccaggcgggag

SEQ ID NO: 5625 - DNA, 601 bp, Human
gagaccagggaagccaagcaaggccccggggaagcttcgtttgagcttcgggctgaaggatgaactcaatgtggagtagaagcaggggctgtgcctgggctgcccctccgccattccatgtcttagtggtccctgcagccccagaaccagccctggatagggacctagtaggcccctagcaacaggtggtggctgcaagaacagagcccagtgtccctttctggagaggaaggacatctggaagatgagagggtgatgaggccggatgcccacctaaggtttcctttttttatatttattatttttttttttgagacagagtctcgctctgtcactaggctggagcgcaggggcgcaatctcggctcactgcaacctccacctcctgggttcaagtgattctcctgcctcagcctcccgagtagctgggactacaggcgtgtaccaccacgcctggctaatttttgtatttttagtagagactgggtttcaccatgttggccaggatggtctcaatctcttgacgtgtgatctgcccacttcagcctccccaaatgctgggattacaggcgtgagccaccatgcttggccaagattccctt

SEQ ID NO: 5626 - DNA, 601 bp, Human
aggagaccagggaagccaagcaaggccccggggaagcttcgtttgagcttcgggctgaaggatgaactcaatgtggagtagaagcaggggctgtgcctgggctgcccctccgccattccatgtcttagtggtccctgcagccccagaaccagccctggatagggacctagtaggcccctagcaacaggtggtggctgcaagaacagagcccagtgtccctttctggagaggaaggacatctggaagatgagagggtgatgaggccggatgcccacctaaggtttcctttttttatatttattttttttttttttgagacagagtctcgctctgtcactaggctggagcgcaggggcgcaatctcggctcactgcaacctccacctcctgggttcaagtgattctcctgcctcagcctcccgagtagctgggactacaggcgtgtaccaccacgcctggctaatttttgtatttttagtagagactgggtttcaccatgttggccaggatggtctcaatctcttgacgtgtgatctgcccacttcagcctccccaaatgctgggattacaggcgtgagccaccatgcttggccaagattccc

SEQ ID NO: 5627 - DNA, 601 bp, Human
ctggttctgaaagctgaagttgttcaccaggtggaagggaggggagaggccactgggttgcgcggagcaggacaggacagtgtggggacaagcggggatgcctgaaagggcaggcggactgcttggagaaaagaaagctgtctggcgtagtcacttggagcaaaggacatgagtcacttcctggccagtctttcatcagctttcccagcctcaccccgagagctccctgccccccgatcctcaccataaatagcaccatggctttcactgatcagagcatcgagccccggtcttgctgacstcagggtgatggccctgaaagggggacgggaccagcttggggctagtctgaaggaagacacagagacaagagagccccttgagagacagggtcaggggcctgaacgaggggctatggagggttcgtacagccctggagaccatgggctactgggttgctaagtgctggaaacacctgcatgtcccccaggcaccacggcagctctgagaagaggactctgtgaggggagggcggaaatggggaagctgggatacagaagatcagggagagcaaaaggggagtgcctcgcccctcccaggg

SEQ ID NO: 5628 - DNA, 601 bp, Human
ctcaaaccccagctccttcacaaagactttcctggcagaactgtatccatccaccctctgaccagatactagatgcttactctatgctaggccctgtgtaagctgtgggacacaagagaaaacatccctgtccccaaggagcttctgcatgggaccctgttaaaatcctactcaacctcaaggcctctacggggacatctttttgatgaaggctctcctaagatgttcattcccaaaggccctcaccgctctgcatacctgtgtccaccattagaccgtgagctccttgggacagaaagcrggtcttatttatgcctataaaattcagagcccagccctgtgcctggcacccagcagaaactcaaagaaatgaccacaagacacgacagtgctatgaacaacgcacgtggctatggaacacagagaaaagtcactcccttcggaggggtggggagaagaggggtctccagagggcgttccatttgagctggttctgaaagctgaagttgttcaccaggtggaagggaggggagaggccactgggttgcgcggagcaggacaggacagtgtggggacaagcggggatgcctgaaagggcagg

SEQ ID NO: 5629 - DNA, 601 bp, Human
tgggttcacagacgtgtccccgggttgaccgcacgtgcccaccagcaggacagtgttcttcccctgtggataacgtgtggtacgaacacccctgcctggtgcatgggacagaggccggtcttggttttcagataccagatgatctttcttgtgataaagactgaagttggatggaaactcaaaaggctcattcattatgaatttactttttgcttcctccttggaggggctaggcacgttcaccaggcttacagccaactcctggggccgttttccaccgcccttgccaactccagcaagsagcatctccctcctgcagtggcttctcagaccttaccccagacacccggagattctgttcccttctccctcacctcagtgccctggtccagatgccacctgctaaaggcaatgctccggtgggtgcacctggtgaagatgaccgcttcctgccactcaggtccacaagggacccactatatactggggctctgtgcatgagccttcttctcagagccctgctccaggccatgccagatactctaaacccctcaattccatctgtccctcttgcctcctctgggaaactcactgctccaga

SEQ ID NO: 5630 - DNA, 601 bp, Human; identical to SEQ ID NO: 1622

SEQ ID NO: 5631 - DNA, 601 bp, Human; identical to SEQ ID NO: 1623

SEQ ID NO: 5632 - DNA, 601 bp, Human; identical to SEQ ID NO: 1624

SEQ ID NO: 5633 - DNA, 601 bp, Human; identical to SEQ ID NO: 1625

SEQ ID NO: 5634 - DNA, 601 bp, Human; identical to SEQ ID NO: 1626

SEQ ID NO: 5635 - DNA, 601 bp, Human; identical to SEQ ID NO: 1627

SEQ ID NO: 5636 - DNA, 601 bp, Human; identical to SEQ ID NO: 1628

SEQ ID NO: 5637 - DNA, 601 bp, Human; identical to SEQ ID NO: 1629

SEQ ID NO: 5638 - DNA, 601 bp, Human; identical to SEQ ID NO: 1630

SEQ ID NO: 5639 - DNA, 601 bp, Human; identical to SEQ ID NO: 1631

SEQ ID NO: 5640 - DNA, 601 bp, Human; identical to SEQ ID NO: 1632

SEQ ID NO: 5641 - DNA, 601 bp, Human; identical to SEQ ID NO: 1633

SEQ ID NO: 5642 - DNA, 601 bp, Human; identical to SEQ ID NO: 1634

SEQ ID NO: 5643 - DNA, 601 bp, Human; identical to SEQ ID NO: 1635

SEQ ID NO: 5644 - DNA, 601 bp, Human; identical to SEQ ID NO: 1636

SEQ ID NO: 5645 - DNA, 601 bp, Human; identical to SEQ ID NO: 1637

SEQ ID NO: 5646 - DNA, 601 bp, Human; identical to SEQ ID NO: 1638

SEQ ID NO: 5647 - DNA, 601 bp, Human; identical to SEQ ID NO: 1639

SEQ ID NO: 5648 - DNA, 601 bp, Human; identical to SEQ ID NO: 1640

SEQ ID NO: 5649 - DNA, 601 bp, Human; identical to SEQ ID NO: 1641

SEQ ID NO: 5650 - DNA, 601 bp, Human; identical to SEQ ID NO: 1642

SEQ ID NO: 5651 - DNA, 601 bp, Human; identical to SEQ ID NO: 1643

SEQ ID NO: 5652 - DNA, 601 bp, Human; identical to SEQ ID NO: 1644

SEQ ID NO: 5653 - DNA, 601 bp, Human; identical to SEQ ID NO: 1645

SEQ ID NO: 5654 - DNA, 601 bp, Human; identical to SEQ ID NO: 1646

SEQ ID NO: 5655 - DNA, 601 bp, Human; identical to SEQ ID NO: 1647

SEQ ID NO: 5656 - DNA, 601 bp, Human; identical to SEQ ID NO: 1648

SEQ ID NO: 5657 - DNA, 601 bp, Human; identical to SEQ ID NO: 1649

SEQ ID NO: 5658 - DNA, 601 bp, Human; identical to SEQ ID NO: 1650

SEQ ID NO: 5659 - DNA, 601 bp, Human; identical to SEQ ID NO: 1651

SEQ ID NO: 5660 - DNA, 601 bp, Human; identical to SEQ ID NO: 1652

SEQ ID NO: 5661 - DNA, 601 bp, Human; identical to SEQ ID NO: 1653

SEQ ID NO: 5662 - DNA, 601 bp, Human; identical to SEQ ID NO: 1654

SEQ ID NO: 5663 - DNA, 601 bp, Human; identical to SEQ ID NO: 1655

SEQ ID NO: 5664 - DNA, 601 bp, Human; identical to SEQ ID NO: 1656

SEQ ID NO: 5665 - DNA, 601 bp, Human; identical to SEQ ID NO: 1657

SEQ ID NO: 5666 - DNA, 601 bp, Human; identical to SEQ ID NO: 1658

SEQ ID NO: 5667 - DNA, 601 bp, Human; identical to SEQ ID NO: 1659

SEQ ID NO: 5668 - DNA, 601 bp, Human; identical to SEQ ID NO: 1660

SEQ ID NO: 5669 - DNA, 601 bp, Human; identical to SEQ ID NO: 1661

SEQ ID NO: 5670 - DNA, 601 bp, Human; identical to SEQ ID NO: 1662

SEQ ID NO: 5671 - DNA, 601 bp, Human; identical to SEQ ID NO: 1663

SEQ ID NO: 5672 - DNA, 601 bp, Human; identical to SEQ ID NO: 1664

SEQ ID NO: 5673 - DNA, 601 bp, Human; identical to SEQ ID NO: 1665

SEQ ID NO: 5674 - DNA, 601 bp, Human; identical to SEQ ID NO: 1666

SEQ ID NO: 5675 - DNA, 601 bp, Human; identical to SEQ ID NO: 1667

SEQ ID NO: 5676 - DNA, 601 bp, Human; identical to SEQ ID NO: 1668

SEQ ID NO: 5677 - DNA, 601 bp, Human; identical to SEQ ID NO: 1669

SEQ ID NO: 5678 - DNA, 601 bp, Human; identical to SEQ ID NO: 1670

SEQ ID NO: 5679 - DNA, 601 bp, Human; identical to SEQ ID NO: 1671

SEQ ID NO: 5680 - DNA, 601 bp, Human; identical to SEQ ID NO: 1672

SEQ ID NO: 5681 - DNA, 601 bp, Human; identical to SEQ ID NO: 1673

SEQ ID NO: 5682 - DNA, 601 bp, Human
atataccaattctttccttaaaaaaaaaagtgtttaaatgtgtttttccctgaagatttccagtgtattccacagtgtttaaaaaatagtttccccaaaaatatatcttgaaagcatttgacacagtggtatttgtggcgtatctggcgcttgtcagtgtggggcccaggcctgatgagccaccagcccagcacccgaatgcctgctgaaggtggcgcacacgtgtgcctgggatgtccggctcttcacaggggatcagactgcgggtcacgttgagagccaacaccatgggctcggttcyggctgaaaacccgccagtgtgaggaagcagggccccgggtggccaagcgggctgagcaatgccctggaggctggatgggggtctcgtcctcagccccttcccctcctccgtcttggctctctccgcttcgtccttaccagacttcgcacttgtgaggcgggttcatgggtgagccaggtgggcagcggaagtgttctgagaactccttggaattggagagggagccgatgacccggaagcgagaggggctgtggggatcggtgatgaggccttcgtgggagctctcaggtgtgcggacgg

SEQ ID NO: 5683 - DNA, 601 bp, Human
ccctgagatagacatgggacagcccgaaaaggtgggactgagaggggacacttgtggccagcagtgtatctctgacacagtctcaccccgcagggctcctgcagtctcgattcagggtgcttggtgttcccagatggtgtttgagggtcctgacccgacctcattctgctatagccatcagtcccctgctgtggctttggggatcagaacttcccagctagggctcccactgttggactcaggggacggaggcaggctagctgaaggggcagtgcccatgagctgggccccccgcagagcrggctcctctctctgcctggcctccacacctctactggtctccacgcccttgcatgaggtgacaggagctgaaatcacacatcccaggggctgaggcagctgtctgatttggagacttgctctgtggcccagggatccgtgcctcagcccagcctcacagggagtggggaagagagggagtaaatcagtggggcttcccttgtccacaggttatttagaaaaacagaacataataaatataccaattctttccttaaaaaaaaaagtgtttaaatgtgtttttccctgaagatttccagtg

SEQ ID NO: 5684 - DNA, 601 bp, Human
gggtgtccctgtgccgtctgcttcctctcgggcaggaggattccagcttcccgggtgaggggagagcactgtccaggcagggctgggccaggaggcctgggctgctgaggcgggaaagcggtggctgtggagggcacgtgctgcccccacctccgtctcggggcctggcttccccactggatggcagaggccgctccaggtgcttccacttggtggcgcccatgagtctgctactggagaagctgtggtctcagggaggagacagacaccacaggccagactgggtggaggaatcttcccstcacaatgtcccctggctaaaagcatccatctagctgcaagtactatcttgattcaacccaggggccgacaatggactgcagcccagggtaagtccagcagttttgcagtcttccgatgccctgtgccatggacctgccggccagagctcctgggctcccgtggaggttagccctgcaggcaccggggaaatggggctatggcctgtgcttcagtcaggacacctgggggctgcactgcggaggccaagggcatctaggagcaggggctgtctccttggggtggagactggcggctgcag

SEQ ID NO: 5685 - DNA, 601 bp, Human
aggacctccatctggaatccactctcgataccctgcaccagcttggaggcagatcccaaggtggcaggggtgtccctgtgccgtctgcttcctctcgggcaggaggattccagcttcccgggtgaggggagagcactgtccaggcagggctgggccaggaggcctgggctgctgaggcgggaaagcggtggctgtggagggcacgtgctgcccccacctccgtctcggggcctggcttccccactggatggcagaggccgctccaggtgcttccacttggtggcgcccatgagtctgctaytggagaagctgtggtctcagggaggagacagacaccacaggccagactgggtggaggaatcttcccctcacaatgtcccctggctaaaagcatccatctagctgcaagtactatcttgattcaacccaggggccgacaatggactgcagcccagggtaagtccagcagttttgcagtcttccgatgccctgtgccatggacctgccggccagagctcctgggctcccgtggaggttagccctgcaggcaccggggaaatggggctatggcctgtgcttcagtcaggacacctgggggctg

SEQ ID NO: 5686 - DNA, 601 bp, Human
tatgtggcaaggggactgcggctggcttctgcttcagctacttctcgggttcctgtctcctctgcagagctaccaggactgctgcgtgctgggaccaggacctccatctggaatccactctcgataccctgcaccagcttggaggcagatcccaaggtggcaggggtgtccctgtgccgtctgcttcctctcgggcaggaggattccagcttcccgggtgaggggagagcactgtccaggcagggctgggccaggaggcctgggctgctgaggcgggaaagcggtggctgtggagggcacrtgctgcccccacctccgtctcggggcctggcttccccactggatggcagaggccgctccaggtgcttccacttggtggcgcccatgagtctgctactggagaagctgtggtctcagggaggagacagacaccacaggccagactgggtggaggaatcttcccctcacaatgtcccctggctaaaagcatccatctagctgcaagtactatcttgattcaacccaggggccgacaatggactgcagcccagggtaagtccagcagttttgcagtcttccgatgccctgtgccatggacctg

SEQ ID NO: 5687 - DNA, 601 bp, Human; identical to SEQ ID NO: 3041

SEQ ID NO: 5688 - DNA, 601 bp, Human
gaggtgtgcccttctttgactttgccattttctctttagctggaacatagacatgctggctggacctcaataaaggggatgccacatgctgaggatgatggagccacatgctgaggatgatggagcaacaagcaagaataagcccaggaccctacagtgtatgacaccagctcttgaccacctacctctcttgctttagctactattattattattattattatttttttttttttttagtggggtgaggtttgctgtcacacacagcaacataatcctctttttttttttttttttttttgagacagagtctcactctgtcacctaggctagagtgtagtggtgtgatcttggctcgctgcaacctctgcctcctgggttcaagcgattctccttcctcagcctcccatgtagctgggattacaggcgcccaccaccacgcctggctagtttttgtatttttagtagagacagggtttcatcatgctggccaggctggtctcgaactcctggcctcaagtgattcacctacctcagcttcccaaagtgctgggattataggcatgagccactgtgctgggccagcaacataatcctaatg

SEQ ID NO: 5689 - DNA, 601 bp, Human
gcctcccaatagcaaattattaatgatagcaaattactatctgtgaccggaagcatttagagtccttcagtggaggaggtgtgcccttctttgactttgccattttctctttagctggaacatagacatgctggctggacctcaataaaggggatgccacatgctgaggatgatggagccacatgctgaggatgatggagcaacaagcaagaataagcccaggaccctacagtgtatgacaccagctcttgaccacctacctctcttgctttagctactattattattattattattattwttttttttttttagtggggtgaggtttgctgtcacacacagcaacataatcctctttttttttttttttttttttgagacagagtctcactctgtcacctaggctagagtgtagtggtgtgatcttggctcgctgcaacctctgcctcctgggttcaagcgattctccttcctcagcctcccatgtagctgggattacaggcgcccaccaccacgcctggctagtttttgtatttttagtagagacagggtttcatcatgctggccaggctggtctcgaactcctggcctcaagtgattc

SEQ ID NO: 5690 - DNA, 601 bp, Human
agacatgaagtccttgcccatgcctatatcctgaatggtattgcttaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccatataattttctttttctttgttttgagacagggtcttactacattgtcaagctggtttcaaactcctgggctcaagcaattctcccaygttggcctcccaaagtgctgggattacaggtgtgagctaccatgcctagcctgatttacaattttctacactgaagattttattaggaatattgtatcacacaagacagggtaggctgtgctgcagtaacaaatgaaaccaaattttggtggtttaacattgaaaagtgtatttctctatcacatgaagttctctgtaggacaataggaccctctgtaggactggaagtcctctgtagggccctccagggctgctgtcctctatgtggtaggtcatgctgctttggccttctggcgcctc

SEQ ID NO: 5691 - DNA, 601 bp, Human
atttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttaattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgkcttttgttgccattgcttttggtgttttagacatgaagtccttgcccatgcctatatcctgaatggtattgcttaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccatataattttctttttctttgttttgagacagggtcttactacattgtcaagctggtttc

SEQ ID NO: 5692 - DNA, 601 bp, Human
acaaatacacacaaacctgatttctattttcatataaaaataagaaataaactgtccactagtaggtgattatttaaacaaattgcggtgaatcatacgtaacgtgccatgcagttaaaaaaatagataacattgatacagagatgatacacaatgaaaaaagtgatttatagaatagactatatagtatgagcttatatataaaaagaaaaatgtatgcatacttatacaaaaataaagtgggggaagcagattaaatagatgtttaactttatgatttataattttcttttttttaaaattttattattatattttaagttttagggtacatgtgcacaatgtgcaggtttgttacatatgtatacatgtgccatgttggtatgctgcacccattaactcgtcatttagcattaggtatatctcctaatgctatccctccctcctccccgcaccccacaacagtccccagagtgtgatgttccccttcctgtgtccatgtgctctcattgttcaattcccacctatgagtgagaacatgcagtgtttggttttttgtccttgcaatagtttgcagagaatgatggtttccagtttcatc

SEQ ID NO: 5693 - DNA, 601 bp, Human
gatacaaatacacacaaacctgatttctattttcatataaaaataagaaataaactgtccactagtaggtgattatttaaacaaattgcggtgaatcatacgtaacgtgccatgcagttaaaaaaatagataacattgatacagagatgatacacaatgaaaaaagtgatttatagaatagactatatagtatgagcttatatataaaaagaaaaatgtatgcatacttatacaaaaataaagtgggggaagcagattaaatagatgtttaactttatgatttataattttcttttttttwaaattttattattatattttaagttttagggtacatgtgcacaatgtgcaggtttgttacatatgtatacatgtgccatgttggtatgctgcacccattaactcgtcatttagcattaggtatatctcctaatgctatccctccctcctccccgcaccccacaacagtccccagagtgtgatgttccccttcctgtgtccatgtgctctcattgttcaattcccacctatgagtgagaacatgcagtgtttggttttttgtccttgcaatagtttgcagagaatgatggtttccagtttc

SEQ ID NO: 5694 - DNA, 601 bp, Human
gtgtgcaaagatacaaatacacacaaacctgatttctattttcatataaaaataagaaataaactgtccactagtaggtgattatttaaacaaattgcggtgaatcatacgtaacgtgccatgcagttaaaaaaatagataacattgatacagagatgatacacaatgaaaaaagtgatttatagaatagactatatagtatgagcttatatataaaaagaaaaatgtatgcatacttatacaaaaataaagtgggggaagcagattaaatagatgtttaactttatgatttataattttyttttttttaaaattttattattatattttaagttttagggtacatgtgcacaatgtgcaggtttgttacatatgtatacatgtgccatgttggtatgctgcacccattaactcgtcatttagcattaggtatatctcctaatgctatccctccctcctccccgcaccccacaacagtccccagagtgtgatgttccccttcctgtgtccatgtgctctcattgttcaattcccacctatgagtgagaacatgcagtgtttggttttttgtccttgcaatagtttgcagagaatgatggtt

SEQ ID NO: 5695 - DNA, 601 bp, Human
tagattttaaccaagtaagcttgtgtttaagaatcaattctaaggaaattattggacaagtgtgcaaagatacaaatacacacaaacctgatttctattttcatataaaaataagaaataaactgtccactagtaggtgattatttaaacaaattgcggtgaatcatacgtaacgtgccatgcagttaaaaaaatagataacattgatacagagatgatacacaatgaaaaaagtgatttatagaatagactatatagtatgagcttatatataaaaagaaaaatgtatgcatacttatayaaaaataaagtgggggaagcagattaaatagatgtttaactttatgatttataattttcttttttttaaaattttattattatattttaagttttagggtacatgtgcacaatgtgcaggtttgttacatatgtatacatgtgccatgttggtatgctgcacccattaactcgtcatttagcattaggtatatctcctaatgctatccctccctcctccccgcaccccacaacagtccccagagtgtgatgttccccttcctgtgtccatgtgctctcattgttcaattcccacctatga

SEQ ID NO: 5696 - DNA, 601 bp, Human
caaaattcagggccagaaattacacagttatgagataaacagatttgaatgtttaaaaaattaaaaatatacagaaggagcaggactgaaaaaaactgttcacagttcaaaaaacaccccgacactattaaagcaaaaacaaaatttaaatatacatagcatatagaaggttaatatccttattagataaagcaaaagatgaatggtaatctaggaaaataagcaaaaaatataagttaaaaatgctcaaggaggaaatgaagatgacaaatttatttagaaatcatctctatattactamtaatcaaagaaactcattgtttggatgttaaggatacctaaacatttaaaaagttttattacatccagcattgaggatgtaggaaatgaatactcatatattgttaaagggaatataaatcattatgttttctggacagcaaattggtaacatgtataattaagatatagattttaaccaagtaagcttgtgtttaagaatcaattctaaggaaattattggacaagtgtgcaaagatacaaatacacacaaacctgatttctattttcatataaaaataagaaataaactgtccactag

SEQ ID NO: 5697 - DNA, 601 bp, Human
aattaataagcagtttttcaagactagacaaagattgttataaaccatggatattaaaaggtttcctagccaaaattcagggccagaaattacacagttatgagataaacagatttgaatgtttaaaaaattaaaaatatacagaaggagcaggactgaaaaaaactgttcacagttcaaaaaacaccccgacactattaaagcaaaaacaaaatttaaatatacatagcatatagaaggttaatatccttattagataaagcaaaagatgaatggtaatctaggaaaataagcaaaaaayataagttaaaaatgctcaaggaggaaatgaagatgacaaatttatttagaaatcatctctatattactactaatcaaagaaactcattgtttggatgttaaggatacctaaacatttaaaaagttttattacatccagcattgaggatgtaggaaatgaatactcatatattgttaaagggaatataaatcattatgttttctggacagcaaattggtaacatgtataattaagatatagattttaaccaagtaagcttgtgtttaagaatcaattctaaggaaattattggacaagtgt

SEQ ID NO: 5698 - DNA, 601 bp, Human
gaactcctggactcaagtgaacctcctgcctcagcctcccaaggtgctgggattacaggcatgagccggcatgccttattaattttaaaattaataagcagtttttcaagactagacaaagattgttataaaccatggatattaaaaggtttcctagccaaaattcagggccagaaattacacagttatgagataaacagatttgaatgtttaaaaaattaaaaatatacagaaggagcaggactgaaaaaaactgttcacagttcaaaaaacaccccgacactattaaagcaaaaacaaratttaaatatacatagcatatagaaggttaatatccttattagataaagcaaaagatgaatggtaatctaggaaaataagcaaaaaatataagttaaaaatgctcaaggaggaaatgaagatgacaaatttatttagaaatcatctctatattactactaatcaaagaaactcattgtttggatgttaaggatacctaaacatttaaaaagttttattacatccagcattgaggatgtaggaaatgaatactcatatattgttaaagggaatataaatcattatgttttctggacagcaa

SEQ ID NO: 5699 - DNA, 601 bp, Human
gtccaagtgattatcgcacctcagcctcctgagtagctggcataacaggtatgcacccccaggctaacttttgtatttttagtagagacggggtttcaccatgttggccaggctggtcttgaactcctggactcaagtgaacctcctgcctcagcctcccaaggtgctgggattacaggcatgagccggcatgccttattaattttaaaattaataagcagtttttcaagactagacaaagattgttataaaccatggatattaaaaggtttcctagccaaaattcagggccagaaattayacagttatgagataaacagatttgaatgtttaaaaaattaaaaatatacagaaggagcaggactgaaaaaaactgttcacagttcaaaaaacaccccgacactattaaagcaaaaacaaaatttaaatatacatagcatatagaaggttaatatccttattagataaagcaaaagatgaatggtaatctaggaaaataagcaaaaaatataagttaaaaatgctcaaggaggaaatgaagatgacaaatttatttagaaatcatctctatattactactaatcaaagaaactcattgttt

SEQ ID NO: 5700 - DNA, 601 bp, Human
tcttgggcattttttttttctgttttctttttgaacttggccatattcttttctccttttttctaaaaaagaaaaaacccacatcttttatggctacaaatattgatctacaaacctgcaatgtcattacttttttaagtaatttttttcctgttttccctgactttgagaaggcaagaaaaccatgtgacctatgtgaaaaaagtactccattttagctggaaattgaatttggggattgaataaagatggatcaggaatatactagaggactaacatttaatatatgtcatttaaaaarttttttggggacagagtcttgttctgttatgcaggctggagtgcagtggcataatctcagctcactgcaatctccacatcctgggtccaagtgattatcgcacctcagcctcctgagtagctggcataacaggtatgcacccccaggctaacttttgtatttttagtagagacggggtttcaccatgttggccaggctggtcttgaactcctggactcaagtgaacctcctgcctcagcctcccaaggtgctgggattacaggcatgagccggcatgccttattaattttaaaattaata

SEQ ID NO: 5701 - DNA, 601 bp, Human
tcaggtgaggggcctgataaacaccaagagagtaacaatttcacttttcttccttatgtcttgggcattttttttttctgttttctttttgaacttggccatattcttttctccttttttctaaaaaagaaaaaacccacatcttttatggctacaaatattgatctacaaacctgcaatgtcattacttttttaagtaatttttttcctgttttccctgactttgagaaggcaagaaaaccatgtgacctatgtgaaaaaagtactccattttagctggaaattgaatttggggattgartaaagatggatcaggaatatactagaggactaacatttaatatatgtcatttaaaaaattttttggggacagagtcttgttctgttatgcaggctggagtgcagtggcataatctcagctcactgcaatctccacatcctgggtccaagtgattatcgcacctcagcctcctgagtagctggcataacaggtatgcacccccaggctaacttttgtatttttagtagagacggggtttcaccatgttggccaggctggtcttgaactcctggactcaagtgaacctcctgcctcagcctc

SEQ ID NO: 5702 - DNA, 601 bp, Human
tgccagctggtcaggtgaggggcctgataaacaccaagagagtaacaatttcacttttcttccttatgtcttgggcattttttttttctgttttctttttgaacttggccatattcttttctccttttttctaaaaaagaaaaaacccacatcttttatggctacaaatattgatctacaaacctgcaatgtcattacttttttaagtaatttttttcctgttttccctgactttgagaaggcaagaaaaccatgtgacctatgtgaaaaaagtactccattttagctggaaattgaattwggggattgaataaagatggatcaggaatatactagaggactaacatttaatatatgtcatttaaaaaattttttggggacagagtcttgttctgttatgcaggctggagtgcagtggcataatctcagctcactgcaatctccacatcctgggtccaagtgattatcgcacctcagcctcctgagtagctggcataacaggtatgcacccccaggctaacttttgtatttttagtagagacggggtttcaccatgttggccaggctggtcttgaactcctggactcaagtgaacctcctg

SEQ ID NO: 5703 - DNA, 601 bp, Human
gttgactgaggtagttctgaacactctatgactccaaatctaatccagtttggaactgaaagtctgaatcctgcctggggatttaggttacttgtgtctattcttctgggctctgaccctagacaggaaacaattctaatctcaaaattgtctgatgcctcatgtccacctcaaccccattccctccctatgataagagaaaagaagactaggtataaaccaagttggtgttaggtttgctcttcctttgttggggagtctactgatggggtggcctaggggacaaggttggggctggctrtgctccaggcacatgtggctggagaggaggtcatgccagctggtcaggtgaggggcctgataaacaccaagagagtaacaatttcacttttcttccttatgtcttgggcattttttttttctgttttctttttgaacttggccatattcttttctccttttttctaaaaaagaaaaaacccacatcttttatggctacaaatattgatctacaaacctgcaatgtcattacttttttaagtaatttttttcctgttttccctgactttgagaaggcaagaaaaccatgtgacctatgtga

SEQ ID NO: 5704 - DNA, 601 bp, Human
tacaaaaaatttacaaaataaattaaaaaaagaaaaagggaaaaagaaaggaacagagaaagggaagagggagagaatacagaggagaaaaagaaaagtgggatgaagcagaggaaccagaaaaatgcagcttttttgtttcttattctgcaagtaacacagtttgtgcactggagtagacacatgcatgcaggcatgcaagcaagcatgggttgactgaggtagttctgaacactctatgactccaaatctaatccagtttggaactgaaagtctgaatcctgcctggggatttaggttwcttgtgtctattcttctgggctctgaccctagacaggaaacaattctaatctcaaaattgtctgatgcctcatgtccacctcaaccccattccctccctatgataagagaaaagaagactaggtataaaccaagttggtgttaggtttgctcttcctttgttggggagtctactgatggggtggcctaggggacaaggttggggctggctatgctccaggcacatgtggctggagaggaggtcatgccagctggtcaggtgaggggcctgataaacaccaagagagtaacaatttcactt

SEQ ID NO: 5705 - DNA, 601 bp, Human
gcaagacctggtctatacaaaaaatttacaaaataaattaaaaaaagaaaaagggaaaaagaaaggaacagagaaagggaagagggagagaatacagaggagaaaaagaaaagtgggatgaagcagaggaaccagaaaaatgcagcttttttgtttcttattctgcaagtaacacagtttgtgcactggagtagacacatgcatgcaggcatgcaagcaagcatgggttgactgaggtagttctgaacactctatgactccaaatctaatccagtttggaactgaaagtctgaatcctgcytggggatttaggttacttgtgtctattcttctgggctctgaccctagacaggaaacaattctaatctcaaaattgtctgatgcctcatgtccacctcaaccccattccctccctatgataagagaaaagaagactaggtataaaccaagttggtgttaggtttgctcttcctttgttggggagtctactgatggggtggcctaggggacaaggttggggctggctatgctccaggcacatgtggctggagaggaggtcatgccagctggtcaggtgaggggcctgataaacaccaagaga

SEQ ID NO: 5706 - DNA, 601 bp, Human
gtaaatatctattaggtccatttgttctagagtgtagtttacatctattgtttcttttttgactttctgtctcaatgatctctctggtgctgacagtggaatactgaagttccccactattattgtgttgttgtcttatctcttttcttaggtctagtagtaaatgtcttatgaatctgggagctccagtgttagctacatctaaatttaggactgtaatatcttcctgttagattgatccttttatcattatataatgaccttctttgcctttttttactgttgttgctttaaagtctgytttatctgatatgagaaaagctactcctgtttacttttggtttccatttgcatggaatatcttttttcacccttataccttgaatttatatgggtccttgtgtgttaagtgagtctcttgaagatagcagatatttggtttgtgattttgtatccattctgccaatctgtatcttttaagtggagcatttaggcccatttatgttgaacattaatatcaagatgtgaggtactgtttcagtcatcatgttaattgttacctacatacgttgttttcttcattgtgttattgttttataga

SEQ ID NO: 5707 - DNA, 601 bp, Human
caaagtctcaggatacaaaatcaatgtgcaaaaatcacaagcatgcctttacaccaacaataggcaagcagagagccaaatcatgatgaactaccattcacaatcactacaaagagaataaaatacctaggaatacagctaacagaggatgggaaggacctcttcaaggagaactacaaaccactcctcaaggaaataagagaggacacaaatggaaaaacattccatcttcatggataagaagaatcaatatcttggaaatggccatactgcccaaagtaatttatagattcaatgttaytcccatcaaactataatttcaatttataaaaatttattgagacttgttttgtggctatcatatggtctatcttggagaatgttccatgtgctgatgagaagaatgtaatcttctgtaaatatctattaggtccatttgttctagagtgtagtttacatctattgtttcttttttgactttctgtctcaatgatctctctggtgctgacagtggaatactgaagttccccactattattgtgttgttgtcttatctcttttcttaggtctagtagtaaatgtcttatgaatctgggagctc

SEQ ID NO: 5708 - DNA, 601 bp, Human
atatcatataaaatgggcaaaagctggaagcattccctttgaaaaccagtacaagacaaggatgccctctctcaccattcctattcaacatagtattagaagttctggccagcacaatcaggcaagagaaagaaataaagcgtattcaaataggaagagaggaagtcaagttgtttctgtttgcagatgacatgattatatacttagaaaaccccatcatctcagcccaaaaacttctcgaactgataagcaacttcaacaaagtctcaggatacaaaatcaatgtgcaaaaatcacaagyatgcctttacaccaacaataggcaagcagagagccaaatcatgatgaactaccattcacaatcactacaaagagaataaaatacctaggaatacagctaacagaggatgggaaggacctcttcaaggagaactacaaaccactcctcaaggaaataagagaggacacaaatggaaaaacattccatcttcatggataagaagaatcaatatcttggaaatggccatactgcccaaagtaatttatagattcaatgttattcccatcaaactataatttcaatttataaaaatttattgag

SEQ ID NO: 5709 - DNA, 601 bp, Human
gaagacaagaaataagtaagatcagagaaaaattgaaggagatagagacacaaaaaaccctcaaaaaatcaatgaatccaggagctggttttttgaaaaaattaacaaaatagatcactagccatattaataaagaagagagagaagaatcaaatagacagaataaaaatgataagggggaatatcatcactgatcccacagaaatacaaactaccatcagagaatactataaacacctctacacaaatgaactagaaaatctagaagaaatggataaattcctggacacatacaccctaycaagactaaaccaggaagaagttaaatccctgaatagaccaataacaagctctgaaattgaggcagtaattaatagcctaccaacaacacaaaacccaggaccagatggattcacagctgattctaccagaaatacaaagaggagctggtaccattacttctgaaactattccaaacaattgaaaaggagggaactcctccttaactcattttatgaagccagcatcatcctgataccaaaactgggaagacacacaacaaaaaaaaagaaaatttcaggccaatatccctgatgaacat

SEQ ID NO: 5710 - DNA, 601 bp, Human
tagtgggatgcatcccgttttatcctttttgcttaggattgtcctagctatatgggatcttcttcgattccatatgaaatttaaaatagtttttttttctaattctgtgaagaatgtagagacaatataccagaatctctgggacacagctaaagcagtgttaagaggaaaacttgtagcactaaatgcccacatcaggaagctagaaagatctcaaatggacaccctaacatcacaattaaaagagctagagaggcaagagcaagctaatccaaaagctagcagaagacaagaaataagkaagatcagagaaaaattgaaggagatagagacacaaaaaaccctcaaaaaatcaatgaatccaggagctggttttttgaaaaaattaacaaaatagatcactagccatattaataaagaagagagagaagaatcaaatagacagaataaaaatgataagggggaatatcatcactgatcccacagaaatacaaactaccatcagagaatactataaacacctctacacaaatgaactagaaaatctagaagaaatggataaattcctggacacatacaccctatcaagactaaaccagga

SEQ ID NO: 5711 - DNA, 601 bp, Human
tttattaaatggggaatccttttgccattgcttgtttttgtcaggtttgttgaagaacagatggttgtagatgtgtcgtgttatttctgaggtctctgttctgctccatggtctatatgtctgttttggtaccagtaccgtgctgttttggttactgtagccttgtcgtattgttcaaagtcaggtagtgggatgcatcccgttttatcctttttgcttaggattgtcctagctatatgggatcttcttcgattccatatgaaatttaaaatagtttttttttctaattctgtgaagaatrtagagacaatataccagaatctctgggacacagctaaagcagtgttaagaggaaaacttgtagcactaaatgcccacatcaggaagctagaaagatctcaaatggacaccctaacatcacaattaaaagagctagagaggcaagagcaagctaatccaaaagctagcagaagacaagaaataagtaagatcagagaaaaattgaaggagatagagacacaaaaaaccctcaaaaaatcaatgaatccaggagctggttttttgaaaaaattaacaaaatagatcactagccatattaata

SEQ ID NO: 5712 - DNA, 601 bp, Human
tttttatggttttgggttttacatttaagtctttaatccatcttcagttattttttgtataagatgtgaggaaggggtccagtttcagttttctgcatatggatagccagttttcctggcaccatttattaaatggggaatccttttgccattgcttgtttttgtcaggtttgttgaagaacagatggttgtagatgtgtcgtgttatttctgaggtctctgttctgctccatggtctatatgtctgttttggtaccagtaccgtgctgttttggttactgtagccttgtcgtattgttcraagtcaggtagtgggatgcatcccgttttatcctttttgcttaggattgtcctagctatatgggatcttcttcgattccatatgaaatttaaaatagtttttttttctaattctgtgaagaatgtagagacaatataccagaatctctgggacacagctaaagcagtgttaagaggaaaacttgtagcactaaatgcccacatcaggaagctagaaagatctcaaatggacaccctaacatcacaattaaaagagctagagaggcaagagcaagctaatccaaaagctagcagaagacaa

SEQ ID NO: 5713 - DNA, 601 bp, Human
taagttccctcccctcaccacccacaccccaacaggccctggtgtgtgttgttcccctctctgtgtccatgtgttctcaatgatcaactcccacttatgagtgagaacatgcggtgtttggttttctgttcctgtgttactttgctgaggatgatgggttccagcttcatccatgtacctgcaaaggacatgatcttattactttttatggctgcatagtgttccatgatgtatatgtaccacatattctttatccagtctaaatgctggattctttatccagcatttgggttggttccaygtctttgctatggtaaatactgctgcgataaacatacatgtgcatgtgtctttacagtagaatgatttatattcctttggatatatacccagtaatgggattgctgtgtcaaatggtatttctggttctacatccttgaggaatcaccacactgtcttccacaatggttgaactaatttacactcccaccaacagtgtaaaagtattcctatttctccacagcctcaccagcatctattgttttctgacttcttaataattgtcattctgactggcatgagatggtctctcattgcagtt

SEQ ID NO: 5714 - DNA, 601 bp, Human
ttttgaaagttccttttggagttgatttctagttttattccactgtgatctgaggagatacttaatataatttcaatttttttcttctaaaaaaccccccaaaatgggacacacgtgcagaacatgcaggtttcttacataggtatgcatgtgccatggtggcttgctgcacctattgacccatcctctaagttccctcccctcaccacccacaccccaacaggccctggtgtgtgttgttcccctctctgtgtccatgtgttctcaatgatcaactcccacttatgagtgagaacatgcrgtgtttggttttctgttcctgtgttactttgctgaggatgatgggttccagcttcatccatgtacctgcaaaggacatgatcttattactttttatggctgcatagtgttccatgatgtatatgtaccacatattctttatccagtctaaatgctggattctttatccagcatttgggttggttccacgtctttgctatggtaaatactgctgcgataaacatacatgtgcatgtgtctttacagtagaatgatttatattcctttggatatatacccagtaatgggattgctgtgtcaa

SEQ ID NO: 5715 - DNA, 601 bp, Human
taaaagcactgcttttgctgtatcctagaagttttgataatttatgtcactgttaccattcatttcaaataattttctaatttccgtcttaatttcagtgttaacccataaatcattcaggagcagattatttaatttccatttatttgttatggttttgaaagttccttttggagttgatttctagttttattccactgtgatctgaggagatacttaatataatttcaatttttttcttctaaaaaaccccccaaaatgggacacacgtgcagaacatgcaggtttcttacataggtaygcatgtgccatggtggcttgctgcacctattgacccatcctctaagttccctcccctcaccacccacaccccaacaggccctggtgtgtgttgttcccctctctgtgtccatgtgttctcaatgatcaactcccacttatgagtgagaacatgcggtgtttggttttctgttcctgtgttactttgctgaggatgatgggttccagcttcatccatgtacctgcaaaggacatgatcttattactttttatggctgcatagtgttccatgatgtatatgtaccacatattctttatccag

SEQ ID NO: 5716 - DNA, 601 bp, Human
ttagcgctatgaactttcctcttaaaagcactgcttttgctgtatcctagaagttttgataatttatgtcactgttaccattcatttcaaataattttctaatttccgtcttaatttcagtgttaacccataaatcattcaggagcagattatttaatttccatttatttgttatggttttgaaagttccttttggagttgatttctagttttattccactgtgatctgaggagatacttaatataatttcaatttttttcttctaaaaaaccccccaaaatgggacacacgtgcagaacrtgcaggtttcttacataggtatgcatgtgccatggtggcttgctgcacctattgacccatcctctaagttccctcccctcaccacccacaccccaacaggccctggtgtgtgttgttcccctctctgtgtccatgtgttctcaatgatcaactcccacttatgagtgagaacatgcggtgtttggttttctgttcctgtgttactttgctgaggatgatgggttccagcttcatccatgtacctgcaaaggacatgatcttattactttttatggctgcatagtgttccatgatgtatat

SEQ ID NO: 5717 - DNA, 601 bp, Human
aggaatttatttatttcctctagatttttctagtttttgtgcatagaggtgttcatagtagtcctgaatgatcttttgtatttctgtggtgtcagttgtaatgtctccagtttcatttctagttgagtttatttgaaacttctctctttttttttggttactctggctaatgttctatcaattttgtttatcttttcaaagaaccagctttttgtttaattgatcttttttattttttgtttcaattttatttcattcttctctcatctttctttttttctgctagctttgggtttctctrgttccttgaggcatgacattaggttgtcaatttgtgatctttcagactttttgatgtaggcatttagcgctatgaactttcctcttaaaagcactgcttttgctgtatcctagaagttttgataatttatgtcactgttaccattcatttcaaataattttctaatttccgtcttaatttcagtgttaacccataaatcattcaggagcagattatttaatttccatttatttgttatggttttgaaagttccttttggagttgatttctagttttattccactgtgatctgaggagata

SEQ ID NO: 5718 - DNA, 601 bp, Human
aggtgtatagcagtgctaatttgtgtacatttgattttgtaacctgagactttactggattcatttatcaaatctaggagtcttctgaaggagtctttagggttttctaggtatatgatcatataatcagggaacagtgatactttgatttcttttccaatttggatgtcatttatttctttctcttttctgattgttctggctaggacttctagtactatgttgaatagaagtggtgaaagtgggcatccttgtcttattccagttctccaggggaatgcattagattttttcccatttrgtatcacattggctgtgggtttgtcatatatgacttttataactttgaggtaagccccttctatgcctagtttgttgaggatctttatctaaagggatgctggattttatcaaatgttttttctgcatctattgaaatgatctatggtttttaattctgtttttgtgatgtaccacattattgacttgcatgtgttaaaccatccctaaatccctgggattaaatccacttgatcatggtgtattatatttttgatgggctgctggattcaatctcactgtttgttattggtctgttcat

SEQ ID NO: 5719 - DNA, 601 bp, Human
ttaaatatggtgtcatttccccaatttatgtttttgtatgctttgtcaaagatcagttggttttaagtatttggctttatttctgagttctctattctgttccattggtcgatgtatctacttttataacagtatcatgctgttttggtaactatagccttgtagtataattttaagtctggtaatgtgatgcctccagatttgttctttttgcttaggattgctttggctttgcaggctcttttttggttccatatgaattttaagattttttttccagttctgtgaaaaatgatgttgrtatttgataagaattgcattcaatctgtagattgccttgggcagtgtgatcattttcatattgattcttccaatccatgaacatgggatgtgtttctatatgtttgtgtcatctatgatttctttcagcagtgttttgtagttctccctgtagaaatctttcatctccttggataagtatattcctaggtattttattttattttgttgaagttgttttaaaagggattgagttcttgctttgattctcagcttggtcactgtaggtgtatagcagtgctaatttgtgtacatttgattt

SEQ ID NO: 5720 - DNA, 601 bp, Human
tacatggatgaattatataatggcaaaatctgagactttagtgcactcttcgtctgagtagtgtacattgtacccaatacataggtttttactccccctcctccgtccctctcctttctgagtctccataatccgttatatcactctgtatgcctttgagtactaatatcttagctcccacctataagtgagaacatacagtatttggttttccattccatcacctcacttagaataatggcctccagctccatttaagttgctgcaaaagacattatttcattctttttttatggctgaktaatacaccatggtgtatatatactacattttctttacacattcattggtcaatgggcactgaggttggttccctatctttacaattgtgaattatgcagcaataaacatgtgtgtaggtgtcttcttgatataatgacttattttcctttgggttgatacctagtagtggggttgctggatggaatggtagatctacttttagttatttaagaaatctccatactgttttccatagaggttgtactaatttgcactcccaccagcagtgtataaacattcccttttcaccacgtccatg

SEQ ID NO: 5721 - DNA, 601 bp, Human
gttttgaaaatattaaatgtatttttctttttaatttgtttttatttcaatagcttttggggtacaagtggtttttggttacatggatgaattatataatggcaaaatctgagactttagtgcactcttcgtctgagtagtgtacattgtacccaatacataggtttttactccccctcctccgtccctctcctttctgagtctccataatccgttatatcactctgtatgcctttgagtactaatatcttagctcccacctataagtgagaacatacagtatttggttttccattccatyacctcacttagaataatggcctccagctccatttaagttgctgcaaaagacattatttcattctttttttatggctgagtaatacaccatggtgtatatatactacattttctttacacattcattggtcaatgggcactgaggttggttccctatctttacaattgtgaattatgcagcaataaacatgtgtgtaggtgtcttcttgatataatgacttattttcctttgggttgatacctagtagtggggttgctggatggaatggtagatctacttttagttatttaagaaatctcc

SEQ ID NO: 5722 - DNA, 601 bp, Human; identical to SEQ ID NO: 3014

SEQ ID NO: 5723 - DNA, 601 bp, Human; identical to SEQ ID NO: 3015

SEQ ID NO: 5724 - DNA, 601 bp, Human; identical to SEQ ID NO: 3016

SEQ ID NO: 5725 - DNA, 601 bp, Human; identical to SEQ ID NO: 3017

SEQ ID NO: 5726 - DNA, 601 bp, Human; identical to SEQ ID NO: 3018

SEQ ID NO: 5727 - DNA, 601 bp, Human; identical to SEQ ID NO: 3019

SEQ ID NO: 5728 - DNA, 601 bp, Human; identical to SEQ ID NO: 3020

SEQ ID NO: 5729 - DNA, 601 bp, Human; identical to SEQ ID NO: 3021

SEQ ID NO: 5730 - DNA, 601 bp, Human; identical to SEQ ID NO: 3022

SEQ ID NO: 5731 - DNA, 601 bp, Human; identical to SEQ ID NO: 3023

SEQ ID NO: 5732 - DNA, 601 bp, Human; identical to SEQ ID NO: 3024

SEQ ID NO: 5733 - DNA, 601 bp, Human; identical to SEQ ID NO: 3025

SEQ ID NO: 5734 - DNA, 601 bp, Human; identical to SEQ ID NO: 3026

SEQ ID NO: 5735 - DNA, 601 bp, Human; identical to SEQ ID NO: 3027

SEQ ID NO: 5736 - DNA, 601 bp, Human; identical to SEQ ID NO: 3028

SEQ ID NO: 5737 - DNA, 601 bp, Human; identical to SEQ ID NO: 3029

SEQ ID NO: 5738 - DNA, 601 bp, Human; identical to SEQ ID NO: 3030

SEQ ID NO: 5739 - DNA, 601 bp, Human; identical to SEQ ID NO: 3031

SEQ ID NO: 5740 - DNA, 601 bp, Human; identical to SEQ ID NO: 3032

SEQ ID NO: 5741 - DNA, 601 bp, Human; identical to SEQ ID NO: 3033

SEQ ID NO: 5742 - DNA, 601 bp, Human; identical to SEQ ID NO: 3034

SEQ ID NO: 5743 - DNA, 601 bp, Human; identical to SEQ ID NO: 3035

SEQ ID NO: 5744 - DNA, 601 bp, Human; identical to SEQ ID NO: 3036

SEQ ID NO: 5745 - DNA, 601 bp, Human; identical to SEQ ID NO: 3041

SEQ ID NO: 5746 - DNA, 601 bp, Human; identical to SEQ ID NO: 5688

SEQ ID NO: 5747 - DNA, 601 bp, Human; identical to SEQ ID NO: 5689

SEQ ID NO: 5748 - DNA, 601 bp, Human; identical to SEQ ID NO: 5690

SEQ ID NO: 5749 - DNA, 601 bp, Human; identical to SEQ ID NO: 5691

SEQ ID NO: 5750 - DNA, 601 bp, Human; identical to SEQ ID NO: 5692

SEQ ID NO: 5751 - DNA, 601 bp, Human; identical to SEQ ID NO: 5693

SEQ ID NO: 5752 - DNA, 601 bp, Human; identical to SEQ ID NO: 5694

SEQ ID NO: 5753 - DNA, 601 bp, Human; identical to SEQ ID NO: 5695

SEQ ID NO: 5754 - DNA, 601 bp, Human; identical to SEQ ID NO: 5696

SEQ ID NO: 5755 - DNA, 601 bp, Human; identical to SEQ ID NO: 5697

SEQ ID NO: 5756 - DNA, 601 bp, Human; identical to SEQ ID NO: 5698

SEQ ID NO: 5757 - DNA, 601 bp, Human; identical to SEQ ID NO: 5699

SEQ ID NO: 5758 - DNA, 601 bp, Human; identical to SEQ ID NO: 5700

SEQ ID NO: 5759 - DNA, 601 bp, Human; identical to SEQ ID NO: 5701

SEQ ID NO: 5760 - DNA, 601 bp, Human; identical to SEQ ID NO: 5702

SEQ ID NO: 5761 - DNA, 601 bp, Human; identical to SEQ ID NO: 5703

SEQ ID NO: 5762 - DNA, 601 bp, Human; identical to SEQ ID NO: 5704

SEQ ID NO: 5763 - DNA, 601 bp, Human; identical to SEQ ID NO: 5705

SEQ ID NO: 5764 - DNA, 601 bp, Human; identical to SEQ ID NO: 5706

SEQ ID NO: 5765 - DNA, 601 bp, Human; identical to SEQ ID NO: 5707

SEQ ID NO: 5766 - DNA, 601 bp, Human; identical to SEQ ID NO: 5708

SEQ ID NO: 5767 - DNA, 601 bp, Human; identical to SEQ ID NO: 5709

SEQ ID NO: 5768 - DNA, 601 bp, Human; identical to SEQ ID NO: 5710

SEQ ID NO: 5769 - DNA, 601 bp, Human; identical to SEQ ID NO: 5711

SEQ ID NO: 5770 - DNA, 601 bp, Human; identical to SEQ ID NO: 5712

SEQ ID NO: 5771 - DNA, 601 bp, Human; identical to SEQ ID NO: 5713

SEQ ID NO: 5772 - DNA, 601 bp, Human; identical to SEQ ID NO: 5714

SEQ ID NO: 5773 - DNA, 601 bp, Human; identical to SEQ ID NO: 5715

SEQ ID NO: 5774 - DNA, 601 bp, Human; identical to SEQ ID NO: 5716

SEQ ID NO: 5775 - DNA, 601 bp, Human; identical to SEQ ID NO: 5717

SEQ ID NO: 5776 - DNA, 601 bp, Human; identical to SEQ ID NO: 5718

SEQ ID NO: 5777 - DNA, 601 bp, Human; identical to SEQ ID NO: 5719

SEQ ID NO: 5778 - DNA, 601 bp, Human; identical to SEQ ID NO: 5720

SEQ ID NO: 5779 - DNA, 601 bp, Human; identical to SEQ ID NO: 5721

SEQ ID NO: 5780 - DNA, 601 bp, Human; identical to SEQ ID NO: 3014

SEQ ID NO: 5781 - DNA, 601 bp, Human; identical to SEQ ID NO: 3015

SEQ ID NO: 5782 - DNA, 601 bp, Human; identical to SEQ ID NO: 3016

SEQ ID NO: 5783 - DNA, 601 bp, Human; identical to SEQ ID NO: 3017

SEQ ID NO: 5784 - DNA, 601 bp, Human; identical to SEQ ID NO: 3018

SEQ ID NO: 5785 - DNA, 601 bp, Human; identical to SEQ ID NO: 3019

SEQ ID NO: 5786 - DNA, 601 bp, Human; identical to SEQ ID NO: 3020

SEQ ID NO: 5787 - DNA, 601 bp, Human; identical to SEQ ID NO: 3021

SEQ ID NO: 5788 - DNA, 601 bp, Human; identical to SEQ ID NO: 3022

SEQ ID NO: 5789 - DNA, 601 bp, Human; identical to SEQ ID NO: 3023

SEQ ID NO: 5790 - DNA, 601 bp, Human; identical to SEQ ID NO: 3024

SEQ ID NO: 5791 - DNA, 601 bp, Human; identical to SEQ ID NO: 3025

SEQ ID NO: 5792 - DNA, 601 bp, Human; identical to SEQ ID NO: 3026

SEQ ID NO: 5793 - DNA, 601 bp, Human; identical to SEQ ID NO: 3027

SEQ ID NO: 5794 - DNA, 601 bp, Human; identical to SEQ ID NO: 3028

SEQ ID NO: 5795 - DNA, 601 bp, Human; identical to SEQ ID NO: 3029

SEQ ID NO: 5796 - DNA, 601 bp, Human; identical to SEQ ID NO: 3030

SEQ ID NO: 5797 - DNA, 601 bp, Human; identical to SEQ ID NO: 3031

SEQ ID NO: 5798 - DNA, 601 bp, Human; identical to SEQ ID NO: 3032

SEQ ID NO: 5799 - DNA, 601 bp, Human; identical to SEQ ID NO: 3033

SEQ ID NO: 5800 - DNA, 601 bp, Human; identical to SEQ ID NO: 3034

SEQ ID NO: 5801 - DNA, 601 bp, Human; identical to SEQ ID NO: 3035

SEQ ID NO: 5802 - DNA, 601 bp, Human; identical to SEQ ID NO: 3036

SEQ ID NO: 5803 - DNA, 601 bp, Human; identical to SEQ ID NO: 3856

SEQ ID NO: 5804 - DNA, 601 bp, Human; identical to SEQ ID NO: 3857

SEQ ID NO: 5805 - DNA, 601 bp, Human; identical to SEQ ID NO: 3858

SEQ ID NO: 5806 - DNA, 601 bp, Human; identical to SEQ ID NO: 3859

SEQ ID NO: 5807 - DNA, 601 bp, Human; identical to SEQ ID NO: 3860

SEQ ID NO: 5808 - DNA, 601 bp, Human; identical to SEQ ID NO: 3861

SEQ ID NO: 5809 - DNA, 601 bp, Human; identical to SEQ ID NO: 3862

SEQ ID NO: 5810 - DNA, 601 bp, Human; identical to SEQ ID NO: 3863

SEQ ID NO: 5811 - DNA, 601 bp, Human; identical to SEQ ID NO: 3864

SEQ ID NO: 5812 - DNA, 601 bp, Human; identical to SEQ ID NO: 3865

SEQ ID NO: 5813 - DNA, 601 bp, Human; identical to SEQ ID NO: 3866

SEQ ID NO: 5814 - DNA, 601 bp, Human; identical to SEQ ID NO: 3867

SEQ ID NO: 5815 - DNA, 601 bp, Human; identical to SEQ ID NO: 3868

SEQ ID NO: 5816 - DNA, 601 bp, Human; identical to SEQ ID NO: 3869

SEQ ID NO: 5817 - DNA, 601 bp, Human; identical to SEQ ID NO: 3870

SEQ ID NO: 5818 - DNA, 601 bp, Human; identical to SEQ ID NO: 3871

SEQ ID NO: 5819 - DNA, 601 bp, Human; identical to SEQ ID NO: 3872

SEQ ID NO: 5820 - DNA, 601 bp, Human; identical to SEQ ID NO: 3873

SEQ ID NO: 5821 - DNA, 601 bp, Human; identical to SEQ ID NO: 3874

SEQ ID NO: 5822 - DNA, 601 bp, Human; identical to SEQ ID NO: 3875

SEQ ID NO: 5823 - DNA, 601 bp, Human; identical to SEQ ID NO: 3876

SEQ ID NO: 5824 - DNA, 601 bp, Human; identical to SEQ ID NO: 3877

SEQ ID NO: 5825 - DNA, 601 bp, Human; identical to SEQ ID NO: 3878

SEQ ID NO: 5826 - DNA, 601 bp, Human; identical to SEQ ID NO: 3879

SEQ ID NO: 5827 - DNA, 601 bp, Human; identical to SEQ ID NO: 3880

SEQ ID NO: 5828 - DNA, 601 bp, Human; identical to SEQ ID NO: 3881

SEQ ID NO: 5829 - DNA, 601 bp, Human; identical to SEQ ID NO: 3882

SEQ ID NO: 5830 - DNA, 601 bp, Human; identical to SEQ ID NO: 3883

SEQ ID NO: 5831 - DNA, 601 bp, Human; identical to SEQ ID NO: 3884

SEQ ID NO: 5832 - DNA, 601 bp, Human; identical to SEQ ID NO: 3885

SEQ ID NO: 5833 - DNA, 601 bp, Human; identical to SEQ ID NO: 3886

SEQ ID NO: 5834 - DNA, 601 bp, Human; identical to SEQ ID NO: 3887

SEQ ID NO: 5835 - DNA, 601 bp, Human; identical to SEQ ID NO: 3888

SEQ ID NO: 5836 - DNA, 601 bp, Human; identical to SEQ ID NO: 3889

SEQ ID NO: 5837 - DNA, 601 bp, Human; identical to SEQ ID NO: 3890

SEQ ID NO: 5838 - DNA, 601 bp, Human; identical to SEQ ID NO: 3891

SEQ ID NO: 5839 - DNA, 601 bp, Human; identical to SEQ ID NO: 3892

SEQ ID NO: 5840 - DNA, 601 bp, Human; identical to SEQ ID NO: 3893

SEQ ID NO: 5841 - DNA, 601 bp, Human; identical to SEQ ID NO: 3894

SEQ ID NO: 5842 - DNA, 601 bp, Human; identical to SEQ ID NO: 3895

SEQ ID NO: 5843 - DNA, 601 bp, Human; identical to SEQ ID NO: 3896

SEQ ID NO: 5844 - DNA, 601 bp, Human; identical to SEQ ID NO: 3897

SEQ ID NO: 5845 - DNA, 601 bp, Human; identical to SEQ ID NO: 3898

SEQ ID NO: 5846 - DNA, 601 bp, Human; identical to SEQ ID NO: 3899

SEQ ID NO: 5847 - DNA, 601 bp, Human; identical to SEQ ID NO: 3900

SEQ ID NO: 5848 - DNA, 601 bp, Human; identical to SEQ ID NO: 3901

SEQ ID NO: 5849 - DNA, 601 bp, Human; identical to SEQ ID NO: 3902

SEQ ID NO: 5850 - DNA, 601 bp, Human; identical to SEQ ID NO: 3903

SEQ ID NO: 5851 - DNA, 601 bp, Human; identical to SEQ ID NO: 3904

SEQ ID NO: 5852 - DNA, 601 bp, Human; identical to SEQ ID NO: 3905

SEQ ID NO: 5853 - DNA, 601 bp, Human; identical to SEQ ID NO: 3906

SEQ ID NO: 5854 - DNA, 601 bp, Human; identical to SEQ ID NO: 3907

SEQ ID NO: 5855 - DNA, 601 bp, Human; identical to SEQ ID NO: 3908

SEQ ID NO: 5856 - DNA, 601 bp, Human; identical to SEQ ID NO: 3909

SEQ ID NO: 5857 - DNA, 601 bp, Human; identical to SEQ ID NO: 3910

SEQ ID NO: 5858 - DNA, 601 bp, Human; identical to SEQ ID NO: 3911

SEQ ID NO: 5859 - DNA, 601 bp, Human; identical to SEQ ID NO: 1099

SEQ ID NO: 5860 - DNA, 601 bp, Human; identical to SEQ ID NO: 1100

SEQ ID NO: 5861 - DNA, 601 bp, Human; identical to SEQ ID NO: 1101

SEQ ID NO: 5862 - DNA, 601 bp, Human; identical to SEQ ID NO: 1102

SEQ ID NO: 5863 - DNA, 601 bp, Human; identical to SEQ ID NO: 1103

SEQ ID NO: 5864 - DNA, 601 bp, Human; identical to SEQ ID NO: 1104

SEQ ID NO: 5865 - DNA, 601 bp, Human; identical to SEQ ID NO: 1105

SEQ ID NO: 5866 - DNA, 601 bp, Human; identical to SEQ ID NO: 1106

SEQ ID NO: 5867 - DNA, 601 bp, Human; identical to SEQ ID NO: 1107

SEQ ID NO: 5868 - DNA, 601 bp, Human; identical to SEQ ID NO: 1108

SEQ ID NO: 5869 - DNA, 601 bp, Human; identical to SEQ ID NO: 1109

SEQ ID NO: 5870 - DNA, 601 bp, Human; identical to SEQ ID NO: 1110

SEQ ID NO: 5871 - DNA, 601 bp, Human; identical to SEQ ID NO: 1111

SEQ ID NO: 5872 - DNA, 601 bp, Human; identical to SEQ ID NO: 1112

SEQ ID NO: 5873 - DNA, 601 bp, Human; identical to SEQ ID NO: 1113

SEQ ID NO: 5874 - DNA, 601 bp, Human; identical to SEQ ID NO: 1114

SEQ ID NO: 5875 - DNA, 601 bp, Human; identical to SEQ ID NO: 1115

SEQ ID NO: 5876 - DNA, 601 bp, Human; identical to SEQ ID NO: 1116

SEQ ID NO: 5877 - DNA, 601 bp, Human; identical to SEQ ID NO: 1117

SEQ ID NO: 5878 - DNA, 601 bp, Human; identical to SEQ ID NO: 1118

SEQ ID NO: 5879 - DNA, 601 bp, Human; identical to SEQ ID NO: 1119

SEQ ID NO: 5880 - DNA, 601 bp, Human; identical to SEQ ID NO: 1120

SEQ ID NO: 5881 - DNA, 601 bp, Human; identical to SEQ ID NO: 1121

SEQ ID NO: 5882 - DNA, 601 bp, Human; identical to SEQ ID NO: 1122

SEQ ID NO: 5883 - DNA, 601 bp, Human; identical to SEQ ID NO: 1123

SEQ ID NO: 5884 - DNA, 601 bp, Human; identical to SEQ ID NO: 1124

SEQ ID NO: 5885 - DNA, 601 bp, Human; identical to SEQ ID NO: 1125

SEQ ID NO: 5886 - DNA, 601 bp, Human; identical to SEQ ID NO: 1126

SEQ ID NO: 5887 - DNA, 601 bp, Human; identical to SEQ ID NO: 1127

SEQ ID NO: 5888 - DNA, 601 bp, Human; identical to SEQ ID NO: 1128

SEQ ID NO: 5889 - DNA, 601 bp, Human; identical to SEQ ID NO: 1129

SEQ ID NO: 5890 - DNA, 601 bp, Human; identical to SEQ ID NO: 1130

SEQ ID NO: 5891 - DNA, 601 bp, Human; identical to SEQ ID NO: 1131

SEQ ID NO: 5892 - DNA, 601 bp, Human; identical to SEQ ID NO: 1132

SEQ ID NO: 5893 - DNA, 601 bp, Human; identical to SEQ ID NO: 1133

SEQ ID NO: 5894 - DNA, 601 bp, Human; identical to SEQ ID NO: 1134

SEQ ID NO: 5895 - DNA, 601 bp, Human; identical to SEQ ID NO: 1135

SEQ ID NO: 5896 - DNA, 601 bp, Human; identical to SEQ ID NO: 1136

SEQ ID NO: 5897 - DNA, 601 bp, Human; identical to SEQ ID NO: 1137

SEQ ID NO: 5898 - DNA, 601 bp, Human; identical to SEQ ID NO: 1138

SEQ ID NO: 5899 - DNA, 601 bp, Human; identical to SEQ ID NO: 1139

SEQ ID NO: 5900 - DNA, 601 bp, Human; identical to SEQ ID NO: 1140

SEQ ID NO: 5901 - DNA, 601 bp, Human; identical to SEQ ID NO: 1141

SEQ ID NO: 5902 - DNA, 601 bp, Human; identical to SEQ ID NO: 1142

SEQ ID NO: 5903 - DNA, 601 bp, Human; identical to SEQ ID NO: 1143

SEQ ID NO: 5904 - DNA, 601 bp, Human; identical to SEQ ID NO: 1674

SEQ ID NO: 5905 - DNA, 601 bp, Human; identical to SEQ ID NO: 1675

SEQ ID NO: 5906 - DNA, 601 bp, Human; identical to SEQ ID NO: 1676

SEQ ID NO: 5907 - DNA, 601 bp, Human; identical to SEQ ID NO: 1677

SEQ ID NO: 5908 - DNA, 601 bp, Human; identical to SEQ ID NO: 2290

SEQ ID NO: 5909 - DNA, 601 bp, Human; identical to SEQ ID NO: 2291

SEQ ID NO: 5910 - DNA, 601 bp, Human; identical to SEQ ID NO: 2292

SEQ ID NO: 5911 - DNA, 601 bp, Human; identical to SEQ ID NO: 2293

SEQ ID NO: 5912 - DNA, 601 bp, Human; identical to SEQ ID NO: 3470

SEQ ID NO: 5913 - DNA, 601 bp, Human; identical to SEQ ID NO: 3471

SEQ ID NO: 5914 - DNA, 601 bp, Human; identical to SEQ ID NO: 3472

SEQ ID NO: 5915 - DNA, 601 bp, Human; identical to SEQ ID NO: 3473

SEQ ID NO: 5916 - DNA, 601 bp, Human; identical to SEQ ID NO: 3474

SEQ ID NO: 5917 - DNA, 601 bp, Human; identical to SEQ ID NO: 3475

SEQ ID NO: 5918 - DNA, 601 bp, Human; identical to SEQ ID NO: 3476

SEQ ID NO: 5919 - DNA, 601 bp, Human; identical to SEQ ID NO: 3477

SEQ ID NO: 5920 - DNA, 601 bp, Human; identical to SEQ ID NO: 3478

SEQ ID NO: 5921 - DNA, 601 bp, Human; identical to SEQ ID NO: 3479

SEQ ID NO: 5922 - DNA, 601 bp, Human; identical to SEQ ID NO: 3480

SEQ ID NO: 5923 - DNA, 601 bp, Human; identical to SEQ ID NO: 3481

SEQ ID NO: 5924 - DNA, 601 bp, Human; identical to SEQ ID NO: 3482

SEQ ID NO: 5925 - DNA, 601 bp, Human; identical to SEQ ID NO: 1772

SEQ ID NO: 5926 - DNA, 601 bp, Human; identical to SEQ ID NO: 1773

SEQ ID NO: 5927 - DNA, 601 bp, Human; identical to SEQ ID NO: 1774

SEQ ID NO: 5928 - DNA, 601 bp, Human; identical to SEQ ID NO: 1775

SEQ ID NO: 5929 - DNA, 601 bp, Human; identical to SEQ ID NO: 1776

SEQ ID NO: 5930 - DNA, 601 bp, Human; identical to SEQ ID NO: 1777

SEQ ID NO: 5931 - DNA, 601 bp, Human; identical to SEQ ID NO: 1778

SEQ ID NO: 5932 - DNA, 601 bp, Human; identical to SEQ ID NO: 1779

SEQ ID NO: 5933 - DNA, 601 bp, Human; identical to SEQ ID NO: 1780

SEQ ID NO: 5934 - DNA, 601 bp, Human; identical to SEQ ID NO: 1781

SEQ ID NO: 5935 - DNA, 601 bp, Human; identical to SEQ ID NO: 1782

SEQ ID NO: 5936 - DNA, 601 bp, Human; identical to SEQ ID NO: 1783

SEQ ID NO: 5937 - DNA, 601 bp, Human; identical to SEQ ID NO: 1784

SEQ ID NO: 5938 - DNA, 601 bp, Human; identical to SEQ ID NO: 1785

SEQ ID NO: 5939 - DNA, 601 bp, Human; identical to SEQ ID NO: 1786

SEQ ID NO: 5940 - DNA, 601 bp, Human; identical to SEQ ID NO: 1787

SEQ ID NO: 5941 - DNA, 601 bp, Human; identical to SEQ ID NO: 1788

SEQ ID NO: 5942 - DNA, 601 bp, Human; identical to SEQ ID NO: 1789

SEQ ID NO: 5943 - DNA, 601 bp, Human; identical to SEQ ID NO: 1790

SEQ ID NO: 5944 - DNA, 601 bp, Human; identical to SEQ ID NO: 1791

SEQ ID NO: 5945 - DNA, 601 bp, Human; identical to SEQ ID NO: 1792

SEQ ID NO: 5946 - DNA, 601 bp, Human; identical to SEQ ID NO: 1793

SEQ ID NO: 5947 - DNA, 601 bp, Human; identical to SEQ ID NO: 1794

SEQ ID NO: 5948 - DNA, 601 bp, Human; identical to SEQ ID NO: 1795

SEQ ID NO: 5949 - DNA, 601 bp, Human; identical to SEQ ID NO: 3560

SEQ ID NO: 5950 - DNA, 601 bp, Human
agcttcccagagctccagtcacaggactagagaggcgcaggcagtctcaaaagggatcccctagcctctctcttgtccttcaggcgctgcccccaaaagatcgagcagctcatgggcactagagccttcatttccaaatgcacccctcagctcaaaatagagaaaaccaacttttcaaagaaccagctggagttcaacaggaaaccacagcagaaaaaccaatgattcccggtcagccaaggggcagagggctaactgggcatttcagcatcactgccagctccctgggctggtattaccygcacgcaaggaaacaggaagactgactgccagcccataagtccaccacacacatatcacgccagtatgcacaaggacggacacaaactcaacagatgctcaacacactgatgtgcagaaacccagacacatacgtgcacaagagacactggcacacgcacatgttcacacaggtgcacgggcacccagatgcaggtacacaccaacgttccacaacacatgtgcacacactcacaaaggtacacacacatacacggacccacccccggatgcaagccagagacctgttcaggcaggcaaa

SEQ ID NO: 5951 - DNA, 601 bp, Human
tgcctgtaatcccagcactttaggaggccgaggcaggcagatcacaaggtcaggagattgagaccaccctggctaacacggtgaaacaccgtctctactaaaaattttaaaaaaaataaaaaaaaattagctgcacgtggtggcgggcgcctgtagtccctgctacttgggaggctgaggcaggagaatggcgtgaacccggaaggcagagcgcttgcagtgagctgagatcgcgccactgcactccagcctgggtaatagagtgagactccgtctcaaaaaaaaaaaaaaaaaaagaaaacagaaccaatggtgctgtcccactgtccaaggccattattcagtgacagcattcaatgccgctcaggcaggtcccagctcctcttccaaccccaatattcttcccagctctgtctggtacatgggacacttcagcaggcctgtcctgcccaggccaatccacacctggtacctctgcacacgctcctccctctgcccgggttgccaacctgcgtcttttccagctggccactcattcttccagcccccattcaaacagccccccaggagcacactctccaagtcctggccagagtgtccg

SEQ ID NO: 5952 - DNA, 601 bp, Human
gctcatgcctgtaatcccagcactttaggaggccgaggcaggcagatcacaaggtcaggagattgagaccaccctggctaacacggtgaaacaccgtctctactaaaaattttaaaaaaaataaaaaaaaattagctgcacgtggtggcgggcgcctgtagtccctgctacttgggaggctgaggcaggagaatggcgtgaacccggaaggcagagcgcttgcagtgagctgagatcgcgccactgcactccagcctgggtaatagagtgagactccgtctcaaaaaaaaaaaaaaaaaaagaaaacagaaccaatggtgctgtcccactgtccaaggccattattcagtgacagcattcaatgccgctcaggcaggtcccagctcctcttccaaccccaatattcttcccagctctgtctggtacatgggacacttcagcaggcctgtcctgcccaggccaatccacacctggtacctctgcacacgctcctccctctgcccgggttgccaacctgcgtcttttccagctggccactcattcttccagcccccattcaaacagccccccaggagcacactctccaagtcctggccagagt

SEQ ID NO: 5953 - DNA, 601 bp, Human
ggcgcggtggctgaggcctgtaatcccagcactttaggaggccaagatgggcagatcgcttgaggtcgggagtttgagaccagcctgatcaaaaggaaagaaagaaagaaaaaaaggaaggaaggaaggaaggaaagagaagagaagagaaagaggacaagcgaaaagaaaagaggctgggcgcagtggctcatgcctgtaatcccagcactttaggaggccgaggcaggcagatcacaaggtcaggagattgagaccaccctggctaacacggtgaaacaccgtctctactaaaaatttwaaaaaaaataaaaaaaaattagctgcacgtggtggcgggcgcctgtagtccctgctacttgggaggctgaggcaggagaatggcgtgaacccggaaggcagagcgcttgcagtgagctgagatcgcgccactgcactccagcctgggtaatagagtgagactccgtctcaaaaaaaaaaaaaaaaaaagaaaacagaaccaatggtgctgtcccactgtccaaggccattattcagtgacagcattcaatgccgctcaggcaggtcccagctcctcttccaaccccaatattcttcccag

SEQ ID NO: 5954 - DNA, 601 bp, Human
gggcgcggtggctgaggcctgtaatcccagcactttaggaggccaagatgggcagatcgcttgaggtcgggagtttgagaccagcctgatcaaaaggaaagaaagaaagaaaaaaaggaaggaaggaaggaaggaaagagaagagaagagaaagaggacaagcgaaaagaaaagaggctgggcgcagtggctcatgcctgtaatcccagcactttaggaggccgaggcaggcagatcacaaggtcaggagattgagaccaccctggctaacacggtgaaacaccgtctctactaaaaattwtaaaaaaaataaaaaaaaattagctgcacgtggtggcgggcgcctgtagtccctgctacttgggaggctgaggcaggagaatggcgtgaacccggaaggcagagcgcttgcagtgagctgagatcgcgccactgcactccagcctgggtaatagagtgagactccgtctcaaaaaaaaaaaaaaaaaaagaaaacagaaccaatggtgctgtcccactgtccaaggccattattcagtgacagcattcaatgccgctcaggcaggtcccagctcctcttccaaccccaatattcttccca

SEQ ID NO: 5955 - DNA, 601 bp, Human
acatacgcagcaacaaagtcagaaaaggaaagaagaggccgggcgcggtggctgaggcctgtaatcccagcactttaggaggccaagatgggcagatcgcttgaggtcgggagtttgagaccagcctgatcaaaaggaaagaaagaaagaaaaaaaggaaggaaggaaggaaggaaagagaagagaagagaaagaggacaagcgaaaagaaaagaggctgggcgcagtggctcatgcctgtaatcccagcactttaggaggccgaggcaggcagatcacaaggtcaggagattgagaccaycctggctaacacggtgaaacaccgtctctactaaaaattttaaaaaaaataaaaaaaaattagctgcacgtggtggcgggcgcctgtagtccctgctacttgggaggctgaggcaggagaatggcgtgaacccggaaggcagagcgcttgcagtgagctgagatcgcgccactgcactccagcctgggtaatagagtgagactccgtctcaaaaaaaaaaaaaaaaaaagaaaacagaaccaatggtgctgtcccactgtccaaggccattattcagtgacagcattcaatgccgctcag

SEQ ID NO: 5956 - DNA, 601 bp, Human
gatattattatgaataacttccgtctagtcactcaacctcccagagcctgagtgctccacctgtaaccagggatgagatgcctccccgaccagggctctgtgaggacaagaggtgccctgtgtaaagacccaggtccttagcaaagaagcctatcgtggtggcagcagagggggatttaacagtaggacagacacatacgcagcaacaaagtcagaaaaggaaagaagaggccgggcgcggtggctgaggcctgtaatcccagcactttaggaggccaagatgggcagatcgcttgaggtygggagtttgagaccagcctgatcaaaaggaaagaaagaaagaaaaaaaggaaggaaggaaggaaggaaagagaagagaagagaaagaggacaagcgaaaagaaaagaggctgggcgcagtggctcatgcctgtaatcccagcactttaggaggccgaggcaggcagatcacaaggtcaggagattgagaccaccctggctaacacggtgaaacaccgtctctactaaaaattttaaaaaaaataaaaaaaaattagctgcacgtggtggcgggcgcctgtagtccctgctacttgggagg

SEQ ID NO: 5957 - DNA, 601 bp, Human
gcttcgaagcttgaagcaagctatctcgacttttggagcctcagtttattcatctgtagaagggggatgatgtcgggatatgttccgtagggtgctgtgaggattaaacaaggcgaggtggcacagggggctcagctgagagcctggcacacaatgttaataggaacacagtcaactgtcacttaccatcattaccttttacgccaaaaggcttctcactgggtttttaatgggcatgtaaaaaccacgtgaaattagcacgcctaccacgctgcccaggagatactggaaaactcttccrcagcaacgtgaggcacaacaccactctgtgcagcctgttttgctcatgccttgtgcaaagggacattttgctgtggatactatgaataacccctcgctgtggatattattatgaataacttccgtctagtcactcaacctcccagagcctgagtgctccacctgtaaccagggatgagatgcctccccgaccagggctctgtgaggacaagaggtgccctgtgtaaagacccaggtccttagcaaagaagcctatcgtggtggcagcagagggggatttaacagtaggacagacacatac

SEQ ID NO: 5958 - DNA, 601 bp, Human
cccacaggagcctctgctcctacctggggagccccgacaccctagggaacccagaggttcctgcagcccctctttagtcttcctgacaacctctcattgcgatccaggcagtgccaaggtggggtgggaggaaggaagaccctaccagcggcagctgcaaatctcaggtgcccctcaccccactgcacagtcccaggacccgctcacacctgcctgatctgctctagcacctgagcctgctggagcccagtgtgtggcctcgaaggcagcagccttgctgggaaaaatgaaactcatctcratcccttaggccggcttctgacttctctctgtggcctttatgactcttaatgtccagcaagacagagtgggtgcctggcccagacagcagccccgcaggggagccccagcctgaaaggcagcagccctggatttcttcttgccatgcaaccttgggtctctctgagcctcagccacgcagtggggcagccctatctcacagggttgtggggttcgcatcaagcatccagggaagggcatacacttcctcctttgggccccaggattggaccaggccttggagggcggaccatctccaccg

SEQ ID NO: 5959 - DNA, 601 bp, Human
ccaaaggtgggcaggagacctgggctaggcccgcatcacagccatgggtttgaagatgggcctccaatccctcccccaactctcacaggtgtcacccagagaggagggctttccatctcaaaggttgcctccttggaaaacgagttgggcctggagccgctggtgggccgggggttgaggggtggagagcaattctgaaatgaacactgagaggcagggctgagaaatggatagcatgctctgagcccctggattcagccaggcctgaagccaacactcctcaggacccccagataattgsggccatgctgtcccttgtttgtttcatccaatatgagcaggggtttctgtcacttaaactgagcaagtcttaaggtgacaagtatggcggaggctgagactggccttagcagctgtgtaggctgcttgcagctggggcccacaggagcctctgctcctacctggggagccccgacaccctagggaacccagaggttcctgcagcccctctttagtcttcctgacaacctctcattgcgatccaggcagtgccaaggtggggtgggaggaaggaagaccctaccagcggcagctgcaaatc

SEQ ID NO: 5960 - DNA, 601 bp, Human
gggcgatcctggaagggtggggtctggaggagagtggggagagccacgtgacttgagtatggggtcatccagggaagggggttccagaggcagccgagcaggcaagcctggagcccaggaggacttctaagcccaacatggggtctggagtccaggagaagggtggccacaaccgtgttcaccaccctgcacaattctcctcccttcttgtatgataggcccctcttcattccagagtttgggagtctgtccctccccctcagtcccaaaggtgggcaggagacctgggctaggcccgcaycacagccatgggtttgaagatgggcctccaatccctcccccaactctcacaggtgtcacccagagaggagggctttccatctcaaaggttgcctccttggaaaacgagttgggcctggagccgctggtgggccgggggttgaggggtggagagcaattctgaaatgaacactgagaggcagggctgagaaatggatagcatgctctgagcccctggattcagccaggcctgaagccaacactcctcaggacccccagataattggggccatgctgtcccttgtttgtttcatccaatatg

SEQ ID NO: 5961 - DNA, 601 bp, Human
ttctataaaaatcagtagccttcctgtgtaccaatagatggaaagtattcaatgagcaatggcaaaaagaaaaaaaatccttgaaataatcctgatttttaaaaatggatgacctgtataaaaatatgtatatataatacttcatggtacaacatcaaagcagaatgaaataagctgaaaaaatatactatgttcctgatgaatactgtaaattatgtcaattcctcctttaattagtttctaagtttaatttactatcaatcaaattcacgagggatttttctacccgacaaaacaattmtaaaattcatttgaaagaataaacatatgtgaccagccaagaaaattttgtaagagaataccagcaaagggggacgtatccagccagatgttccaaagccacacagtccaacagaaatagaactcgagctttatatgtagccatgtttttaaaaaaaaaagacacaggtgaaattaatttcagaaatatattttatttaacccagtatgcccaaaatattaccatttcaacctgtaatcaatactttaaaatgatctattaaacattccacattctttttggggggtacgaagtctctga

SEQ ID NO: 5962 - DNA, 601 bp, Human
gcagtggcgcaatttcagctcactgcaagctccgcctcctgggttcaagagattctcctgcctcagcctcccaagtagctgggactacaggcgtgtgccaccatgcccagctaatttttgtatttttaatggagatggggtttcaccatattggccaggctggtctcaaacacctgacctcaagtgatctgcccgcctcagcctcctcaagttacacaggcgtgagccactgtgccccgcctacagatttcttctaaggagggaaatgtctttgcttggaaaaacaccttctagaagcacrtgggataacagataacagtgggactggaagagcaggagactctgcagacagtgccaccacctcagagcagcgggcaaagtccgctgttaagacacaggaggagaatggagggattgctccagagaaactggacagagggagggagacgccactgggagggaagaaagaacccacagatgaaagtggaaatgcccccacacatggcccaaagggctttccaagaacagggtcctgttcttccagaagtcacccgcgtggccgggaggtgctggctcccccaccttctgcaggaaggctgcc

SEQ ID NO: 5963 - DNA, 601 bp, Human
caagacagagacggcctacatctacccaccccataccatgcccagtcctggaccagccatccctggccccaaaggccacagcgtagtcaccacagctgagactgccccaatcagggccacctgcaatgtccagcagcctccctgcaactgccccggctttggtttttaatgtccctagtcccgagaatgcagaagctctgcaaagagaagaacgcagcaactctggcaacctgactgtggaggcagacacctggcacacatttcccctcccccagtgcccgtgatctccacccagcgctgsgcaccctccaacctccactccattcactcccagacggagcaaaggctggcctcattggccaccttgcccagcacaccacctgcacaaccttcccagcagccctgctcatcgggccaccctccccagtgaggacacagcccgtgacagcctgggcaccccaacaggaaagacagcccaaaggccaagccgccctatctgaggtggaggatgctctggcagggcagggactcagccttgaccttgtttgctagaaaatgcaccaagaactcagtagcaggccaaggagaggagacatgaatt

SEQ ID NO: 5964 - DNA, 601 bp, Human
cttatttccgtgagaaaattaaacatcatgaagatgtcgttcatttgttcagcaaagatttgctgagggccttctgcaaaggggacactactttaggcatttttttaaaacctcacgatggtgatacttgccctatcagatgtcagaacatattgtcaaccaacagcaattaaagacccctggactggtgcaaaagaaaaacagaaaaggccaggcacagtggctcatgcctgcaatcccagcactttgggaggccaaggagggcggatcacgaggtcaggagatggagaccatcctggckaacacggtgaaaccccgtctctactaaaaatacaaaaaattagccgggtgtggtggcgggcgcctgtagtcccagctactcttgaggctgaagcaggagaatcgcttgaacccaggaggcagagcttgcagtgagccgagatagtgccactgcgctccagcctgggcaacagagtgagactccgtctcaaaaaaaaaaaaaaaaacaaaacaaaacccagaaaggccagaaataaaccccatatcctccatgaacttcacagatgatggaatatacattccaaagtcaagaagaaagagt

SEQ ID NO: 5965 - DNA, 601 bp, Human
atctgaatcaatcttcttatttccgtgagaaaattaaacatcatgaagatgtcgttcatttgttcagcaaagatttgctgagggccttctgcaaaggggacactactttaggcatttttttaaaacctcacgatggtgatacttgccctatcagatgtcagaacatattgtcaaccaacagcaattaaagacccctggactggtgcaaaagaaaaacagaaaaggccaggcacagtggctcatgcctgcaatcccagcactttgggaggccaaggagggcggatcacgaggtcaggagatsgagaccatcctggctaacacggtgaaaccccgtctctactaaaaatacaaaaaattagccgggtgtggtggcgggcgcctgtagtcccagctactcttgaggctgaagcaggagaatcgcttgaacccaggaggcagagcttgcagtgagccgagatagtgccactgcgctccagcctgggcaacagagtgagactccgtctcaaaaaaaaaaaaaaaaacaaaacaaaacccagaaaggccagaaataaaccccatatcctccatgaacttcacagatgatggaatatacattccaaag

SEQ ID NO: 5966 - DNA, 601 bp, Human
ccaccgtggggaaatgggcctgggagatccattcaggccaaggtttgtccactttgggtctaccaccaccagcattcacagaagaagcagcacctggttctcaattcccttagaagcggggctagatgctctgaaggcatggttgtagctcccacacaaaattactaaagacataaaacgaaaacatgttgaaaaagaagagacaatattatgaactgcagaaagtaactgcacacgtagagaatcctcacccccaaaaacatccaaaaaaaggaaccaaataataacaaggaagttcatraaaagtctagatgcaaaataaatagagaaactcatatatctgggaacgcaaacatgggaaacatccaagcgagagatttaggtttgttttgttttgttttttgagacagagtctcgctctgtcgcccaggctggagtgcagtggtgcaagcgatctgagctcactgcaggctccgcctcccgggttcacgccattctcctgcctcagcctcccgagtagctgggactacaggcgcgcaccaccacgcccggctaattttttgtatttttagtagagacggggtttcaccgtgttagccag

SEQ ID NO: 5967 - DNA, 601 bp, Human
aaaagccaaacaaaactcatctgtgggtggacatggcccgtggcccaccagtgtgcaaactccgccctgcacaatgggaaccctgaagtgcagaaaattatctcattgtgaagggtaaggcagggactcaaaacagggctcctcagtccacattcatagagtctccaggttgtaccaccgaatctactcgccagccttctcctgaaagtgtctcactgaaccacatcccccgtagaaactcagggcatctttcaaagaccgcagttttcctgccagcctgcaaacaaccctgtgcatgccyggtgcactgctccccaaccacaggggacacctaacagaccacgagggactgagagagcctccttgactgaaagggaaggtcaaccgccgccactcatccccataaaaccacaacatgggcacatcctgcgttcgaagctctacttgatgcaagagagcagggaaaggaaagccgtgccaccgtggggaaatgggcctgggagatccattcaggccaaggtttgtccactttgggtctaccaccaccagcattcacagaagaagcagcacctggttctcaattcccttagaagcggggcta

SEQ ID NO: 5968 - DNA, 601 bp, Human
ttttcagattcaacttcagccaagacaaatggtcccctcctgcacctgccacaggcactgtttccaacgtgggcagagttgacagttgatgggtgtgtgtgatctttcggagctcctgtcccaggcccacaggatgaacgggaaggtggacatggtgggtagagcaagcaggaaatgatgatggtcaggaggggccttgaatgctggttctgggggcctgtgctttaccctcaaagtggaggagccatggggagcatttcgggtggggcacggaagggagaccgcgtgcttatcatgggcrgctggaagggagtgggagaaacgggggcagggagaagacagggcagatgtcctggagacagaaggcaatggggacccatagctcctcctgacacatcagcctggctttcctctggggcccatcctctccccgacccactcccagagggtcagaggacagacgccagccctggagccacagcagtcctgtgacgaggcctggccagccgaagtcctgctccgctgtcctggccatagtgatttgcctgaagcatgtgacccaacctgagccagtgagaactcaccactgggctctcccaga

SEQ ID NO: 5969 - DNA, 601 bp, Human
gggttcacgacatggaacagctgtgctaactaccaggacagaagacaggaaggtttgctggaagaggggtgatgagaagttggccaggcctatggggttcccagcattcaggcaaaagcccagaggtcctcagggaccccccactgtctgctctgctaatgcaaagcccatgaggcccaaggagtctcagcttcttcagccacccgatcacaccccgacacacactaggccctggttccttcaagtccttaggtcattttcagattcaacttcagccaagacaaatggtcccctcctgcamctgccacaggcactgtttccaacgtgggcagagttgacagttgatgggtgtgtgtgatctttcggagctcctgtcccaggcccacaggatgaacgggaaggtggacatggtgggtagagcaagcaggaaatgatgatggtcaggaggggccttgaatgctggttctgggggcctgtgctttaccctcaaagtggaggagccatggggagcatttcgggtggggcacggaagggagaccgcgtgcttatcatgggcagctggaagggagtgggagaaacgggggcagggagaagacagggc

SEQ ID NO: 5970 - DNA, 601 bp, Human
taatgaagctctgatgcatgctgcaacctagatgaaccttgaaaacattatgctgagtgaaagaagccagacacaaagggcaaatattgtgtgattcatttatactaatgaaatgcccagaacaggcaaatctatacaggcagaaggtaggtcagtggttgcctaggcctgggaggacggggtaattgggggttactaaagggtctggggtttcttttcagagtcttgaacatgatctaaaattgtggtgatggttgcaccattctgtgaacatactaaagccattcattgaattttacgytataagttggtaaaatacatagtatgtgaattatgtctcaataacattattatcaaaaatgtgtaaggtataataatgattaaaaattttaaaagcatgtgtatgttgatagctttatttttctctttttttttttttttgagacagagtctcactctatagccccaactggagtgcagtggtgcgatctcagctcactgcaacctccacctccagggttcaaacaattctcgtgcctcagcctcctgaatagttggaactacagatgcccgccaccacgcccggctagttccttgtatt

SEQ ID NO: 5971 - DNA, 601 bp, Human
ctaaggacagagagaatacttcggggaggagaaagaagcagacaccaggcttcgtggcaggtgtcagcatggctgagggcaggcagaacagccgccagcttgatctggacacctggtcctgccacaggccacagcacttgccaggggccgttgggtcctgtcactgccctgtgggagctccctggagagttcttaacctgggctccataaactgggaaaagagaacacttcaacttcatctttactaactgggaactgaaagctgccattcccttcaactctggagagaggcagcaacccsagacttaacagcacctgcgcccatcagggcagaaatcacaggcttcggcaactgtcagcaccgctgctgcagaccagaccaaatggtgtttacactcagcacaacttaaattatagaggctgtaagatgcactcctaggtcttattatttaatgcatcaattaaaagcacacaaaaaagttttacatgaatgttcctggcagcattattcacaagagctaaagggtggaaacaacccaatccatcaacccatgagtggatttaaaaaactgtggtacatccatgcaatggaatcatatct

SEQ ID NO: 5972 - DNA, 601 bp, Human
tagttctagatatttttctttttgcagattaaccaataagtttttttttcttttttctgaagccacttttacttggatttccaacacttgaggaataacacctgactaatacactctctcttctatagcttcaaactctccatctcccggatcctcatcctcggtccctgagcaaactcaagccacctaaaatcctctgtgctcgaggcagggccacacacacatctacacaagcgcacacgtaaacactgcactcacatctaagactgcacaccctccgcagctgatgtctgccccaccrcagcatgtgtgccatgcgcaccagcttccctccactcccttgcctctcactggcccctcacctggtcagtctagcttccaccaactccccagcgaccctgcaaagccccctcttggctgctgggcctgatgccccctgccatcccaattccctgaaccccctcctcttgaacctctctcatcctttagcaggtgggcagccccgctcctaagaccccactgcctcctccacttgtctgcacatggtggggggccaaggagcacttccttccccttctgcctccctcttcctttggtgccc

SEQ ID NO: 5973 - DNA, 601 bp, Human
ttttgggttttttttgagacggagtctcgctctgtcactcaggctggagtgcagtggcacgatcttgactcactgcgagctccacctcctgggttcacaccattttcctgcctcagcctcctgagtagctgagactacaggtgtccaccactacgcctggctaatttttttttttttttttgtatttttagtagagacgaggtttcaccattttagccaggatggtctcaatctcctgaccttgtgatccgtccacctcagcctcccaaagtgctgggattacaggcatgagccactgttyctggcccacccttctccttctgatagcacagcccctgtgtcactcaggaaccagctctcatccctgcgtcaccagtgggcaaggagggcacatgacccagcctaggccaggtagaatacgttgtcatctgactacatgaacatagctcagggatgaggacttgccacaaggtattccatgaagttaaatccaggaactattgctggaattgttggaaaggaaaagctgtttcccccgggttgttgccctgtgaggaggtaatgcagcagctgcctgcatccatttttctgcctcagagaa

SEQ ID NO: 5974 - DNA, 601 bp, Human
tctctcctgctgtgctcctgggcagcagctccctcctccagccttccaggtctcccaatcctggccccagccacttccttgggaaccctaagcctgcctggagtccaccctcctccatttttttgggttttttttgagacggagtctcgctctgtcactcaggctggagtgcagtggcacgatcttgactcactgcgagctccacctcctgggttcacaccattttcctgcctcagcctcctgagtagctgagactacaggtgtccaccactacgcctggctaatttttttttttttttttgtatttttagtagagacgaggtttcaccattttagccaggatggtctcaatctcctgaccttgtgatccgtccacctcagcctcccaaagtgctgggattacaggcatgagccactgttcctggcccacccttctccttctgatagcacagcccctgtgtcactcaggaaccagctctcatccctgcgtcaccagtgggcaaggagggcacatgacccagcctaggccaggtagaatacgttgtcatctgactacatgaacatagctcagggatgaggacttgccacaaggtattccatg

SEQ ID NO: 5975 - DNA, 601 bp, Human
ctccatgtctgcctcgtgtccttctctctcctgctgtgctcctgggcagcagctccctcctccagccttccaggtctcccaatcctggccccagccacttccttgggaaccctaagcctgcctggagtccaccctcctccatttttttgggttttttttgagacggagtctcgctctgtcactcaggctggagtgcagtggcacgatcttgactcactgcgagctccacctcctgggttcacaccattttcctgcctcagcctcctgagtagctgagactacaggtgtccaccactacgcstggctaatttttttttttttttttgtatttttagtagagacgaggtttcaccattttagccaggatggtctcaatctcctgaccttgtgatccgtccacctcagcctcccaaagtgctgggattacaggcatgagccactgttcctggcccacccttctccttctgatagcacagcccctgtgtcactcaggaaccagctctcatccctgcgtcaccagtgggcaaggagggcacatgacccagcctaggccaggtagaatacgttgtcatctgactacatgaacatagctcagggatga

SEQ ID NO: 5976 - DNA, 601 bp, Human
acagctccttctcagaccagggcaggtggggcaatgccaaggccccctcggctcaggatggagctgagcctccccaggatgactcccctgggggaaacactgatgtcgctgtttgagcgttgagacgttggggcctggcctctgagaggcggggccccgaagggtcttccaggaaggtcagaccccagcccaaaagcagcaggcctgggccacaaagagagctggtccctgggccagaaagccctcttccaccatgcactctgggcaaggggcgtgtgtgccattaggaacacagctgcaygctatttctctcctgtcttcctccagctgaagatttcacacagccctgttatgactgagggttcccaacagctattccctcaacacacaggcccccacacacatgcatgtgcactcatgcactcccacatgcagcatgcatgcacccacatacaaatgtccatacgcatcacatgcaccacgtgtgcactcacacgcaggcgtcacacaggcaccatgcagacgcatgcacacacacatcactcatatgtgcatctcctgtgacacatgcatcacatacacatgtccacacatgtgcact

SEQ ID NO: 5977 - DNA, 601 bp, Human
ggacacatgccccacacaaacgcccccacatgtgcatcgcatacatcacccacacacacacgtgtacatttcagcacgcgtctaggggaggttagcgtgccagcaccagctgagactccctggccagactcatcgccagttggggagagtggagcagacgtacaggatggagggtagaggtggggctggtccacagtgagggagggaggcaggtgtagactgggccagggaaaggttctggaaacccagactgaaggttccctggggtccctggggctcatccagggctggggtggagccrggacatgaggaacgggcagtgatgaatctgaagccctgctggtcagcagagcctccacctgcacgtcctccccaaaggtcaggcaggcttcaccctggccacgtctctaccctggccattagcaaagaggccccccttggaccaggaggaacacagcaggccagccctcctgcccttcccatccaaggctccagccactctcatggagactctgagctgagacactcccagcagaaagggtcatttatctcagagcttaactagccccttccaattagtgaggaataaaatggcagcatt

SEQ ID NO: 5978 - DNA, 601 bp, Human
acttctataagcacggacccagaggccatcccagcgacactgtgtggggactcctgcacctcttcctgctgcccagaccatgggtggccagcagcactgcagtgttggtgtaatctatgtcccccggatggccagcgggcacagagcatatgtgtgctgagggacacatgccccacacaaacgcccccacatgtgcatcgcatacatcacccacacacacacgtgtacatttcagcacgcgtctaggggaggttagcgtgccagcaccagctgagactccctggccagactcatcgccagytggggagagtggagcagacgtacaggatggagggtagaggtggggctggtccacagtgagggagggaggcaggtgtagactgggccagggaaaggttctggaaacccagactgaaggttccctggggtccctggggctcatccagggctggggtggagccgggacatgaggaacgggcagtgatgaatctgaagccctgctggtcagcagagcctccacctgcacgtcctccccaaaggtcaggcaggcttcaccctggccacgtctctaccctggccattagcaaagaggccccccttg

SEQ ID NO: 5979 - DNA, 601 bp, Human
gtcaaggttgcagggagctacgattgcaccactgccttctagcccgggagagagcaagaccctgtctcaaaaaaaggaaatatatttaattttttaaaaagaatacacagtggtgagaaaggatggaaagaagagaggaaaggaaggaaaggatagggaaagaacaaaagaaggaaagaaagaaattccagctaattctcagcaacagacaattacaggaacacaaggacaaagcccagagccccaaccccacgtggcctgggtccccacagcctccagccctcctgtcactctgccagcyggcagcagggccacctctgagcatccttttcctcagcactttggcgtctttcctcccagtggtttcttggtagttcctcataaatccatgcgtaggtctggctacagctatccttgtccctgaagatggactcagctagcagagtcgctgatatggtaacacaatatcacacatctcatccaagcctgctcggacgctgcccttctgaccccgattcctgtcaccaacacaacaggaaaggagcttgaagacccaggaggccacagcacagttcctcgtggagggagagagatgcgagca

SEQ ID NO: 5980 - DNA, 601 bp, Human
gggaagccatctctggggactttcctcccatctcccttgtcccgctcacgaggagaagccagagctagaagctggcatgagccctcctagcaccaccagccacagtctccacctccggggacacgagctgggatctgagtggcgcaggtactatgttctagagaggccgtacccaggaccgcccatggcacgcagaggaaaactgaaacaacgatccttccagagacaaagcacagccccagatggccacaggaactggccgcccccaggagctgctgagcacaaacgccactggagagarggcttggtggctgcaccgaagagcagaacagaggaactgaacagccacagccaccgcagaactgggggatctggacagagctctcgctgtgtgctaagaaaggagcaagagacagagggcagggagaaaagctgcgagacgtgggcaagtcccagaagagagtcggggaggtgagagaaggaatatttcaaaaaacaaaattacatgaaagattccagcatggatgggttcctagaggccttatcaatacatatataagaaaaagctccatagctagacccacgataatgaaacctaaga

SEQ ID NO: 5981 - DNA, 601 bp, Human
ccacacccctgcctatgcccagacctccagcttcaggctctgcatccacacggaggcttcggattgggcgcagcctgggagcacacagaccggccagggccagggccaggactggcatttcccgggctcctggtcccatcctgcccctcccaccgggtcggccctgtccttgtcttgctcagctcgggggaagcacctctcgccagccatctggggcttggctgggcctcagcctcctggctgccacgtctcactgggagctgggcggccgccagctctgagctaagtgagcgcagaggaragtgcagggagcggcaaggccaggctcctccccaccccgtggcgtggcgtggcgtggccggaatactcagttttccctgctttttgagacaagagtagtaaatgcaccgtgctgtactcagagcccaggaagcagccctcccacccacagcgctcctgcctctgcagccccccgggccgtgtctctctctcacgggcccacatcctcactggactgtctcccttttacagatgaggtgagacagcatgcagaggcccatgtgcttgtcccacagggtgacgggccagaattacaagcccc

SEQ ID NO: 5982 - DNA, 601 bp, Human
agaggagggcctggccggagcaggggtgtcagcagaggggacgcacacgcattcacactcgtgcacacacacactcacaccgagacagaggagggcctggccggagcaggggtgtcagcagaggggacgcacacgcattcacactcgtgcacacacacactcacaccgagacagaggagggcctggccggagcaggggtgtcagctccaggaccaggagttcccaggcagaacctgatggtggggcgggggggttcctcacacaccccacacccctgcctatgcccagacctccagcttcrggctctgcatccacacggaggcttcggattgggcgcagcctgggagcacacagaccggccagggccagggccaggactggcatttcccgggctcctggtcccatcctgcccctcccaccgggtcggccctgtccttgtcttgctcagctcgggggaagcacctctcgccagccatctggggcttggctgggcctcagcctcctggctgccacgtctcactgggagctgggcggccgccagctctgagctaagtgagcgcagaggagagtgcagggagcggcaaggccaggctcctcccca

SEQ ID NO: 5983 - DNA, 601 bp, Human
tcctcaggagtggcctgtgaagaggggacgcacacgcattcacactcatgcacacacacacaccgagacagaggagggcctggccagagcaggggtgtcagcagaggggacgcacacgcattcacactcatgcacacacacatcacaccgagacagaggagggcctggccagagcaggggtgtcagcagaggggacgcacacgcattcacactcatgcacacacacactcacaccgagacagaggagggcctggccggagcaggggtgtcagcagaggggacgcacacgcattcacactcrtgcacacacacactcacaccgagacagaggagggcctggccggagcaggggtgtcagcagaggggacgcacacgcattcacactcgtgcacacacacactcacaccgagacagaggagggcctggccggagcaggggtgtcagctccaggaccaggagttcccaggcagaacctgatggtggggcgggggggttcctcacacaccccacacccctgcctatgcccagacctccagcttcaggctctgcatccacacggaggcttcggattgggcgcagcctgggagcacacagaccggcc

SEQ ID NO: 5984 - DNA, 601 bp, Human
taccggggctccctcctcaggagtggcctgtgaagaggggacgcacacgcattcacactcatgcacacacacacaccgagacagaggagggcctggccagagcaggggtgtcagcagaggggacgcacacgcattcacactcatgcacacacacatcacaccgagacagaggagggcctggccagagcaggggtgtcagcagaggggacgcacacgcattcacactcatgcacacacacactcacaccgagacagaggagggcctggccggagcaggggtgtcagcagaggggacgcacaygcattcacactcgtgcacacacacactcacaccgagacagaggagggcctggccggagcaggggtgtcagcagaggggacgcacacgcattcacactcgtgcacacacacactcacaccgagacagaggagggcctggccggagcaggggtgtcagctccaggaccaggagttcccaggcagaacctgatggtggggcgggggggttcctcacacaccccacacccctgcctatgcccagacctccagcttcaggctctgcatccacacggaggcttcggattgggcgcagcctgggagc

SEQ ID NO: 5985 - DNA, 601 bp, Human
tccgggtgggcccagggatagacagaatgtttatattccccccaaattccgatgttgaaagctactcccccaaggtgatatattaggaagtggggcctttgggaggtgattatgtcaccagattccatccacacgaatgggatttgtgccccgatcagagggaccccagagagctccctcaccctttcagcatgtgaggatgcaacaagatgccttcttgaaccagggagcagaccctcaccacaaccatatgcacagcttccagaaccgtgagaaataagcttccgatgcttttaagccrctccgtttatggtatttggctatagcagcctgcatggactaagacaggccctaaatgcaatcacacttctctttatcagaggaaggcagagcaagatgagccaggcagaggagaaggccacgtacaggcagagcagagggagatggaggatgtcggccctgaagcccagagcgaagaggccacaagccaagcactgctggctgccacgaggacctggaagagcccaggacgcatcctcccctagaggctccggagggagcgcggccctgccgccacctgcgttttgccctgttgaaactg

SEQ ID NO: 5986 - DNA, 601 bp, Human
ccttgatatctggtcaggctcgtcctccccatcacccctctggtgatgtctggtcaccccagcctgtcttcagctagaatcatgttaggtgagtttagctagaatccccgacccctgatgttgctcttagtaattccccatcccctggcccctaccctgctccttggctatcaccccccactcgcccgtgctgtattcggagttgagcccagtctctctccccgactgcaagagcccactctagcggttcctgtgtctatctccatggtcctgaataaagtccgccttaccgcgctttaayaagtatcattgaatcatttttcatttaacaacactctgccttgctgaagggaaggtagaaatgacagcagtggggaggagggagaaggggcatgggaaccctgtgccgctaagggcatactctagaccctctgccccaggctaatgttagaagctgcagaggtgcaaatataacagtcagacgaccatggcagtggtcagctgaaaaatggcccccgaagacacgtccgggtcccaatccctggaacccataaatgttaccttccatggcaaaaaagaactttgtagatgcggtgagtcc

SEQ ID NO: 5987 - DNA, 601 bp, Human
caggaaaccatttttccagacagcattatataaggggaggatgcgtatgttcagcagatgttcactctgaggccgagcctcccccgccctctgaacaggaaggccacgtccccatccctctcccccagggcctggcgctcctggcccaggtggagctggcctctggctggccacttctctggaagggcctcgtccagctctgtcctgtgcagggtcatgcccctccactctgctctctctagcccatgggcaggcgccgcctggctcagaggcacagcaatgggccagggtcagacagtgktgagcagcatgccaagaatcacagggacatccacctgccagcaaagcctcaatgacaacaaaggacctgaacagtggacactgacagggactctcctgcttgaccaaactttagtccagctcctgaaccttctccttcgcccacttccttgtaagatccagtttatcaagaactctgctaagtcacgaatgccccatctctccatatctgatcacccttgatatctggtcaggctcgtcctccccatcacccctctggtgatgtctggtcaccccagcctgtcttcagctagaatcatgt

SEQ ID NO: 5988 - DNA, 601 bp, Human
gctcccctggtcattaaatatctcaggatttccaggaacaaggagaggttcaagtccacagaagaatctgattggcgtctctgggccacccaccggtgctagaatcccggctggggtgagggatggtggtgcagagcctggctatgcaaaatgtggcctggagcagcctgggggcccccgggagcttgttagagatgctgaatccaggccccatccagaccagctgaactaaaacctgcattttggcaagttcccaggtggtctgatgacattgaagtctgggacacactgctctagaccytcccagggtccctcaaaggtgggtgtagaggccctactgccctgccctggggacgcagaggcatcagggccttagtcctcctggggacagtgaaagggccaccaccccagaccatggccaaactgcaggggtcagggaggcatggcccaggacagcagctcagcagggtgcccaaccccacctgcccctgcctgccccaacccacttgccggctgggtcctctggacctccgcccctttccaccccaggttggagccaaagaccaccctctccactccccagccccccaccccccaaccc

SEQ ID NO: 5989 - DNA, 601 bp, Human
ggacggccctcctcccccaccaggctgcagctcccagcgggcagggatctaggcatgccttgctcataccacaaggcagaaacacagtgaagaaagacagagaactggtcttgttgtctttgggggctcagccccccagctccaagctggaggatcaggaggcatctacaagcctttccgaagcccccccataggctgccttgcagggtacagtatggcctagagagccccagagggctcccctggtcattaaatatctcaggatttccaggaacaaggagaggttcaagtccacagaagwatctgattggcgtctctgggccacccaccggtgctagaatcccggctggggtgagggatggtggtgcagagcctggctatgcaaaatgtggcctggagcagcctgggggcccccgggagcttgttagagatgctgaatccaggccccatccagaccagctgaactaaaacctgcattttggcaagttcccaggtggtctgatgacattgaagtctgggacacactgctctagaccctcccagggtccctcaaaggtgggtgtagaggccctactgccctgccctggggacgcagaggcat

SEQ ID NO: 5990 - DNA, 601 bp, Human
agagctggagaaaggccacctcttcgggacccaggtcacaggatgtccccccaaagccatcccagtcagatgtctgcagacacctgctcccctggcaacagtgacccagacctgaccttcaactctaactgtgcacagcttcctagcccggcccccaagcctgaagcctggtccctccagacactgcagaaagctggggctgactgtaatcccagcactttgggaggccaaggtggggcgggtcacgaggtcaggaaatagagaccatcgtggctaacatggtgaaaccctgtctgtactraaaatacaaaaaaaatagccacgcatggtggcacgcaccggtaaccccagctactcaggaggctaaggcaggagaatcgcttgaacctgggaggcggagttgcagtgagccgagatcatgccattgtactccagcctgggcaacacagcaagactcagtctccaaaaaaaaaaaaaaaaaaaaaaaaaaaggctctggccctgccacttgaccgggtgggtcacctctccgtgcctcagtttcttctatttaaaatgcataggggaggagctctgagggcaaaacaccctgggtttgcct

SEQ ID NO: 5991 - DNA, 601 bp, Human
tgccagctggaaaggtcacgcacgccagctggaaggggagccgcgcagcccctgggcaggctgaggacaggaacgggcagccgccactgttcacgagcaagggtgcaggggcaccagagcccacaggagctcctgcaatgcgatgaccatgcctgcaggcccccataatagacagcctcattttttttttctaggcaaaactttgggaggatcctttttaattgtatttgcaaaacagtttctcccaacatgatgcccatgtgtatgtggattgggggaaattcccaaggcctctcagagragtgcctccttcctaaggtggtgtcccagcagatgaatctggctggcgtcctgagtggaagcagggcgcgggctgccatggaaccccaccctcctgcaggttcctggcccctctgcctcctcttccttcccaccccaggggccctgggatgcagctaggccagctgggagccagacagccactgaagccctcggggtactgttccctgcctttagcatccccctcagctgcccattcattcagccattcttctaggaggacaggccaggccatggtgaggccctgggtccagggaaagat

SEQ ID NO: 5992 - DNA, 601 bp, Human
tccctgtggtgcagagtgggccaagtttgccgccttctggagcgacaacaaggagaaaacaggggtttaagtggaggatccggtgctctgatttctccccagttagtaaagcattcaggctgctcggtggaggtgggaagacaggcgctgagagttgtctgacacaattgtcttagcagcaggagacgctgatgggatgtcgggagtcaccaggaccatctgacaaatgaccgccttggggatccgtggagctcagcggtgcccagagagagcactcgaaatgccagctggaaaggtcacrcacgccagctggaaggggagccgcgcagcccctgggcaggctgaggacaggaacgggcagccgccactgttcacgagcaagggtgcaggggcaccagagcccacaggagctcctgcaatgcgatgaccatgcctgcaggcccccataatagacagcctcattttttttttctaggcaaaactttgggaggatcctttttaattgtatttgcaaaacagtttctcccaacatgatgcccatgtgtatgtggattgggggaaattcccaaggcctctcagagaagtgcctccttcctaaggt

SEQ ID NO: 5993 - DNA, 601 bp, Human
ccttcttccagaagtccaggtcctagctccgatgcctcctcacaaggaccttggtgaagggtgtcccttctccatcacactccacactgccatcctgtcctatttttttgtaacaccatttcccaatcatcgacacgtgggttctttattgggtcactctctgccccctgaccagggatcttacgagagcaaagttgtccttgctgggtccacgtcaccagaccagtgcctggcatctcacaggcatggagttgagtacgggaggtcgccggccctcccgaggctcccttcccctacttcrggatggtgtaaggtttccttgccaaggtccctgtggtgcagagtgggccaagtttgccgccttctggagcgacaacaaggagaaaacaggggtttaagtggaggatccggtgctctgatttctccccagttagtaaagcattcaggctgctcggtggaggtgggaagacaggcgctgagagttgtctgacacaattgtcttagcagcaggagacgctgatgggatgtcgggagtcaccaggaccatctgacaaatgaccgccttggggatccgtggagctcagcggtgcccagagagagc

SEQ ID NO: 5994 - DNA, 601 bp, Human
tagtttaaaatcctgcaaaaaagaaatttccaggtctagacggttttactggaaaattctactaacctctcaggaaaaaatggcaccaattctcccattcattttatgaggtcaacattaccctgatattaaaaccagacaaagacagttcaataaaaaaaaaaaccctacaaaccaatatccctcatgaacctataaaccaatatccctcaatgaacatagacacaaaaatcctcagcaaaacactggcaagtctagtccagccatgtataaacagcagagtgcacaacagacaagtcaygtttgtcctggatttgcagagtctggcacaatatccaaaagtcagtgtaacccagcatattaacagactgaagaaggaaaaaaaatatgcttatatcaagtgatagagaaaaccatatgatatgattcattcatgactaaaaattaaaaactctcaactaacagagaaagaaacgtgctcaacctggtaagaatatctacaaaaaaactaaagctaacacaataccgcatcctgagaaactgttttcccctaaaataaggagcattttcacgactcctactcaaccttgggttgagtcct

SEQ ID NO: 5995 - DNA, 601 bp, Human
ctaccctaagatggttgctgaaggaagttcttcagacagggggaaaatgatgctagaaagaaattttgaacatcaggaataaaggaagagcaacagaaatacctgaaaaaatataacagattaggctcttgcgtattttaaagaggaatgataatgctgtctgatgtagttttccatgtatgtaggtgtataaaagacaacaacattcaggggaggacagagggacctatatgatggcagggtctcaacattcaacttgaagtggtaaaatattgatttgaaaaagactctgaagagttayataggtttattataatccctggagcaaccagtaaacactatacaaagatatacaaccaaacacaataggtaaattaaaattgaataccaaaacatgctcaaatagaaaaagcaaaataagcccaaagcaagtagaagggaggaaatgataagagtaaaaatcaatgaaactgaaaatatgaaaataatagagaagatcaatgaaaccaaatttggttctttgtaaagatcagtcaactgataaatctctagtgagactgaagaagagaaacagaaaaaaatatgaattaccagtatcaga

SEQ ID NO: 5996 - DNA, 601 bp, Human
aacagataacaagactgagatagcacatatgttggaattaactgacaatgatcttaaagcagctattataaaaatactccataaagtaagggcaaaaactctggcaactaatggaaagatagtctcagcaagaaacggaagacatatttttaaaaaggaccaaacggaaattttagaactgaaaaatacaataacagaaactttaagaactcactggataggctcaagagcagaatggatatgacagaggaatgagtcagtgaacttgaggatagagcaatagaagttacccaattcaaaytgcagcgagtaaaaatattttataatgccaagagccttagagactgtgggaaaataccgaaagatctaactaacagtcatgtcccagaaggagaagagaaagaatgtattactaaacaaatatttggataaataatggctgaaaacttctcaaattctgtgaaatgcataaacctaccaattcaacagatcggcaaacctcaaatgagagaaatccaaggaaacacaatcccacacgttataaacacactctgaaaactatagacaaaaaaaagtcttgaaagcagtcaaagaaaaacag

SEQ ID NO: 5997 - DNA, 601 bp, Human
tgcatcccccactgcctgcagccacccaaatgcactggattcatgagcagctagctgaggaccctgcaaaataaataacagcatgcagattggggaagaagactagaatgtgaggttcagcaaacccgcagagtttactcttcattctctggtattcctcagcctagatacaaggcaggtcaaactccagaagcgggcactgggtacagacagacagagctcgagacaagccctgttgttgtagctcaaggatagaaaaagcatttccgaatgctcagagccaagccaacacctcattttwctttcctatttcctttttcttttcttcgtgttctcacacgccagctcatggcagcccacaggcacctaaaactctaagaggggagcctggctgtgtagctggaagtgctgtggtcctagaaaggtggagtgaaaccccattgctctttcctcttttggtcctcccaggagtgtagttgcaggaagtgtgcaagacagcagggtcaataaagccccagctttctggccagagagatttaacaaggagccgcaggaaactggacagggctaggaagatggcagagacagcagagcttgggga

SEQ ID NO: 5998 - DNA, 601 bp, Human
tataaaggaggccctggtttaagaagaatgatgtgcacactcaaaagtgcactttaaggccaagctccgaataaacacgatgatattattttatttaagagtcttcatacatacaacttaattcagtaacagtctgagaaacgcaagccagcagacagataaaccgttatggctctggctctggcaaaaactcttcatctacgcggagccagaagaaagccaattaaaagtcggagaggtcccgcaggacagaggccggaggatgtccccacacactgagcacaagccccaaacacaggcytccccagtctggagccggcggccagccccctcctggcctcagtgaagcctggactcctcactctgtccaagtgggaggaactggtcccagctgcaagaaccgcctactgtgatctgggcaaaggttctggaggctctgctcgctcctgtcccccaggaaaaaaaaaaaaaaaaagacagcagagggcattgctcaggggcccagcctggctgtcatccctgaacatcctgggctgaaggaaagaattgagcccagccgaaacttgagatctttagacttaaatccccactctgtcacttg

SEQ ID NO: 5999 - DNA, 601 bp, Human
tgtaatcccagcactttgggaggccaaggtgggtgaatcacgaggtcaggagatggagaccatcctggccaacacggtgaaaccccatctctactaaaaatacaaaaaattagccaggcgtggtggcgggcacctgtagtcccagctacttgggaggctgaggcaggagaatggtgtgaacccaggaggcggagcttgcagtgagccaagatcacaccacagcactccagcctgggcaacagatcaagactccaactcaaacacacacacacacacacacacacacacacacacacacacctttattatctgacagttctagagatctgaagtccacaatgggtctcactgggctaaaatcaaggtgtggggagggctgcattccttctggaagctctaaggagaatgtttccttgtttttttccagcttttagaggctacccacattccttggcttgtggccccctcctccatcttcaaagccagcaccggagcatctactgacccctctctgactctgaacttctgcctccatcttctacttttatgaatccttgtcatggccagctcacacctgtaatcccagcactttgggaggctg

SEQ ID NO: 6000 - DNA, 601 bp, Human
caaccttcttaattatagaccagagtgaaaataaatgaagccagtgctccagtcaagagggcagaagagagagcaaccataaacctaaagatgttgatacaaatagcatgagtgacaagatctcacttctgagtgtgacatatatgtaacaagatggaaaaacggttagtttgtatagctgtaacaaattactgcaaatgtagtggcttaaaaacacaaatttgtccaggcgcggtggctcacgcctgtaatcccagcactttgggaggccaaggtgggtgaatcacgaggtcaggagatsgagaccatcctggccaacacggtgaaaccccatctctactaaaaatacaaaaaattagccaggcgtggtggcgggcacctgtagtcccagctacttgggaggctgaggcaggagaatggtgtgaacccaggaggcggagcttgcagtgagccaagatcacaccacagcactccagcctgggcaacagatcaagactccaactcaaacacacacacacacacacacacacacacacacacacacacatttattatctgacagttctagagatctgaagtccacaatgggtctcactgggct

SEQ ID NO: 6001 - DNA, 601 bp, Human
aaagccaccaccagaagcaagttcacaaccttcttaattatagaccagagtgaaaataaatgaagccagtgctccagtcaagagggcagaagagagagcaaccataaacctaaagatgttgatacaaatagcatgagtgacaagatctcacttctgagtgtgacatatatgtaacaagatggaaaaacggttagtttgtatagctgtaacaaattactgcaaatgtagtggcttaaaaacacaaatttgtccaggcgcggtggctcacgcctgtaatcccagcactttgggaggccaaggygggtgaatcacgaggtcaggagatggagaccatcctggccaacacggtgaaaccccatctctactaaaaatacaaaaaattagccaggcgtggtggcgggcacctgtagtcccagctacttgggaggctgaggcaggagaatggtgtgaacccaggaggcggagcttgcagtgagccaagatcacaccacagcactccagcctgggcaacagatcaagactccaactcaaacacacacacacacacacacacacacacacacacacacacatttattatctgacagttctagagatctga

SEQ ID NO: 6002 - DNA, 601 bp, Human
tgacagtgagaattcagcacatcagaacctgtggatgagaccaaagccaccaccagaagcaagttcacaaccttcttaattatagaccagagtgaaaataaatgaagccagtgctccagtcaagagggcagaagagagagcaaccataaacctaaagatgttgatacaaatagcatgagtgacaagatctcacttctgagtgtgacatatatgtaacaagatggaaaaacggttagtttgtatagctgtaacaaattactgcaaatgtagtggcttaaaaacacaaatttgtccaggcgckgtggctcacgcctgtaatcccagcactttgggaggccaaggtgggtgaatcacgaggtcaggagatggagaccatcctggccaacacggtgaaaccccatctctactaaaaatacaaaaaattagccaggcgtggtggcgggcacctgtagtcccagctacttgggaggctgaggcaggagaatggtgtgaacccaggaggcggagcttgcagtgagccaagatcacaccacagcactccagcctgggcaacagatcaagactccaactcaaacacacacacacacacacacacacacac

SEQ ID NO: 6003 - DNA, 601 bp, Human
atgacagtgagaattcagcacatcagaacctgtggatgagaccaaagccaccaccagaagcaagttcacaaccttcttaattatagaccagagtgaaaataaatgaagccagtgctccagtcaagagggcagaagagagagcaaccataaacctaaagatgttgatacaaatagcatgagtgacaagatctcacttctgagtgtgacatatatgtaacaagatggaaaaacggttagtttgtatagctgtaacaaattactgcaaatgtagtggcttaaaaacacaaatttgtccaggcgyggtggctcacgcctgtaatcccagcactttgggaggccaaggtgggtgaatcacgaggtcaggagatggagaccatcctggccaacacggtgaaaccccatctctactaaaaatacaaaaaattagccaggcgtggtggcgggcacctgtagtcccagctacttgggaggctgaggcaggagaatggtgtgaacccaggaggcggagcttgcagtgagccaagatcacaccacagcactccagcctgggcaacagatcaagactccaactcaaacacacacacacacacacacacacaca

SEQ ID NO: 6004 - DNA, 601 bp, Human
gtgatggtgtgaagcgggcctttggaaggtgatgaggtcatgagggtggggaccccgttaatgggattagtgcccttatcagagaggcccagggagcttgtgcaccctccactgtgtgcaaacacagcaagaaggccccagctatgagcgaggaagcagccctcaccagacaccaaacccactggcgccccgatctcacatgtgagactccaaaactgtgagaaataaatttctgttgtttctaaacacccagtctgtgatattttgttatggcagcctgaacggagggacacctgcagascctgggatgctcagaatacacacgtggcaggaggggtgtggacgggctctacggaactgggagatgcctagaaatgctagaggggttgagggggaggcattcacaagcccttgtaggaaactgagatctgcgctggttaggggtggggtgtcactggaatggcaagatgcagatataaatgctgacaagacccaatttaaacccagagatgctaaggtctgaaaacatttggattatactaggaatcaacgcaaagcttaataacctaaaatccaaccactcggaagttttttcaacatt

SEQ ID NO: 6005 - DNA, 601 bp, Human
cttcactcctaactctgtggcaggcctggccctgccaagcctccatggagatgagctcttcctgtcccaaggtgatggtgtgaagcgggcctttggaaggtgatgaggtcatgagggtggggaccccgttaatgggattagtgcccttatcagagaggcccagggagcttgtgcaccctccactgtgtgcaaacacagcaagaaggccccagctatgagcgaggaagcagccctcaccagacaccaaacccactggcgccccgatctcacatgtgagactccaaaactgtgagaaataaayttctgttgtttctaaacacccagtctgtgatattttgttatggcagcctgaacggagggacacctgcagagcctgggatgctcagaatacacacgtggcaggaggggtgtggacgggctctacggaactgggagatgcctagaaatgctagaggggttgagggggaggcattcacaagcccttgtaggaaactgagatctgcgctggttaggggtggggtgtcactggaatggcaagatgcagatataaatgctgacaagacccaatttaaacccagagatgctaaggtctgaaaacatt

SEQ ID NO: 6006 - DNA, 601 bp, Human
accagaggccagggtcccctcgtgccacagtgaccctgcaacgcagattccgtgctcccttcagaagcccacctgacattcatagaagctgagcaaacaccaggagacagaggcaatttcagaaattccccgaggctcggggaacccaggctgtccccttcactcctaactctgtggcaggcctggccctgccaagcctccatggagatgagctcttcctgtcccaaggtgatggtgtgaagcgggcctttggaaggtgatgaggtcatgagggtggggaccccgttaatgggattagtgmccttatcagagaggcccagggagcttgtgcaccctccactgtgtgcaaacacagcaagaaggccccagctatgagcgaggaagcagccctcaccagacaccaaacccactggcgccccgatctcacatgtgagactccaaaactgtgagaaataaatttctgttgtttctaaacacccagtctgtgatattttgttatggcagcctgaacggagggacacctgcagagcctgggatgctcagaatacacacgtggcaggaggggtgtggacgggctctacggaactgggagatgcctaga

SEQ ID NO: 6007 - DNA, 601 bp, Human
tggcctctgctgctccctcccacgcaccaatgcccatggcctctgtccctcctccccagggccccggggacctccacaccctcctgctcagcctctctctggccgcccccagctgctccggtttccacagcaccagaggccagggtcccctcgtgccacagtgaccctgcaacgcagattccgtgctcccttcagaagcccacctgacattcatagaagctgagcaaacaccaggagacagaggcaatttcagaaattccccgaggctcggggaacccaggctgtccccttcactcctaactctgtggcaggcctggccctgccaagcctccatggagatgagctcttcctgtcccaaggtgatggtgtgaagcgggcctttggaaggtgatgaggtcatgagggtggggaccccgttaatgggattagtgcccttatcagagaggcccagggagcttgtgcaccctccactgtgtgcaaacacagcaagaaggccccagctatgagcgaggaagcagccctcaccagacaccaaacccactggcgccccgatctcacatgtgagactccaaaactgtgagaaataaatttctgttgtttc

SEQ ID NO: 6008 - DNA, 601 bp, Human
cagccagaaggccctccccacagcctgcccctttctcttgactgttcccttccccaatacgctgaggccccatgtctcccaggaccctccctcaagaccccggcttccctctccagggtgacttgggcccttgcatcatggggcataatgccaactccccacccctactgatgaagtcactggcagagtgcccccaacgccctccactataatcccagaggacggagagctcttgctctgagccgagacaacccactgcccaccaccagctccctcagggctctccacaagtcccttctcscctcccctgctgcgtcttcggcctcctcctctctaaagtcctctctcagcccaacaacagaaccgggtctcttcaatcctgaacaagaagactctgcttcccctccagccacaggacctcccttccctcacagcccttctcagcaggctggcctctgctgctccctcccacgcaccaatgcccatggcctctgtccctcctccccagggccccggggacctccacaccctcctgctcagcctctctctggccgcccccagctgctccggtttccacagcaccagaggccagggtcccctc

SEQ ID NO: 6009 - DNA, 601 bp, Human
ccttgagcaccctactggaggctgctgggtttgtctgtcatcctcagagcctgagagcatctggcaccaggcctggctgaataaatagattctggattagaaaggaaacctggctttgaaaagacacagagaagaaccaggtccctgcgtcccttccttccaggctgatgttctgggctggcgggtctctgttgggctccccaccccttcaccttctgccctgtcctacagcccagtaggcagacctgatggactggctcctcctggctctccctgggtgaaggggggcaccgacaggaarccagggctggggagagagacagaaggttttatttctcccgctgtggtggcccccagcctccccgccctgcaagctccctcgtcctgcccgcagctctgtgagttgtgcctttgtcaactcctttctgttgatcccttatgtgtcccaggcccctgactgatccgacatgccctgtagcccgaccaggcagccctcactctcatagtccaggtgctggtcccatctctagggtttgggatgggacttccacactccagcccaatttccaccctgaagcacacgggtgagccagttccctgc

SEQ ID NO: 6010 - DNA, 601 bp, Human
agagagaagcccattgtaagcagggccaatccaagctcccaccccaccctggagtgcagaccactgcccagacggcttcctgaggtcctggctggggccctccaaggtaccccatttccaggcctccagccccagccccccaatagcctgccttgaattgtcttctgcttaagtgagttgaggtcagttttgccatccaaagagaagccctcctgttttcctagaggttgtcaggagctacgctggccggtcccctgggcttgggacatcctctgttgttggggggagagggtgggaagcrtctttcctgcagccatgacctcaccttggtgacagccacagcttctcactcacagcactggtgtaagtgctaacctgaagccgctcctccttgtccacggggaagacagtctgaccccactttcctctgctccccgaaaataaggaacgttattggtgttgctttgtcctgacagactcacacgtccttaaaaagtgctaatcttcacaaaagaggcagcggcctgtgccttccttgaggaaagtcagattaattagctgactcccacatgagcagcctctgattcttgcaggctttgtt

SEQ ID NO: 6011 - DNA, 601 bp, Human
aagagatagctcctgagcctgagcagtaacgagggtctctgcaagcactgagcagacagtgagcaaatgtgttcgtgcttctcctccccgtcccctaaatcttccttgatacatcttgctattccccatgtgggctcatgaatcttgttataaattttttaatcaaattgtctatatagacaggagtcctgcaggaaatatatgcccagggccccatgtatcctagggacagccagccatgcctttgggaacagcctagaaggactgtcaggaaggggcctgggtgggtgggagtcagctygcccaaggtgactctctctccttgcaagatacatctgagagagaagcccattgtaagcagggccaatccaagctcccaccccaccctggagtgcagaccactgcccagacggcttcctgaggtcctggctggggccctccaaggtaccccatttccaggcctccagccccagccccccaatagcctgccttgaattgtcttctgcttaagtgagttgaggtcagttttgccatccaaagagaagccctcctgttttcctagaggttgtcaggagctacgctggccggtcccctgggcttg

SEQ ID NO: 6012 - DNA, 601 bp, Human
aaccaccttcaagggaacaacggaagccggcattcccgggggcagagagaagcggcggagtcaggagaaatgccacaaccagcactaaatacatggggctggggaatgcggggcaagaagatatacagcatctccacacaaacaggttccaaagagccacacattgtgagcggtaacagctttgctattaccccccagctgtgggagatataaatatgaaattagctgggacagcacactcgaccataaagaacaggaagagatagctcctgagcctgagcagtaacgagggtctctgcawgcactgagcagacagtgagcaaatgtgttcgtgcttctcctccccgtcccctaaatcttccttgatacatcttgctattccccatgtgggctcatgaatcttgttataaattttttaatcaaattgtctatatagacaggagtcctgcaggaaatatatgcccagggccccatgtatcctagggacagccagccatgcctttgggaacagcctagaaggactgtcaggaaggggcctgggtgggtgggagtcagcttgcccaaggtgactctctctccttgcaagatacatctgagagag

SEQ ID NO: 6013 - DNA, 601 bp, Human
gaccagatgaggacgtatggctcacattttcttgcacactctgggcaagatccacattggtggtcatcattaatgaagcacggtaaccaccttcaagggaacaacggaagccggcattcccgggggcagagagaagcggcggagtcaggagaaatgccacaaccagcactaaatacatggggctggggaatgcggggcaagaagatatacagcatctccacacaaacaggttccaaagagccacacattgtgagcggtaacagctttgctattaccccccagctgtgggagatataaataygaaattagctgggacagcacactcgaccataaagaacaggaagagatagctcctgagcctgagcagtaacgagggtctctgcaagcactgagcagacagtgagcaaatgtgttcgtgcttctcctccccgtcccctaaatcttccttgatacatcttgctattccccatgtgggctcatgaatcttgttataaattttttaatcaaattgtctatatagacaggagtcctgcaggaaatatatgcccagggccccatgtatcctagggacagccagccatgcctttgggaacagcctaga

SEQ ID NO: 6014 - DNA, 601 bp, Human
cccaaacattaaatttaacacgaccagatgaggacgtatggctcacattttcttgcacactctgggcaagatccacattggtggtcatcattaatgaagcacggtaaccaccttcaagggaacaacggaagccggcattcccgggggcagagagaagcggcggagtcaggagaaatgccacaaccagcactaaatacatggggctggggaatgcggggcaagaagatatacagcatctccacacaaacaggttccaaagagccacacattgtgagcggtaacagctttgctattaccccccagctgtgggagatataaatatgaaattagctgggacagcacactcgaccataaagaacaggaagagatagctcctgagcctgagcagtaacgagggtctctgcaagcactgagcagacagtgagcaaatgtgttcgtgcttctcctccccgtcccctaaatcttccttgatacatcttgctattccccatgtgggctcatgaatcttgttataaattttttaatcaaattgtctatatagacaggagtcctgcaggaaatatatgcccagggccccatgtatcctagggacagccagcca

SEQ ID NO: 6015 - DNA, 601 bp, Human
gtgccacaacagctagctaattaaaagaaaaaaaaaaatttgtagaaatgaggtcttgctatgttgccagggctgatgttgaactcctgggctcaagtaatcctactgccttggtctcccaaaatgctgggattacagatgtgagccaccacacctggcccaaacattaaatttaacacgaccagatgaggacgtatggctcacattttcttgcacactctgggcaagatccacattggtggtcatcattaatgaagcacggtaaccaccttcaagggaacaacggaagccggcattcccsggggcagagagaagcggcggagtcaggagaaatgccacaaccagcactaaatacatggggctggggaatgcggggcaagaagatatacagcatctccacacaaacaggttccaaagagccacacattgtgagcggtaacagctttgctattaccccccagctgtgggagatataaatatgaaattagctgggacagcacactcgaccataaagaacaggaagagatagctcctgagcctgagcagtaacgagggtctctgcaagcactgagcagacagtgagcaaatgtgttcgtgcttc

SEQ ID NO: 6016 - DNA, 601 bp, Human
gtgtgcccaccattaaacgaggttgaattctgggagtgcagaagtaacagcctcaggactgatggggaagatgaggctgcaagatgtgtggttcttcccttcgctataaaggtccaaacgatatttatttatttatttatttatttagagacaggatcttactgtgtcacccactgcagtacagtggctcaaacacagctcactgcagcctggaccccctgggctcaagtgatcctcccaactcagcctcccaagtagctgggaccacagacgtgtgccacaacagctagctaattaaaaraaaaaaaaaaatttgtagaaatgaggtcttgctatgttgccagggctgatgttgaactcctgggctcaagtaatcctactgccttggtctcccaaaatgctgggattacagatgtgagccaccacacctggcccaaacattaaatttaacacgaccagatgaggacgtatggctcacattttcttgcacactctgggcaagatccacattggtggtcatcattaatgaagcacggtaaccaccttcaagggaacaacggaagccggcattcccgggggcagagagaagcggcggagtcag

SEQ ID NO: 6017 - DNA, 601 bp, Human
gggagtgtgcccaccattaaacgaggttgaattctgggagtgcagaagtaacagcctcaggactgatggggaagatgaggctgcaagatgtgtggttcttcccttcgctataaaggtccaaacgatatttatttatttatttatttatttagagacaggatcttactgtgtcacccactgcagtacagtggctcaaacacagctcactgcagcctggaccccctgggctcaagtgatcctcccaactcagcctcccaagtagctgggaccacagacgtgtgccacaacagctagctaattwaaagaaaaaaaaaaatttgtagaaatgaggtcttgctatgttgccagggctgatgttgaactcctgggctcaagtaatcctactgccttggtctcccaaaatgctgggattacagatgtgagccaccacacctggcccaaacattaaatttaacacgaccagatgaggacgtatggctcacattttcttgcacactctgggcaagatccacattggtggtcatcattaatgaagcacggtaaccaccttcaagggaacaacggaagccggcattcccgggggcagagagaagcggcggag

SEQ ID NO: 6018 - DNA, 601 bp, Human
agatctaaagttatttcaaaattaaaactttaaacacataaaaataaaactgggccccagcctccctcagtgctctctggccggtccattcttcacattggctgcctttccctggagtggaggcgcccactgcatccccagtgtccagggagcaggtcctgtagaaggtggtaggttccagggatcggggagcaagtacagaggccctgagaaggaagcaagcctggcgtgttccaggaacaccagggagaaccgtgtagccggagcaatgctcttgtgcagagggcctatgcctgagccrccctgtgggccctgccgttcccttcagggcactctccaaccctctgccctgtgcatggggccacggatgccccaggagctctagggctgttgactatgaggttgcttcaggtctcagtgagtggcttgatgagcgagccaccctcactggccaggaggggacttccttcacaggtgtgaatgggactgagccaccagcatgatgctgacacgtgggttttgaggattcccactcacatcagacagaatgagtgcggggctctgggatacagctgcccaagcctcaagcctgagtggcact

SEQ ID NO: 6019 - DNA, 601 bp, Human
gttataaaagcaggacactccctgggtttcccttctttgcacacatgggctttccctttgaccctctccaccacgttatgacacagcacaaaaaggcctcaccagaagccagggccatgctcttgaacttcccagcctgcagaaccatgagctaaataagcttcttttctttataaattacccagtctcaggtattccattatagcaacacaaaatagactaaaactaagacactaagtaccaacgcttagtatcaacctacaaagttcctggtttcagtccttgttctacgttgcatacrgaggaagctgggtgaagggcacagaggaaatctatgctatttttgcaacttttcttgcaatttttccaagacagcatagatctaaagttatttcaaaattaaaactttaaacacataaaaataaaactgggccccagcctccctcagtgctctctggccggtccattcttcacattggctgcctttccctggagtggaggcgcccactgcatccccagtgtccagggagcaggtcctgtagaaggtggtaggttccagggatcggggagcaagtacagaggccctgagaaggaagcaagc

SEQ ID NO: 6020 - DNA, 601 bp, Human
accagaaaaacccatggggatgcaccgtctacaaaacagctgaccagtcctcttcaaaaacatccaggtcatgaaacctcagatgggaggaaacgggagagacacaacaactaaatgccacgtgggatcctgagggggagcctgaaccagacaacggacatgagtcggaagactgacaaaattcagtgcagtctggagtgctacggttagaatgtgactggtttgttcccaccaaaactcatcttgacatttggtccccagtgtggcagtgttggaaggtggggcctggggtgaggtatcygaatcatggaggccgatccctcgtgagtggcttgatactgttctcaaggtagcaagggaattcttgctctggagaggcttgattagttcccgagcctgggttgttataaaagcaggacactccctgggtttcccttctttgcacacatgggctttccctttgaccctctccaccacgttatgacacagcacaaaaaggcctcaccagaagccagggccatgctcttgaacttcccagcctgcagaaccatgagctaaataagcttcttttctttataaattacccagtctcaggtattcc

SEQ ID NO: 6021 - DNA, 601 bp, Human
tagccaaatgaagaagggcatcactgacaataggagacaactggacatcccaatgtgacagtcccagcgtggtgccctacggagggcacagtgcttctgtgacagtcctgccagaaacacgtaagctcaagccagtacaaggcacaccagaaaaacccatggggatgcaccgtctacaaaacagctgaccagtcctcttcaaaaacatccaggtcatgaaacctcagatgggaggaaacgggagagacacaacaactaaatgccacgtgggatcctgagggggagcctgaaccagacaacsgacatgagtcggaagactgacaaaattcagtgcagtctggagtgctacggttagaatgtgactggtttgttcccaccaaaactcatcttgacatttggtccccagtgtggcagtgttggaaggtggggcctggggtgaggtatctgaatcatggaggccgatccctcgtgagtggcttgatactgttctcaaggtagcaagggaattcttgctctggagaggcttgattagttcccgagcctgggttgttataaaagcaggacactccctgggtttcccttctttgcacacatgggcttt

SEQ ID NO: 6022 - DNA, 601 bp, Human
gggcattctcacatggggacacggggcagtgagtgcaggcgcagggagacaagaatgctgcacagccggtgggtggtggacgggcctcaggacccctccgccagcagcaggccactctctcacggtccagcaggagccctgctccagagcccacgactggagccagctgaggctggtgtctcacattcctgcagagaggctggctaaggctcccgtgtgggggcactccccatgcccactgcaccccagaattttctgggcgatcccaaggctgagtctacgcagctgttggaagacggggtatgcaattctagatgtgtggcgtgttttgaacagcatccaataccctttctgtggcagctcagcccggagagcaggtccccagtctcgaggacccaggaggcagggtctgctccttcccacagcgggtgctcctccaggaggggccaggtgctcagagggaaaccagtgcccaccaagggcccagctgcctggctggctcccagcagtgtggggaagacacactacccgacggacgtcccccttagaagcaggggcagacaggaactcccatggggagagcacaggctgggacgcagcc

SEQ ID NO: 6023 - DNA, 601 bp, Human
ccaggcgccaagtccacacagaatcggagcaggctgctggcagggtccggtggccagagctgggcgggctgttccttggggagccactctggacaggccggaaggtcaatgccaggatcactccccaggggccagaaatccagcatggaggaaagctgccactccagggaagtaggagcccgcccagggctggccacatgggatgcccatctcacccttccttctaaactgggcattctcacatggggacacggggcagtgagtgcaggcgcagggagacaagaatgctgcacagccggtrggtggtggacgggcctcaggacccctccgccagcagcaggccactctctcacggtccagcaggagccctgctccagagcccacgactggagccagctgaggctggtgtctcacattcctgcagagaggctggctaaggctcccgtgtgggggcactccccatgcccactgcaccccagaattttctgggcgatcccaaggctgagtctacgcagctgttggaagacggggtatgcaattctagatgtgtggcgtgttttgaacagcatccaataccctttctgtggcagctcagcccgga

SEQ ID NO: 6024 - DNA, 601 bp, Human
cactcagcccataacagcctccaggcgccaagtccacacagaatcggagcaggctgctggcagggtccggtggccagagctgggcgggctgttccttggggagccactctggacaggccggaaggtcaatgccaggatcactccccaggggccagaaatccagcatggaggaaagctgccactccagggaagtaggagcccgcccagggctggccacatgggatgcccatctcacccttccttctaaactgggcattctcacatggggacacggggcagtgagtgcaggcgcagggagacragaatgctgcacagccggtgggtggtggacgggcctcaggacccctccgccagcagcaggccactctctcacggtccagcaggagccctgctccagagcccacgactggagccagctgaggctggtgtctcacattcctgcagagaggctggctaaggctcccgtgtgggggcactccccatgcccactgcaccccagaattttctgggcgatcccaaggctgagtctacgcagctgttggaagacggggtatgcaattctagatgtgtggcgtgttttgaacagcatccaatacccttt

SEQ ID NO: 6025 - DNA, 601 bp, Human
aatcctagcactttgggaggccgaggcaggcggatcacctgaggtcaggagtttgagaccatcctgggcaacatggtgaaaccctgtctctaccaaaatacaacaaattagcgggacatggtggtgggcgtctgtagtcccagctactcgggaggctgaggcatgagaatcgcttgagcccagaaggcggaggttgcaatgagctaagatcgcaccgctgcactccagcttgggctacagagtgagagactcttgtctcaaaaaaaaaaaaaaaaaaaaaagaccctgtcgacaggccctyccctgggctggcacctgcccacaccagctggaacctaacacctttgcacagctgttccctgccagcctccctgcctccttggaggtctgcacacaccgcccctcccttcctccaaccagcccgggagaccagcacgcctgagcaccagcactcccagagacagagccggcacggtgggtctgtctgctcagggggctggggtggcaggggcacatgtctgggagttgccaacatatgcttccttaccagattccccaggggacccaccctggagagcaaccaaaccctgcaaggctgcac

SEQ ID NO: 6026 - DNA, 601 bp, Human
gcacggtggctcacgcctataatcctagcactttgggaggccgaggcaggcggatcacctgaggtcaggagtttgagaccatcctgggcaacatggtgaaaccctgtctctaccaaaatacaacaaattagcgggacatggtggtgggcgtctgtagtcccagctactcgggaggctgaggcatgagaatcgcttgagcccagaaggcggaggttgcaatgagctaagatcgcaccgctgcactccagcttgggctacagagtgagagactcttgtctcaaaaaaaaaaaaaaaaaaaaaagaccctgtcgacaggcccttccctgggctggcacctgcccacaccagctggaacctaacacctttgcacagctgttccctgccagcctccctgcctccttggaggtctgcacacaccgcccctcccttcctccaaccagcccgggagaccagcacgcctgagcaccagcactcccagagacagagccggcacggtgggtctgtctgctcagggggctggggtggcaggggcacatgtctgggagttgccaacatatgcttccttaccagattccccaggggacccaccctggagagcaac

SEQ ID NO: 6027 - DNA, 601 bp, Human
taaaagagtttctcagattttttgaccacttaaggaacagacacacccatgacatattggtgaccgaagaaggcggcaagcccagctgcagcatgacctccttacgtaaaatcatgtatatctctgtgccaaacgtcagcacagtctaataattaagcatgtggcctccgagtcactctgcctcgattcaaatgtttacttcacctctgactgagtggcctctctgtggacagtgtctgcagggttgaatggagataataacagggtttccatggctgatgtgagggctaagcgagatacygcgtctctagcactgggcacagcacgtgataaatcagccgactggcagcaccatcaccatcatgatgatcatggcatgacagctgttaggaaacgcgtaacaaagggtcagcagtgttacgatcgggggtgagtttcactttttattaatattttctgtattttttttgttttacatttttacaaagggcatatagcaaaacagacaattcatgtgaagacaggagagacggaaagggggagagcacagagagaaagataagggggaaaatggaataaacaagatgccgacaagaatgcc

SEQ ID NO: 6028 - DNA, 601 bp, Human
gcactccattctgggcaacagagtgagactccatctcaaaaacaaacaaacaaacaaaaacagacaacaaaaacaataaatggtcagattattattattattattttggagacagtgtcttgttctgtcacccaggctggagtggagtacagtggcctgagctcagttcactgagacctctgcctcccaggttcaagcaattctcctgcctcagcctcccaagtagctgggattacaggtgcacaacaccatgcctggctaatttttgcatttttagtagagacggggtttcgccatgttrgccaggctggtctcgaactcctgacctcaggtgatccgcccacctcggcctcccaaagtgctgggattacaggtgtgaaccaccgttcccagccagtcagattatttcaataacactctatgccctgcaaaataattttacaaaatttacagatttatgctaggctaaaagagtttctcagattttttgaccacttaaggaacagacacacccatgacatattggtgaccgaagaaggcggcaagcccagctgcagcatgacctccttacgtaaaatcatgtatatctctgtgccaaacg

SEQ ID NO: 6029 - DNA, 601 bp, Human
tgtgagcaactctgggccctgggagagggtgcacagagggatggcttcaaccctgctgctagagaatgccctcgagagcgtctgtctcagttctgcttggcatccctccccagcaccccccacctgccactttacgcagcctggacttgactttaaaactgagacacctggcaagtggggaaatcacaggtcgaaatagcggaattgccctctgcatctatgctacagggataatgagggttacaaatcagaagacatttagcatatattctggaaaaaaaaagctatgtaatatataaaytattcataatttaactttaataaatgggggcaggcaaaaaattgccaaacaagcccacaacaatcagacaaagagtagaggaagaaaaaaggaattacagtttaattgcactcgtttcctaatcttcagaatcttcagttagcatcaacagttactggtaagtttctaaaatcagtagatacaagctgaagaattctactcaaaattagaaaagtcacaactagtaaaactaatgtataccttccaaatgactgaaggcagaccatatagaaaatatggtagactagaaaaacagcaaaa

SEQ ID NO: 6030 - DNA, 601 bp, Human
gtctatcaactaaccaggtgagccactgtgagcaactctgggccctgggagagggtgcacagagggatggcttcaaccctgctgctagagaatgccctcgagagcgtctgtctcagttctgcttggcatccctccccagcaccccccacctgccactttacgcagcctggacttgactttaaaactgagacacctggcaagtggggaaatcacaggtcgaaatagcggaattgccctctgcatctatgctacagggataatgagggttacaaatcagaagacatttagcatatattctggraaaaaaaagctatgtaatatataaactattcataatttaactttaataaatgggggcaggcaaaaaattgccaaacaagcccacaacaatcagacaaagagtagaggaagaaaaaaggaattacagtttaattgcactcgtttcctaatcttcagaatcttcagttagcatcaacagttactggtaagtttctaaaatcagtagatacaagctgaagaattctactcaaaattagaaaagtcacaactagtaaaactaatgtataccttccaaatgactgaaggcagaccatatagaaaa

SEQ ID NO: 6031 - DNA, 601 bp, Human
gggatttgagccactcggtcctcaccactgggggctcctttacagttcagcatcccagaggatttcacacactgacttttccacttttccaaaagggacgccagcgggcaggagctgtccatggggttaggaaacagctgtcctcacccgcatctccaccagctcctcctctgtctcatgggatcctcgccaggtgccagccactcccgtccttcctcttggagagcgaccccttgtctagggctctgtcttggagctatggctggagctgggccttccagggttctgctgagcacagtgrccacaacagagttgcctctgagctccacagaacctgatgactttgcttggccactctaaccttccctggacctggtttcaggccctacagacctttactccagaaagtctcttttttggcctaagctggccggagccaatttccaacaggaccaaggagccccgacagtcacatgcccagcgaggctctaaggaaagctagactccactttgaagggcagggtggggggcgaggcaggcagggagagtaagcactggacgctgagccaggggccctggtttccaatgcggtcatggccag

SEQ ID NO: 6032 - DNA, 601 bp, Human
cgggactttgattttcctgctgccagtgtcaagtgtatctgtttttacatgtaatttttattaattagaatcagtttcctctccccactcaataaatattaaagaaactccagaagcacactaggctgaaaagcactcagttgggagcctgctggtggcctgtctgtccaaccccacagctgtccagcctggggtcttacagaaaggttggtaccccgacctggctctaagtgtgagtcccgctctgctcttgaagtctgtggatgtctggcaaacccagccaggttctcccctgggggayagagagaggatcatggggagggctctgtccctgaccttcaggtgccaccgcaggggcccagagcctggtagtacccgggtcatcaagtcaagttgccggcattcagatcctggtgagttacacaacgcctgccctgcctcttccttctatagaacctgctcctttgcagttggattgatggtaaagtagttactagaaatggcaactagatgttaaaaatttataaagatccaaaggcttaacagctctcctctattactctgaatttttaagtattcaaccacagacagcctggaagtt

SEQ ID NO: 6033 - DNA, 601 bp, Human
ctaggccagccagcaccctccctgactacaaactcctcgctgggtcctcatttccgttgggactcaggctgctctatatgctggcattcaggctcttggcctgccccaccctcccagaccgcggcttgcaccaccccatgcttctcactgggctgggtgcaccctgccgagccacccagcccctgaaccccatgctgccaactcaggaatccccattctcccaccccaccaccccatccccagctcggccatctggtaaacctgtgttcccccttcaaggcctgattcagcccccctcacstctcctgccctcccctgccatccagcctgccctcccctgccataccctgccctcccctgccataccctgccatccagcctgctggcaccatcaggtccacccatcccatgacaactccagctcctacacttttatcttctggtccattatccataaaccaaggtctcacactggaagtgcacactgtgtccagccttcagagtgtttccttcagatcacaagcttatgacccatgcaggggattttaaaagcttgaatttgttgccaaacttaagaaacaggagagttcacataaacgac

SEQ ID NO: 6034 - DNA, 601 bp, Human
ccctgaccccctaggccagccagcaccctccctgactacaaactcctcgctgggtcctcatttccgttgggactcaggctgctctatatgctggcattcaggctcttggcctgccccaccctcccagaccgcggcttgcaccaccccatgcttctcactgggctgggtgcaccctgccgagccacccagcccctgaaccccatgctgccaactcaggaatccccattctcccaccccaccaccccatccccagctcggccatctggtaaacctgtgttcccccttcaaggcctgattcagmccccctcacgtctcctgccctcccctgccatccagcctgccctcccctgccataccctgccctcccctgccataccctgccatccagcctgctggcaccatcaggtccacccatcccatgacaactccagctcctacacttttatcttctggtccattatccataaaccaaggtctcacactggaagtgcacactgtgtccagccttcagagtgtttccttcagatcacaagcttatgacccatgcaggggattttaaaagcttgaatttgttgccaaacttaagaaacaggagagttca

SEQ ID NO: 6035 - DNA, 601 bp, Human
agctgaactgctgcccctgaccccctaggccagccagcaccctccctgactacaaactcctcgctgggtcctcatttccgttgggactcaggctgctctatatgctggcattcaggctcttggcctgccccaccctcccagaccgcggcttgcaccaccccatgcttctcactgggctgggtgcaccctgccgagccacccagcccctgaaccccatgctgccaactcaggaatccccattctcccaccccaccaccccatccccagctcggccatctggtaaacctgtgttcccccttcraggcctgattcagcccccctcacgtctcctgccctcccctgccatccagcctgccctcccctgccataccctgccctcccctgccataccctgccatccagcctgctggcaccatcaggtccacccatcccatgacaactccagctcctacacttttatcttctggtccattatccataaaccaaggtctcacactggaagtgcacactgtgtccagccttcagagtgtttccttcagatcacaagcttatgacccatgcaggggattttaaaagcttgaatttgttgccaaacttaaga

SEQ ID NO: 6036 - DNA, 601 bp, Human
ccagactctacaggcagctgaactgctgcccctgaccccctaggccagccagcaccctccctgactacaaactcctcgctgggtcctcatttccgttgggactcaggctgctctatatgctggcattcaggctcttggcctgccccaccctcccagaccgcggcttgcaccaccccatgcttctcactgggctgggtgcaccctgccgagccacccagcccctgaaccccatgctgccaactcaggaatccccattctcccaccccaccaccccatccccagctcggccatctggtaaacctgtgttcccccttcaaggcctgattcagcccccctcacgtctcctgccctcccctgccatccagcctgccctcccctgccataccctgccctcccctgccataccctgccatccagcctgctggcaccatcaggtccacccatcccatgacaactccagctcctacacttttatcttctggtccattatccataaaccaaggtctcacactggaagtgcacactgtgtccagccttcagagtgtttccttcagatcacaagcttatgacccatgcaggggattttaaaagcttgaatttg

SEQ ID NO: 6037 - DNA, 601 bp, Human
cttgaacatggaatcccagctttccttggaaacgcaggccctgaccacagcgggtcttggatggaacacatgcccctgcaactggctccagtccctactgccccccaactgtctctcctgctctctgtgtcagccaccagcccagactctacaggcagctgaactgctgcccctgaccccctaggccagccagcaccctccctgactacaaactcctcgctgggtcctcatttccgttgggactcaggctgctctatatgctggcattcaggctcttggcctgccccaccctcccagacckcggcttgcaccaccccatgcttctcactgggctgggtgcaccctgccgagccacccagcccctgaaccccatgctgccaactcaggaatccccattctcccaccccaccaccccatccccagctcggccatctggtaaacctgtgttcccccttcaaggcctgattcagcccccctcacgtctcctgccctcccctgccatccagcctgccctcccctgccataccctgccctcccctgccataccctgccatccagcctgctggcaccatcaggtccacccatcccatgacaactccag

SEQ ID NO: 6038 - DNA, 601 bp, Human
ccctgagctctcggggacacaggggttgctaatgccactgggcttgcccgacagcagctagctagcaaggagcaaagctggggccctgcccccgggtctggagcactcgctcagccccttccacgctggccctcctagattactcctccttccttccctgcaaaatagtccaagggtggggataagtcgaggctgagaccacagctggaaaaggctgggcaggcagtacccagtggcccggctgtctgcagcatagcagacgctgatttgtcaccaaggaacaaggggccaccggttgcaytgattggctccagagtacattgggcttcctgatggaacaattcctttgcaaaggtatctgatgccgtttcatgaaattagaagtatgcctgccaggctgtacccaatttttctgtcaagctaggaagtcagacagacctacagtaaatgaggcggggctgctatggagtgacgggagtaccttagtaaatcacagcacgggggctggcccagcccaggcccctggagcactcgctgtgaacgtgcaggtgtgcccgatcctgggccccagactccagactctcctcacccaggggtcctg

SEQ ID NO: 6039 - DNA, 601 bp, Human
gcctcacccagcgtcttctaaggccaatggtttctgggcttattctgagattgaaattcctttcctgtgttctgaatttcaagttctcattaaagatatgtggattgggggtgggggtggagggaggattcagcagaagatgccaaacaccagcagaagcccagaaaataaggcaaggccggccaggctgtgggggaagggctgccatgttcaggaagacaagcaccatatggaatctgggatcagagacatggccaagggcacgtggccagctcacctcgcctgagcagaggcccccagraccaccctgaatcttccaggagaggccagccagaagcaccaagcccacagcacaagtgaccagcccctgagctctcggggacacaggggttgctaatgccactgggcttgcccgacagcagctagctagcaaggagcaaagctggggccctgcccccgggtctggagcactcgctcagccccttccacgctggccctcctagattactcctccttccttccctgcaaaatagtccaagggtggggataagtcgaggctgagaccacagctggaaaaggctgggcaggcagtacccagtgg

SEQ ID NO: 6040 - DNA, 601 bp, Human
cacatacacacacacccgcacccaggtcctggagttgtgtgccaggcaggctgtgcccctcactatgcctggccacaggacacagcttttatgtatctcccagttgccactctgggccctgaaaaggcccaggcagatggaaagctggacgcctgaggtcaccgtgggccctccacccagctccggcactcactgggcctggtgcccttccagtcagtgtgtcgatctcagcccagggccacgtgggaacgattaggtgcatggcgtgggagctagctcactgaaggcccgagcccctcaygcagggtctgctgacaccagacaggaacatcaagcaaaggggacttggccccagccccaagttctgggatccagacctatagccccaggcccacgctcacatccacagcctgggccccaggcctggagctaaggctggacaggctcacctcctccccgacagcccattaccaaacccccaccttccagcccagcctcacccctgacctggcagctggcctcacccagcgtcttctaaggccaatggtttctgggcttattctgagattgaaattcctttcctgtgttctgaatttcaagt

SEQ ID NO: 6041 - DNA, 601 bp, Human
cgtgggcttctcggggaaaacaggacatcctgaaaaggaggcacccctgacgctgcagggatatcctgccacccagacagatgcccaccccccactgggacacccagggcaggtgtgtcaccttccccggcagaacataaatagcagggtgcttcacacccacttccagacgttgcttttggggaggcaggaagaaactgccagccagcacctcctgccagcttctgccagggccacactgatatatcagggttccctcagaattcactggaagaaagggtcccctatacacacacacacatacacacacacccgcacccaggtcctggagttgtgtgccaggcaggctgtgcccctcactatgcctggccacaggacacagcttttatgtatctcccagttgccactctgggccctgaaaaggcccaggcagatggaaagctggacgcctgaggtcaccgtgggccctccacccagctccggcactcactgggcctggtgcccttccagtcagtgtgtcgatctcagcccagggccacgtgggaacgattaggtgcatggcgtgggagctagctcactgaaggcccgagcccctcatgca

SEQ ID NO: 6042 - DNA, 601 bp, Human
ttcccaggccagcagcactgagcaggacccttctgccaaggccagcatggccagggaggagagaaaaggaccctccccgctccctcaccccttgcccctcctaataacatcctctcccgggtgttgcctaagctgcccagtgcacacactcatccctggcctgtctgtgaaatgctttaaaaccgtcattttctatccgtttcccccaggcaatctgcaatccagcaactgatcttggatgacagagactattagtgaaaatgattccctgaggctccatgagtccccgagatcaccctgrgcagcccgtgggcttctcggggaaaacaggacatcctgaaaaggaggcacccctgacgctgcagggatatcctgccacccagacagatgcccaccccccactgggacacccagggcaggtgtgtcaccttccccggcagaacataaatagcagggtgcttcacacccacttccagacgttgcttttggggaggcaggaagaaactgccagccagcacctcctgccagcttctgccagggccacactgatatatcagggttccctcagaattcactggaagaaagggtcccctatacacac

SEQ ID NO: 6043 - DNA, 601 bp, Human
caaaaggccacccagcctcagagctcggcctccggtcctggccaggttcccaggccagcagcactgagcaggacccttctgccaaggccagcatggccagggaggagagaaaaggaccctccccgctccctcaccccttgcccctcctaataacatcctctcccgggtgttgcctaagctgcccagtgcacacactcatccctggcctgtctgtgaaatgctttaaaaccgtcattttctatccgtttcccccaggcaatctgcaatccagcaactgatcttggatgacagagactattaktgaaaatgattccctgaggctccatgagtccccgagatcaccctgagcagcccgtgggcttctcggggaaaacaggacatcctgaaaaggaggcacccctgacgctgcagggatatcctgccacccagacagatgcccaccccccactgggacacccagggcaggtgtgtcaccttccccggcagaacataaatagcagggtgcttcacacccacttccagacgttgcttttggggaggcaggaagaaactgccagccagcacctcctgccagcttctgccagggccacactgatatatc

SEQ ID NO: 6044 - DNA, 601 bp, Human
tgtaatcaaggcatccttgcaagagggaagcacagggacacgtcagaagaggagggggcgacatgacccgggggcagagattggcatgatgcagccacaagccaagggaggctggcagcccccaggagcggggatgggccagaaacagattctcccctggagcctctggagggagcacagccctgtccacccttgatcttggctcagtgagattcatttcagacttctggcccacagagctgtgagagaggcatttgtattagtccgttttcacaatgctgataaagacatacccgagackgggcaacttacaaaagaaagaggtttattggacttacagttccacatggctggggaggcctcacaatcatggcagaagatgaaaggcacgtctcacatggcagcagccgagagagagagagcttgtgcagggcaactcccgtttttaaaaccctcagatctcgtgagacccactcaccatcatgagaacagcatgggaaagacccacccccatgattcaatcatctctcactgggtccctcccataacacatgggaattatgggagctacaagatgagattcaggtggagacacagagac

SEQ ID NO: 6045 - DNA, 601 bp, Human
gacaggccctcagtgtcagcacagggttggcttctctgtgcacgtggtcttggagtcagccgctccaggtcccttaacgcgggcggtgggggaggactgccaggctgagactggcacttagacatgcagggaagagctcccacacgacagggtggagggtccagtgagggaggcagcaggaccagggcctgcctgggctgtgcctctgggctatatgccctggggaggcctaagtgaagcctacagtgctgctcctccgcgtgacccagacgggcgcctcccgggtgtgctgtgcactgcrtggccagccttgtacgtgagggccattcacatcctgtagctggctgcatggtgcccccaaagatgctggatcctgatccctgcaacctgagacgggtaccttctatgggaagaaagggctttgcagatgtgcttgcagtaaggctcttgagatgagaagcctgtcctggattactcgggtgagtcctaaatgtaatcaaggcatccttgcaagagggaagcacagggacacgtcagaagaggagggggcgacatgacccgggggcagagattggcatgatgcagccacaagccaagggag

SEQ ID NO: 6046 - DNA, 601 bp, Human
acgtgactcggggtctttctcactgtgtggcaaccttcacagagtcccaaggtcagtctctgggaagctaagacaggccctcagtgtcagcacagggttggcttctctgtgcacgtggtcttggagtcagccgctccaggtcccttaacgcgggcggtgggggaggactgccaggctgagactggcacttagacatgcagggaagagctcccacacgacagggtggagggtccagtgagggaggcagcaggaccagggcctgcctgggctgtgcctctgggctatatgccctggggaggcstaagtgaagcctacagtgctgctcctccgcgtgacccagacgggcgcctcccgggtgtgctgtgcactgcatggccagccttgtacgtgagggccattcacatcctgtagctggctgcatggtgcccccaaagatgctggatcctgatccctgcaacctgagacgggtaccttctatgggaagaaagggctttgcagatgtgcttgcagtaaggctcttgagatgagaagcctgtcctggattactcgggtgagtcctaaatgtaatcaaggcatccttgcaagagggaagcacagggac

SEQ ID NO: 6047 - DNA, 601 bp, Human
tgtgccaggacctgtctctgtgtctccaaccaggcacttcctgagtgactccccagacccctgaggcctggtcctttcgcatggtgataggggctgtctctcgtacccgggtcggcctgggccctgccaagccagctgttgccgactcactgagctcagcgccgtggctggattcctggagccttctcagttcatcctctcattccagaaattttaagccacattttaacatcaggaaagttcacataaaaagtctgatgtctggattttcttgataggatgttcagctgcaccagaccccacttctaccaaattgaggtcaagggagttgaggagggtctgtccctccttgcagggcctcccagacgccctgtgcccatggcaaggccagggctggacaccacgtgtggctgcattcccactgctgtttctttttagtggagatgtattcttggtctccacgtttccatcaaaaggagagaaatgaaagccaggccaagggtgggtgcaattatctttttttcctccactgctgtccttgttggcattgcctgccaggccctgcaggctctgagtttgcagctcttgtctttctgcaaat

SEQ ID NO: 6048 - DNA, 601 bp, Human
ttctgtggaaagagggctttgtctggatttgctggctgagccctggacctggccagcgtccttgtgccaggacctgtctctgtgtctccaaccaggcacttcctgagtgactccccagacccctgaggcctggtcctttcgcatggtgataggggctgtctctcgtacccgggtcggcctgggccctgccaagccagctgttgccgactcactgagctcagcgccgtggctggattcctggagccttctcagttcatcctctcattccagaaattttaagccacattttaacatcaggaargttcacataaaaagtctgatgtctggattttcttgataggatgttcagctgcaccagacccaacttctaccaaattgaggtcaagggagttgaggagggtctgtccctccttgcagggcctcccagacgccctgtgcccatggcaaggccagggctggacaccacgtgtggctgcattcccactgctgtttctttttagtggagatgtattcttggtctccacgtttccatcaaaaggagagaaatgaaagccaggccaagggtgggtgcaattatctttttttcctccactgctgtcct

SEQ ID NO: 6049 - DNA, 601 bp, Human
gcctgacagcagcaggcagaggcttggcaccggcggtgtctggggtggaggcagccaaggtcactggcacgttgctgtctgacttctcttccttcagcccagcagggtgtgtgcacagcagcctggtagcagttccccaggatgggaagcacctgcccctcctctgtcccaaggccaggccggggcgagccccaggagagcagcccacagaggagggcagaagatgcttctacctctgcatcacagaaagcatgggtagccaatgggggaccgtgttttgtttggtctatatagtgagcamgggaggggaccccaggcatgacagctcccactgggtgtgcagggcccagggctggaggcagagagctgatgtggaggcttctgtggaaagagggctttgtctggatttgctggctgagccctggacctggccagcgtccttgtgccaggacctgtctctgtgtctccaaccaggcacttcctgagtgactccccagacccctgaggcctggtcctttcgcatggtgataggggctgtctctcgtacccgggtcggcctgggccctgccaagccagctgttgccgactcactgagctcagc

SEQ ID NO: 6050 - DNA, 601 bp, Human
cgccgcggcgtctgccaagggtgcgctcagccctgaagcacgcctcccggagccgcctcgggtttcacaatcagtgcttctccctgggtttcccggggcctgggctgcaggctcagctccagggtggaaagagaggatgagctgagaagactccagggatccagcgccgaggcgctgaactcagtgagtcggcaacagtggcttggcagggcccaggctgaccagggtatgagagagagcacctatcaccacgccagaggccctggcctcaggggtctggggagtcacttgggaagtgccyggttggagacacagagacaggtctgggcacaagacgctggccaggtccagggctcaccctgcaaatccagccaaagccctctctccattctcccttaggacccaaggttcaacacttagacatgtcagctgaatcatgacccccggacgtccatgtcctaatcccccaaaactcgtgagcattaccttatatggcagaagagactttgcaaatgtgtttaaatcaggggtcttgagatggggaaagtaacctggatggtcccagcgggccctaaatgttatcacaagtgtccttctaaga

SEQ ID NO: 6051 - DNA, 601 bp, Human
ccggctgaccccaggcaactccagcctcggagaatgtgcagcctcggctttcccagcgccggcccccgcccaccccttccgcgtgggccacatcaccgcgctggcatctccaacagccatcccaagggcccggtctgcacgaggacaggagcgccgcggcgtctgccaagggtgcgctcagccctgaagcacgcctcccggagccgcctcgggtttcacaatcagtgcttctccctgggtttcccggggcctgggctgcaggctcagctccagggtggaaagagaggatgagctgagaagrctccagggatccagcgccgaggcgctgaactcagtgagtcggcaacagtggcttggcagggcccaggctgaccagggtatgagagagagcacctatcaccacgccagaggccctggcctcaggggtctggggagtcacttgggaagtgcccggttggagacacagagacaggtctgggcacaagacgctggccaggtccagggctcaccctgcaaatccagccaaagccctctctccattctcccttaggacccaaggttcaacacttagacatgtcagctgaatcatgacccccggacg

SEQ ID NO: 6052 - DNA, 601 bp, Human
ccccggctgaccccaggcaactccagcctcggagaatgtgcagcctcggctttcccagcgccggcccccgcccaccccttccgcgtgggccacatcaccgcgctggcatctccaacagccatcccaagggcccggtctgcacgaggacaggagcgccgcggcgtctgccaagggtgcgctcagccctgaagcacgcctcccggagccgcctcgggtttcacaatcagtgcttctccctgggtttcccggggcctgggctgcaggctcagctccagggtggaaagagaggatgagctgagargactccagggatccagcgccgaggcgctgaactcagtgagtcggcaacagtggcttggcagggcccaggctgaccagggtatgagagagagcacctatcaccacgccagaggccctggcctcaggggtctggggagtcacttgggaagtgcccggttggagacacagagacaggtctgggcacaagacgctggccaggtccagggctcaccctgcaaatccagccaaagccctctctccattctcccttaggacccaaggttcaacacttagacatgtcagctgaatcatgacccccgga

SEQ ID NO: 6053 - DNA, 601 bp, Human
ggcacgtctccactgtggaataaggggggcccagccctcgctggggctgcaagcctcgcttctgccttcacagcccagggggtgggaagcacccacagggcagcgctctgagcagcagactccagccagagagccagccaggcccgggagctggcccctcctgctctccccggctgaccccaggcaactccagcctcggagaatgtgcagcctcggctttcccagcgccggcccccgcccaccccttccgcgtgggccacatcaccgcgctggcatctccaacagccatcccaagggcccrgtctgcacgaggacaggagcgccgcggcgtctgccaagggtgcgctcagccctgaagcacgcctcccggagccgcctcgggtttcacaatcagtgcttctccctgggtttcccggggcctgggctgcaggctcagctccagggtggaaagagaggatgagctgagaagactccagggatccagcgccgaggcgctgaactcagtgagtcggcaacagtggcttggcagggcccaggctgaccagggtatgagagagagcacctatcaccacgccagaggccctggcctcaggggtctggg

SEQ ID NO: 6054 - DNA, 601 bp, Human
aggggagttgctgcgcacgtgggggctgtcaggcggagtgccaggcccagacgccgtggagggggagcacaccctggcacgtctccactgtggaataaggggggcccagccctcgctggggctgcaagcctcgcttctgccttcacagcccagggggtgggaagcacccacagggcagcgctctgagcagcagactccagccagagagccagccaggcccgggagctggcccctcctgctctccccggctgaccccaggcaactccagcctcggagaatgtgcagcctcggctttcccagygccggcccccgcccaccccttccgcgtgggccacatcaccgcgctggcatctccaacagccatcccaagggcccggtctgcacgaggacaggagcgccgcggcgtctgccaagggtgcgctcagccctgaagcacgcctcccggagccgcctcgggtttcacaatcagtgcttctccctgggtttcccggggcctgggctgcaggctcagctccagggtggaaagagaggatgagctgagaagactccagggatccagcgccgaggcgctgaactcagtgagtcggcaacagtggcttgg

SEQ ID NO: 6055 - DNA, 601 bp, Human
ccaagccagggccaaggccaccatcctccgggtcaggcttgtcacctgcccacggtgctccaccaaagatccaggcccttgccagccacatttacctggtcggctccacccctgaaccagaaaccatgtcgggaggggagaggtggcgggggaagggcaagcctgagactcagggactaaatttatgtcggaggcacaggggagttgctgcgcacgtgggggctgtcaggcggagtgccaggcccagacgccgtggagggggagcacaccctggcacgtctccactgtggaataagggggscccagccctcgctggggctgcaagcctcgcttctgccttcacagcccagggggtgggaagcacccacagggcagcgctctgagcagcagactccagccagagagccagccaggcccgggagctggcccctcctgctctccccggctgaccccaggcaactccagcctcggagaatgtgcagcctcggctttcccagcgccggcccccgcccaccccttccgcgtgggccacatcaccgcgctggcatctccaacagccatcccaagggcccggtctgcacgaggacaggagcgccgcggc

SEQ ID NO: 6056 - DNA, 601 bp, Human
ccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacctgcccacggtgctccaccaaagatccaggcccttgccagccacatttacctggtcggctccacccctgaaccagaaaccatgtcgggaggggagaggtggcgggggaagggcaagcctgagactcagggactaaatttatgtyggaggcacaggggagttgctgcgcacgtgggggctgtcaggcggagtgccaggcccagacgccgtggagggggagcacaccctggcacgtctccactgtggaataaggggggcccagccctcgctggggctgcaagcctcgcttctgccttcacagcccagggggtgggaagcacccacagggcagcgctctgagcagcagactccagccagagagccagccaggcccgggagctggcccctcctgctctccccggctgaccccaggcaactccagcctcggagaatgtgcagcctcggc

SEQ ID NO: 6057 - DNA, 601 bp, Human
gagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcasgcttgtcacctgcccacggtgctccaccaaagatccaggcccttgccagccacatttacctggtcggctccacccctgaaccagaaaccatgtcgggaggggagaggtggcgggggaagggcaagcctgagactcagggactaaatttatgtcggaggcacaggggagttgctgcgcacgtgggggctgtcaggcggagtgccaggcccagacgccgtggagggggagcacaccctggcacgtctccactgtggaataaggggggcccagccctcgctggggctgcaagcctcgcttctg

SEQ ID NO: 6058 - DNA, 601 bp, Human
ctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagarccactggccggtcttccagaactgtcccctgcactcgagttggggctgcagccaagccagggccaaggccaccatcctccgggtcaggcttgtcacctgcccacggtgctccaccaaagatccaggcccttgccagccacatttacctggtcggctccacccctgaaccagaaaccatgtcgggaggggagaggtggcgggggaagggcaagcctgagactcagggactaaatttatgtcggaggcacaggggagttgctgcgcacgtgggggctgtcaggcggagtgccaggcccagac

SEQ ID NO: 6059 - DNA, 601 bp, Human
ggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccasctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacctgcccacggtgctccaccaaagatccaggcccttgccagccacatttacctggtcggctccacccctgaaccagaaaccatgtcgggaggggagaggtggcgggggaagggcaagcctgagactcagggactaaatttatgtcggaggcacagg

SEQ ID NO: 6060 - DNA, 601 bp, Human
ggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggrgctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacctgcccacggtgctccaccaaagatccaggcccttgccagccacatttacctggt

SEQ ID NO: 6061 - DNA, 601 bp, Human
gagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggyggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacctgcccacggtgctccaccaaagatccaggcccttgccagccacatttacct

SEQ ID NO: 6062 - DNA, 601 bp, Human
attcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacctgcccacggtgctccac

SEQ ID NO: 6063 - DNA, 601 bp, Human
caattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacctgcccacggtgctcc

SEQ ID NO: 6064 - DNA, 601 bp, Human
aaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacc

SEQ ID NO: 6065 - DNA, 601 bp, Human
ggaaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtca

SEQ ID NO: 6066 - DNA, 601 bp, Human
agggaaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgt

SEQ ID NO: 6067 - DNA, 601 bp, Human
caagggaaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggctt

SEQ ID NO: 6068 - DNA, 601 bp, Human
atccaagggaaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcagg

SEQ ID NO: 6069 - DNA, 601 bp, Human
agggcatgaaggaagcctcacctgggtcccaagcaggtcccactgctccttgcccaaacttcaccccagccagcaggctcctacatccaaggcacagatgtcacagacatgaaaagatgccctggacacatgcctctctcccagaagcctgcctctgccatgctggggacctgaaaagagggggcatgcccagcccacagttgctgatcaaacgccagatgcccccgtgagcagatcacagcttcacccctgagccgtgtactgtctgcatgccagggactgttaccttgtgcaaaacccraaaagctctttggaggacattcccaacacagatccaagggaaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactg

SEQ ID NO: 6070 - DNA, 601 bp, Human
ctctctatccccaagaggcctctgtctagggacccactatgggatgcagtccctttgtccccattatgcagggtgcccatgtctctttcaccgtcatccatggggcagccagggcatgaaggaagcctcacctgggtcccaagcaggtcccactgctccttgcccaaacttcaccccagccagcaggctcctacatccaaggcacagatgtcacagacatgaaaagatgccctggacacatgcctctctcccagaagcctgcctctgccatgctggggacctgaaaagagggggcatgcccagcccacagttgctgatcaaacgccagatgcccccgtgagcagatcacagcttcacccctgagccgtgtactgtctgcatgccagggactgttaccttgtgcaaaacccgaaaagctctttggaggacattcccaacacagatccaagggaaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggta

SEQ ID NO: 6071 - DNA, 601 bp, Human
tggtcagaggcctccggctggcacaaactggcagagtttggacctcggacccaaatgcagtttctgagccaggcctgtcctcgctgctgctggggaagagcttcctgtccccttcagatgtccctacagctgcctctgcagccctgatgctggtacccaacgcctctcacctgtcgccccacccctctctatccccaagaggcctctgtctagggacccactatgggatgcagtccctttgtccccattatgcagggtgcccatgtctctttcaccgtcatccatggggcagccagggcaygaaggaagcctcacctgggtcccaagcaggtcccactgctccttgcccaaacttcaccccagccagcaggctcctacatccaaggcacagatgtcacagacatgaaaagatgccctggacacatgcctctctcccagaagcctgcctctgccatgctggggacctgaaaagagggggcatgcccagcccacagttgctgatcaaacgccagatgcccccgtgagcagatcacagcttcacccctgagccgtgtactgtctgcatgccagggactgttaccttgtgcaaaacccgaaaagc

SEQ ID NO: 6072 - DNA, 601 bp, Human
aacccgcatggcattcaggtgcccggccttttcccaaccagaccagcgcaccagccacctctccacacaggcccagtgcccaggtcacctcctgtcctgtcctgcaggctctctctgggtgtgccgacagtttgggatgggaggcgtgggaggcgtgagctgcgctcctggccgggttctctaccagctgtgctcgtggcgcagcccacacctcacggcaagccccagccaaagggaccaagtcaagagctctgagagacatcccagccgaagaatccagcccttgtcccaaacgtgtgtrtgcacaggcacacgaaagaaggtgagacagaaggagagaaaaatgaagccagagagcaggagagagagaagacagacgccagcacgcccatctgactgcgcgacctttccccgctcagagctccttcagggcccagagcacagcgctgcctaggattaatttcaaagagaaacgggtcaaagaaaattggaaatttttatagaaaatatttcaggcttggagctggctgaagtgtctgccaacctgcagagaattctgagaggagatggggcctgtggtcagaggcctccggctggcaca

SEQ ID NO: 6073 - DNA, 601 bp, Human
gacacatagcaagaacgtgacgagtgaatgcaggaaaatacacttgtggcagcaggcaaggtgccctctctgagcctcagtctccccctaagcagtagagctgctaatgctattattcccccatgatttggggagcagtattattcccccatgatttggggagcagtattattcccccatgatttggggagcagcattattcccccatgatttggggagcagcattattcccccatgatttggggagcagcattattcccccatgatttggggagcagcattattcccccatgatttgggragcagcattattcccccatgatttggggagcagcattattcccccatgatttggggagcagcattattcccccatgatttggggagcagcattattcccccatgatttggggagcagcattattcccccatgatttggggagcagtattattcccccatgatttggggagcagcattattcccccatgatttggggagcagcattattcccccatgatttggggagcagcattattattgagcattaatgaacccgcatggcattcaggtgcccggccttttcccaaccagaccagcgca

SEQ ID NO: 6074 - DNA, 601 bp, Human
cctggctgcctgtggggctgcattgggggctcctgcccccgccccgtgagtctgggaacacatgggtcttggccttggcaccttctttcctgggaaaacacctccctctgggccagggcagtgcagagcagtggaagcgggcagctgtggagtcagagtgatgggtgccaattctgactcctgcacgtggcccagaccacctaacctgccacccccaccagcacacctgcccggccacccccaccagcacacctgcccggccagcctcaggccaccagccagcctcccagccacgtgaccwctcaggggcaggatgtgtccttgattccttccttcacaccacgtcccggaagctccacctcaaactcatcctgaacccactgcctccaccgccatctgtcaccgggactcctccctgcttccacaccgtccaccgaaaaccctccaaaggcctccaccgcacagggaatgaattctcaccccgtaccgtgaccgtcccttcaaagcgatgagtgccacccatccctcccggccctgcacgcctcccactcccccattacgtcctcagttccaggtactagctcttccttctgccccttgg

SEQ ID NO: 6075 - DNA, 601 bp, Human
tgccctgcacactcctaagtacgtgcaggccacagttcctgcatccattcatcccggccagtctggggtccctccccacagtggcaggcaaggggaagctggaccggtcctgctagacaaacaaggatgcacacacgtccatgggaccccaaacctcacactgtccctgacagcccgccccacagagcacagcctctgcctcccggagcaagaggaggtggcagtgcatcccagggcctggctgcctgtggggctgcattgggggctcctgcccccgccccgtgagtctgggaacacatgkgtcttggccttggcaccttctttcctgggaaaacacctccctctgggccagggcagtgcagagcagtggaagcgggcagctgtggagtcagagtgatgggtgccaattctgactcctgcacgtggcccagaccacctaacctgccacccccaccagcacacctgcccggccacccccaccagcacacctgcccggccagcctcaggccaccagccagcctcccagccacgtgacctctcaggggcaggatgtgtccttgattccttccttcacaccacgtcccggaagctccacctcaaa

SEQ ID NO: 6076 - DNA, 601 bp, Human
aaaggacttaggaataggagacatgcagagtaatcaaacccagggaagatcactcatcctcgccagtaaccaaagaagcgcaaattagcgcaaaaagcaacgccgctttgctgccggagcagcaaaatattaaacactaaagcccccgtgctggtgaggatttggagaaaccaggagctgctgtgggagccagtctggctctgccccgagtggtgagtctgttaagcgctgggatttcctaattcatttagtcactcagtaggtgccccctgatggctgctcagggccagggctcgagcgygtctgggctggctcaggccgccatctgccgggtcagcaacagatacctatttgcaggaacagaacctgaggtcagctcccaggatgtccccacccctgagtttcaagagagtttgcaccaggagcagggagcattccagctgtctcgggcagcttttgtgtggggaacagctggtagcgctgcctgcggccccttggggtggacaggaaggctctgcctgcaaaggcctagaggcagccacacaccctgccctgcacactcctaagtacgtgcaggccacagttcctgcatccattcatc

SEQ ID NO: 6077 - DNA, 601 bp, Human
tccctcctgatgcaggagtcaaaaggcctggctcccactgtttctacagcttactatctgtgcgaccgtcggcacctcagtttcctcatctgtaacgtgggcacagcaaaagcaccaacccaccgtggggctcattacaagaatcctaggagatgatgtacctgcagcgtgctggcagacgcggtcaacggtaagtgctccaggaacgcgtcacgttcttcttgctccctgctgttcccgctactgcttggacagtggtagccctgcaccttagttttctctctgcttccaggactaccgygcctattaaatgacaccatgaagagtgcccaccttcgcgcaggccctcggtgaatgggcatgtccttgaacgcaaacttggctccaacggggcaggagaaggatcattcagactcagctacagaaaaacagacttttgtgcaactaacgctaacaaaactggaaaggaaagaggaactatggcctggggaaaagcttgtatcgaacatgacagaaagtcaatatctaaaaagagataaagggcttatcccaatatataagaccccaggagataaacaggcaaaggacttaggaataggag

SEQ ID NO: 6078 - DNA, 601 bp, Human
ctccccgaagctaacgtgctaagtgacctggagacacatcctcactcaccctcgctgggccccagtttctgcagccgttaagtggagttccaggccttggtgcttggaaggccctctgtccaacaaacagatggggtcacaggctaccgggttttgccagcccaggctctgagcggggacaggagggcactgcactgggtgtcagcagccctgggttctaagcctgctcctccctcctgatgcaggagtcaaaaggcctggctcccactgtttctacagcttactatctgtgcgaccgtcrgcacctcagtttcctcatctgtaacgtgggcacagcaaaagcaccaacccaccgtggggctcattacaagaatcctaggagatgatgtacctgcagcgtgctggcagacgcggtcaacggtaagtgctccaggaacgcgtcacgttcttcttgctccctgctgttcccgctactgcttggacagtggtagccctgcaccttagttttctctctgcttccaggactaccgtgcctattaaatgacaccatgaagagtgcccaccttcgcgcaggccctcggtgaatgggcatgtccttgaa

SEQ ID NO: 6079 - DNA, 601 bp, Human
ctgtggcagtcacaggggcacattcctgataccgggtctgtcgttccagcatggacagggccatcttcctcgccatctgcagtctggcatcagacattcccaaataaaggacagacagttaactgtcagaaagtgctggtgcttgggcctggaaggaagggagcccgtgtctactgggcacccccaattttggccactgtgcagtgccctgtgtcctcaacctcggggcctggaccacagctccatgagaccacagggaggaagcagagtcacagaagaaagagtgatgaacagcactggycacttgatttgcagggcacagtgcaaaatggaaacgcacagtcccttgttcaaaaagtgattacgacttctaaggcaggaatgacagagtgttaaagtgggcatagggccctgccggatgggtcacaagccggcgaagtcagtcctgctcaagtgtgaggaagtgggactagcaaaggcccagggccacccaatgtcccatgggcccatgggaccagtagccacccacagctgccaacctgagtctgcagccctgacactgtggcaacaacaggaggcgtcagtgccaagccctccaatg

SEQ ID NO: 6080 - DNA, 601 bp, Human
gactagtgcactgtgggctgtatgaggtcagggctgtgcctgtctggtcccagagcctggcccagtgcccggtcctgctgtgcgtgccgggtagagatctgttggatgaatcaagggagagaggaaggggagcagccctgggattccacaggtgctttatgtccagagacaaccgcgcagggaacagtggccaaggcacgctgggagcagtgctccagcccgacggcatccccagggcagaggctgggattcacgcattgctgccctcaggcaccaaacgggcctgtggcagtcacagggrcacattcctgataccgggtctgtcgttccagcatggacagggccatcttcctcgccatctgcagtctggcatcagacattcccaaataaaggacagacagttaactgtcagaaagtgctggtgcttgggcctggaaggaagggagcccgtgtctactgggcacccccaattttggccactgtgcagtgccctgtgtcctcaacctcggggcctggaccacagctccatgagaccacagggaggaagcagagtcacagaagaaagagtgatgaacagcactggccacttgatttgcagggc

SEQ ID NO: 6081 - DNA, 601 bp, Human
cgggctcactctgtggcacttcccaagtctttcattgtgcaggtatttgtggactgactagtgcactgtgggctgtatgaggtcagggctgtgcctgtctggtcccagagcctggcccagtgcccggtcctgctgtgcgtgccgggtagagatctgttggatgaatcaagggagagaggaaggggagcagccctgggattccacaggtgctttatgtccagagacaaccgcgcagggaacagtggccaaggcacgctgggagcagtgctccagcccgacggcatccccagggcagaggctrggattcacgcattgctgccctcaggcaccaaacgggcctgtggcagtcacaggggcacattcctgataccgggtctgtcgttccagcatggacagggccatcttcctcgccatctgcagtctggcatcagacattcccaaataaaggacagacagttaactgtcagaaagtgctggtgcttgggcctggaaggaagggagcccgtgtctactgggcacccccaattttggccactgtgcagtgccctgtgtcctcaacctcggggcctggaccacagctccatgagaccacagggaggaa

SEQ ID NO: 6082 - DNA, 601 bp, Human
gcctcagcccaacgtccagtgactgcgggctcactctgtggcacttcccaagtctttcattgtgcaggtatttgtggactgactagtgcactgtgggctgtatgaggtcagggctgtgcctgtctggtcccagagcctggcccagtgcccggtcctgctgtgcgtgccgggtagagatctgttggatgaatcaagggagagaggaaggggagcagccctgggattccacaggtgctttatgtccagagacaaccgcgcagggaacagtggccaaggcacgctgggagcagtgctccagccygacggcatccccagggcagaggctgggattcacgcattgctgccctcaggcaccaaacgggcctgtggcagtcacaggggcacattcctgataccgggtctgtcgttccagcatggacagggccatcttcctcgccatctgcagtctggcatcagacattcccaaataaaggacagacagttaactgtcagaaagtgctggtgcttgggcctggaaggaagggagcccgtgtctactgggcacccccaattttggccactgtgcagtgccctgtgtcctcaacctcggggcctggaccac

SEQ ID NO: 6083 - DNA, 601 bp, Human
ggccctcaccctgcccctcctgccacacccccaaacaagccccgtcctcacccctcaggtacttcgcatctgctgccctggccccttttcctcctggggaactgcaacccacactccaggcctcagcccaacgtccagtgactgcgggctcactctgtggcacttcccaagtctttcattgtgcaggtatttgtggactgactagtgcactgtgggctgtatgaggtcagggctgtgcctgtctggtcccagagcctggcccagtgcccggtcctgctgtgcgtgccgggtagagatctgytggatgaatcaagggagagaggaaggggagcagccctgggattccacaggtgctttatgtccagagacaaccgcgcagggaacagtggccaaggcacgctgggagcagtgctccagcccgacggcatccccagggcagaggctgggattcacgcattgctgccctcaggcaccaaacgggcctgtggcagtcacaggggcacattcctgataccgggtctgtcgttccagcatggacagggccatcttcctcgccatctgcagtctggcatcagacattcccaaataaaggacagacagt

SEQ ID NO: 6084 - DNA, 601 bp, Human
gatctgggaaaggtccttgagaaaagggccagacacagggaccttcccaggcccggatcccacagaggaaatgattctagcgagcgccacctcgacaggtctgaggtccagacaggggtggagctgtcacaggcagccgggtggggctgtgatctgggtcctcccagcctcacggtgatttggaatgggaatacggttctgccaggcaaggagtatccccctctgaccaacctgtggactgcctaccaggactcccaacacccttcctgcacgatggcgctgaggggctgatccggccgckgctctcattcccatggccacctgatccaggccgcagtctctccctgcacacaggacagcagcctcctgccggctccctgcctcttccgtgctcaccctcctcggaaaccagaccatgccacctgctgcatggcacagcccctcctccacgacggagcccacagaagccatcgtgatctgacctccagtcccctcaggccctcaccctgcccctcctgccacacccccaaacaagccccgtcctcacccctcaggtacttcgcatctgctgccctggccccttttcctcctggggaactgc

SEQ ID NO: 6085 - DNA, 601 bp, Human
ctgggactgcccatggctgtgggctctgatttgggtgggcagacctgagcaggccatcatgcttcttattcccagcctgacacccccagaccgccccccgccaacccagacaatgtgtactgaactcctcgtcaacttgacccctgagctcctccccgcagcccaccaggtgctcctgctgtggtttgggcagcacctagtccttttcgccctgctggacgtcgcctggccagacttgcagagccatctcagccctttgttctcctgactccatccctccaagcctggccaccccagcctsggccccagctcctgccacgtgaattgtcaaaggcagagcatgaggaggctgaaggcagcccccatggcacaccccacggagtccctgcagtcgtccaaaaaaggctcaagcctgggcagcattgctcgcagctaggaatctgcagctggactcaaatatgtgtccagaatgatctgggaaaggtccttgagaaaagggccagacacagggaccttcccaggcccggatcccacagaggaaatgattctagcgagcgccacctcgacaggtctgaggtccagacaggggtggagctgtcac

SEQ ID NO: 6086 - DNA, 601 bp, Human
ccccgtgtctacctgggcccagtgatctctgctggcgtcacctgccaggcccccatcagtgtgcccatacgagaccactgtcctcagcgaacgcctgacccccaggctccaggcaaggttgagaggacagatgctctcatcctgggggctctggccttcctggggccagtgttatccagctctgccctccagagccctctgcacacgctggggctgggactgcccatggctgtgggctctgatttgggtgggcagacctgagcaggccatcatgcttcttattcccagcctgacacccccrgaccgccccccgccaacccagacaatgtgtactgaactcctcgtcaacttgacccctgagctcctccccgcagcccaccaggtgctcctgctgtggtttgggcagcacctagtccttttcgccctgctggacgtcgcctggccagacttgcagagccatctcagccctttgttctcctgactccatccctccaagcctggccaccccagcctcggccccagctcctgccacgtgaattgtcaaaggcagagcatgaggaggctgaaggcagcccccatggcacaccccacggagtccctg

SEQ ID NO: 6087 - DNA, 601 bp, Human
ggccgaccccgtgtctacctgggcccagtgatctctgctggcgtcacctgccaggcccccatcagtgtgcccatacgagaccactgtcctcagcgaacgcctgacccccaggctccaggcaaggttgagaggacagatgctctcatcctgggggctctggccttcctggggccagtgttatccagctctgccctccagagccctctgcacacgctggggctgggactgcccatggctgtgggctctgatttgggtgggcagacctgagcaggccatcatgcttcttattcccagcctgacmcccccagaccgccccccgccaacccagacaatgtgtactgaactcctcgtcaacttgacccctgagctcctccccgcagcccaccaggtgctcctgctgtggtttgggcagcacctagtccttttcgccctgctggacgtcgcctggccagacttgcagagccatctcagccctttgttctcctgactccatccctccaagcctggccaccccagcctcggccccagctcctgccacgtgaattgtcaaaggcagagcatgaggaggctgaaggcagcccccatggcacaccccacggag

SEQ ID NO: 6088 - DNA, 601 bp, Human
tgtcatcttgtgacccgcccctggggacacgggtgcccaacaggaaagaggacgggggcttattataaggaaaatagtgtcaggcctgccatggagctttgggcctgaggcctcagctgaggccaaggcagcaggactcatccagagacaggacagaccctgggctcctggtgcccagctcagggaagctcctgggtgcggctcggttcactccagcatttcctacatggatgaagatgtggatgtgtctgctctgaccatgggtgtgtgcatgcctgcgtgtgtgtgagagagagagaggagagagagacggagagagtttatgtacgtgtaactaccaaccagagtccaggagtctcacactccactgcaaaccaggcaggcggggccagcatgagtgggggggccaggcacgaatcggcagggagggaggggttgtgttcgcccatccagaggaggcacagagcctcccacccagtgctgctggcaggaacacgcccagggtggccaggccttctgaaggaactgaaaattgagattttcatgtgaaacctcctgatttttaagtgtacactcaacatttctgaagccgttgtacgag

SEQ ID NO: 6089 - DNA, 601 bp, Human
aagttgtcatcttgtgacccgcccctggggacacgggtgcccaacaggaaagaggacgggggcttattataaggaaaatagtgtcaggcctgccatggagctttgggcctgaggcctcagctgaggccaaggcagcaggactcatccagagacaggacagaccctgggctcctggtgcccagctcagggaagctcctgggtgcggctcggttcactccagcatttcctacatggatgaagatgtggatgtgtctgctctgaccatgggtgtgtgcatgcctgcgtgtgtgtgagagagagagaggagagagagacggagagagtttatgtacgtgtaactaccaaccagagtccaggagtctcacactccactgcaaaccaggcaggcggggccagcatgagtgggggggccaggcacgaatcggcagggagggaggggttgtgttcgcccatccagaggaggcacagagcctcccacccagtgctgctggcaggaacacgcccagggtggccaggccttctgaaggaactgaaaattgagattttcatgtgaaacctcctgatttttaagtgtacactcaacatttctgaagccgttgta

SEQ ID NO: 6090 - DNA, 601 bp, Human
gcgctggcctggggtgcttgcagacactgactggatgaatggatggatggattgggtggatgaatgagtgtgtagatgaatggatgatgaatgatggatggatggatggatgatggatgaatgaatggataaataattggatggatggatgggtagatgggggatgggtagatggatgagtaagtagatgaatggagatcaatgatggatggatagatggatggatgaatgagtgggtagacgaatgaatacacgatggatgaatgaatggataaatgattggatagatgaatggatggayggatgacagatggataaatggatgaatgattggatagatggatgaatgggtagacagaaagactctgatactggaaagtgaatccttcacatccatggcaagtgaaccgggtaacaaagtcagaggcaagaccatagcagcgtcatttgtcactgttgccatttatacacatttttggggcagaatcggtcatgcttgaccacaggtcatctctagagggtgaggattgggggtcaggaactgtggggtgggctcagggctagggctgccgatgtggcctttgtgcctgtgagcagactg

SEQ ID NO: 6091 - DNA, 601 bp, Human
aacacaacagggcacaatgaggaagggctgccaagcagcctattagcagcatttgtcatggttcatctgggagtctgccttttcccccagccagactcttcagggacagagaccagattgttcatactcagtgcccagcagggcgctggcctggggtgcttgcagacactgactggatgaatggatggatggattgggtggatgaatgagtgtgtagatgaatggatgatgaatgatggatggatggatggatgatggatgaatgaatggataaataattggatggatggatgggtagatrggggatgggtagatggatgagtaagtagatgaatggagatcaatgatggatggatagatggatggatgaatgagtgggtagacgaatgaatacacgatggatgaatgaatggataaatgattggatagatgaatggatggacggatgacagatggataaatggatgaatgattggatagatggatgaatgggtagacagaaagactctgatactggaaagtgaatccttcacatccatggcaagtgaaccgggtaacaaagtcagaggcaagaccatagcagcgtcatttgtcactgttg

SEQ ID NO: 6092 - DNA, 601 bp, Human
gttgatggcgtcaaagatgcacagaaatatattttggctgaaagaaacacaacagggcacaatgaggaagggctgccaagcagcctattagcagcatttgtcatggttcatctgggagtctgccttttcccccagccagactcttcagggacagagaccagattgttcatactcagtgcccagcagggcgctggcctggggtgcttgcagacactgactggatgaatggatggatggattgggtggatgaatgagtgtgtagatgaatggatgatgaatgatggatggatggatggatgatggatgaatgaatggataaataattggatggatggatgggtagatgggggatgggtagatggatgagtaagtagatgaatggagatcaatgatggatggatagatggatggatgaatgagtgggtagacgaatgaatacacgatggatgaatgaatggataaatgattggatagatgaatggatggacggatgacagatggataaatggatgaatgattggatagatggatgaatgggtagacagaaagactctgatactggaaagtgaatccttcacatccatggcaagtgaaccgggta

SEQ ID NO: 6093 - DNA, 601 bp, Human
ctgttgatggcgtcaaagatgcacagaaatatattttggctgaaagaaacacaacagggcacaatgaggaagggctgccaagcagcctattagcagcatttgtcatggttcatctgggagtctgccttttcccccagccagactcttcagggacagagaccagattgttcatactcagtgcccagcagggcgctggcctggggtgcttgcagacactgactggatgaatggatggatggattgggtggatgaatgagtgtgtagatgaatggatgatgaatgatggatggatggatggatgatggatgaatgaatggataaataattggatggatggatgggtagatgggggatgggtagatggatgagtaagtagatgaatggagatcaatgatggatggatagatggatggatgaatgagtgggtagacgaatgaatacacgatggatgaatgaatggataaatgattggatagatgaatggatggacggatgacagatggataaatggatgaatgattggatagatggatgaatgggtagacagaaagactctgatactggaaagtgaatccttcacatccatggcaagtgaaccggg

SEQ ID NO: 6094 - DNA, 601 bp, Human
aacagtcttggtgtttcctcaaaaagtgaaacactgtgttatcatgtgagccagcaattctcctaggcatatacctaagagtaatgaacatatatgtacacacaaagacttgtccacaaatggccatcgaggagaagctggccacagagaagatggcccagagaggaggtgctgtgtgcagaagcagctctgggaggaaagacgtgcacaggccaaattcagattactgacactttttttttaatgcagagattgtctgcagaattacctatttttgacttatcttgaaaaactgaggatstggcaacactgaccccgaatcttcctaacagcaacaatgatcagaactcagaggttttctgtctcactgatttttttttctttttcttttcttttttttttttttttgagatagggtctgactttgtcacccaggctggagtgcagtggtgcactctcagctcactgcaacctctacctcccaggctcaagcaattctcctgcctcagcctcccaagtagctggttccacaggtgcatgccaccacgtgtagctaatttttagatttttttggtagagatggggtttcaccattttgccc

SEQ ID NO: 6095 - DNA, 601 bp, Human
aatgacatccacacggtactggaagcagagctgctagaaacccagccaggcagggtttgaacttgttatctccaaaaagtctcaggaatcgtatttctgcctgatggtgacctacttcagcaaggacccaatgtagaaattactctgccaccaaaaaagcaggcctcagaccccctccatcacctccccaatttatgaattaaacaacgaggccagtgcctgaggggtctgcagatgagagtcagaaaccagcagccccccaccccacagagacaggtccctgctaactagacacaagaawtggccttctggggtgtctctgcgtgttctgtgtatggtgacctagccccggccctccaggagggacactacgtgcaggacattttggaaaacagtcttggtgtttcctcaaaaagtgaaacactgtgttatcatgtgagccagcaattctcctaggcatatacctaagagtaatgaacatatatgtacacacaaagacttgtccacaaatggccatcgaggagaagctggccacagagaagatggcccagagaggaggtgctgtgtgcagaagcagctctgggaggaaagacgtgcacag

SEQ ID NO: 6096 - DNA, 601 bp, Human
ggttcaaatcccagatcctccactttctaattgtgccatctctgagccttccatcccttacctagaaacagagttctttccacccatgcccttgtgagacagcgtaagtgaaaatgacatccacacggtactggaagcagagctgctagaaacccagccaggcagggtttgaacttgttatctccaaaaagtctcaggaatcgtatttctgcctgatggtgacctacttcagcaaggacccaatgtagaaattactctgccaccaaaaaagcaggcctcagaccccctccatcacctcccyaatttatgaattaaacaacgaggccagtgcctgaggggtctgcagatgagagtcagaaaccagcagccccccaccccacagagacaggtccctgctaactagacacaagaattggccttctggggtgtctctgcgtgttctgtgtatggtgacctagccccggccctccaggagggacactacgtgcaggacattttggaaaacagtcttggtgtttcctcaaaaagtgaaacactgtgttatcatgtgagccagcaattctcctaggcatatacctaagagtaatgaacatatatgtac

SEQ ID NO: 6097 - DNA, 601 bp, Human
ggccagcattaccctgataccgaaaccagacaaaaacatcataagaaaactacagactaatgtctcttataaatataggtgcaaaaatcctcaatgatattctagcaaaccaaattcagcagcatattaaaaggcttatatacaatcaccaagtgggatttatccgtggaatgcaagagtggttcaacacacaaaaatcaatccatataatacactacattcataaaatggaggaaaataaaccacacagtcatcttggttgatgcagagaaagcattagacagaacccaacaccctttgygatcaaaaaatactcaagaaacaaggactagaagggaaattcctcagcatgataaagggtatttacgaaaagccaaaagtactcatcatggtcaactgtaagactggaagcctgctctcaccacctgtattcaacatagtaccggacattctagtcagagcaattcagcaagaaaaaaataaataaataaaaggcatccacattgcaaaggaagaagtaacacttcttgagggaaaatggggaatgatggctcgtgggtacagggtttcttttgggagcaatgaaaatgatctaaagttg

SEQ ID NO: 6098 - DNA, 601 bp, Human
gtcaaatcactagctgaccactaagctaacaaaacagagactttggtggccatatataatgaacaatgcagactttacaaaaatagtttagaaaaatcactaaacaaacaagcaacaacacataaaaaacaacaagccccgggaagtggggggcatctgatttccagagtctccacattcaaaatgtccagtttccaacaaaaaatacaaagcatgcaaaataacaagaaaggatggtccactcacaggaaataaaaaagaccttccctgaggaagcctagacacctcatgtgccagacaragattttaaataaattgtcttaaatgtgttcaaagaactaaaagaaaccatgggcaaataacgtaagtaaagcaagaacataatgtatcacaaaatagagaatatcaataaagaaatagaaattataaaaaggaaccacaaacaattttggagctgaaaagcataataactgaaataaaaatttcaatagatcagttcaatagcagatttgagcaggcaaacaaagaatcagcaaacttacattatcagcaatcatccaatctgagaagtagaaggaaaaagaatgaggaaaaaggaaca

SEQ ID NO: 6099 - DNA, 601 bp, Human
tgagtagacccattttatcagacatactaaaggaagttcttcaagctgaaagcaagtgacctcagttggtaacttgaattcacacccacacacatacagtaccagtaaaggtaatcacgcaactttaaaagacaatataaatgggtatttcttctcttttcttcccttaactggcttaaaaagcaataatatagaagaagatgtatataattgtattattgggcccatataatatataaatgtaatatatttgactaacagcacaaagcaggtgaacagaaacacagctactggagtaaaraaatgacaccagatgggaacttgaatccaccgcaacaaatgaagagagccagaaatggtcaacaggaaggcaaactgttgatatatatgtactctcctctcttttttcagcttctttaagcatgaaattatataaagcaataattacaacaattgttaggtttgtagcatatatagctgtgtggtaggcagaactgtggccctccaaagatgttcacattctaatccccagaacctatctatctgtaaggttatatgtaaaggaaaattaacattgtaaatcagatgactttaaaatatt

SEQ ID NO: 6100 - DNA, 601 bp, Human
aatggaaattctggagttgaaaagcaccataactgagaggcttaacagtagattggaactggcagaagaaagaatcttgaaaacagatcaatagacattatgcaatttgaaggacacagggaaaaaagaatgaagaaaagtaaacggaacttaagaaaaatgtggaaaccataaagggcatgaacatatgcacaatgggagtcccagaaagaggcaagtgagtataaaggagcagaaaagatggaagaaacagtggcaaaaagctccctaaatttggtgaaaacattaacctacgtgtccragaaactcagcaaacttcaaacgggataaatgccaagagatccacacccagagacatcatagtaaaaatgccgaaagccaaagacaaagagaaaattctgaaagcagcaaaagaaaaatgacttgccacatatgtgggaatcccagtgggatttccagccgacttctcctaataatggaagccagaaggcagcagaatggcatatccaatgtaaaaaagctgtcaaccaagaatctttctccagcagaactatttttcaaaattaaggtgcaatatagacagtcccagataagtaaaaac

SEQ ID NO: 6101 - DNA, 601 bp, Human
aattataaacaagaaccaaatggaaattctggagttgaaaagcaccataactgagaggcttaacagtagattggaactggcagaagaaagaatcttgaaaacagatcaatagacattatgcaatttgaaggacacagggaaaaaagaatgaagaaaagtaaacggaacttaagaaaaatgtggaaaccataaagggcatgaacatatgcacaatgggagtcccagaaagaggcaagtgagtataaaggagcagaaaagatggaagaaacagtggcaaaaagctccctaaatttggtgaaaacattaacctacgtgtccgagaaactcagcaaacttcaaacgggataaatgccaagagatccacacccagagacatcatagtaaaaatgccgaaagccaaagacaaagagaaaattctgaaagcagcaaaagaaaaatgacttgccacatatgtgggaatcccagtgggatttccagccgacttctcctaataatggaagccagaaggcagcagaatggcatatccaatgtaaaaaagctgtcaaccaagaatctttctccagcagaactatttttcaaaattaaggtgcaatatagacag

SEQ ID NO: 6102 - DNA, 601 bp, Human
acagctgtcagattttgcagcaaagatttcaaagcagccattggaaatatgtctttgaaaaaaggaaaccatgcttatgtaaaggagtgatgatgacaatatctcatcaaataaagactatcaataaagagaaattataaacaagaaccaaatggaaattctggagttgaaaagcaccataactgagaggcttaacagtagattggaactggcagaagaaagaatcttgaaaacagatcaatagacattatgcaatttgaaggacacagggaaaaaagaatgaagaaaagtaaacggaacytaagaaaaatgtggaaaccataaagggcatgaacatatgcacaatgggagtcccagaaagaggcaagtgagtataaaggagcagaaaagatggaagaaacagtggcaaaaagctccctaaatttggtgaaaacattaacctacgtgtccgagaaactcagcaaacttcaaacgggataaatgccaagagatccacacccagagacatcatagtaaaaatgccgaaagccaaagacaaagagaaaattctgaaagcagcaaaagaaaaatgacttgccacatatgtgggaatcccagtggg

SEQ ID NO: 6103 - DNA, 601 bp, Human
agaatgaatttcaaagactggcctcaaaatcatccctacccaaatttaattggatcaaactatgtgacaatttatgtctcaggacattgttgaaaataatagagcaatcatccctcaattagtgaagcctagtagctgggtgtgataccaaatgaagcagagagtgtaacagacagatcagagaaagggacagtcatagggagccctgctgaaatcactgtcatcccgggatgaccctgcacacgctcaaggctgtgccctccaacagctgaggcttcccactgtgaagaatacagacttygtgaaaacagtctaaccaaatcaggaaacaaataaatacacaaacaactgcaaacagcctcagagatgggggaggggaatcagtatgcagagctgccacatgacccaaaatgtccagtttcacacaacagaaacacaaatgactcattcacagaaaaaaaggcggcaacagacactgctggtaagaaagcccagatgtcagatgtaacagctgtcagattttgcagcaaagatttcaaagcagccattggaaatatgtctttgaaaaaaggaaaccatgcttatgtaaaggagtgatgat

SEQ ID NO: 6104 - DNA, 601 bp, Human
ccgaaaggccggagcaccttcctccacccagccctaactcagggcaggagctccgtctcaggtgcagcagggcgagagtgctgggctcctaatcaccctaagtccagcctgcttgctagaaaaatattccatgctagggggaggcaaaccaagaagatcagaggctacctcctgcccaatacctggagtggtggcttcagtgaagattctggcggcaagaatttaagaggaggctgacagctctatgagaacaacaacctgaaccacagaccagcttatttactggaaaaaaaaaaaaaaaatcaggagaacagatcgttatgaggatctcttccagggggagaatgaatttcaaagactggcctcaaaatcatccctacccaaatttaattggatcaaactatgtgacaatttatgtctcaggacattgttgaaaataatagagcaatcatccctcaattagtgaagcctagtagctgggtgtgataccaaatgaagcagagagtgtaacagacagatcagagaaagggacagtcatagggagccctgctgaaatcactgtcatcccgggatgaccctgcacacgctcaaggctgtgccc

SEQ ID NO: 6105 - DNA, 601 bp, Human
aatcaaccaaatcttgggaagaaaaatcccagtaagaacagcaagaatcggtggcacctgagccatcacttgctctctcttccccgcttctagtccttccagttcagcttatggggagttccactctgggggtgtgtggccaagaacacagggctccctcttccctcagatcccagtcaaggaatacagtatttcaccaggatagatgggccaccagcgtttctcatcatctccaactcccagtgacagagggtaactccctgctgagtgtgaccgaaaggccggagcaccttcctccacycagccctaactcagggcaggagctccgtctcaggtgcagcagggcgagagtgctgggctcctaatcaccctaagtccagcctgcttgctagaaaaatattccatgctagggggaggcaaaccaagaagatcagaggctacctcctgcccaatacctggagtggtggcttcagtgaagattctggcggcaagaatttaagaggaggctgacagctctatgagaacaacaacctgaaccacagaccagcttatttactggaaaaaaaaaaaaaaaatcaggagaacagatcgttatgaggat

SEQ ID NO: 6106 - DNA, 601 bp, Human
aagcaacatcatctattcaagaaaatcaaccaaatcttgggaagaaaaatcccagtaagaacagcaagaatcggtggcacctgagccatcacttgctctctcttccccgcttctagtccttccagttcagcttatggggagttccactctgggggtgtgtggccaagaacacagggctccctcttccctcagatcccagtcaaggaatacagtatttcaccaggatagatgggccaccagcgtttctcatcatctccaactcccagtgacagagggtaactccctgctgagtgtgaccgaraggccggagcaccttcctccacccagccctaactcagggcaggagctccgtctcaggtgcagcagggcgagagtgctgggctcctaatcaccctaagtccagcctgcttgctagaaaaatattccatgctagggggaggcaaaccaagaagatcagaggctacctcctgcccaatacctggagtggtggcttcagtgaagattctggcggcaagaatttaagaggaggctgacagctctatgagaacaacaacctgaaccacagaccagcttatttactggaaaaaaaaaaaaaaaatca

SEQ ID NO: 6107 - DNA, 601 bp, Human
tagcccacacctggtactcaatgccctcagcacagtgattggtccagggggtgaacacatgactggagtgagactaatcatgggtcttccatgagatctgaacattgggagaaaaaaatattcccttcctggctcagtaagctcacagcgtaggcctggggctgcgtatgtgaagagccaatctgagaaggaagtctctgcagaagagagccaagtcctaggaggaggagagacgctgagccttggcagcctcgtgtgggccagcggtgcctgctgtcttgctcgcgtgtgccagcaaatytccttttcttggcttaattggatttggatctctaattataccttgaatgaccctgacatatccagtgtcttctaccttccttattgctgtggccctttaaaaaaagattaggaatcatctgccatgagaattccacttctggaatggtggtgagaggagccccatggacacattcccctcagaacaaccataactggtgaaaagtattgaaaagtcaccatcaacaacaatttaaagtctctagaaattatcctaagagcacacaacaaactaagcaacatcatctattcaagaaaatca

SEQ ID NO: 6108 - DNA, 601 bp, Human
tgtgttgccagggacagagtgcaaggtgcctggaagctcctcgggaacgttagctgtgtccctcatcgcaggcaatgggaccctgcaccagtggccagtacctgctgccccagccagcctctgtgaggcacacactgccagagatgacctcacgctggtggaaaacgaggagacagcagatcaacccagccgggcttccacgtccagcaaaacgaggcgagttcgggttgttattctgctctttcatgagtcagggctttgggcctcactgccttccaaacagagtcaaaatcaatttgaygttcaaaacgacatgaaaattgccatgtcaaaggccattctgtaatttcagtgtattaaaatcaaaagagcacagccttcttgaagaagtttcctttgggcagaattcaagtttcctctttcttttacttgtgcaatttgaatttatttcactttttcaggaagtgaccatttttgcaggaaaagtgtagtcaaaagagataatgcacatgaagtttctttttaagttctgagtatgtcgaagagatttacagtgcattaaaataaactataggcaaaatagtgtgtgtacctatctcta

SEQ ID NO: 6109 - DNA, 601 bp, Human
tcctgtgtcaaatgagttcccgtgacgcgtgtcagtgcgtgtggatcttgctgtttgggggagggcagaaactctgcagaccccatgccttgccaccctcgaccctgatacgcgatgccaatagacacactgctgcggaaaccataaacgtcaccagattcagagcttgagcccacctctcccagaggttttgtccggtaaagggaagaggaacagggttcaactctcctggcagaactctatggatgccgcagaagacaacgttaatgagcttggcttaacttacaagggatttccggtyttgtgaaagaggaggaaactcaaatctcaggagagtttaatggcaggagtgagcttgagtgttggtttccctaatagatgggtttagctgcatgggtgaggtagaccaaggccctctgtagaatatgctggagaacaatgattcaagactacaaagaaactgaagtgtgagcggaagataggagtgaaccttcgagaaccggaggccatgccactgccttgtttcgggtggaggaacaaagccttgtcactgtgttgccagggacagagtgcaaggtgcctggaagctcctcgggaacgt

SEQ ID NO: 6110 - DNA, 601 bp, Human
ttgctggagcacaggtcggagcaaaagggaaccgggaaaatagaaggtcatcagaatgcaacactgcaacggattatgcaggtataggggccgctggcaaaagaaggtttaaggtatgaccaaggccaaatccagtggggagtcctttttggaaaccttgacagctgtggtcatggtcgacctcatgggaaattttgcaaacttgatcctgtgtcaaatgagttcccgtgacgcgtgtcagtgcgtgtggatcttgctgtttgggggagggcagaaactctgcagaccccatgccttgccrccctcgaccctgatacgcgatgccaatagacacactgctgcggaaaccataaacgtcaccagattcagagcttgagcccacctctcccagaggttttgtccggtaaagggaagaggaacagggttcaactctcctggcagaactctatggatgccgcagaagacaacgttaatgagcttggcttaacttacaagggatttccggttttgtgaaagaggaggaaactcaaatctcaggagagtttaatggcaggagtgagcttgagtgttggtttccctaatagatgggtttagctgcatg

SEQ ID NO: 6111 - DNA, 601 bp, Human
agggaagccgtcaggtgtgaatgcggatagggagcagatgttggaggtgttcagaggacggaagatatgaaaagtcatctggaaggaggcaaacagactgaggggagcagtctggctgctagcggcaccttgctggtgaacatcatcgtaagcaagagcagaagcagggctgagctttgttcaggggtacccgtgccagcatgaagtaggtagaaagtttcattttaccaggactagggcattgttcagtagatgttacaaagcaagagtgactccaatgagggaacctgcagtttaagasaaggaggctgggtaaggggtggagggaaggatcagtggtgtgagagaccgtgacaaggcggcagcatcaatggcctgcaggtttgctggagcacaggtcggagcaaaagggaaccgggaaaatagaaggtcatcagaatgcaacactgcaacggattatgcaggtataggggccgctggcaaaagaaggtttaaggtatgaccaaggccaaatccagtggggagtcctttttggaaaccttgacagctgtggtcatggtcgacctcatgggaaattttgcaaacttgatcctgtgtcaaa

SEQ ID NO: 6112 - DNA, 601 bp, Human
ggcgtgctgaggtggtacttccaaattgaggttggcaagtagagaaatgccttggaacttggatttgaagagtgcagagacagatgaggtgcagattctgctggagtcaggagcgtgggcaatacagagagcatggaaggtggaggggcagttggaatatgagtcttgggtgcaggagagagatctgggctggagacgcaaatctgggagccatttcatggtacataaagcaacaagaggaatgagatcgcccacagaggggtgcagagggagaccaaggagcgtccaggacagagccctsggcgcatcaaccccagagggtgcgggaagaggaaggatcagcaaaggaaacggggatgaactgtgagtgctgtgattagaccaagaaagtgggtgtccggtaagccacaccaagggagcaggagggactagcctgccacgtgctagggatggcgactgaggattggcagggagatgcagcagcatgatgacctcggggagggtgcctctggcagagtggcacacacagaggcctggtccaagtggggttaagacacagtgagaggagaggaatcgaagatggcgtctccacctagggggt

SEQ ID NO: 6113 - DNA, 601 bp, Human
cggttttcacctgctgggtgtccacggattcacccccagctactgtgtaggggccagctcccctcagggactgctcctgggagaccgtgggagtcaccgcagctccctgctctgtggagcggccacgctagcagaaggaacagagggtgccagtgctctgagtatgccggagggcagtgagtgctgcgggaaggggctggagggcacagggtctgcgagtgccagggcaggtggtgcggggggagctgtctacaaagccttagagcgccagggtaggtcccactggaagggaacatgcaarcaaagactcgaatgaggtgggagggtgagctgagggtgtctagaaagggcatccaggcggaaggaggaccccatgtggggttttgaaaagaagggcaaggaggcccaggatggcaggaatcaagtgagtgagaaggaaaatggaggccacggggtcccagggcgaggcgctgggtcgtgtggggtctggtaggtggcccgggtgctgggtgctgacttctgagctgaacgaagcaggagccactgtgggatttccagcagaagacagacatgatccagcagaaggcatcaaaggatccct

SEQ ID NO: 6114 - DNA, 601 bp, Human
agctgaagagtcccaggcagccatcgctcccgacacgcacgccgcagtgtagctgtggctcctgagaacggcggtgttaaaggacagttacttaaccagaacttggggtccccctgccccgccccacggaggccttgaacatcctacaataaacacacaccgaagccatgttcttggagagactttggggaggctgtgcactctggaaacagccaagctgttctgtggcttggaagaaacaagcagttccatccactctgggctcacagatattcctcctgagcttgaaggaagccacagyggaacttggagctgctctagttctctggaacatgcagcaggtggaaccgcagacgtctctccagggagctgagtcccggttttcacctgctgggtgtccacggattcacccccagctactgtgtaggggccagctcccctcagggactgctcctgggagaccgtgggagtcaccgcagctccctgctctgtggagcggccacgctagcagaaggaacagagggtgccagtgctctgagtatgccggagggcagtgagtgctgcgggaaggggctggagggcacagggtctgcgagtgcca

SEQ ID NO: 6115 - DNA, 601 bp, Human
gcctcaaagcctcttggcacatctcagcttccagatgtcctgtgccttgtgagatattaaccacactctgcctagccctctgccatgaggtcagctccgctcccaggcagggggaagagctgccttgggagcaatgatgggcatcgtccctctgtgctgtgtttggggtcttccctccctccaagtcttggactttgggcccagaaatcactttccctccctcctctctgagcacacaaagggcaggacttgtcttcaggtgcttggggaagagggacgccaattgttccagccactcccrtaagggtgaaccaggagactaaccatcaaattcaccaggaaatcccaacctccaggccctgactgaggccctaagacccaagcaagcaatatcaatgaaagccagaggtgcttaaggtggggaacaagaatgagctgtcagaggcctctgataaagaatcgtttaaaaagactttctttgctgcggctcatgcctgtaatcccagccctttggaagtctgaggcggtaggatcacttgaggtcaagaattcaagagcagcctgggcaatatggtaaaaccctgtctccatacacataaaa

SEQ ID NO: 6116 - DNA, 601 bp, Human
cctgtgaccactcatgtccacctagcctggtcctggtcccaggtgccctcctggtctagctgccactaaacagatgagaatctccctcccatcccagccctgaaatatgctcagcctcaaagcctcttggcacatctcagcttccagatgtcctgtgccttgtgagatattaaccacactctgcctagccctctgccatgaggtcagctccgctcccaggcagggggaagagctgccttgggagcaatgatgggcatcgtccctctgtgctgtgtttggggtcttccctccctccaagtcytggactttgggcccagaaatcactttccctccctcctctctgagcacacaaagggcaggacttgtcttcaggtgcttggggaagagggacgccaattgttccagccactcccgtaagggtgaaccaggagactaaccatcaaattcaccaggaaatcccaacctccaggccctgactgaggccctaagacccaagcaagcaatatcaatgaaagccagaggtgcttaaggtggggaacaagaatgagctgtcagaggcctctgataaagaatcgtttaaaaagactttctttgctgcggc

SEQ ID NO: 6117 - DNA, 601 bp, Human
tctgctcagaccaaaggcagaatccagtgctgatggttgccaatagggtcctctctgttgctgggcccccatgaaccatgtgagccctgcacagagctcctgctagatcctgggggtctccctgcactgggattgctccaacagtgcccccaccctcagggcatgggttgccctctgcatctggccaagtgccttcccagacaccctgcagcctcagcctcctgtgaccactcatgtccacctagcctggtcctggtcccaggtgccctcctggtctagctgccactaaacagatgagaakctccctcccatcccagccctgaaatatgctcagcctcaaagcctcttggcacatctcagcttccagatgtcctgtgccttgtgagatattaaccacactctgcctagccctctgccatgaggtcagctccgctcccaggcagggggaagagctgccttgggagcaatgatgggcatcgtccctctgtgctgtgtttggggtcttccctccctccaagtcttggactttgggcccagaaatcactttccctccctcctctctgagcacacaaagggcaggacttgtcttcaggtgcttggg

SEQ ID NO: 6118 - DNA, 601 bp, Human
aagtgtcagaaccaggatatgaaccctggcatggctaccaagagtctgtgctcttgaacgctgtgctaggccactccttctggggctgttacattttaactctgacatgtcaagcaaatcactataagtttattgagtcatttcttagctgcttcatctgtaaagtcgggtgacaatggctgcaggtcctgccactcagacgattcccacgcgtgtctgtatcaggatgaggatgagtagatcggtaaagtgccttgtagactgtgatgatcatatttttgtctttgattccactgccagsacaatacctttttttttttaataaagggctgttgaactgcaattcccatgtttgtatacattcttcttctgtttctttggttaaagtttcaagattctcttagggttcaaatgtttaaatttcaaatcctttggctcatctgactaattacaagcataaaatatggcatttccaacaagtctggagaatggaagcacatgaaattatgcacgaccatgagcatctgtgtcgggaggcgggaaggcgttcacccttcaaactcaagtgaaaaaggtttgccgtagttaaaggctgctgaca

SEQ ID NO: 6119 - DNA, 601 bp, Human
tgtgtgagttagctgtgatgcttatcttcattctgcagatggggaaactgagaaaggctatcccaatttcacactgctcggaagtgtcagaaccaggatatgaaccctggcatggctaccaagagtctgtgctcttgaacgctgtgctaggccactccttctggggctgttacattttaactctgacatgtcaagcaaatcactataagtttattgagtcatttcttagctgcttcatctgtaaagtcgggtgacaatggctgcaggtcctgccactcagacgattcccacgcgtgtctgyatcaggatgaggatgagtagatcggtaaagtgccttgtagactgtgatgatcatatttttgtctttgattccactgccagcacaatacctttttttttttaataaagggctgttgaactgcaattcccatgtttgtatacattcttcttctgtttctttggttaaagtttcaagattctcttagggttcaaatgtttaaatttcaaatcctttggctcatctgactaattacaagcataaaatatggcatttccaacaagtctggagaatggaagcacatgaaattatgcacgaccatga

SEQ ID NO: 6120 - DNA, 601 bp, Human
gcactgttccaagcacctcgtctatagttgcccactgattcttcgcagcagctgtgtgagttagctgtgatgcttatcttcattctgcagatggggaaactgagaaaggctatcccaatttcacactgctcggaagtgtcagaaccaggatatgaaccctggcatggctaccaagagtctgtgctcttgaacgctgtgctaggccactccttctggggctgttacattttaactctgacatgtcaagcaaatcactataagtttattgagtcatttcttagctgcttcatctgtaaagtcrggtgacaatggctgcaggtcctgccactcagacgattcccacgcgtgtctgtatcaggatgaggatgagtagatcggtaaagtgccttgtagactgtgatgatcatatttttgtctttgattccactgccagcacaatacctttttttttttaataaagggctgttgaactgcaattcccatgtttgtatacattcttcttctgtttctttggttaaagtttcaagattctcttagggttcaaatgtttaaatttcaaatcctttggctcatctgactaattacaagcataaaatatggc

SEQ ID NO: 6121 - DNA, 601 bp, Human
caggcccagaaggacaaatacggcactcgtccactcacatgaggatctgtaatcaaacgcatgaaagcagatgacaccatagaggctgccagagctgggggagcgggaaatggggagttgctgttcaatgggtgtaaagttttagtgatgctggacgagtaagtactagaggtctgctgtacaacgttgtgcctgtagctgaccatgtggcactgtgcacttcgaaattctctgagaggtctgagctcacgttaagtgttctttccacaaaagcaaacaacaacagcaacagaaatgaagkgacagaaggaaaccgtgggagaagacgagtgtctaccgcctcgatgtgctgatggcgtcccggtgtctgcacaaatccacacttgctgaactgtaaggggccggtgacctctacagtcgcctaccatggcgagcataaacttgcagagaagaggatgagaattctgataataggacaaatcaaagcttaacaagtaattaaaggacaaattggtgcatataacaagtcgttccctgtctcgcagctgacatggatcaatgtccaaaatttttatccaaattgttataaatacacatgaga

SEQ ID NO: 6122 - DNA, 601 bp, Human
aattagccgggcatggtggtgggcgcctgtaattgcagctactcaggaggctgaggcaggagaatggcttgaacccgggaggcggaggttgcagtgagccgagatcgtgccactgcactccagcctgggcgacagagcgaaactcagtctcaaaaaaaaaaagccgggggggctaccaaaagatgagagggacccaggcctgtattgcacatccacatcagtgacagtgtaatggtacgcagaccccctccccgcatgcacacgcattctgaaataagccaggcccagaaggacaaatackgcactcgtccactcacatgaggatctgtaatcaaacgcatgaaagcagatgacaccatagaggctgccagagctgggggagcgggaaatggggagttgctgttcaatgggtgtaaagttttagtgatgctggacgagtaagtactagaggtctgctgtacaacgttgtgcctgtagctgaccatgtggcactgtgcacttcgaaattctctgagaggtctgagctcacgttaagtgttctttccacaaaagcaaacaacaacagcaacagaaatgaagggacagaaggaaaccgtgggag

SEQ ID NO: 6123 - DNA, 601 bp, Human
tcaggcactctttcattttgtaaaacaatagggttatcaaggcctgcgcagtggctcatgcttctaatcccagcactttgggaggccgaggcaggcggattgcctgaggtcaggagttcgagaccaggctggccaacatggtgaaaccccatttctactaaaaatacaaaaattagccgggcatggtggtgggcgcctgtaattgcagctactcaggaggctgaggcaggagaatggcttgaacccgggaggcggaggttgcagtgagccgagatcgtgccactgcactccagcctgggcracagagcgaaactcagtctcaaaaaaaaaaagccgggggggctaccaaaagatgagagggacccaggcctgtattgcacatccacatcagtgacagtgtaatggtacgcagaccccctccccgcatgcacacgcattctgaaataagccaggcccagaaggacaaatacggcactcgtccactcacatgaggatctgtaatcaaacgcatgaaagcagatgacaccatagaggctgccagagctgggggagcgggaaatggggagttgctgttcaatgggtgtaaagttttagtgatgct

SEQ ID NO: 6124 - DNA, 601 bp, Human
aaacacacatcaaatacatacgcttgacgttatgcccgggagggctgtgcacacaggcacacagagacggtgagacttggggatacttgggtccagttactgtcaccttgggtctcacttctgggagcgtggatttggctggcaccactgcactgcggtgtgtctgcgtctatacagacttcctccatttcacgcatgtacctaaaacataccaccattcatgtactgtcaggcactctttcattttgtaaaacaatagggttatcaaggcctgcgcagtggctcatgcttctaatcccarcactttgggaggccgaggcaggcggattgcctgaggtcaggagttcgagaccaggctggccaacatggtgaaaccccatttctactaaaaatacaaaaattagccgggcatggtggtgggcgcctgtaattgcagctactcaggaggctgaggcaggagaatggcttgaacccgggaggcggaggttgcagtgagccgagatcgtgccactgcactccagcctgggcgacagagcgaaactcagtctcaaaaaaaaaaagccgggggggctaccaaaagatgagagggacccaggcctgt

SEQ ID NO: 6125 - DNA, 601 bp, Human
ggcttcctgagtgcctacctggccctgggcactcacagggcattgatgccgagatgctcagctgtgcagagggtgtgcaggtctggtggtcacttatgcgctccagggcctgcttctgctgatgccagggcaagacccagcctcaaacacacatcaaatacatacgcttgacgttatgcccgggagggctgtgcacacaggcacacagagacggtgagacttggggatacttgggtccagttactgtcaccttgggtctcacttctgggagcgtggatttggctggcaccactgcactgcrgtgtgtctgcgtctatacagacttcctccatttcacgcatgtacctaaaacataccaccattcatgtactgtcaggcactctttcattttgtaaaacaatagggttatcaaggcctgcgcagtggctcatgcttctaatcccagcactttgggaggccgaggcaggcggattgcctgaggtcaggagttcgagaccaggctggccaacatggtgaaaccccatttctactaaaaatacaaaaattagccgggcatggtggtgggcgcctgtaattgcagctactcaggaggctgaggcag

SEQ ID NO: 6126 - DNA, 601 bp, Human
cagggcgcatgcccctgtcagctggccggacaggcctctcttgccaaggcttaccctccttggttctaatttaattttgtgaccttttctctcgacatcctgaccccgtacatccctgcgccttggcacactgcaccaaagcaccatagaattactgagctataagcctctcatggaaatctgtttttgactttgttagaaaacactataatcaaatccctgagagtcaggagggatgggcttggcctgccagaggaaacatatcaccggattaagtgatttagcagaggtggtcccggcrggaggagggcagggcaggctgggcagggctgggcgtgaggtgggcaggcagggtgccctcgggggcaaggggggaggggatgcgcagaggcagaggatgggcaatgtgggattaccagaaagtgcggtctggacatcccagggcctgcaggcttcctgagtgcctacctggccctgggcactcacagggcattgatgccgagatgctcagctgtgcagagggtgtgcaggtctggtggtcacttatgcgctccagggcctgcttctgctgatgccagggcaagacccagcctcaaacaca

SEQ ID NO: 6127 - DNA, 601 bp, Human
cccaggcaggaaatgggccgcaggcagcatgaatgtttaattacgttaattgtccaagtccagcgcacatcatccctcctaagtaccttatgggaaatcgtaattaggcgtgaaatggctcattttcacaactcccctttctcggggttctccagggcgcatgcccctgtcagctggccggacaggcctctcttgccaaggcttaccctccttggttctaatttaattttgtgaccttttctctcgacatcctgaccccgtacatccctgcgccttggcacactgcaccaaagcaccatakaattactgagctataagcctctcatggaaatctgtttttgactttgttagaaaacactataatcaaatccctgagagtcaggagggatgggcttggcctgccagaggaaacatatcaccggattaagtgatttagcagaggtggtcccggcgggaggagggcagggcaggctgggcagggctgggcgtgaggtgggcaggcagggtgccctcgggggcaaggggggaggggatgcgcagaggcagaggatgggcaatgtgggattaccagaaagtgcggtctggacatcccagggcctgc

SEQ ID NO: 6128 - DNA, 601 bp, Human
tcaggcacctccagctgtgcacctcggtcaggccaccctctctccgtcagaccctcagtgtcctgatcagtgtccacaagtaagacacatagaaaacctgaggcccagagaagccaaggaagtccttacaggcttctgtcagagaatcggaggaaaggaggggacgccagagaatctgggcttaagtgacttggccgtgatcaaaacacaggcagagtcacaaacacgagaccccgctgcccactcccgacggagaggtaattccacaaacacgagaccctgctgcccactccacaaacaygagaccccgctgcccactcccgacggagaggtaattccacaaacacgagaccccgctgcccactcccgacggagaggtaattccacaaacacgagaccccgctgcccactccacaaacatgagaccccgctgcccattcccgacggagaggtaattccaggtcagtggcatccagccttccccggcccccaggcccccagctgccaccaagaaacactctttgtaggggtcctgccccactggggtgcagaggtacatcccccaaggcccagccccgcaggaagcccttcctctgcagcc

SEQ ID NO: 6129 - DNA, 601 bp, Human
cctccagctgtgcacctcggtcaggcacctccagctgtgcacctcggtcaggccaccctctctccgtcagaccctcagtgtcctgatcagtgtccacaagtaagacacatagaaaacctgaggcccagagaagccaaggaagtccttacaggcttctgtcagagaatcggaggaaaggaggggacgccagagaatctgggcttaagtgacttggccgtgatcaaaacacaggcagagtcacaaacacgagaccccgctgcccactcccgacggagaggtaattccacaaacacgagacccygctgcccactccacaaacacgagaccccgctgcccactcccgacggagaggtaattccacaaacacgagaccccgctgcccactcccgacggagaggtaattccacaaacacgagaccccgctgcccactccacaaacatgagaccccgctgcccattcccgacggagaggtaattccaggtcagtggcatccagccttccccggcccccaggcccccagctgccaccaagaaacactctttgtaggggtcctgccccactggggtgcagaggtacatcccccaaggcccagccccgcag

SEQ ID NO: 6130 - DNA, 601 bp, Human
cagacacccatgagacactcaggcaggagtggtctggagcacagagagagggtgggccggaggccccaggtgtgggcggcctccaggatgaatcagctgcagagcaccgcagtggcgcacacagatcagtgtcctgatctgaaaagtaggcataacgatgctggccacagcccacaagtaagacacatagaaaacctgaggcccacagaggtgacaggaacgggccaggtgcacggacagggctgttcctgactcagctcactccaccagaacccagtctgggcaccagcctgttttcttstcctctccagccagcagggcagaattgggggtggacttgccccagcctgaagacctccggggccctggctcctccctgctccacctgccatagcccaaaaccagtgtgggtgtgaagcggaaggagactccgcagcaaggcccagctcttatgccggccactgccttgcctcctgcctgatgcagtctctcggcagcaaggcaggtgccctgagacctggaggtgcccccagccccagaacccaccatgcgcggctgggccgactgtgcctgcccttaaggcaggcagaacactaaccaa

SEQ ID NO: 6131 - DNA, 601 bp, Human
gaggagccgcgtgggaggaggagaaggccgtgtggggcgtgttgggctgagatttctgtggggacacaaggacagacacccatgagacactcaggcaggagtggtctggagcacagagagagggtgggccggaggccccaggtgtgggcggcctccaggatgaatcagctgcagagcaccgcagtggcgcacacagatcagtgtcctgatctgaaaagtaggcataacgatgctggccacagcccacaagtaagacacatagaaaacctgaggcccacagaggtgacaggaacgggccagstgcacggacagggctgttcctgactcagctcactccaccagaacccagtctgggcaccagcctgttttcttctcctctccagccagcagggcagaattgggggtggacttgccccagcctgaagacctccggggccctggctcctccctgctccacctgccatagcccaaaaccagtgtgggtgtgaagcggaaggagactccgcagcaaggcccagctcttatgccggccactgccttgcctcctgcctgatgcagtctctcggcagcaaggcaggtgccctgagacctggaggtgccc

SEQ ID NO: 6132 - DNA, 601 bp, Human
caggactctcccagcagctcccccaggggtcaggggcagagggagcccccagcctggcctgctccctgacgactctacacttggcagctgaagggggccaccctgacagtcaaggcccagctgtgatctggggtggaactggtctggcaccgatctgcttggcctggctctgggtgctggcacggcagtatctggtgggctgcagggcccccagctggggccctttgagtgatgatgagcctgctgggctgggaccacagagtgagcaggaccagcatcccctcaaccccagatgccctcyaggactgcagggcccagacacagagagggaacctgacgctcatggggagggctgagaggcaggcagagggggaagggtgttcctgaccacggcccacaggaccagcagtgcagagggcctgggagtgagggaagcccctgctgtgccaaggagggagggccaggagaggagagatggccgaggccgggaggagggcagaagtgcagagagactagagggggcagggcagccctggcttggggctggagagggagccaggaaggagggtggaaggcaggggaggcagcgtgtggacaaaga

SEQ ID NO: 6133 - DNA, 601 bp, Human
gagcaggaggaatgggcaggtctggaggggctgctgtggacgacgtccaagacatgttccctgataatcgcaaatgcagggtagcacacggtgtagtctacagtgtgcaggaaaaagtcagaaaaacgaaaacacagtatctacaggacacaaaatcccttgagccagagattctaatcctaggatttatatatgtgtgtgtacacatatgtgtatatatatatacttgtgtgtgcacaggacatcctgaaaggacacagaagaaaggtgtgcagtggctgccctgcagaaaggagctgasttccaggacagccaatgggagggggatgaggacagcaatgagcatttcatatggctgcaatccttagtccagccaaaaagcaagccacgcacatgcaggagaggccaggactctcccagcagctcccccaggggtcaggggcagagggagcccccagcctggcctgctccctgacgactctacacttggcagctgaagggggccaccctgacagtcaaggcccagctgtgatctggggtggaactggtctggcaccgatctgcttggcctggctctgggtgctggcacggcagtatctgg

SEQ ID NO: 6134 - DNA, 601 bp, Human
gctgagagaaacggatccagccaaccatcctagggttgtggtcatccttatcaaagttgaaaatgcacaaaccttttgaatccacaattctagttatcaaatttaatcctacaaatgtcctcatacaagtagccaaggaaataagtgtaaggatatccacggctgcattataagaaacggtgaaaagaagtaacgtccccatcagtcaaggtctggttaagcaagtgattcacaggatggaatgcctgagcaggaggaatgggcaggtctggaggggctgctgtggacgacgtccaagacrtgttccctgataatcgcaaatgcagggtagcacacggtgtagtctacagtgtgcaggaaaaagtcagaaaaacgaaaacacagtatctacaggacacaaaatcccttgagccagagattctaatcctaggatttatatatgtgtgtgtacacatatgtgtatatatatatacttgtgtgtgcacaggacatcctgaaaggacacagaagaaaggtgtgcagtggctgccctgcagaaaggagctgacttccaggacagccaatgggagggggatgaggacagcaatgagcatttcatatg

SEQ ID NO: 6135 - DNA, 601 bp, Human
attacgggtatgagccaccgagcagcttttcagtgtatgagaagacgctcgacctcacccttaattaaagaaacaacctgcatcagattgtccaaataaaaatgtacggatcaggggtacatgctgagagaaacggatccagccaaccatcctagggttgtggtcatccttatcaaagttgaaaatgcacaaaccttttgaatccacaattctagttatcaaatttaatcctacaaatgtcctcatacaagtagccaaggaaataagtgtaaggatatccacggctgcattataagaaacrgtgaaaagaagtaacgtccccatcagtcaaggtctggttaagcaagtgattcacaggatggaatgcctgagcaggaggaatgggcaggtctggaggggctgctgtggacgacgtccaagacatgttccctgataatcgcaaatgcagggtagcacacggtgtagtctacagtgtgcaggaaaaagtcagaaaaacgaaaacacagtatctacaggacacaaaatcccttgagccagagattctaatcctaggatttatatatgtgtgtgtacacatatgtgtatatatatatacttgtgt

SEQ ID NO: 6136 - DNA, 601 bp, Human
ggcctcccacagtgttggtattacgggtatgagccaccgagcagcttttcagtgtatgagaagacgctcgacctcacccttaattaaagaaacaacctgcatcagattgtccaaataaaaatgtacggatcaggggtacatgctgagagaaacggatccagccaaccatcctagggttgtggtcatccttatcaaagttgaaaatgcacaaaccttttgaatccacaattctagttatcaaatttaatcctacaaatgtcctcatacaagtagccaaggaaataagtgtaaggatatccasggctgcattataagaaacggtgaaaagaagtaacgtccccatcagtcaaggtctggttaagcaagtgattcacaggatggaatgcctgagcaggaggaatgggcaggtctggaggggctgctgtggacgacgtccaagacatgttccctgataatcgcaaatgcagggtagcacacggtgtagtctacagtgtgcaggaaaaagtcagaaaaacgaaaacacagtatctacaggacacaaaatcccttgagccagagattctaatcctaggatttatatatgtgtgtgtacacatatgtg

SEQ ID NO: 6137 - DNA, 601 bp, Human
acagagtctctgtcacccaggctggagtacagtggcgtgatctcagctcactgcaaccaccgcctcccggattcaagcagttttcctgcctcagccttccaagcagctgggattacaggtgcctgctatcatacctggttaattttttttttttttgtatgtttagtagagacaggatttcaccatgttagccaggctggtttcaaactcctgacctcaggtgatccatccaccctggcctcccacagtgttggtattacgggtatgagccaccgagcagcttttcagtgtatgagaagaygctcgacctcacccttaattaaagaaacaacctgcatcagattgtccaaataaaaatgtacggatcaggggtacatgctgagagaaacggatccagccaaccatcctagggttgtggtcatccttatcaaagttgaaaatgcacaaaccttttgaatccacaattctagttatcaaatttaatcctacaaatgtcctcatacaagtagccaaggaaataagtgtaaggatatccacggctgcattataagaaacggtgaaaagaagtaacgtccccatcagtcaaggtctggttaagcaa

SEQ ID NO: 6138 - DNA, 601 bp, Human
cccgtctgtattctcccccagaggtttgagcagagggacactgaagaaggaagccacacccccatagcacgccctgcgaggaggacaagagaacttctctcatttcaatatgaggggacaattgtcagaaaagaaaagacagcagcttttcttttcttctttatctctttctttctttcccttccttctttccttccttccttcctttctttctttcttctctttcttctttccttctttcttttttttttttgagacagagtctctgtcacccaggctggagtacagtggcgtgatctcrgctcactgcaaccaccgcctcccggattcaagcagttttcctgcctcagccttccaagcagctgggattacaggtgcctgctatcatacctggttaattttttttttttttgtatgtttagtagagacaggatttcaccatgttagccaggctggtttcaaactcctgacctcaggtgatccatccaccctggcctcccacagtgttggtattacgggtatgagccaccgagcagcttttcagtgtatgagaagacgctcgacctcacccttaattaaagaaacaacctgcatcagattg

SEQ ID NO: 6139 - DNA, 601 bp, Human
aaacattcacccctagacactgctgtggggtcggagccccacagcctgcccgtctgtattctcccccagaggtttgagcagagggacactgaagaaggaagccacacccccatagcacgccctgcgaggaggacaagagaacttctctcatttcaatatgaggggacaattgtcagaaaagaaaagacagcagcttttcttttcttctttatctctttctttctttcccttccttctttccttccttccttcctttctttctttcttctctttcttctttccttctttcttttttttttttgagacagagtctctgtcacccaggctggagtacagtggcgtgatctcagctcactgcaaccaccgcctcccggattcaagcagttttcctgcctcagccttccaagcagctgggattacaggtgcctgctatcatacctggttaattttttttttttttgtatgtttagtagagacaggatttcaccatgttagccaggctggtttcaaactcctgacctcaggtgatccatccaccctggcctcccacagtgttggtattacgggtatgagccaccgagcagcttttcagtgtatgaga

SEQ ID NO: 6140 - DNA, 601 bp, Human
ccgaccggcagaagcagaacgacacggagtttggccggggcagtcagaggagagcccaggctgcttagcggcccgactccagggaaagccctttgcaccccatcctccttctggcttcccccatctgctgagagctacttccactcaataaaacctcgcactcattctccaagcccacgtgtgatctgattcttccaggacatcaaggaagaacccgagatacagaaagccctctgtccttgcgacaaggtagagggtctaactgagctggttaacacaagccgcctacagacagctaaastaaaagagcacatgcagcacacgcccactggggcttcaggggctgcaaacattcacccctagacactgctgtggggtcggagccccacagcctgcccgtctgtattctcccccagaggtttgagcagagggacactgaagaaggaagccacacccccatagcacgccctgcgaggaggacaagagaacttctctcatttcaatatgaggggacaattgtcagaaaagaaaagacagcagcttttcttttcttctttatctctttctttctttcccttccttctttccttccttccttcct

SEQ ID NO: 6141 - DNA, 601 bp, Human
cttggagcatgcggccctcttggcttgtcttttgcttattccctcttcactgagaaatattttgctcccatgagaaaagccatgtgggcagggggatgagagggcacactgcctccagcccaaggtggccagtggtgactaggagggtgcaggtccatgttgctgggtcttatttttgtaaggaagtgagaaatctggatttgcatgtgaagtctctgatctctaaatactggcaaaaagcaatttaagaataatgtaggtgctgtgctgcttgtgaaatgaaccaaagctgggtccccasgtctgtctgccacctcagctccacgcccagaccaaagctgtgtcctcaggtctgtctgccacctcggctccacgccctgagcaaccgtttccctgtatcctcctccgtctggcctggagaggttttgagcacagtaggttctggccaaccagagtgagtccacctgcctctgcctcacagtggctgaagcttcccgggccgcagttcacgccccacttgtttctccacatccctttcccaccttgaaggacagctcctgatggatgtgttttatggtggaatcctcacgcaggggcctga

SEQ ID NO: 6142 - DNA, 601 bp, Human
ccggcacatcctgacatccgtaggcgccatcctgacaacacgctgccggccgcaggcctcacaccacagcaattctcactcgggcctccctgaccctcgacctgtgggtccctgctaggctgggcgtgtttcccgatgccccatctctctgacctagacatattttgttcacatgttgaacagagagaaacggtccgcatttccagaaagaaatatactctcccaattttccttggagcatgcggccctcttggcttgtcttttgcttattccctcttcactgagaaatattttgctcccrtgagaaaagccatgtgggcagggggatgagagggcacactgcctccagcccaaggtggccagtggtgactaggagggtgcaggtccatgttgctgggtcttatttttgtaaggaagtgagaaatctggatttgcatgtgaagtctctgatctctaaatactggcaaaaagcaatttaagaataatgtaggtgctgtgctgcttgtgaaatgaaccaaagctgggtccccaggtctgtctgccacctcagctccacgcccagaccaaagctgtgtcctcaggtctgtctgccacctcggct

SEQ ID NO: 6143 - DNA, 601 bp, Human
tggataaatggaaaacttagttatccttatgctacttctgagcaggtggagacaggacagggtaggacgaggcgcagcgtggatgcgggcggattgtctgtatctccttggtgggagcagttggccgtggagtctacatcggtttccttcctggccgtcatttacagggagagcatgagggcggcgtgaggtcagcggggcaggtggatgctgtgcgcttactgcagccatgcggtgggtgcacgctaccaccgtcttctcctctttttcttgggagctgtcgccatggctcccggcacaycctgacatccgtaggcgccatcctgacaacacgctgccggccgcaggcctcacaccacagcaattctcactcgggcctccctgaccctcgacctgtgggtccctgctaggctgggcgtgtttcccgatgccccatctctctgacctagacatattttgttcacatgttgaacagagagaaacggtccgcatttccagaaagaaatatactctcccaattttccttggagcatgcggccctcttggcttgtcttttgcttattccctcttcactgagaaatattttgctcccatgagaaaa

SEQ ID NO: 6144 - DNA, 601 bp, Human
ttgtcttcctgtgtgaactccgtgggtccagaagcctgagtttgggggtggtgacaattggccctggtggaccccacacactcctgtcccatgatgcttcctgccctagaatatcccagctgcagttgaggagggaaggggctcctcatactccccacacagcacccagaccacggtgttgacaaggcttaatttgatcagccctatttcgagaagggaggaaatcagaaatcagagtgagtgctgagtcctgaaaatttaatccccaaggcagcctcacagggcctttcctccccaaccrgggcaggtggcagggatgcactacaagcccagatcccagggccaccctgagaaccaggaggggagggagggccaccctgcctgcagagaggatggcaaaggccctgcttgccgggccccagctgccctcaacactgcaagggctcagaagactggaccagcagctggccgggcagaaactatagaaatcatcctaattctactttaaaaggctggggtttcctcttcttgcttaaaagctggtgtgacccttccaggtagcagccagcggcaggcctgtggctcactgagatgggctggg

SEQ ID NO: 6145 - DNA, 601 bp, Human
acgggtaaatcccaaggtgcagactcagagacagcaccgagaggcccccagtgcagccgccactctgagcccagaggccaggccatccaaccctgcagggacgggggttcctcccatttgtcttcctgtgtgaactccgtgggtccagaagcctgagtttgggggtggtgacaattggccctggtggaccccacacactcctgtcccatgatgcttcctgccctagaatatcccagctgcagttgaggagggaaggggctcctcatactccccacacagcacccagaccacggtgttgacraggcttaatttgatcagccctatttcgagaagggaggaaatcagaaatcagagtgagtgctgagtcctgaaaatttaatccccaaggcagcctcacagggcctttcctccccaaccagggcaggtggcagggatgcactacaagcccagatcccagggccaccctgagaaccaggaggggagggagggccaccctgcctgcagagaggatggcaaaggccctgcttgccgggccccagctgccctcaacactgcaagggctcagaagactggaccagcagctggccgggcagaaactata

SEQ ID NO: 6146 - DNA, 601 bp, Human
ttcctagctgattgtgggacctggggcagccctgcacggtgggccacactgtgccaccaagctgccttcctaggaggaagagttcctcagatgcccaggcaccagggacttcacacacctcctgtttcttcttcatggtagccggtggagtgggcacgggacctctcttacgcaaatgagggaacaagccctgggcccaggcaacaggcacccctgcgtgaccccagcatctggctctgtcccccgcatcccgagcttccaatggcccatggtggtgattgcacctggtccagcagccaaragggagctgaaagtaccagggccctggcccagctgaggaccttgctgccatcacccaccatgacccttgggcacaaagaccccccactttcagtcgtggcaccaagcacagtccatgtctgaccaggacctgctcaaggagcaggagtgaccgaggacaaccccggggaccaccccagccctcccccatgctgggggtggaagggtggtgaggcctggggcctcttgatgctcccatgccctgatgtcccatcctccaggacgctcccatgcccctgcgcctcctgagggggcagggaaa

SEQ ID NO: 6147 - DNA, 601 bp, Human
aagcgggaggtctcagatgctgcccgaccctgtgcaaatgaggccctctcctacccggccatgagccacgtgcagggactcagcacctgcctctgctccctcctccttcctgacccctctaggtcaggagtccaggcacacagcagtgctggggtgctgcagccaagcacaggctcttcctagctgattgtgggacctggggcagccctgcacggtgggccacactgtgccaccaagctgccttcctaggaggaagagttcctcagatgcccaggcaccagggacttcacacacctcctgyttcttcttcatggtagccggtggagtgggcacgggacctctcttacgcaaatgagggaacaagccctgggcccaggcaacaggcacccctgcgtgaccccagcatctggctctgtcccccgcatcccgagcttccaatggcccatggtggtgattgcacctggtccagcagccaagagggagctgaaagtaccagggccctggcccagctgaggaccttgctgccatcacccaccatgacccttgggcacaaagaccccccactttcagtcgtggcaccaagcacagtccatgtctgacc

SEQ ID NO: 6148 - DNA, 601 bp, Human
cacaacttccccttcgtccccccagcacccgccgaactaccgaggctcctctgcacctgccccgtgccactctccagcggcctctgcagcccactcacctccaaggattcacgggggtctcggggccttcagaggctggggcgggtgacaagagccagcaagccctgcccctgcctagcatctgcttaagccagggagggtccccaggactcaccacagcccccagggctccaagccttccctctgctgggcagttggcccagggaaggggagctggcctgggtaatgtcacgggggcacygcagcacgcggcagccaagtggtgggggccgatggagaggccggcaggtcttttattgaaaatattcactgtgaacttcagaacaaaacgaagatccccacgggtcccaaaggaagggagaattcccaggggttgtgttctgaacgcagaggaggtgggggccggcaagtggggtgctgacagccagtgccacgggacccatgtggccggaggcttggccagtggctcagcagatgacaggcggaaaatccctgtcaccagtctggtacatgctccagagcccctgatttggacatcatc

SEQ ID NO: 6149 - DNA, 601 bp, Human
gcggacagatggacgctccagcccaggcctgctcagcctcagccgtgcttcagggagaaaaaggaagcactaaaggagagaaggcctctccgggccagtcctcagaacatacccccgcacagcagaggacaaaggacacccctcagtggtggacacagaaggtcctggcctgcccagcacctgcacaccctcacagagccacctggggttgcacagcacggtggcctgccctgtctggccattacaccttttctgctagtaaaccaccctcccctatttgcaccccatatggctcatgggsagccaatcccactgcaccccagctccaggagtgcccaaggggtcctgttaggccactggaacctgatgctgtgtgttggtgtgcacaggaagactcccgtgctttcctctctgctgggaaaatgtgactctgggactgctaagtacctccttcccccaggagcagcagaggcgagagatgagggcagccccgtgtgctgctgacactgttcaggtccccaaatccagctatggctgaaggtgatgcacccctggacatcctaattcttcaggtcaattcatttagctctctgtctcttgc

SEQ ID NO: 6150 - DNA, 601 bp, Human
tgtactttattaaaagatgctcattaggattattacatcccagccctttataactttattactgactttgaattaatttttgcaacttcaacagacacagctcatccaatgccatttttatgacctgaggtggatcggagggtggggaggggctcctggggccggcctggccatcaggagcgcatcaggaaccgctgtgccgaatctcaggggcagtcctgacagttctctaaactcccacgggatgggctgccccgcggacagatggacgctccagcccaggcctgctcagcctcagccrtgcttcagggagaaaaaggaagcactaaaggagagaaggcctctccgggccagtcctcagaacatacccccgcacagcagaggacaaaggacacccctcagtggtggacacagaaggtcctggcctgcccagcacctgcacaccctcacagagccacctggggttgcacagcacggtggcctgccctgtctggccattacaccttttctgctagtaaaccaccctcccctatttgcaccccatatggctcatggggagccaatcccactgcaccccagctccaggagtgcccaaggggtc

SEQ ID NO: 6151 - DNA, 601 bp, Human
ctctgggaagcagaaggcaggctcagccccacgggggccatcagcacagagccccactggtgtactttattaaaagatgctcattaggattattacatcccagccctttataactttattactgactttgaattaatttttgcaacttcaacagacacagctcatccaatgccatttttatgacctgaggtggatcggagggtggggaggggctcctggggccggcctggccatcaggagcgcatcaggaaccgctgtgccgaatctcaggggcagtcctgacagttctctaaactcccaygggatgggctgccccgcggacagatggacgctccagcccaggcctgctcagcctcagccgtgcttcagggagaaaaaggaagcactaaaggagagaaggcctctccgggccagtcctcagaacatacccccgcacagcagaggacaaaggacacccctcagtggtggacacagaaggtcctggcctgcccagcacctgcacaccctcacagagccacctggggttgcacagcacggtggcctgccctgtctggccattacaccttttctgctagtaaaccaccctcccctatttgcaccc

SEQ ID NO: 6152 - DNA, 601 bp, Human
tccagtgcttaggagtccccaaaacgtaagtcctaatgaccgccctgcagagccagaactgccacactgcccagaagaggagagggaggctcagggaattagactaaggccatgatgttggcaaatggccaggccagaatgccagcccagttcctgcacacaagcactgccagggcctgcaggggccaccaccaggctcaggaggaccaaagcctggagcaccagcagcctctcctccaacatgaggagccccacccaggggaggtcaacgggaacaaggtcatcccctccatttcttacyaaccaagagagagtcgctctgtggctgtgtattcccctaaagataatcattaagatgaaatatgtttatgtggaagtgtaatcaggacacagcagaaagccctgcttggaagcaggcaggctctttggaggctctgggaagcagaaggcaggctcagccccacgggggccatcagcacagagccccactggtgtactttattaaaagatgctcattaggattattacatcccagccctttataactttattactgactttgaattaatttttgcaacttcaacagacacagctcatccaa

SEQ ID NO: 6153 - DNA, 601 bp, Human
ggcctgagggcagacggcacactcactgaggcacctgcacacagacagaggtgctgtgctactgcctcaacctgccaaccatgtggatgggaacaagtcatcctttttccagtgcttaggagtccccaaaacgtaagtcctaatgaccgccctgcagagccagaactgccacactgcccagaagaggagagggaggctcagggaattagactaaggccatgatgttggcaaatggccaggccagaatgccagcccagttcctgcacacaagcactgccagggcctgcaggggccaccaccrggctcaggaggaccaaagcctggagcaccagcagcctctcctccaacatgaggagccccacccaggggaggtcaacgggaacaaggtcatcccctccatttcttactaaccaagagagagtcgctctgtggctgtgtattcccctaaagataatcattaagatgaaatatgtttatgtggaagtgtaatcaggacacagcagaaagccctgcttggaagcaggcaggctctttggaggctctgggaagcagaaggcaggctcagccccacgggggccatcagcacagagccccactggtg

SEQ ID NO: 6154 - DNA, 601 bp, Human
actcactaggggatggcgcaagggggggatgggcacactcactaggggatggcctgagggcagacaggcacactcactaggtaggggatggcctgagggcagacggcacactcactaggtaggggatggcctgagggcagacggcacactcactgaggcacctgcacacagacagaggtgctgtgctactgcctcaacctgccaaccatgtggatgggaacaagtcatcctttttccagtgcttaggagtccccaaaacgtaagtcctaatgaccgccctgcagagccagaactgccacastgcccagaagaggagagggaggctcagggaattagactaaggccatgatgttggcaaatggccaggccagaatgccagcccagttcctgcacacaagcactgccagggcctgcaggggccaccaccaggctcaggaggaccaaagcctggagcaccagcagcctctcctccaacatgaggagccccacccaggggaggtcaacgggaacaaggtcatcccctccatttcttactaaccaagagagagtcgctctgtggctgtgtattcccctaaagataatcattaagatgaaatatgtt

SEQ ID NO: 6155 - DNA, 601 bp, Human
ggtgtgaggggggatgggcacactcactaggggatggcgcaagggggggatgggcacactcactaggggatggcctgagggcagacaggcacactcactaggtaggggatggcctgagggcagacggcacactcactaggtaggggatggcctgagggcagacggcacactcactgaggcacctgcacacagacagaggtgctgtgctactgcctcaacctgccaaccatgtggatgggaacaagtcatcctttttccagtgcttaggagtccccaaaacgtaagtcctaatgaccgcccygcagagccagaactgccacactgcccagaagaggagagggaggctcagggaattagactaaggccatgatgttggcaaatggccaggccagaatgccagcccagttcctgcacacaagcactgccagggcctgcaggggccaccaccaggctcaggaggaccaaagcctggagcaccagcagcctctcctccaacatgaggagccccacccaggggaggtcaacgggaacaaggtcatcccctccatttcttactaaccaagagagagtcgctctgtggctgtgtattcccctaaagata

SEQ ID NO: 6156 - DNA, 601 bp, Human
actgagacacattaggacacaactcaaaaatcgtgcccacagtcaccattactgagacacattaggacacaactcaaaagccgtgcccacaatcaccattactgagacaaaatcagagataacaataaaaccctaaaccctaaacatctgaaattaaaagcaccattctaataggcctagactaaatagaaaatatacattccactcatggctcaagtagaaaacctgaagaaaccaataacctcagaagaaattgaaagagcagtcaaagaaatgcttccatagaagagtttaaccaaayccacaaggaacagatactcctcatctcacataaaataatgcaaagatcaagacttcttgaacataggaataacccgcaagaaagcagagtggaaaaaagagcttatcagctataacagcaaaactcccaagtatctaagaacaaacaaaaactaatgaatgttcaacgactacacaaaaagtagtataatatagtctaaggtctccaaaaacacaaaagaagacctcagtaaatgaagctacatggacataatcctggactggaagttggtcctcctccaaatgaatcaagaaatttggc

SEQ ID NO: 6157 - DNA, 601 bp, Human
gagacacattaggacacaactcaaaaatcgtgctcacagtcaccattactgagacacattaggacacaactcaaaaatcgtgcccacagtcaccattactgagacacattaggacacaactcaaaagccgtgcccacaatcaccattactgagacaaaatcagagataacaataaaaccctaaaccctaaacatctgaaattaaaagcaccattctaataggcctagactaaatagaaaatatacattccactcatggctcaagtagaaaacctgaagaaaccaataacctcagaagaaaytgaaagagcagtcaaagaaatgcttccatagaagagtttaaccaaatccacaaggaacagatactcctcatctcacataaaataatgcaaagatcaagacttcttgaacataggaataacccgcaagaaagcagagtggaaaaaagagcttatcagctataacagcaaaactcccaagtatctaagaacaaacaaaaactaatgaatgttcaacgactacacaaaaagtagtataatatagtctaaggtctccaaaaacacaaaagaagacctcagtaaatgaagctacatggacataat

SEQ ID NO: 6158 - DNA, 601 bp, Human
ctcaaaaactcaaaagccgtgcccacagtcaccattactgagacacattaggacacaactcaaaagccgtgcccacagtcaccattactgagacacattaggacacaactcaaaaatcgtgctcacagtcaccattactgagacacattaggacacaactcaaaaatcgtgcccacagtcaccattactgagacacattaggacacaactcaaaagccgtgcccacaatcaccattactgagacaaaatcagagataacaataaaaccctaaaccctaaacatctgaaattaaaagcaccrttctaataggcctagactaaatagaaaatatacattccactcatggctcaagtagaaaacctgaagaaaccaataacctcagaagaaattgaaagagcagtcaaagaaatgcttccatagaagagtttaaccaaatccacaaggaacagatactcctcatctcacataaaataatgcaaagatcaagacttcttgaacataggaataacccgcaagaaagcagagtggaaaaaagagcttatcagctataacagcaaaactcccaagtatctaagaacaaacaaaaactaatgaatgttc

SEQ ID NO: 6159 - DNA, 601 bp, Human
acaaggccacagtgataggagcactgtaatacatttattccagacaagtctgatacagcattaggtagggatagaaactatttgaattaataggaaaacctaacgttcaaacccaacagccagaacacgtgaccttgtcaagcacacacgggagaagttccacattttaccacattaggacacaactcaaaaactcaaaagccgtgcccacagtcaccattactgagacacattaggacacaactcaaaagccgtgcccacagtcaccattactgagacacattaggacacaactcaaaaatcgtgctcacagtcaccattactgagacacattaggacacaactcaaaaatcgtgcccacagtcaccattactgagacacattaggacacaactcaaaagccgtgcccacaatcaccattactgagacaaaatcagagataacaataaaaccctaaaccctaaacatctgaaattaaaagcaccattctaataggcctagactaaatagaaaatatacattccactcatggctcaagtagaaaacctgaagaaaccaataacctcagaagaaattgaaagagcagtcaaagaaatgcttc

SEQ ID NO: 6160 - DNA, 601 bp, Human
ttaaaacaagtggggcaaagaaacgtaccatgtaattgccaaccaaggcatttaaggagataaactgataaaacaaacaactcatggaaaaaaatacaaaagatacgaaactttatgctcctaaagcttcaacctggtgcaaggaaggagagacaaggccacagtgataggagcactgtaatacatttattccagacaagtctgatacagcattaggtagggatagaaactatttgaattaataggaaaacctaacgttcaaacccaacagccagaacacgtgaccttgtcaagcacacaygggagaagttccacattttaccacattaggacacaactcaaaaactcaaaagccgtgcccacagtcaccattactgagacacattaggacacaactcaaaagccgtgcccacagtcaccattactgagacacattaggacacaactcaaaaatcgtgctcacagtcaccattactgagacacattaggacacaactcaaaaatcgtgcccacagtcaccattactgagacacattaggacacaactcaaaagccgtgcccacaatcaccattactgagacaaaatcagagataacaataa

SEQ ID NO: 6161 - DNA, 601 bp, Human
aattacttgcatatggcataaccaagtccaaatgaccaggaggagttaaaacaagtggggcaaagaaacgtaccatgtaattgccaaccaaggcatttaaggagataaactgataaaacaaacaactcatggaaaaaaatacaaaagatacgaaactttatgctcctaaagcttcaacctggtgcaaggaaggagagacaaggccacagtgataggagcactgtaatacatttattccagacaagtctgatacagcattaggtagggatagaaactatttgaattaataggaaaacctaaygttcaaacccaacagccagaacacgtgaccttgtcaagcacacacgggagaagttccacattttaccacattaggacacaactcaaaaactcaaaagccgtgcccacagtcaccattactgagacacattaggacacaactcaaaagccgtgcccacagtcaccattactgagacacattaggacacaactcaaaaatcgtgctcacagtcaccattactgagacacattaggacacaactcaaaaatcgtgcccacagtcaccattactgagacacattaggacacaactcaaaagccg

SEQ ID NO: 6162 - DNA, 601 bp, Human
cccctcgccaaggtggaggcgtgtcaccatcagcatatcgtcctatttcagcatcagggaaacaaaccaaggagcaggaaaattacatgacttggacaagccacaccaccagagaggaggagtgggcacgcgcccaggcctctgagtccaacgttgtccacatgcccggagcccttctgtacttcaccagcactgaggggtgatttgcgagaatgagaattgtagaaacaagtatgattagactagagaagagaaaacctgggactgagtctgcaacctcgggagcatcgtgggatggtgygggctctgagggtgggtacagtgggcaggtgtgggctctgtgggcaggtgcagtgggcaggcacaggctctgtgggcaggtgtgggctctgaaggcaggtgcagtgggcaggcgtgggccctgagggtgggttcagtgggcacgtgtgggccctgagggcgggtgcagtgggcaggcacgggctttgtgggcaggtgtgggctccgaaggcaggtgcagtgagcaggcgtgggtcctgagggcaggtgcagtgggcaggcgtgggccctgagggtgggttcagtgggcaggtgtgggccc

SEQ ID NO: 6163 - DNA, 601 bp, Human
agctccatacccccagcagccatccaatcccctcgccaaggtggaggcgtgtcaccatcagcatatcgtcctatttcagcatcagggaaacaaaccaaggagcaggaaaattacatgacttggacaagccacaccaccagagaggaggagtgggcacgcgcccaggcctctgagtccaacgttgtccacatgcccggagcccttctgtacttcaccagcactgaggggtgatttgcgagaatgagaattgtagaaacaagtatgattagactagagaagagaaaacctgggactgagtctrcaacctcgggagcatcgtgggatggtgcgggctctgagggtgggtacagtgggcaggtgtgggctctgtgggcaggtgcagtgggcaggcacaggctctgtgggcaggtgtgggctctgaaggcaggtgcagtgggcaggcgtgggccctgagggtgggttcagtgggcacgtgtgggccctgagggcgggtgcagtgggcaggcacgggctttgtgggcaggtgtgggctccgaaggcaggtgcagtgagcaggcgtgggtcctgagggcaggtgcagtgggcaggcgtgggccctgag

SEQ ID NO: 6164 - DNA, 601 bp, Human
ccagcatcctaggcacaccccgagtctccaggcaggggtgtgtgcacagcccttcacagtggcagctccatacccccagcagccatccaatcccctcgccaaggtggaggcgtgtcaccatcagcatatcgtcctatttcagcatcagggaaacaaaccaaggagcaggaaaattacatgacttggacaagccacaccaccagagaggaggagtgggcacgcgcccaggcctctgagtccaacgttgtccacatgcccggagcccttctgtacttcaccagcactgaggggtgatttgcgrgaatgagaattgtagaaacaagtatgattagactagagaagagaaaacctgggactgagtctgcaacctcgggagcatcgtgggatggtgcgggctctgagggtgggtacagtgggcaggtgtgggctctgtgggcaggtgcagtgggcaggcacaggctctgtgggcaggtgtgggctctgaaggcaggtgcagtgggcaggcgtgggccctgagggtgggttcagtgggcacgtgtgggccctgagggcgggtgcagtgggcaggcacgggctttgtgggcaggtgtgggctccgaag

SEQ ID NO: 6165 - DNA, 601 bp, Human
ccacagtgccacagtgcacagggcacgtgggcaagggctgcaactgccagcatcctaggcacaccccgagtctccaggcaggggtgtgtgcacagcccttcacagtggcagctccatacccccagcagccatccaatcccctcgccaaggtggaggcgtgtcaccatcagcatatcgtcctatttcagcatcagggaaacaaaccaaggagcaggaaaattacatgacttggacaagccacaccaccagagaggaggagtgggcacgcgcccaggcctctgagtccaacgttgtccacatrcccggagcccttctgtacttcaccagcactgaggggtgatttgcgagaatgagaattgtagaaacaagtatgattagactagagaagagaaaacctgggactgagtctgcaacctcgggagcatcgtgggatggtgcgggctctgagggtgggtacagtgggcaggtgtgggctctgtgggcaggtgcagtgggcaggcacaggctctgtgggcaggtgtgggctctgaaggcaggtgcagtgggcaggcgtgggccctgagggtgggttcagtgggcacgtgtgggccctgagggcggg

SEQ ID NO: 6166 - DNA, 601 bp, Human
aggggaggcagcagttctgtccagggaattccatcaggggaacgggtgggtcacagtagccacgggctcatccacagtgccacagtgcacagggcacgtgggcaagggctgcaactgccagcatcctaggcacaccccgagtctccaggcaggggtgtgtgcacagcccttcacagtggcagctccatacccccagcagccatccaatcccctcgccaaggtggaggcgtgtcaccatcagcatatcgtcctatttcagcatcagggaaacaaaccaaggagcaggaaaattacatgactyggacaagccacaccaccagagaggaggagtgggcacgcgcccaggcctctgagtccaacgttgtccacatgcccggagcccttctgtacttcaccagcactgaggggtgatttgcgagaatgagaattgtagaaacaagtatgattagactagagaagagaaaacctgggactgagtctgcaacctcgggagcatcgtgggatggtgcgggctctgagggtgggtacagtgggcaggtgtgggctctgtgggcaggtgcagtgggcaggcacaggctctgtgggcaggtgtgggctctga

SEQ ID NO: 6167 - DNA, 601 bp, Human
tggtgctcaggctggacaggacaaggggagaagccctaagagcagggggatctgcaatgccctcagacctggggcaacaggagctctggcccagcccccctcctgtcctcctctgtcccaacaagacccggcagtcaggctgaagccccagcttgtcaatcacgagtgccacctcagttttccccacaataagattgaccctgaccctgtcaatcacgagtgccacctcagtttttcccacattgggcttaacccaggccatgaagagactctgaccacatgctggcccttgcagacctgytccccaaatagagccttgctatagggagctctggccagtgggcctggcgtggtcctgagtcgtcttcctagtgatccctttgaagtcaaccttggccttgggcctgcccacctgcactggttgcctacctggtctaacagcccctgttccacttggtccctccaaggcagaagagggctatttgctgctctcccctcctcccctgggagctccctgtgtagcccagccctgctgagctgtggtgactgggagctcacacagcctctgctgtatccctcggcactcaccccgcctggatga

SEQ ID NO: 6168 - DNA, 601 bp, Human
ccaacgaacagagacagctcaccttcagaatcaccttgggaaggagagtgatggcaatttccataggaaaactcttcctccctggggaacaggccgggcgttaccctctgcccttgtcaaactaggggtcacacacgggcggtgccctcggcaaaaccagaccacagaggcactcgttgaggtcacgtggtgccatctggttgatagtatttgaaaactgggagatttcatgttttaaaaatctagaacatccagcttctcttgaggaattaagagatggggccaccccaggggtagccckggtctgtgaattgaggggccacacctggagacaaaacacacagggcttggctcaccaggccacctgcctgccactgtcaatgtcattctggcaccagaaggtatcacagtatgtcctcctggccctaaccccagagtccccatgcagggacccctccagacattccccgtaggagggcatgggtgccgcatcgggacagagctgggctggggcacgtcttgaggctgcttctgccgagcaggcagagtttttaactaaactgtgtgttgcaagcccattaaaaacagcaaaggtttctaa

SEQ ID NO: 6169 - DNA, 601 bp, Human
ggcggtggccaggccccgaggcccctgcagctgagggagaccagcgtccctgctgcaccacctctctacaaagagtcttccagaacaacacttttcacccccaacgcctctctcctgctgcctcttccaggcagggacaggcactccctccctgtgagggtggcccaggacaggccctggaggcagaacaaggcccctgcaggcggcacggccactcggacagtgaggcagcctggtaccaggccctcatcccggcacacgcttcctcacccagtgctgacagcaggccactcggtggacrtggccatttccgttttacagatggggagacccatggcatcccagcatggccgactctcggccagaagctctctccttgcaccctgcagcctggctcagacaagacagactgaacatgaagtttcaggcacaaacctgcagcccggctgtgggcaagaccaagacagacagtggaggtgcgaggcggagggtgagggctgggaaagagaagaggagtaagtggggccagggctgagcagctgctggggttccagtaccttcgggggtccttgtgccacccccagctccacagttctgtgtc

SEQ ID NO: 6170 - DNA, 601 bp, Human
gtctgccttatggagcccagggctggcattcagccatggagaggtcgggaacctcagcccgcactgcctgacgctggagtgggcagagccacccttgcccgcactgcccgacgctggagtgggtagagcccttccacctcttctcccccgaagggctgccaggtgccaaaggactggtgtcccaggtgtcatcgccagctgttatgactggggaaaccgaggcccatcctgggctgtgcatgttccccagtgtctccttgggcccctcccagaactttctgctaagtcctccactgaagcraggccccacatctctgggccaggtcccgggccccctccccaggtgaacggtaccgcctctggcctgattgaattgtgcagagaccaagatgaacccctctgtggcagctccgctgcagtcggccctgggcaggcactgacctcctgcccccagggtgtgcccctggccacttggggctgccatcctggggagtctgccccggatatcgtccctgccttctgtgcagtgctgtctctgctgtgttctgtgtcctgcgggcctggagaccaccctggaccaggcttcagttcccagccctcc

SEQ ID NO: 6171 - DNA, 601 bp, Human
cagagacttgccaagctgtctcagacacagcagggcccagacaggcacctctgtgacttccaggaccgctcgttccccagcccctggtggcaaccccagccacagcaggggccacagtggcctccacacgatggatcagacctgctgagactgtgagagacccagcccagcatcaccgtctgccttatggagcccagggctggcattcagccatggagaggtcgggaacctcagcccgcactgcctgacgctggagtgggcagagccacccttgcccgcactgcccgacgctggagtgggyagagcccttccacctcttctcccccgaagggctgccaggtgccaaaggactggtgtcccaggtgtcatcgccagctgttatgactggggaaaccgaggcccatcctgggctgtgcatgttccccagtgtctccttgggcccctcccagaactttctgctaagtcctccactgaagcgaggccccacatctctgggccaggtcccgggccccctccccaggtgaacggtaccgcctctggcctgattgaattgtgcagagaccaagatgaacccctctgtggcagctccgctgcagtcggc

SEQ ID NO: 6172 - DNA, 601 bp, Human
tgcagaggaagatggcagagacttgccaagctgtctcagacacagcagggcccagacaggcacctctgtgacttccaggaccgctcgttccccagcccctggtggcaaccccagccacagcaggggccacagtggcctccacacgatggatcagacctgctgagactgtgagagacccagcccagcatcaccgtctgccttatggagcccagggctggcattcagccatggagaggtcgggaacctcagcccgcactgcctgacgctggagtgggcagagccacccttgcccgcactgccygacgctggagtgggtagagcccttccacctcttctcccccgaagggctgccaggtgccaaaggactggtgtcccaggtgtcatcgccagctgttatgactggggaaaccgaggcccatcctgggctgtgcatgttccccagtgtctccttgggcccctcccagaactttctgctaagtcctccactgaagcgaggccccacatctctgggccaggtcccgggccccctccccaggtgaacggtaccgcctctggcctgattgaattgtgcagagaccaagatgaacccctctgtggcagc

SEQ ID NO: 6173 - DNA, 601 bp, Human
aagcgaggtgcagaggaagatggcagagacttgccaagctgtctcagacacagcagggcccagacaggcacctctgtgacttccaggaccgctcgttccccagcccctggtggcaaccccagccacagcaggggccacagtggcctccacacgatggatcagacctgctgagactgtgagagacccagcccagcatcaccgtctgccttatggagcccagggctggcattcagccatggagaggtcgggaacctcagcccgcactgcctgacgctggagtgggcagagccacccttgcccrcactgcccgacgctggagtgggtagagcccttccacctcttctcccccgaagggctgccaggtgccaaaggactggtgtcccaggtgtcatcgccagctgttatgactggggaaaccgaggcccatcctgggctgtgcatgttccccagtgtctccttgggcccctcccagaactttctgctaagtcctccactgaagcgaggccccacatctctgggccaggtcccgggccccctccccaggtgaacggtaccgcctctggcctgattgaattgtgcagagaccaagatgaacccctct

SEQ ID NO: 6174 - DNA, 601 bp, Human; identical to SEQ ID NO: 3561

SEQ ID NO: 6175 - DNA, 601 bp, Human; identical to SEQ ID NO: 3562

SEQ ID NO: 6176 - DNA, 601 bp, Human
gaagctctgtcgcacagcagggctctggaaggtcaccctttctcagaagctcccacttgctcaatgcccctcctccccaagaccaccaaagggtccgacatagcttagatctgtcctcaggactctccgggcatgcagaggctctcagtgaggacgcagggcattcatcgtcagggcaatgccatgctccaggcacggccgcgccttatctccctcgcccacgctgcgctcttgcagtgggagctggggctcagatcagaggcagagaccccccgctgaccctccgccgccggtctcccaygccccgggactctctgccacgccccgccgcctctgcaggacacccccactgtgcccatgacaagcacactgtcaacacgtttgctgaatgaatcagtgctcacttctgtgcaacaggggacaacagacacggcccaaatactttctcaacttctgagacttgtctcctaaaacggtttctctgttgtgataaaactcatctcaatttaagaatttttaaatttctcatgcttttctagaaacgaaccttcccattattcaaaatagggggtacggctggatcactagggtttgaataaag

SEQ ID NO: 6177 - DNA, 601 bp, Human
ctgccctgttcagcacagcagctgccagccacactgcggcttccatccaggtgaaaattaatccaaacaaagtactcttcggggtggctaccgtaaaaaagaaaaaaaagacaagagttggtgacaatttggagagactagaatccctgtacactgttggtggggggcaaaatggcacagccactgtgggaaacagcgtggaaactcctcaaaaaattaaagaaagaattaccctgtgtcccgcaattctacttatgggcatatagtcaagagaacggaaaacagagtctggaacacccaygttcacggcagcactattcacagtagcccatgagggggccaccggagtgcccatggatggctggataaacaaaatgtggccgatccacccacacacgggatactggtcctccctgaaaaggaaggacattcttacacatgctgcaatgtggatggccccgaggatgtcatgctaagtgaaataagccagacacaaaaggacaattattgtttgatccacttatgcgaggtacccagagtagtcaaattctcagaaacagaaagtggagtggtgggtgccaggagtcggggggaggggagg

SEQ ID NO: 6178 - DNA, 601 bp, Human
ccctgccctgttcagcacagcagctgccagccacactgcggcttccatccaggtgaaaattaatccaaacaaagtactcttcggggtggctaccgtaaaaaagaaaaaaaagacaagagttggtgacaatttggagagactagaatccctgtacactgttggtggggggcaaaatggcacagccactgtgggaaacagcgtggaaactcctcaaaaaattaaagaaagaattaccctgtgtcccgcaattctacttatgggcatatagtcaagagaacggaaaacagagtctggaacacccacgttcacggcagcactattcacagtagcccatgagggggccaccggagtgcccatggatggctggataaacaaaatgtggccgatccacccacacacgggatactggtcctccctgaaaaggaaggacattcttacacatgctgcaatgtggatggccccgaggatgtcatgctaagtgaaataagccagacacaaaaggacaattattgtttgatccacttatgcgaggtacccagagtagtcaaattctcagaaacagaaagtggagtggtgggtgccaggagtcggggggagggga

SEQ ID NO: 6179 - DNA, 601 bp, Human
caaccctgccctgttcagcacagcagctgccagccacactgcggcttccatccaggtgaaaattaatccaaacaaagtactcttcggggtggctaccgtaaaaaagaaaaaaaagacaagagttggtgacaatttggagagactagaatccctgtacactgttggtggggggcaaaatggcacagccactgtgggaaacagcgtggaaactcctcaaaaaattaaagaaagaattaccctgtgtcccgcaattctacttatgggcatatagtcaagagaacggaaaacagagtctggaacacccacgttcacggcagcactattcacagtagcccatgagggggccaccggagtgcccatggatggctggataaacaaaatgtggccgatccacccacacacgggatactggtcctccctgaaaaggaaggacattcttacacatgctgcaatgtggatggccccgaggatgtcatgctaagtgaaataagccagacacaaaaggacaattattgtttgatccacttatgcgaggtacccagagtagtcaaattctcagaaacagaaagtggagtggtgggtgccaggagtcggggggagg

SEQ ID NO: 6180 - DNA, 601 bp, Human
cacgtctgtccttccatgcttttgctttcgctccagccacggggagccctgtgaccagctgggacttacaagaggagtgtgacaagccactggccaggccttagagggccacttggggttgtggttcgaggcccccatagcacccaagttcagagacagggcacggtaggcagatcctctgtgcacaggcccaaccctgccctgttcagcacagcagctgccagccacactgcggcttccatccaggtgaaaattaatccaaacaaagtactcttcggggtggctaccgtaaaaaagaaaraaaagacaagagttggtgacaatttggagagactagaatccctgtacactgttggtggggggcaaaatggcacagccactgtgggaaacagcgtggaaactcctcaaaaaattaaagaaagaattaccctgtgtcccgcaattctacttatgggcatatagtcaagagaacggaaaacagagtctggaacacccacgttcacggcagcactattcacagtagcccatgagggggccaccggagtgcccatggatggctggataaacaaaatgtggccgatccacccacacacgggatact

SEQ ID NO: 6181 - DNA, 601 bp, Human
ccctcccccaaacctggaacaggcgatccctatcctacctcttcccacatccttccgttgtcgtgagcctctgctcccgtgatatctccagtgcaccagcccctgagctgtagaaagtggcctgccttcccctacccttcttccttctccatctcctaactattttatttctttcattgcatttgtcattatttgaaatgatcctgtttgtttttcacttcagtatcgtctgtgcctcccttcccagaatgcaaggtagcagggttacgtcctgtcatgctcacagctgcaccccttgccwgacatataatagacgccccataaacaccggcccccgtatgaacggcagccaggggcaccagacagaggaggatggctatgccgagaatccaccccatctcagcagctgaacacaatacaccgcacaccgtgtttccttactcacaccatggcgcggggtgggtcgggagggcccgagcctatgttgcagctgtacctactgggacacatggcttccaaggtttccgtggcaggggagacagagatggaggggactccaagctcttaccagccttggtccacaggtgacccaggtcacttc

SEQ ID NO: 6182 - DNA, 601 bp, Human
aaaccaaagagcccctttctgtgcccaggtggcctcatgaagtgctccatttccaagccgcttcccttctggcaagtctgagatgaaaagggcagcttcatctttcccatagaaaagggaatatcacgtcttgtctttaacatagacaggaagcagcccctccagtgatttccactgctcccggagccacaggcggctcccctccacctctggaagactgcggcggccggccttgccggccccgacttcccctacctgtgccccctgcttgacaggccaggctgcctccattcttccagcmggccccattcctgcctcagggccttggcgccgcctgccccctcccccaaacctggaacaggcgatccctatcctacctcttcccacatccttccgttgtcgtgagcctctgctcccgtgatatctccagtgcaccagcccctgagctgtagaaagtggcctgccttcccctacccttcttccttctccatctcctaactattttatttctttcattgcatttgtcattatttgaaatgatcctgtttgtttttcacttcagtatcgtctgtgcctcccttcccagaatgcaaggtagcag

SEQ ID NO: 6183 - DNA, 601 bp, Human
ccctgtggtcacacacacaaaaatgtaggacatcaaaaactatcccaggcggaataaaacaaaaggtcaacaacaggactgggggaaatatttcccacacatgtgacagacaaaaagtttatctacttaagtacacagactcttcagatgaataaaacacccccaaatcccagcagaatcaagggcatgaataggccaagcaaaaaaataaaataatctctgtttacaaatacacgtatatttttaaatgcaggctcattaacatcaaggaaataacaacttacaacaaaaaaacttatcwccgttgtaattaaattaccactgctcaaaaggactcagtggtgtgaggaggtggggagacagtcatttgctcaatgaagcgggaatagatgaaaccataacagagaacattccagtgtagaaagcttaaaaaatgggcatatctgttggccagagacttcgctttcagcaactcagcttaaggaaataagtaagcacgagcgatagattcaactctatgaacgtgatacagttagtggcatgtctgacctctaatggagaaataagttttgctatgtgaatatgtcatataaataataag

SEQ ID NO: 6184 - DNA, 601 bp, Human
ctcggcttatttttgtatttttagtagagatgaggttttgtcatgttggccaggctcgtctcgaactcttgacctcaagtgatccgcccgccttggcctcccaaagtcctaggattacaggtgtgagccactgcactaagcctatctttcctcttactttgggagaaattcaggtggagggctgctatggctaaacccaagaacagtcagcggttggtgaggaactggagcttgggaagtacagctgccaagtagggcagaaactcagaagattaacttctggggagggcaggaggcatcmaacacatcacccaagggagaagcttttcccctgggaagggaaagactgcaggatctttccctgtggtcacacacacaaaaatgtaggacatcaaaaactatcccaggcggaataaaacaaaaggtcaacaacaggactgggggaaatatttcccacacatgtgacagacaaaaagtttatctacttaagtacacagactcttcagatgaataaaacacccccaaatcccagcagaatcaagggcatgaataggccaagcaaaaaaataaaataatctctgtttacaaatacacgtatatt

SEQ ID NO: 6185 - DNA, 601 bp, Human
tcagggcaggcgtggtggtggccatcccgcccacggctggcaggaaaggggcatgtctggtggatggctggccagagcccgtgtttcggcagaggtgagcctcccgtgagtgacacctgcatagagatgggattggccgtggccatacgctctgggctggagcagtgcaccagtaggaagggggcgtgcctggctctacttccccagacgccctggccagggcacagccaatgtgttcttccaggggtggcaggaagctctcagaccccagtgggtgtgcccttcctgctgggggtgcacycactctgctaggaccccgtacctgaggagcctcccctcggcaggattccactctgtgaaatcctctcttcttcctcccagcctccctgagtctggctgtgcctgtcataaacttctggtcagcctgaggcacccatcagggatcagccacaaaatacacatttgtttaatttcagtgaccccacatagaagctaaatgctctaatatttgcatttaaaatagccatcgcacaatttaaagatgaataagaaattcatgctaataattcaaggttccaatttttgttcacttagaacaata

SEQ ID NO: 6186 - DNA, 601 bp, Human
cgagatcatgccattgcactccagcccgggcgacagagcaagactctatctcaaggaaaaaaaaaaaaaaacaaaactcactgcagagagcctctgtggacaagggcccgccccctgcctgccacaggctcagcacacacccagtgccctcttagcacggctggcttcgcctgggcctcagaggtgtgtggacatgcccaagcagaggctggggaaaggccacagagaacgggagtctgaggtggcatccagggggcacatgcagggcagcaggtgttccctcaggctatggggtctgagygcagggctcaggtttctgggctcgccctagggacaggctgacttcatagatgaccagggcctatcctcagaaggccccgaccttggggcttgaccctctgcagctctgtcttgaagttcttcgtcatctcacccttgcatgtgtgttttgtaagtgaaggctcctggggcaatgcagcatggtcccatctccccaggacaggctttcagctgcccccagcaggggcaggatcaggcatgtattccccacggcatctcagggcaggcgtggtggtggccatcccgcccacggctggcagga

SEQ ID NO: 6187 - DNA, 601 bp, Human
gcatagcatgaacctgtctctaaaacaaatctttaaaaaatgagtcaggcatggtggtgtgtgcctgtagtcccagctgcttgggaggctgaagtttgaggctgcagtgagctatgattgcagcactacgctccagcctgggtgactgagtgagaccctgtctcaaaaaagaaaaaaatgcatatataaacatattacttccacaacggctctgatcttccaaggcattcatccctgcctcccatttacctgagcctgcagaagagtccctgtctgtacctggggacgaaacttgaggtgycacacacatctgagctgcctcctagcatggcagcctcgcctgtcaggcccaagcccactctttaggggtgcccaggcccacacacatggccacagcatctggtttgtgagcagagactagcccaggcgctggcagagcaagtttttgaaaatgtgagaaataccaaagccccagggtcagtatcaggcatgttcagcaatgtcacctgtgtcccagcctggcagcacccagtacttcagggagtatgtttcccaagcaggaaaggtcaaacatgacagtggtctcccaatgccctcgggg

SEQ ID NO: 6188 - DNA, 601 bp, Human
atagaaagcataagccccaaacctcctaagagagaggagtctatctttgtagaccacaaatcaacctcgctcccgctctccaagccccacaagctccagcagggcccaatctgcgcactgcgattcacgatgcggccaggcctttgcgcgcgctgtgccaccaccaggagtcctcattagaggcaactgcggtggcccttgtccgaggagccttccctgaccagccgccccaggcacccttccctgatgaaccaaggtgtaatcacgtgtcctgatcccgctccccatactcctgtgctcygagctcccccagtgcagggatgcggaggccaggagtccagggagtgccgaacatgactgaggacagctcccaatcccagcatgctcctcccacacccgtgctctactgagcactttcctggtgttcaactcgagtggtgctcccaacagccccgggagttggcactgaccagcacagggcgcagcaggacaggcagtcgcctccttccttctaggctggaaagaacactcaggccacccacacaccagacttgtcctgcagccgtgttctgcttcacctgtgcagtgtggcttcttaatt

SEQ ID NO: 6189 - DNA, 601 bp, Human
gttccccacctgctcaccatcactggtctgtcggcctccccagccctgctggaacatgtgctccctgcggtctggatcccgtgctcaccacgacatccccagcacctagggctgctctatccgggtgcactaagggagtgagtgggcaggcgggtgggcctcagaacaggaggacacagtagatctatgcagaagccaaggcaaagcaagaggcagagcggatggcctgcggggagaggcgggtgtggccaggggactccaaatgctgtggggaggtcagtgaggcctgagatgagaaccygcggagcatgctaggggatttgggagctctcgatcttcaggccagacagtaggggaggaccagcacaggggccaccttcccacaggtatgtgactccatctgccgtgctctggccatgtctctctcagtctcagtgacctgatgcaggcaagggaacctcacagggccactggggcaaggtagtgaggtcacaggtgtgcctccttgcacagggccagcacgtgcaaaaccagcaaatgtgagttcccctcctcaggtggggaggggtgtttccaaggatagaaagcataagccccaaac

SEQ ID NO: 6190 - DNA, 601 bp, Human
tggtggggagggtgctgcacatttcaggaggaagcagaggtgagatccacccacaagacccctgttcgagtgttccccacctgctcaccatcactggtctgtcggcctccccagccctgctggaacatgtgctccctgcggtctggatcccgtgctcaccacgacatccccagcacctagggctgctctatccgggtgcactaagggagtgagtgggcaggcgggtgggcctcagaacaggaggacacagtagatctatgcagaagccaaggcaaagcaagaggcagagcggatggcctgyggggagaggcgggtgtggccaggggactccaaatgctgtggggaggtcagtgaggcctgagatgagaacccgcggagcatgctaggggatttgggagctctcgatcttcaggccagacagtaggggaggaccagcacaggggccaccttcccacaggtatgtgactccatctgccgtgctctggccatgtctctctcagtctcagtgacctgatgcaggcaagggaacctcacagggccactggggcaaggtagtgaggtcacaggtgtgcctccttgcacagggccagcacgtgcaaaa

SEQ ID NO: 6191 - DNA, 601 bp, Human
agagattgagaggctcacataagtgggcatgggagtcagtacagaggctctgaggagcaatttggcaaacctgctgcaactagaaactgtatcccgggacctggccattcagacgtcagcatggacgatggagacacagcctctgtcatagaagcgaaggcataaggacacccagccacgaggagttccacacccacagatagagttcatttttatgggagtctctgagatcacagtcgctttatgggaattcatttagtcacttattcattcaaaagagatttactgagcacctactacrtgccaggccttttccaggtactcagtgaaaaatcaggtgggcagaccctctctgggtccgatacaaagtcacctttgtgggagtccctaaccctgctgagacacaccaccaaggagacccctggactggggaggaagacccaggattgcttgactgcaactcagctccaggggcagcctgggaggggcctcagggagtgagagcccacgccaggtcagcccgacagcccggcgtggcacatcatcgcctctgttcttgtggttcagctgtcacctccttgctggagcctgcacaagacaa

SEQ ID NO: 6192 - DNA, 601 bp, Human
acatcatgggccgagtgaacaactgctcgcctcgctggtcggctctgatcttctccgcctacgccgagtacttccccgcgtgcgatatctttcccttcccacaccctgcgagtgagtgttatccccgctgtgccagtgaggaagccgaggcacagagagattgagaggctcacataagtgggcatgggagtcagtacagaggctctgaggagcaatttggcaaacctgctgcaactagaaactgtatcccgggacctggccattcagacgtcagcatggacgatggagacacagcctctgycatagaagcgaaggcataaggacacccagccacgaggagttccacacccacagatagagttcatttttatgggagtctctgagatcacagtcgctttatgggaattcatttagtcacttattcattcaaaagagatttactgagcacctactacgtgccaggccttttccaggtactcagtgaaaaatcaggtgggcagaccctctctgggtccgatacaaagtcacctttgtgggagtccctaaccctgctgagacacaccaccaaggagacccctggactggggaggaagacccagga

SEQ ID NO: 6193 - DNA, 601 bp, Human
gcacaaggggctcctctgtgtggaatgatgccctcccactttccacttgggagacaccaactctgtgaccaaaaccagctcaaggatcaccccactgtgactatctccactaccaggtggagacagctgaccgtctcctttggctgccaaggccctgtcctcgctgtgccaaggcaagcaggtggcccccatgagaaaaaagcttgtccaggacgggagctggctggggctcttcccagacatcatgggccgagtgaacaactgctcgcctcgctggtcggctctgatcttctccgcctaygccgagtacttccccgcgtgcgatatctttcccttcccacaccctgcgagtgagtgttatccccgctgtgccagtgaggaagccgaggcacagagagattgagaggctcacataagtgggcatgggagtcagtacagaggctctgaggagcaatttggcaaacctgctgcaactagaaactgtatcccgggacctggccattcagacgtcagcatggacgatggagacacagcctctgtcatagaagcgaaggcataaggacacccagccacgaggagttccacacccacagatagagtt

SEQ ID NO: 6194 - DNA, 601 bp, Human
tgcattcttgctgatgcaacctgggtgctcagtactcccgtgtttccccaggcttcaggaccaaggccaagctcagccgcacgcgccttctcccaccccagcgggctcccagggtggccgagggctggcacctcttttgcacaaggggctcctctgtgtggaatgatgccctcccactttccacttgggagacaccaactctgtgaccaaaaccagctcaaggatcaccccactgtgactatctccactaccaggtggagacagctgaccgtctcctttggctgccaaggccctgtcctcrctgtgccaaggcaagcaggtggcccccatgagaaaaaagcttgtccaggacgggagctggctggggctcttcccagacatcatgggccgagtgaacaactgctcgcctcgctggtcggctctgatcttctccgcctacgccgagtacttccccgcgtgcgatatctttcccttcccacaccctgcgagtgagtgttatccccgctgtgccagtgaggaagccgaggcacagagagattgagaggctcacataagtgggcatgggagtcagtacagaggctctgaggagcaatttggcaaa

SEQ ID NO: 6195 - DNA, 601 bp, Human
ctgctcaggatcagaagggccagcatgggcagcccccaggccaggctccctgccaggcgcgggtgggaggtcttgcaggctgcagccaggtttccttcctcctgtctggctgcagggaagtttcccttgctctgaagtttcctcactctgtgaacattcccacggggcaccctatgctgcctcgggtgctgtcccatcctggtaacttcctggcaccatcgtgatctccagtcgccttcgtttgttagctgtctgtccgtctccactaggcagggactgttctgcattcttgctgatgcawcctgggtgctcagtactcccgtgtttccccaggcttcaggaccaaggccaagctcagccgcacgcgccttctcccaccccagcgggctcccagggtggccgagggctggcacctcttttgcacaaggggctcctctgtgtggaatgatgccctcccactttccacttgggagacaccaactctgtgaccaaaaccagctcaaggatcaccccactgtgactatctccactaccaggtggagacagctgaccgtctcctttggctgccaaggccctgtcctcgctgtgccaaggcaagcag

SEQ ID NO: 6196 - DNA, 601 bp, Human
catgcatgatgaggaagaagggagaggccctggcagagcaggtatgaacccctcagagactgagaaggcatgacagagggctgcaggccatcaccttgcactgtgcccctcgacctgggcaggggcccccaaggcactcagagcgcagggcaagagtaaggtgaaggctgcaagaagggtcctgcattacaagctcacggcaagggtcgtctgctgccagcgtatccctccctgaaagcgcagtcatgcagggtgctttccaacacccagagcagatgttccagcgcctcttgggcttggmgggaaacggctttgcccttctgtgcagcaggtcacaatccccctgcaccaccagagtctgtttatgtggcttagctcccttgccagactctggcagatggaaagatagatgaaatcctgcccaccgctacacaggaaacccagaaccaaaggaagaggggccgaattattggaagcacaagggtccgtgatcacttctgctcaggatcagaagggccagcatgggcagcccccaggccaggctccctgccaggcgcgggtgggaggtcttgcaggctgcagccaggtttccttcctcctg

SEQ ID NO: 6197 - DNA, 601 bp, Human
tactccccaggcatccatgcatgatgaggaagaagggagaggccctggcagagcaggtatgaacccctcagagactgagaaggcatgacagagggctgcaggccatcaccttgcactgtgcccctcgacctgggcaggggcccccaaggcactcagagcgcagggcaagagtaaggtgaaggctgcaagaagggtcctgcattacaagctcacggcaagggtcgtctgctgccagcgtatccctccctgaaagcgcagtcatgcagggtgctttccaacacccagagcagatgttccagcrcctcttgggcttggcgggaaacggctttgcccttctgtgcagcaggtcacaatccccctgcaccaccagagtctgtttatgtggcttagctcccttgccagactctggcagatggaaagatagatgaaatcctgcccaccgctacacaggaaacccagaaccaaaggaagaggggccgaattattggaagcacaagggtccgtgatcacttctgctcaggatcagaagggccagcatgggcagcccccaggccaggctccctgccaggcgcgggtgggaggtcttgcaggctgcagccag

SEQ ID NO: 6198 - DNA, 601 bp, Human
tgtgtgggatgcagcagctcctgctggtgagggccagggcgtgggtagctggcactggctggcagaggctgtagagtggacacccatcaaggcatagggcttggactgggcaggggtccagcatgcctaagtggcccaggcgtcagacccgaccacctcagagcaaagctgaggaggactcaggccagcctccctactccccaggcatccatgcatgatgaggaagaagggagaggccctggcagagcaggtatgaacccctcagagactgagaaggcatgacagagggctgcaggccatyaccttgcactgtgcccctcgacctgggcaggggcccccaaggcactcagagcgcagggcaagagtaaggtgaaggctgcaagaagggtcctgcattacaagctcacggcaagggtcgtctgctgccagcgtatccctccctgaaagcgcagtcatgcagggtgctttccaacacccagagcagatgttccagcgcctcttgggcttggcgggaaacggctttgcccttctgtgcagcaggtcacaatccccctgcaccaccagagtctgtttatgtggcttagctcccttgccagactct

SEQ ID NO: 6199 - DNA, 601 bp, Human
ggggcagcaagcagctgccggggtggggggcgggctgctgagcccacaccaggcttggagccggagccctatccctaccgctgcccccgccttagggtgagatgcagatagtccccggggttctgggctccacttcccactgagatgagaccctctgctgagggtggaggccaacccacatggtggccaagcaggtggttagaatggagagggatctcatgttaatgaatgggcctcaggcagcacatggatgcccctcgctccagaagggggtgtgtgggatgcagcagctcctgctggygagggccagggcgtgggtagctggcactggctggcagaggctgtagagtggacacccatcaaggcatagggcttggactgggcaggggtccagcatgcctaagtggcccaggcgtcagacccgaccacctcagagcaaagctgaggaggactcaggccagcctccctactccccaggcatccatgcatgatgaggaagaagggagaggccctggcagagcaggtatgaacccctcagagactgagaaggcatgacagagggctgcaggccatcaccttgcactgtgcccctcgacctggg

SEQ ID NO: 6200 - DNA, 601 bp, Human
tgggggtgatatggagagataatgggtgatgcttctcagggctgcttcgagcaggattaggggcagcatggaaacctagagtgggagagattaagctgaaggaagattttggggtaacaggtgatattatggggttgttagaaggagcatttgtcgtatagaatgattggtgatggcctggatgcagtttggtatgaattgagaaactaaacggaagacacagcgtccgaataaaaggagaaaaacaggtattaaaggactaagaattgggaggacccaggacatccaattagagagtgcycaagggggttcagcataattatttgcttggttggcgagtttttgggctctatccttgagtttatgttgtcatacaccaggccagactgatttaggtaaaaacaacacctaggtgattcaaaagctttattgctcacacaaagcctggtggtggtctcttcacacggacatgcgtgacaaaagtgaaatccccagcacctagtacaggctgaatgaaactgtcatcaaattacaggagggtccaacagcccaagctgtttccctgggaccccatgcacagaatggtccacctgggcttcgc

SEQ ID NO: 6201 - DNA, 601 bp, Human
ggggatatgatggcttagcttgggctcagaggcctgacattcctgtcttcttatattaataagaaaaacaaaatgaaatagtggtgaagtgttggggtggtgaaaatttttgggggtgatatggagagataatgggtgatgcttctcagggctgcttcgagcaggattaggggcagcatggaaacctagagtgggagagattaagctgaaggaagattttggggtaacaggtgatattatggggttgttagaaggagcatttgtcgtatagaatgattggtgatggcctggatgcagtttkgtatgaattgagaaactaaacggaagacacagcgtccgaataaaaggagaaaaacaggtattaaaggactaagaattgggaggacccaggacatccaattagagagtgcccaagggggttcagcataattatttgcttggttggcgagtttttgggctctatccttgagtttatgttgtcatacaccaggccagactgatttaggtaaaaacaacacctaggtgattcaaaagctttattgctcacacaaagcctggtggtggtctcttcacacggacatgcgtgacaaaagtgaaatcc

SEQ ID NO: 6202 - DNA, 601 bp, Human
tcaattgattgatcagctagggtggggcaggaacagatcacaatggtggaatgccatcagttaaggcaggaactatctattttcacttcttttgtggatcttcagttgtttcaggccatctggatgtatatgtgcaggtcacaggggatatgatggcttagcttgggctcagaggcctgacattcctgtcttcttatattaataagaaaaacaaaatgaaatagtggtgaagtgttggggtggtgaaaatttttgggggtgatatggagagataatgggtgatgcttctcagggctgcttygagcaggattaggggcagcatggaaacctagagtgggagagattaagctgaaggaagattttggggtaacaggtgatattatggggttgttagaaggagcatttgtcgtatagaatgattggtgatggcctggatgcagtttggtatgaattgagaaactaaacggaagacacagcgtccgaataaaaggagaaaaacaggtattaaaggactaagaattgggaggacccaggacatccaattagagagtgcccaagggggttcagcataattatttgcttggttggcgagtttttgggc

SEQ ID NO: 6203 - DNA, 601 bp, Human
tctctctctgttgcccaggttggagtgcagtggcatgatctcagctcactgccagctccacctcccaggttcatgccattctcttgcctcagcctcccgagtagctggggctacaggcgcccgccagtgcgcctggtttttttttttttttttttttttttttttagtagaggcagggtttcacaatgttagccaggatggtcttgatctcctgacttcatgatctgcccgcctcggcctcccaaagtgctgggattacaggcgtgagccaccgcgcccggccaggagcaattttttgtgsgctggggacggattttacaaagtacattctcaagggcggaagaatattacaaaatatcttcttaaggtagggggggacaatattacaaagtatcttcttaaggatgggggtggggaagaatattactaagtatcttcttaagttggggggagagaatattacaaagtatcttctcaagggtggggagggtgtatcatacaaagtagattcacaagggcgggtccggcgggggcgggtggcaatatcacaaagtacattaccccaagggcggagagggtgtattgttcacaaattcaattg

SEQ ID NO: 6204 - DNA, 601 bp, Human
gggtggtgggactaccattcgttggtataggtttgggatagacggtggagttaggagcaatttttttttttttttgagacggagtctctctctgttgcccaggttggagtgcagtggcatgatctcagctcactgccagctccacctcccaggttcatgccattctcttgcctcagcctcccgagtagctggggctacaggcgcccgccagtgcgcctggtttttttttttttttttttttttttttttagtagaggcagggtttcacaatgttagccaggatggtcttgatctcctgacytcatgatctgcccgcctcggcctcccaaagtgctgggattacaggcgtgagccaccgcgcccggccaggagcaattttttgtgggctggggacggattttacaaagtacattctcaagggcggaagaatattacaaaatatcttcttaaggtagggggggacaatattacaaagtatcttcttaaggatgggggtggggaagaatattactaagtatcttcttaagttggggggagagaatattacaaagtatcttctcaagggtggggagggtgtatcatacaaagtagattcacaagg

SEQ ID NO: 6205 - DNA, 601 bp, Human
tttttaatcacctgggtgcaggtgggctgagtccaaaaagagagtcagcaaagggtggtgggactaccattcgttggtataggtttgggatagacggtggagttaggagcaatttttttttttttttgagacggagtctctctctgttgcccaggttggagtgcagtggcatgatctcagctcactgccagctccacctcccaggttcatgccattctcttgcctcagcctcccgagtagctggggctacaggcgcccgccagtgcgcctggtttttttttttttttttttttttttttttagtagaggcagggtttcacaatgttagccaggatggtcttgatctcctgacttcatgatctgcccgcctcggcctcccaaagtgctgggattacaggcgtgagccaccgcgcccggccaggagcaattttttgtgggctggggacggattttacaaagtacattctcaagggcggaagaatattacaaaatatcttcttaaggtagggggggacaatattacaaagtatcttcttaaggatgggggtggggaagaatattactaagtatcttcttaagttggggggagagaatattacaa

SEQ ID NO: 6206 - DNA, 601 bp, Human
caaacaggctttgtgtgagcaataaagctttttaatcacctgggtgcaggtgggctgagtccaaaaagagagtcagcaaagggtggtgggactaccattcgttggtataggtttgggatagacggtggagttaggagcaatttttttttttttttgagacggagtctctctctgttgcccaggttggagtgcagtggcatgatctcagctcactgccagctccacctcccaggttcatgccattctcttgcctcagcctcccgagtagctggggctacaggcgcccgccagtgcgcctggyttttttttttttttttttttttttttttagtagaggcagggtttcacaatgttagccaggatggtcttgatctcctgacttcatgatctgcccgcctcggcctcccaaagtgctgggattacaggcgtgagccaccgcgcccggccaggagcaattttttgtgggctggggacggattttacaaagtacattctcaagggcggaagaatattacaaaatatcttcttaaggtagggggggacaatattacaaagtatcttcttaaggatgggggtggggaagaatattactaagtatctt

SEQ ID NO: 6207 - DNA, 601 bp, Human
ccaaacaggctttgtgtgagcaataaagctttttaatcacctgggtgcaggtgggctgagtccaaaaagagagtcagcaaagggtggtgggactaccattcgttggtataggtttgggatagacggtggagttaggagcaatttttttttttttttgagacggagtctctctctgttgcccaggttggagtgcagtggcatgatctcagctcactgccagctccacctcccaggttcatgccattctcttgcctcagcctcccgagtagctggggctacaggcgcccgccagtgcgcctgctttttttttttttttttttttttttttttagtagaggcagggtttcacaatgttagccaggatggtcttgatctcctgacttcatgatctgcccgcctcggcctcccaaagtgctgggattacaggcgtgagccaccgcgcccggccaggagcaattttttgtgggctggggacggattttacaaagtacattctcaagggcggaagaatattacaaaatatcttcttaaggtagggggggacaatattacaaagtatcttcttaaggatgggggtggggaagaatattactaagtatct

SEQ ID NO: 6208 - DNA, 601 bp, Human
tgactcttgctcaaaatatcaaactaccatgaaacggaaatggccaggatcagaattactaggctcagttcatacatcaaaaagtgaggtggtcagagtcccctccttcaatacccagcgcaggaacactctgcccaaggccaccccctcactcctcaggcgacgtctcctgtgcctgtccacactctgctgatacctctgcagatgcctcagggtggggacggggctcctccacttccaggccagctcatcaatgcacagagcccagcagggtctcaagagatgtgctgcacccctcagkgtggcactccagcaggcacgttgagaagacaggtcgcattacaaaccttcccgggtttgtactaacgacggcaagaggctgcccctccccctctcctgaatttggggggttagcagagtgtgggggggatattcccactctgaggtcagatttcatgggtgccagcatgggctctgccacaatcctgctgcgtgacttggggccagttacttaacctgtctgggcctcagtttctttatctataaaatggagataataatagtccctgtgtctcagggttgtttcaggttgaagcaacaa

SEQ ID NO: 6209 - DNA, 601 bp, Human
atcatgagaatcaacgttcccattgcagatcttcttcaccctcggctcctcagcagatgcttcagagggaatgctagaagaaacgtgactcttgctcaaaatatcaaactaccatgaaacggaaatggccaggatcagaattactaggctcagttcatacatcaaaaagtgaggtggtcagagtcccctccttcaatacccagcgcaggaacactctgcccaaggccaccccctcactcctcaggcgacgtctcctgtgcctgtccacactctgctgatacctctgcagatgcctcagggyggggacggggctcctccacttccaggccagctcatcaatgcacagagcccagcagggtctcaagagatgtgctgcacccctcagtgtggcactccagcaggcacgttgagaagacaggtcgcattacaaaccttcccgggtttgtactaacgacggcaagaggctgcccctccccctctcctgaatttggggggttagcagagtgtgggggggatattcccactctgaggtcagatttcatgggtgccagcatgggctctgccacaatcctgctgcgtgacttggggccagttacttaac

SEQ ID NO: 6210 - DNA, 601 bp, Human
aaagatgcagccaagtttctgttctggaatagacaatgaggaaggagcggctctgcatggcaatgtaaagtttgcctcactggtggcagagttccacccaggggatggtgagccctgggaggtggcctgcggctgctgggcagaggtgactttgtcctctgccaaggtgggggaggggtgcagaaaggggggaaccggtgcaggctccctactggggaggcctactggcccgccagccacagaggagacaggcaggggccctggaacagcagccaccccaaccttcaggaaagttcccatrtccttcgctcagctgagctttgggccaccagaggcagcctgtggcccacctggcaaaaccatgtccaggagcaagccaggcctgaaaagtctgtcagaggcctgggggaggggggcctgctgctctgtggcttctctgggaccccctgaaataagtgaggagaaggctgttctctctgtgccccttcggaggccaggcttggaccaccaggatggaggcagagaagagagtgcagccaggagcaggggacagaggtctgctggcctccgtggaggaagagtttaggcattgcatggtgcc

SEQ ID NO: 6211 - DNA, 601 bp, Human
ggggaggcccccagctaagggcctcccctcccctccccccagcagccctgggggcctcctccgcatccaccctacccaaggcctgcgtgtgctggggagaagcagctctcctttcccaggttgcagggggaggggaagcccagggacaatgtccttgagtactgtctgagaaattgatcctggaatctttaaaccttggggggaaatgttcaaagccgcagccatctctgtgcggagagaggccaagggctctcttgtttggggaaacacattgtaatgcgccttttgcttatgcaaagaygcagccaagtttctgttctggaatagacaatgaggaaggagcggctctgcatggcaatgtaaagtttgcctcactggtggcagagttccacccaggggatggtgagccctgggaggtggcctgcggctgctgggcagaggtgactttgtcctctgccaaggtgggggaggggtgcagaaaggggggaaccggtgcaggctccctactggggaggcctactggcccgccagccacagaggagacaggcaggggccctggaacagcagccaccccaaccttcaggaaagttcccatgtcctt

SEQ ID NO: 6212 - DNA, 601 bp, Human
tctccacctcaggaactttggacttgccgtgcaactgctcccagcagtgtctagcccatagtaggtgctcagtaaacatttgctgaatgaatggagtgaatcactttgaagatatggaataacaggaaatgggcaaaatgtatgacccagcgtaggcctgtgacccctctcatgggggaggcccccagctaagggcctcccctcccctccccccagcagccctgggggcctcctccgcatccaccctacccaaggcctgcgtgtgctggggagaagcagctctcctttcccaggttgcagrgggaggggaagcccagggacaatgtccttgagtactgtctgagaaattgatcctggaatctttaaaccttggggggaaatgttcaaagccgcagccatctctgtgcggagagaggccaagggctctcttgtttggggaaacacattgtaatgcgccttttgcttatgcaaagatgcagccaagtttctgttctggaatagacaatgaggaaggagcggctctgcatggcaatgtaaagtttgcctcactggtggcagagttccacccaggggatggtgagccctgggaggtggcctgcgg

SEQ ID NO: 6213 - DNA, 601 bp, Human
agactcatcctaaaaaatatatctcaaaggaaagaggcagtgacctccttgcttaaacccttcctaccccaaggcatgagaccgcagttcctggcgtgacctccaggccaggagggtctggccctgctgagtcttctcgggctgccctggccctgctccctgtgctccagcggctagcccggctgctccttgcacaggcagcctgtctccacctcaggaactttggacttgccgtgcaactgctcccagcagtgtctagcccatagtaggtgctcagtaaacatttgctgaatgaatggartgaatcactttgaagatatggaataacaggaaatgggcaaaatgtatgacccagcgtaggcctgtgacccctctcatgggggaggcccccagctaagggcctcccctcccctccccccagcagccctgggggcctcctccgcatccaccctacccaaggcctgcgtgtgctggggagaagcagctctcctttcccaggttgcagggggaggggaagcccagggacaatgtccttgagtactgtctgagaaattgatcctggaatctttaaaccttggggggaaatgttcaaagccgcagc

SEQ ID NO: 6214 - DNA, 601 bp, Human
tgcagcccctcaattctttagatatctcaggagcatttgaaaaaaaagactcatcctaaaaaatatatctcaaaggaaagaggcagtgacctccttgcttaaacccttcctaccccaaggcatgagaccgcagttcctggcgtgacctccaggccaggagggtctggccctgctgagtcttctcgggctgccctggccctgctccctgtgctccagcggctagcccggctgctccttgcacaggcagcctgtctccacctcaggaactttggacttgccgtgcaactgctcccagcagtgyctagcccatagtaggtgctcagtaaacatttgctgaatgaatggagtgaatcactttgaagatatggaataacaggaaatgggcaaaatgtatgacccagcgtaggcctgtgacccctctcatgggggaggcccccagctaagggcctcccctcccctccccccagcagccctgggggcctcctccgcatccaccctacccaaggcctgcgtgtgctggggagaagcagctctcctttcccaggttgcagggggaggggaagcccagggacaatgtccttgagtactgtctgagaaattg

SEQ ID NO: 6215 - DNA, 601 bp, Human
tctccagtgccttcggaagcagggcccagcccctcgcctggcattcggagccctctccacgctggccctggctggcttctccatgcgtcacttcagatacctccccacatggcacccttgctcctgacagcccagccagccttccccagagccggctgccctctcctgctgcctgtgctttggttcaggcctggaatcctcactctccctgtgcagcccctcaattctttagatatctcaggagcatttgaaaaaaaagactcatcctaaaaaatatatctcaaaggaaagaggcagtgasctccttgcttaaacccttcctaccccaaggcatgagaccgcagttcctggcgtgacctccaggccaggagggtctggccctgctgagtcttctcgggctgccctggccctgctccctgtgctccagcggctagcccggctgctccttgcacaggcagcctgtctccacctcaggaactttggacttgccgtgcaactgctcccagcagtgtctagcccatagtaggtgctcagtaaacatttgctgaatgaatggagtgaatcactttgaagatatggaataacaggaaatgggcaaaat

SEQ ID NO: 6216 - DNA, 601 bp, Human
ctggggctccctggctgctgaggagctagagagggcatgcctgcaaatgctcccagcaggtagccagggagaaggaggccaggccgcagccaaggccccctcagccctccctccctggtagccttcaactgtggtgcgctctccctgatcctctccccaggaaacctctgtcccttcctcccttccacaccagcacagcacatagttccccaggcatgcccactctctgggaggcaggcctgagcaaggccgtggtggggcttgcgatggcctcctggctcctctgggtggctgctgggcytgggatcctgctccggagccctcaacttggccccctcccaggccaggtctcagcagcccctcccagcagtcaggaaccccatggggcactgtggcccagagaccactgaccactggcctgggtggttctcctgcccctgcgtgtgctatggcaaagtccaacccacagtccggggccgggctccttctgctgtccagcctctcagtccccgtaggttaatatgatacatcaggaacagacatggggggcaggcagggtttgtggggcatgtgagaggcaggggtgctccacagtgtcctt

SEQ ID NO: 6217 - DNA, 601 bp, Human
ccagggttggaagcagcgaggcaccttccaagcacagaggggatgtggaagggatgccccagcagaggaggtgggaggggagcactgaggccagaccacgaagtcaggagaaggattccaaatcctctctaagagcagtgggaggacatggaggaaggatgatggcggggcatttaagaagcttactccaggtgccttacggaaagtagatggaaggggtcaagatgtgggaatgtggggttcagctttggggatgagtgcagagaagggacggatgtgagggatgatgtggattggaatrggggtcatctgccccgcctgagcagggagaggctggggctctggaagggcattccggcagctcccacagggcggagggaggagatgcggggctggccctctcctggctcctggccaggccctgcccctcaggacgcaagatcttcccactctcctagccctacccctggggccgaaggtggcagctctcatctcaagaaggaatcttgtgtccttctgaacattgagcagatctaatcctgctccctgatttgggacaggaggtgaccaaccactccaaaagccccgtcgctgggcatgg

SEQ ID NO: 6218 - DNA, 601 bp, Human
ctcccacctctctttcctataggcaagggacaactcatcagacccacgggagcgtggctggtcaccgtggctccgggctgtaggcgtctggggagggtgggtcagcaacccctgtaggcgctgagggttatcctctagacccccagtgacccatctcgcccctgtggctgacaagatggagctccgaggagggcacccaggtccccaggaagccttgccatttggtcatcgccctccgtttcctctgtaaaatgaggattgcagtccccccatcacaaagctgttgtggggatgaaaccgycatgcaggtgcaatggaatggtgcttgtgcaaacaatgaaacggtttttcattgctggtaaaccatagtgccctgcagctccctgtgaggtcctgggggtagggtatgcacccctaaaccacagaagtccttgcccagctttgagggtcagactagattgtttagtccacgctggcacagtagccttaaaagccagtttttcttaagagagaaggggtttctgtaattgtccacagtattgctttctctatcacgacaaagcttggccagcttggctcatggagtctgaccgagggaagg

SEQ ID NO: 6219 - DNA, 601 bp, Human
ctgtgtgcagaccgagcccaggggctgctgacagctccggacatggccaagacatacttcccggagcctgctgccacgtcaggccagcacacactccctgcactccaatctgtagagcctgcatctgagcaacagtgattgctacctcaaaacagtgggaaggcacctcaggaaacccgagggttcacaaggagaatgacatcatgatggatgggtggacaggcatacagggcgtgcaagacaaggatcccgaggcccgctggcatcggtgctgggaacaaagatggcaccgatcgtgggrcagagttcatgacatgtggaccctgctgagggtaccatccagcccaaacgcagctcctcttggcaactgctgcccagcaaatctacatctgattgtaaatgggctccccacaactcccacctctctttcctataggcaagggacaactcatcagacccacgggagcgtggctggtcaccgtggctccgggctgtaggcgtctggggagggtgggtcagcaacccctgtaggcgctgagggttatcctctagacccccagtgacccatctcgcccctgtggctgacaagatggagctccga

SEQ ID NO: 6220 - DNA, 601 bp, Human
ccactcctcctcgaggccagctcagcagtcacttccccctggaaggccccccgcaggcctgagccgcccctcatcaagcacaaggtgtgttatttctggagccctctgtgtgcccctgtgggctgggcagccacctgcatcctccctgcttgcacgcccagagccaggctaagcagcacctggcaggcactcagggatacccgctgaaaggctgaagccattggcaccatcaagaagtggagaaacagggactggctgtgtgcagaccgagcccaggggctgctgacagctccggacatgkccaagacatacttcccggagcctgctgccacgtcaggccagcacacactccctgcactccaatctgtagagcctgcatctgagcaacagtgattgctacctcaaaacagtgggaaggcacctcaggaaacccgagggttcacaaggagaatgacatcatgatggatgggtggacaggcatacagggcgtgcaagacaaggatcccgaggcccgctggcatcggtgctgggaacaaagatggcaccgatcgtggggcagagttcatgacatgtggaccctgctgagggtaccatccagccc

SEQ ID NO: 6221 - DNA, 601 bp, Human
gaaacagggaggcatcagcgggaaccacaggccctaggactggctctggctctgccaatgggatgacccccacctgctccttcttcttcccatgctttccacccaggcgtcaccatcaactaggagccaccttgtgacccctccctcattgccccctgccctctgcctctccaggctgccaccaccacctgctgggatcactgtagccccttcctgagcaaccccacccaccagcccagggtttcctcacctggggcctgaacatggaacgtgggcagggaaagcagccctacgcttgctrtagcctccagctgaaacacaaccttcccttcaacagtgaacgtgggtgatggacccccgcggcacaggcagggctgggaccggccctggcagaagtcactccaagctatagctggtgggtgtggggattacctacctgcatcgctacttggaaatgggggcggttctaggcccaccaccaggtataatgttttaacgtgttaataaaaagctcatattactgcatccccaatgtgctctccctgttctgttttgatggctggagctcctgcagtcgccgtctctgtatttatcacaatca

SEQ ID NO: 6222 - DNA, 601 bp, Human
gaggcaggcccggctggccacagtgcactcacctttccatagctcaggaggatgatccgcaccaggaccacgttgatgtgggcacccaaggactcgtcatggtagatttcattgacctgaaagaaacagggaggcatcagcgggaaccacaggccctaggactggctctggctctgccaatgggatgacccccacctgctccttcttcttcccatgctttccacccaggcgtcaccatcaactaggagccaccttgtgacccctccctcattgccccctgccctctgcctctccaggctgycaccaccacctgctgggatcactgtagccccttcctgagcaaccccacccaccagcccagggtttcctcacctggggcctgaacatggaacgtgggcagggaaagcagccctacgcttgctgtagcctccagctgaaacacaaccttcccttcaacagtgaacgtgggtgatggacccccgcggcacaggcagggctgggaccggccctggcagaagtcactccaagctatagctggtgggtgtggggattacctacctgcatcgctacttggaaatgggggcggttctaggcccaccac

SEQ ID NO: 6223 - DNA, 601 bp, Human
cctcattacccagaaaactaactcaggaccgctccactccccagagcccactggaattattcaaactggccaaccttaagccagctcaccctgtccccatcggtccttcctgcagaaacaacatggactcaggctgctgtttacccaattccctctgcctcctgaccacccctggtgcctccctgtgtggcccccgtggcctggtatgtctcttcctcttgggatctgggagtaacagactcttttcagtgaacaatagtaatggccacattttaaaacaaggggtgaaagggagcagggwtcttgtttcttataggaacctcaggggagccagggagaggcagggtggttctggcaaacgcacacactctccaaggaggcccatgcctcactcccaggcccctcactccgagggggtggaggcaggcccggctggccacagtgcactcacctttccatagctcaggaggatgatccgcaccaggaccacgttgatgtgggcacccaaggactcgtcatggtagatttcattgacctgaaagaaacagggaggcatcagcgggaaccacaggccctaggactggctctggctctgccaatg

SEQ ID NO: 6224 - DNA, 601 bp, Human
cgcccacctcagcctcccaagtagttgggactacaggcacatgccaccacacccggctaatttttgtatttttttggtagagacagggtttcaccacgttagctaggctggtctcaaactcctgacctcaagtgatctacccaccttggcctcccaaagtgctaggattacaggtgtgagcgaccatgcctggcccctagtaggttttttttttttttaatgttttcaaatgaattggatttttttaggtttataaattctgctgcccccacccctacttttaggcatttcatcagcgaasatggacaaaatcgttttagctgtataaaattcacaatattttctttatgacccaaaacacttctgtaatttttaagtgttctatgattcctcgaaaagaaggttcatctttctttttttctgtagggcaagggaaacagtgatataactactaatttagctttactcattgtgtcattcaaaaattctatgccttattagcatctaatctgtgaaaggcttttaaaagtgtattagagactctcatagttaggtttttgccaatttcccctttgttccaaggatttgttttgggatgttt

SEQ ID NO: 6225 - DNA, 601 bp, Human
tttccttgctctgttacccaggctggagcgcagtggtgtgatctcagctcactgcaacctctgcctcccgggttcaagcaattcgcccacctcagcctcccaagtagttgggactacaggcacatgccaccacacccggctaatttttgtatttttttggtagagacagggtttcaccacgttagctaggctggtctcaaactcctgacctcaagtgatctacccaccttggcctcccaaagtgctaggattacaggtgtgagcgaccatgcctggcccctagtaggttttttttttttttaatgttttcaaatgaattggatttttttaggtttataaattctgctgcccccacccctacttttaggcatttcatcagcgaacatggacaaaatcgttttagctgtataaaattcacaatattttctttatgacccaaaacacttctgtaatttttaagtgttctatgattcctcgaaaagaaggttcatctttctttttttctgtagggcaagggaaacagtgatataactactaatttagctttactcattgtgtcattcaaaaattctatgccttattagcatctaatctgtgaaag

SEQ ID NO: 6226 - DNA, 601 bp, Human
atttgttagaggatgagttttgtcatttggaaactgatgtgatgaactgtatgaatagatttcctgatattaaacaatctccacattcctaggataagccctagatgatcacggtagaagtttctctttatacattattcaattaaactcttaatgccttgggatttttacttctatttttagaagtgagacaggtctgtactttgtcctgacgggctacctttggcatctttgggtataagggtcccattgactacgaaagacacattgggtagatttcagaatacatgagtttacaggrtattgtattagtcttgcctgataaatgcttgcaaatgagtatgaatgcactggcaaaactttggaaaaggtgaagaacttgagttccctccatggttatgggacttatggcatattctccattttttggagtcagctttgaaatattcacatcccaggaaatcctcaatttccccaggatctccgtgtccctggcatagagatcctcaaattctcaccttcagggtttgactctcttctgcaaatgttctgactgtgatcacatactccttctacctacctgaggcagttaaggaaaaaa

SEQ ID NO: 6227 - DNA, 601 bp, Human
ccttctggaagcggtcccctgaggacagagactatgccagtgaatattcccagcacagcacttcccacacagaagcccttcaaacagtatttgttagaggatgagttttgtcatttggaaactgatgtgatgaactgtatgaatagatttcctgatattaaacaatctccacattcctaggataagccctagatgatcacggtagaagtttctctttatacattattcaattaaactcttaatgccttgggatttttacttctatttttagaagtgagacaggtctgtactttgtcctgaygggctacctttggcatctttgggtataagggtcccattgactacgaaagacacattgggtagatttcagaatacatgagtttacagggtattgtattagtcttgcctgataaatgcttgcaaatgagtatgaatgcactggcaaaactttggaaaaggtgaagaacttgagttccctccatggttatgggacttatggcatattctccattttttggagtcagctttgaaatattcacatcccaggaaatcctcaatttccccaggatctccgtgtccctggcatagagatcctcaaatt

SEQ ID NO: 6228 - DNA, 601 bp, Human
tgtgaggggctacggggccgtcacgcccttgccctgccagaggcttcaacactggagccctgaggcctctctcccaggctccccctaggcagcaagctcctcatgcctgcagttgcttctgctacccccagctccagaccccgcagggctccagacccacatccacatcttcttggcctcctccgctgggatggcaccaggtacctctaactgcacatctcagctgacctcttcagcttccctcctgtgctccccaatctcaggggttgataccatcatctacccagctgagagtctctcygccttcacccacctagtgccacatcctctcgaagtggcctcctctgtcctcctgtctgtatccctggacccaggcctggtcccagtccagctgccagcatcccccatttgatggcagtgactgtctcctaagccactgctcccacctgccccttctgcacacaggagccagtgatcttcttagaaatgcacatgggatcgtgtcactgcttaaagctgccctcatgggcaagccaaaccccttggcgggagacgcaggtctgctctgctccttgcgatcggctccttccgacgtctttgg

SEQ ID NO: 6229 - DNA, 601 bp, Human
actgctcggactctcggaggtacaccatgcacagctccacaggaaagtctccgggaaatttcacccccaggaatgcccattttcctttgtttgaccagcattttccagacttctttgaccttgggacccctctatagtcctctgtaacatctactcatatcctaagaattcgctgtgcagaacacttttagggaaatgtgcttctttttccgcctttaaatacaatcttggttgtcctgttgccctctgttactagttttctggggatctggaaaaggaggagtgccctgtgaggggctayggggccgtcacgcccttgccctgccagaggcttcaacactggagccctgaggcctctctcccaggctccccctaggcagcaagctcctcatgcctgcagttgcttctgctacccccagctccagaccccgcagggctccagacccacatccacatcttcttggcctcctccgctgggatggcaccaggtacctctaactgcacatctcagctgacctcttcagcttccctcctgtgctccccaatctcaggggttgataccatcatctacccagctgagagtctctccgccttcacccac

SEQ ID NO: 6230 - DNA, 601 bp, Human
ccattcccaactctgccaaaagtggaagtggggccccagcatggccccagtgaagcagagcttctgcaggtgcatgaggggtgggggtcccagcaaagcagaacttctgcaggcaaggcgcatgaggggcaggggccaaggaggccctggccaggagggtggtgcctgctaacccaggggcgtgggcttctcatgcaggggagaccacgtacctatggcagcctgcgtcctcactccaagatttcccatttccttcaggtggacccgctgcaggtggaccccctgccccagccacaggaarcgtgagctagcgcccatagggtggaacacagaaacctcattactcctccccagcccactgcagagatgacgtgccaagggaaagcatgaattctctttgatgtcttcattgaaatcagaaataaaggactgagcgtgacagagccctgtggcatgccaccggagacctttctccagagtgctgaattcagtcaaacggcatcatttggatcctaccatttttaaatgattttttaaaaaatcatttaaaaaatttaaatttcacaaatttaaaatgcagtgttttgtttataaaagaaac

SEQ ID NO: 6231 - DNA, 601 bp, Human
attcccggggtctgacagagggaccggctgtgtgttgtcctccaagctaggctgaggggcctgggaacaggcactggggtgtcctgggtcccacacccctcacaacccagcactgcctctcccctgcctcctcagctgcgggtccactgagccctcggggccgggggtaagctggttccatctggagttagctctggaagcgtgcgtccagcttccggttctgtcttccaatccctcaccaccatcagttctcaagccccttcccagcaggaggcggaagcaaggccagcctcagttcacytatgtcctctctgttctctttgtacctgggtcgcagaagttgcccggtgcccaccacaggcatgagctgccctggtttgctggctatggatctcagcacccccagggcctgcacatgtccccatgttgtccctgggaagagcaggctgcacctgacaaccggtcccctgcccactgccccattcccaactctgccaaaagtggaagtggggccccagcatggccccagtgaagcagagcttctgcaggtgcatgaggggtgggggtcccagcaaagcagaacttctgcaggcaaggcgca

SEQ ID NO: 6232 - DNA, 601 bp, Human
aaacagtcacttgcacgaacgcctttatgattgtcgtcattcctgttgtgtgctggggtttcacagacctcctcttatgggggaaactaaggccccatgatgttaaattgctcaccaaaggtcccacgagtatggacaaagccagaatgaatggcagggacaaggtcccaccatccctgctctgtgagcacatgttctaccgtgccccccagctgagtgcaaagtgggctcccccaaggctggaggtctcttgttccaggcagggcttacagatcaaatctcatcacgacagagaaccacragagctggggcaggaggcgtgcacctcatttctctgccagaactcccatatcgttccagcattttgtttccagccatcttccccaaagcctgggaagctattcccagagagagccaagctgccagaacaggattctcaacttgagccttcccaggcatgagccagtgcaggcctgtggggaggcagaagaggggcctcctgctagaatctgaatgttgtgtcccccacatttgaaaggttgaaagctgagaaccaatgttatggtattaggaagtgtggtctttgagaggtcattaggtc

SEQ ID NO: 6233 - DNA, 601 bp, Human
gccgcacccgggctcccggggccccagcggccccaagacagcctctgggcctcaccctaaatacatcaattatgacctgagcaaaaagttctgttccaatcgttgctctccgacatttccattgtttgctctggaaggagctgaattatctatgctcttccctccttcagtcaaggagacgtgggaggaaaccgggatggggatcagcagcctggaggccgcctccgctggaaccgcgcccgccccgccaggaggctctgcctgctgggcaaggcgcactcagccagccccgcaggccgcyacgcgaccgaggctcaccaagtccactgcaggtggcaggtgaggtcacctgggcagctctaggcccggccgaaatatctcatctgctctgttcttgggcaagttaccttacttgtccccacctgcaaaatgggcacaactgcagctccgagcttggagctggggggcttccgcccatgacagttcaggcagggtgcagtcagcgcccacaaatgtcccttgtccttgtctctgccgtgctgttgatactgatggagtataacaccagtccctggggactggcctacccgctggggctggc

SEQ ID NO: 6234 - DNA, 601 bp, Human
gacgagtaggctgcgtccagctccaagtcccagccccatcctggccgcgggaccctggctctgagctgcccgccgggtccctcctcctgcgtgcgatcggtcacctgccagatggggcacctactggggatgtgcctgttgctgtcgctggcctctgagtcactaaagcctaagctccttgagggccgggtggttgctgggcccgagtctgtgccccagccctggcccacgcctgccctcagtagccccactcctcccttcacggagcaatcccggcttctgctctccatgccaggatgasgcagcgaacgcggccagaggaccccggctgctgggcgctcagtgatgaaggaatgaacacgagcaccctcaggagccaggctgggcagggagggaggcgccggctgcggggacgttctcgggaggcctggggaagtgagcccaaagggccgccccggcagatgctgaccccagcaggaagtcaccgtccgcaaggagcgccccgctaggctcaggcttggcacacgacacctcgcttccacttcattttcctaccttccggatgacgaactgcgtctcagacaactgaaaggactcgcct

SEQ ID NO: 6235 - DNA, 601 bp, Human
ggagagggcagatctgagggccttagggaggcaagagcttgatggccctcaccttgggtcagaaggtcactttgctgaatgctccccagggctgtcaggaggcttggccagggcaagggtgaggaaacactgcgggcccctgaacctcaggcccagcctgcaggggtctgggtaaccccacgggcctcagggaacagccaggagcttagggggcccgtgggccttgggtggacgagtaggctgcgtccagctccaagtcccagccccatcctggccgcgggaccctggctctgagctgccygccgggtccctcctcctgcgtgcgatcggtcacctgccagatggggcacctactggggatgtgcctgttgctgtcgctggcctctgagtcactaaagcctaagctccttgagggccgggtggttgctgggcccgagtctgtgccccagccctggcccacgcctgccctcagtagccccactcctcccttcacggagcaatcccggcttctgctctccatgccaggatgaggcagcgaacgcggccagaggaccccggctgctgggcgctcagtgatgaaggaatgaacacgagcaccctc

SEQ ID NO: 6236 - DNA, 601 bp, Human
tgggctggccgtggacagggcaaggccctcgctactggaggcagtcggaacccaagggaagagccaagctcaggtctctccgctgagacctccagccaaggatactgtcctgacatgcagtgaactcccctgtgggtcacttgggctccagcgggaccacctgctgggatgcgacctcctttgctcctctgccacctggcctgcatgcaggaggccagatgggtccctgctgcctggggcaccccagcccccaccatcctgtgcccttgctatgtatcaagcctgggaactgtgcttcccytgagcgagaagaagacacatttctcatatatggatctcctccagaagtgagggaggctgcactgcttgtttccactgaggagtctttcaccagctcgccctggtcatctacgtccctcccagtcctgaatgcacctgacttccagctgcctgctcggctctgcacggctcctctaggaaagtctgtctgtgtgactccacctgttcctagctgtgctgagggggggaccaggagtgagccgtagcaccctgggctctgcaaagggggtggctgcaggaccagccagggactttacagggc

SEQ ID NO: 6237 - DNA, 601 bp, Human
ctgcttgtgcttcctctctctctctgccaacgtcccaacatctccaaggtcccagcctatctctgacgggcacagaggagcccaggggcagagatcttgtccttgctgggtctggagcattcaagggctatggggtacccatgaggcccagacattgaccttgtgcccagaggccagggcaaggtctgtgtgcattcttaaaacagccctttgggtcagtgaggaaggagtggggatagaaggggacagtgtggcactgagatgcatgcaggtgtggctggtgccacgtcaggagggtcargacctggtggcaggagctgagaggcatcagggctgcagggcgggagcaatgaggcagagacggcaccagtgtctggctttggggattggtagcaaggcagaagaggcggcgcgggaaggggacggcaagtgccagaggaagagcgtggggtccgcagtgcaggaaacatggtcacggcaatgtctttcctggccagcttgctcgttgggaagagctgggctgttttgctttgggagctctcccacttctgggggtgcagcccttgtgggtgatcagtcccaagccgtagctgggacccat

SEQ ID NO: 6238 - DNA, 601 bp, Human
gcaaacccaggtgcccaggcacagctgaagggagcaacatccgcccagtgctggcaggaacagaggcccagagctgctggatcagatttctcaggtcaatcgtgaaatctggattctacagacacctacctaatagtaaacactggctcaaattgaaatcagttatgcagacaaaacaacgcatcctccccgtcaccactttattccagaaccctggaataagagccctgcagtgggcagccccttctccacgtcctgcagactggatccactctggccgatcacctctctcctcccagaygctggcttctgtggttcagcctgggttcccagcccgtcttagcagccaaagtgatcttgctgctgcggcaagacaatttattgaaatattgatttgtgtttttgttcttgcctcgctttgttctcggcccagtccaagaaggcagcctgccactttcgttctccaaccccaaggaggttgtgctgcagggtccagagctaaaggggtctatgacccccttctggctttggggttctgaggagactccctgaggagggggcagaggggagggctggggtgcatgggcacagggaggggaag

SEQ ID NO: 6239 - DNA, 601 bp, Human
agacaacaagagaaggcacctcccctacagaagccacagtctgcttttgatagaatctcagtcccgcctaccgcagggcatggacattaagagactgggtcactggcggccatcacgaaggctgcctgccactgacgggtgtcatttatgcctgaagaagttcctctccttgtgaaagccaattctgagttgtgctcttgtcacttgcagcgaagagaatctgagccacgtgcttcctcctttgggggaccacagggaccccagtcaggacactcgctggcccatgaaagatggcgtctgrtctgggggcagctgatatgttctgggggcagtttatatgcttctcagtgggagaagggccctggccaagtctttgaggaggagtcaagagtccagccagaaagacatgccccaatatcaggaccagaggcaggaatgaggctagtgtgtaggacagagctgcgggaggagccaggctgaggcaggctgggggtgtgcagggaggtccgctatcctagtgtgtgggcttgtggggagtaccgggaggatgctagaaacccaagcgcctacaggagcaaggcaggtgacaagtcaatgaggc

SEQ ID NO: 6240 - DNA, 601 bp, Human
gagaaccgagagcccctctgagtcctgggcatgttcttttcccctttaaggatttatctggccataaaatagagatgtgcattccttggaagctacgtatgcaggtgttttttctcttgcataaatgtatccacaaagtagagccacgtatttctctttgtgtctataaataacaaaaagttggccgtgcgcggtggctcacacctgtaatcccagcactttgggaggctgaggcaggtggatcacctgaggtcaggagtttgagaccagcctggccaacatggtgaaaccctgtctctaytaaaaatgcaaaacttagtctggcttggtggcgtaatcccagcaacctgggaggctgaggaaggagaatcgcttgaacccgggaggtggaggttgcagtgagctgagatcacgccactgcactccagcctaggcgacagagtgagactccgtctcaaaacaaaacaaaacaaacaacaaagggtattgttagcaagccagttagttccagaagaagggagcacaattcaaggctaggtaagacaagtcgttcccaggggtcccagtcaatgactgacaagatggcagaccaattcccaag

SEQ ID NO: 6241 - DNA, 601 bp, Human; identical to SEQ ID NO: 3563

SEQ ID NO: 6242 - DNA, 601 bp, Human; identical to SEQ ID NO: 3564

SEQ ID NO: 6243 - DNA, 601 bp, Human; identical to SEQ ID NO: 3565

SEQ ID NO: 6244 - DNA, 601 bp, Human; identical to SEQ ID NO: 3566

SEQ ID NO: 6245 - DNA, 601 bp, Human; identical to SEQ ID NO: 3567

SEQ ID NO: 6246 - DNA, 601 bp, Human; identical to SEQ ID NO: 3568

SEQ ID NO: 6247 - DNA, 601 bp, Human; identical to SEQ ID NO: 3569

SEQ ID NO: 6248 - DNA, 601 bp, Human; identical to SEQ ID NO: 3570

SEQ ID NO: 6249 - DNA, 601 bp, Human; identical to SEQ ID NO: 3571

SEQ ID NO: 6250 - DNA, 601 bp, Human; identical to SEQ ID NO: 3572

SEQ ID NO: 6251 - DNA, 601 bp, Human; identical to SEQ ID NO: 3573

SEQ ID NO: 6252 - DNA, 601 bp, Human; identical to SEQ ID NO: 3574

SEQ ID NO: 6253 - DNA, 601 bp, Human; identical to SEQ ID NO: 3575

SEQ ID NO: 6254 - DNA, 601 bp, Human; identical to SEQ ID NO: 3576

SEQ ID NO: 6255 - DNA, 601 bp, Human
tccattgttgaccaaacagtcattttgcagcacatgactctatttatccatctgaccgctggctgcggtcagccctagggatcactaacccatcccaataggccccaggaaagagaaaaccacattcccgctcactgtattagagatggggttcccagcaggaaacagagcgaaccctgggaggccaattgaagagattttatgaagggactgcttcagagaggtgggctcctttaaggaaaccaaccactgcctgcacagaggtgggctcggatgttgaggtacccagagaccagcaacrgcacttctgcctggaattcccttccctctcctgtcagtcctgtggctggcactcagatgtgggctgaaacgtccgctctcccagaggccttcctggcctcacaggctcagccagctgccccctcactctctgcagcacctcccattgtaattccctgaacatctctgatcgccagctgatacgtttcctcattgacttatttattttcctgttgttcccattactgcagactccccaagggagtgtgtcttacttactgcggcacccccattgcctagcatggagcccatcatgcagtag

SEQ ID NO: 6256 - DNA, 601 bp, Human
tcatcccaggagttgcaggtcagtaacacagggaccccagagggtggagagatagagtcagggctgagagaacatgctaatggccaaggtcacagcctgcactcctcgtggggctgtagagaaaacccctgttcctggaattcagaatgaagccaggccttgatctctgggtgatccacatccctaccccacagacctgccttcaagagtgtgcaacctgtgcaactgtacagggcttgcacttcaaagggcatcatccttggtttaatgttctgtcgccttcttaaaattcttttgcackgggccacacaaattatgaagccattcctatgaacccagaccctcaactcaccaccccacccacccctgctcttctgacagcaaagctgaccactcactgtaagatctggagtgaagggctggccctcagggttaagacagttggattttcctaagagccttctgaagacagaatcaaggcaaaattgtcaaaggggctttcaggcaggaggatgtttgccgagagaaggctttaaatcttaccccatagcagctgctgggacaagggaagtcaggaggaaaggatttgaacttccgggcc

SEQ ID NO: 6257 - DNA, 601 bp, Human
gtgcaacctgtgcaactgtacagggcttgcacttcaaagggcatcatccttggtttaatgttctgtcgccttcttaaaattcttttgcactgggccacacaaattatgaagccattcctatgaacccagaccctcaactcaccaccccacccacccctgctcttctgacagcaaagctgaccactcactgtaagatctggagtgaagggctggccctcagggttaagacagttggattttcctaagagccttctgaagacagaatcaaggcaaaattgtcaaaggggctttcaggcaggargatgtttgccgagagaaggctttaaatcttaccccatagcagctgctgggacaagggaagtcaggaggaaaggatttgaacttccgggccagacaaccttggttcaaatcctggctgtgctccttacagtttgggtgatttcaggaatgttctgaaacctctctgttcctcttctgcaaaatgagggttataattacaccaacctggaagatgatggggaagattaaatagataagatatataaagtgcttgaaacagtgccaggcaaaaaataaatgcttgataaagattagctatcag

SEQ ID NO: 6258 - DNA, 601 bp, Human
agagtggtggaagaaattttagggaaaggacgcaaaccttcttgaaaggtcagaaggttttgcatagcttcggggaagaataagcagaaggcagctgttctaccctgaggcagagggtgaggagtaggtacaaggaagtgtagggaaatttatcttaaatgcgcttgtttactcatgttgtcctaaaaccgacctttcatccagtgcatgactgctccctgaaagggggaacaataatgttaattacccgcagattgtgtttgccccaggcttttggcattatatctagctgctcttatgygaaatacctgtgtctaagtactcctttcatcgtcactggccagaatctgaatgtgtctcctctttccccagatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaag

SEQ ID NO: 6259 - DNA, 601 bp, Human
aaggtcagaaggttttgcatagcttcggggaagaataagcagaaggcagctgttctaccctgaggcagagggtgaggagtaggtacaaggaagtgtagggaaatttatcttaaatgcgcttgtttactcatgttgtcctaaaaccgacctttcatccagtgcatgactgctccctgaaagggggaacaataatgttaattacccgcagattgtgtttgccccaggcttttggcattatatctagctgctcttatgtgaaatacctgtgtctaagtactcctttcatcgtcactggccagartctgaatgtgtctcctctttccccagatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaaggtaaggctcaagccccaggacaggagaagccatcagcagctggcc

SEQ ID NO: 6260 - DNA, 601 bp, Human
atgaagagaaaaacacctcacttccccatcatgtaggcaaggtaaggctcaagccccaggacaggagaagccatcagcagctggcccatagtgacaagtggtggtggtgatggcgatggtggcaaaggtggtaatagatattgtggtggttgtaggagtggagatgataagggtgaaggtggtagcaatagtggtagaggtcgtggtggtagaagtagtggtggtaatggtagcaatggtggtggtagtgatagtgatggtggtgaggatgggaaaggccaaggtggtggtgggagtggtsagaatggtggtggtggtagtgatgataaaggggtaggtggtggttgtgatggtggtgatggtggtggtggctgtgatggtggtgatcacggtgatggtggtgatgataaaggggtaggtgttggtggtgatcacggtgatggtggtgatgataaaggggtaggtggtggtggtgatcatggtgatggtggtgatgataaaggggtaggtggtggtggtgatcatggtgatggtggtgatgataaaggggtaggtggtggtggtgatcacggtgatgcgtggtgatgataaaggggtaggt

SEQ ID NO: 6261 - DNA, 601 bp, Human
aattagccgagcttggtggtgcacacttgtagtcccagctactccggagtacctgtctcaaaaaaaaaaaaaaaaaaaaaagaggctgggcgtggtggctcacacctgtaatcacagcactttgggaggccaaggcaggcagatcacttgaggtcaggagtttgagaccagcctggccaacatggtgaaaccctgtctctactaaaaatagaaaaattagccaggcacggtggcacatgcctataatcccagctactcaggaggctgaggcagaataatcgcttgaacccaggaggcggargttgcagtgagccaagatcgtgccactgcactccagcctgggcaacagagctaaactcaaaaaacaaacaaacaaacaaaaaagcaatgttgcacttcctcagcatgccagcctctgaggctgcaaacctagatcctgagagccacaatgggatctgtaccctctgtactcctagtgggggcctggcacctcccaggcaccaagttatattttttaattgaatagaattctattttggggacatactaaccttctatgagagtatcattgtatatgcatagaatactattctataggaac

SEQ ID NO: 6262 - DNA, 601 bp, Human
tgaggtcaggagtttgagaccagcctggccaacatggtgaaaccctgtctctactaaaaatagaaaaattagccaggcacggtggcacatgcctataatcccagctactcaggaggctgaggcagaataatcgcttgaacccaggaggcggaagttgcagtgagccaagatcgtgccactgcactccagcctgggcaacagagctaaactcaaaaaacaaacaaacaaacaaaaaagcaatgttgcacttcctcagcatgccagcctctgaggctgcaaacctagatcctgagagccacaatgggatctgtaccctctgtactcctagtgggggcctggcacctcccaggcaccaagttatattttttaattgaatagaattctattttggggacatactaaccttctatgagagtatcattgtatatgcatagaatactattctataggaactataccgttcctaatattttctgtttctatgattctttaaatggagatcctctaacctgtggctctattattgataattattagctagcatttatagaaccctgtttggtgtaagatgctttacatatattattttccaaatcttact

SEQ ID NO: 6263 - DNA, 601 bp, Human
accataaacacagataacctcaaaacacagtcaaaggtagcaaaacaattcggaagcgatgaattctgagaattcgttgtttttcatgatttatttaattgtaagttcatataatttaatttgtaatagtggctgtatttaacaatcagctcacaaatattcctgaaaatttaagctggttcttgaaagccaagctgatacaatccagcgccagcacaccactggctaggaccccatctttgcgtggaacagcagaagagttcagtgtttcccagaactcatcttcaaaagtgctgttctmctcctcagagcaaagcaacatcagaagcaatatttccattttacaaatgaggcaactaaaacttagagaggttaagtgacttctacggggcaaaaatatcctttgccttccaatggcaccaggtatattttttccactcaaaaaatgttttctaagcacctactctgttcaggcaccattctaggcatgctggggctctgccaggcaactcacaccatgagaacaactcattggtgactagtcagaggttcttttttttttttggctttttaaaaattttattttcaggggtacatgtcc

SEQ ID NO: 6264 - DNA, 601 bp, Human
gatttatttaattgtaagttcatataatttaatttgtaatagtggctgtatttaacaatcagctcacaaatattcctgaaaatttaagctggttcttgaaagccaagctgatacaatccagcgccagcacaccactggctaggaccccatctttgcgtggaacagcagaagagttcagtgtttcccagaactcatcttcaaaagtgctgttctactcctcagagcaaagcaacatcagaagcaatatttccattttacaaatgaggcaactaaaacttagagaggttaagtgacttctacrgggcaaaaatatcctttgccttccaatggcaccaggtatattttttccactcaaaaaatgttttctaagcacctactctgttcaggcaccattctaggcatgctggggctctgccaggcaactcacaccatgagaacaactcattggtgactagtcagaggttcttttttttttttggctttttaaaaattttattttcaggggtacatgtccatgtttgttacatgtatattgcatattcgtggggattgggcttctagcatacccattacccaaatagtgaacattatggccaatagg

SEQ ID NO: 6265 - DNA, 601 bp, Human
caggggtacatgtccatgtttgttacatgtatattgcatattcgtggggattgggcttctagcatacccattacccaaatagtgaacattatggccaataggttatttgtctaccctcgccctcatcccaacctcccctcttttggagtctccagtgtctattatttccatttttatggccatatgtaccaattgtttagctcctacttataagtgagaatatgtggtattggatttgttgcttctgggttagttcacttaggttcatttaggattatggcctgcagctctatccatgttsctgcaaaggacatgattttattcttttttatggctgccagaggttcttgataaaaaatctcagtatcatatttagggaccctggccagcaccacacacaccacatacacacatgcacaggcacacctgtgtacacacactctcactcacacactcacacacagccactgccgcccattcccagctcacgtcacctcttcttttctagatcaagtcaagcgtgagtcgcaagaatgccaagtacctgctcaaaggagaatatgtgggcaaggtcttccgggtcgatgcagagacaggagac

SEQ ID NO: 6266 - DNA, 601 bp, Human; identical to SEQ ID NO: 1815

SEQ ID NO: 6267 - DNA, 601 bp, Human; identical to SEQ ID NO: 1816

SEQ ID NO: 6268 - DNA, 601 bp, Human; identical to SEQ ID NO: 1817

SEQ ID NO: 6269 - DNA, 601 bp, Human; identical to SEQ ID NO: 1818

SEQ ID NO: 6270 - DNA, 601 bp, Human; identical to SEQ ID NO: 1819

SEQ ID NO: 6271 - DNA, 601 bp, Human; identical to SEQ ID NO: 1820

SEQ ID NO: 6272 - DNA, 601 bp, Human; identical to SEQ ID NO: 1821

SEQ ID NO: 6273 - DNA, 601 bp, Human; identical to SEQ ID NO: 1822

SEQ ID NO: 6274 - DNA, 601 bp, Human; identical to SEQ ID NO: 1823

SEQ ID NO: 6275 - DNA, 601 bp, Human; identical to SEQ ID NO: 1824

SEQ ID NO: 6276 - DNA, 601 bp, Human; identical to SEQ ID NO: 1825

SEQ ID NO: 6277 - DNA, 601 bp, Human; identical to SEQ ID NO: 1826

SEQ ID NO: 6278 - DNA, 601 bp, Human; identical to SEQ ID NO: 1827

SEQ ID NO: 6279 - DNA, 601 bp, Human; identical to SEQ ID NO: 1828

SEQ ID NO: 6280 - DNA, 601 bp, Human; identical to SEQ ID NO: 1829

SEQ ID NO: 6281 - DNA, 601 bp, Human; identical to SEQ ID NO: 1830

SEQ ID NO: 6282 - DNA, 601 bp, Human; identical to SEQ ID NO: 1831

SEQ ID NO: 6283 - DNA, 601 bp, Human; identical to SEQ ID NO: 1832

SEQ ID NO: 6284 - DNA, 601 bp, Human; identical to SEQ ID NO: 1833

SEQ ID NO: 6285 - DNA, 601 bp, Human; identical to SEQ ID NO: 1834

SEQ ID NO: 6286 - DNA, 601 bp, Human
ggggaaaaaatgacaacataaaactcactgtcttcataaatgaatctttattaatgctgtcaggtcttaacaaatgagagtgtgacactaataggattaagtaacttttgacttcattactattatcagagtcttggttagtgttcatcgtccactaatgccttttgttaaatatatctgttattaaaaatcccacagtatggatggacacttatggaacataagttggacatcgtaaatagttcaattctggagtttataaattgaggctctgaagaacaaatgtgttcccaaatctgartgatctactcacatcatgcctcttaacttaatattaccaactaactataagaagcaccactaaattttatgttattagatacagatttattgatctgttatttcattgtccactgtatctaagtaaaaataaatttgaacttaatattattcttgccaaaggaaatgacttaaatcctaaaataaaaacatatttttataagacaaaattaattggtatagaattatttaatgaaaacatgaggttgtattacacagatctaattgtctttaacaactttgatcaatgctaataatctaa

SEQ ID NO: 6287 - DNA, 601 bp, Human
ctaataggattaagtaacttttgacttcattactattatcagagtcttggttagtgttcatcgtccactaatgccttttgttaaatatatctgttattaaaaatcccacagtatggatggacacttatggaacataagttggacatcgtaaatagttcaattctggagtttataaattgaggctctgaagaacaaatgtgttcccaaatctgaatgatctactcacatcatgcctcttaacttaatattaccaactaactataagaagcaccactaaattttatgttattagatacagatktattgatctgttatttcattgtccactgtatctaagtaaaaataaatttgaacttaatattattcttgccaaaggaaatgacttaaatcctaaaataaaaacatatttttataagacaaaattaattggtatagaattatttaatgaaaacatgaggttgtattacacagatctaattgtctttaacaactttgatcaatgctaataatctaagattataaatatcccaatgtgggtagttttcttggcataaattattctttttgtctacactgatttatattgattatataacaacac

SEQ ID NO: 6288 - DNA, 601 bp, Human
tatcagagtcttggttagtgttcatcgtccactaatgccttttgttaaatatatctgttattaaaaatcccacagtatggatggacacttatggaacataagttggacatcgtaaatagttcaattctggagtttataaattgaggctctgaagaacaaatgtgttcccaaatctgaatgatctactcacatcatgcctcttaacttaatattaccaactaactataagaagcaccactaaattttatgttattagatacagatttattgatctgttatttcattgtccactgtatctaartaaaaataaatttgaacttaatattattcttgccaaaggaaatgacttaaatcctaaaataaaaacatatttttataagacaaaattaattggtatagaattatttaatgaaaacatgaggttgtattacacagatctaattgtctttaacaactttgatcaatgctaataatctaagattataaatatcccaatgtgggtagttttcttggcataaattattctttttgtctacactgatttatattgattatataacaacactgctgtggagacactctcttagtgaactgaagtgtg

SEQ ID NO: 6289 - DNA, 601 bp, Human
tatgtgtgtgtgtgtgtgtgtgtgtgtgtgtgtgtgtgtatcttttttctttctttttctttgtgagacacagccttgctctgtcgcccaggctagagtgcagtggcacgatctcggcttactgcaacctccacctcctgagttcaattgattctcctaccttagcctcccgagtagctgggactacagacgtctgccacaaagcttggctaattttgttgttgttattgtatttttagtagagacagggtttcaccattttggccaggggctcaaactcctgacctccagtgatcctccygcctcggcctcctgaaatgtcatggttacaggcatgagccatcacacttggccatatttattatgttataagaacattttatcttaaattgatcatgctgccattaagaaaatggaattatttaaagttttattgtctcagaaaagttaaaattttatatctatttttagtagatttttaccaagcactctcattaacttatgatatcttattttgttactaggtttgcaattatggcagttaatactttttgccaacatttatctgcacaatcattttgagactggaaataaaacgttt

SEQ ID NO: 6290 - DNA, 601 bp, Human
gctagagtgcagtggcacgatctcggcttactgcaacctccacctcctgagttcaattgattctcctaccttagcctcccgagtagctgggactacagacgtctgccacaaagcttggctaattttgttgttgttattgtatttttagtagagacagggtttcaccattttggccaggggctcaaactcctgacctccagtgatcctcccgcctcggcctcctgaaatgtcatggttacaggcatgagccatcacacttggccatatttattatgttataagaacattttatcttaaattratcatgctgccattaagaaaatggaattatttaaagttttattgtctcagaaaagttaaaattttatatctatttttagtagatttttaccaagcactctcattaacttatgatatcttattttgttactaggtttgcaattatggcagttaatactttttgccaacatttatctgcacaatcattttgagactggaaataaaacgttttgatgacaatggtaattcttgtgctagttgtggtaattacctaagtctttctattatcttaattctcaaacttgttatctgtgcctacaat

SEQ ID NO: 6291 - DNA, 601 bp, Human
catatgttgaaccatccttgtttaccaggggtacatcccacttggttatgatgaatgatctttctaatgtattgttgaatttggtttgctagtatttttgttgaggatttttgcattaatagtcatcaaagatatttgcttgtagttttctctttttattatcatttttaagttccagggtacatgtgcaggatgtgcagttcattacataggtaaatgtgtgccgtggtgatttgctgcacctatcaacccatcatgtaggtattaaacacagcatgcattagctagttagctgatgctstccttccctaactggcctcagtgtgtggtgttcccctccctgtgtccatgcgttctcgttgttcagatcccacttataagttagaacatgtggtgtttgattttctgttcctgtgttagtttgcggaggataatggcttccatctccacccatgttactgcaaaggacatgatctcatttctttttgtggctgcatagtattccattatgtatatgtaccaaattttctttatccagtctatcattgattggcatttgcgttgattccacatctttgctattgtgaatagtgctgcaatg

SEQ ID NO: 6292 - DNA, 601 bp, Human
gttcccctccctgtgtccatgcgttctcgttgttcagatcccacttataagttagaacatgtggtgtttgattttctgttcctgtgttagtttgcggaggataatggcttccatctccacccatgttactgcaaaggacatgatctcatttctttttgtggctgcatagtattccattatgtatatgtaccaaattttctttatccagtctatcattgattggcatttgcgttgattccacatctttgctattgtgaatagtgctgcaatgaacatacatgtgcatgtatctgtatcgtgsaataatgtatattcccttgggtatatacccagtaatgggattgctgggtcaaatggtatttctggtcctaggttatattagtctgttctcatgctgctaataaagacatacccaagactgggtaatttataaagaaaaatagggttaattgactcacacagttccacgttgctggagaggcctcacaatcatggcacaaggcaaaggaggagaaaggcaggacttacatggaggctggcaagagagagcgtgttcaggggagctcccttttataaaaccatcagatctcatgagacttat

SEQ ID NO: 6293 - DNA, 601 bp, Human
agaacatgtggtgtttgattttctgttcctgtgttagtttgcggaggataatggcttccatctccacccatgttactgcaaaggacatgatctcatttctttttgtggctgcatagtattccattatgtatatgtaccaaattttctttatccagtctatcattgattggcatttgcgttgattccacatctttgctattgtgaatagtgctgcaatgaacatacatgtgcatgtatctgtatcgtgcaataatgtatattcccttgggtatatacccagtaatgggattgctgggtcaartggtatttctggtcctaggttatattagtctgttctcatgctgctaataaagacatacccaagactgggtaatttataaagaaaaatagggttaattgactcacacagttccacgttgctggagaggcctcacaatcatggcacaaggcaaaggaggagaaaggcaggacttacatggaggctggcaagagagagcgtgttcaggggagctcccttttataaaaccatcagatctcatgagacttattcactatcacaagaacagcacaagaaagaaatgcttccatgattcaattacct

SEQ ID NO: 6294 - DNA, 601 bp, Human
gcatttgcgttgattccacatctttgctattgtgaatagtgctgcaatgaacatacatgtgcatgtatctgtatcgtgcaataatgtatattcccttgggtatatacccagtaatgggattgctgggtcaaatggtatttctggtcctaggttatattagtctgttctcatgctgctaataaagacatacccaagactgggtaatttataaagaaaaatagggttaattgactcacacagttccacgttgctggagaggcctcacaatcatggcacaaggcaaaggaggagaaaggcaggwcttacatggaggctggcaagagagagcgtgttcaggggagctcccttttataaaaccatcagatctcatgagacttattcactatcacaagaacagcacaagaaagaaatgcttccatgattcaattacctcacaccaggttcctcccatgacacatgggaattatgggagctgcaatttgaaatttgggtggggacacagtgaaaccatatttttctgcccctggcccctcccagaactcatgtcatcacattttaaagccaatcatagcttcccaactgtcctccaaagtcttaactt

SEQ ID NO: 6295 - DNA, 601 bp, Human
tgaatagtgctgcaatgaacatacatgtgcatgtatctgtatcgtgcaataatgtatattcccttgggtatatacccagtaatgggattgctgggtcaaatggtatttctggtcctaggttatattagtctgttctcatgctgctaataaagacatacccaagactgggtaatttataaagaaaaatagggttaattgactcacacagttccacgttgctggagaggcctcacaatcatggcacaaggcaaaggaggagaaaggcaggacttacatggaggctggcaagagagagcgtgtkcaggggagctcccttttataaaaccatcagatctcatgagacttattcactatcacaagaacagcacaagaaagaaatgcttccatgattcaattacctcacaccaggttcctcccatgacacatgggaattatgggagctgcaatttgaaatttgggtggggacacagtgaaaccatatttttctgcccctggcccctcccagaactcatgtcatcacattttaaagccaatcatagcttcccaactgtcctccaaagtcttaacttatttcaacattaactcgaaagcccaagtccaa

SEQ ID NO: 6296 - DNA, 601 bp, Human
atacatgtgcatgtatctgtatcgtgcaataatgtatattcccttgggtatatacccagtaatgggattgctgggtcaaatggtatttctggtcctaggttatattagtctgttctcatgctgctaataaagacatacccaagactgggtaatttataaagaaaaatagggttaattgactcacacagttccacgttgctggagaggcctcacaatcatggcacaaggcaaaggaggagaaaggcaggacttacatggaggctggcaagagagagcgtgttcaggggagctcccttttatraaaccatcagatctcatgagacttattcactatcacaagaacagcacaagaaagaaatgcttccatgattcaattacctcacaccaggttcctcccatgacacatgggaattatgggagctgcaatttgaaatttgggtggggacacagtgaaaccatatttttctgcccctggcccctcccagaactcatgtcatcacattttaaagccaatcatagcttcccaactgtcctccaaagtcttaacttatttcaacattaactcgaaagcccaagtccaaagtctcatgtgagataaggc

SEQ ID NO: 6297 - DNA, 601 bp, Human
atatacccagtaatgggattgctgggtcaaatggtatttctggtcctaggttatattagtctgttctcatgctgctaataaagacatacccaagactgggtaatttataaagaaaaatagggttaattgactcacacagttccacgttgctggagaggcctcacaatcatggcacaaggcaaaggaggagaaaggcaggacttacatggaggctggcaagagagagcgtgttcaggggagctcccttttataaaaccatcagatctcatgagacttattcactatcacaagaacagcacargaaagaaatgcttccatgattcaattacctcacaccaggttcctcccatgacacatgggaattatgggagctgcaatttgaaatttgggtggggacacagtgaaaccatatttttctgcccctggcccctcccagaactcatgtcatcacattttaaagccaatcatagcttcccaactgtcctccaaagtcttaacttatttcaacattaactcgaaagcccaagtccaaagtctcatgtgagataaggcaagccccttccacctatgagcctataaaatcaatagcaagttactttct

SEQ ID NO: 6298 - DNA, 601 bp, Human
aatttataaagaaaaatagggttaattgactcacacagttccacgttgctggagaggcctcacaatcatggcacaaggcaaaggaggagaaaggcaggacttacatggaggctggcaagagagagcgtgttcaggggagctcccttttataaaaccatcagatctcatgagacttattcactatcacaagaacagcacaagaaagaaatgcttccatgattcaattacctcacaccaggttcctcccatgacacatgggaattatgggagctgcaatttgaaatttgggtggggacacagygaaaccatatttttctgcccctggcccctcccagaactcatgtcatcacattttaaagccaatcatagcttcccaactgtcctccaaagtcttaacttatttcaacattaactcgaaagcccaagtccaaagtctcatgtgagataaggcaagccccttccacctatgagcctataaaatcaatagcaagttactttctagatacaatgggtgtacagggtaaatacacccattccagatgggagaaattggccaaaataaaggggctacaggccccataaaagtctgaaatccaatagg

SEQ ID NO: 6299 - DNA, 601 bp, Human
aatgctttgctgcttagaaatttcttctgccggataccctaaatcatctctctcaaattcaaagttccacaaatctctagggcagggacaaaatgccaccagtctcttcactaaaacatagcaagagtcacctttgctccagttcccaacaagttcctcatctccatctgagaccacctcagcctggactttattgtccatttcactatcaacattttggtcaaagtcattcagcaagtctctaggaggttccaaactttcccacatcttcttgtttatttaggatccctctaaactgttmcagtctctgcctgttactcagttgcaaagtcatttccaaattttggggtatctttacagcagcaccccactctaccagtaccagtttactgtatcagtccattctcacatggctagtacagacatacccgagactgggtaatttataaagaaaaagaggtttaatgaatccacagtttacaacaacagtgtaaaagcttttctatttctccacagcctggccggaatctgtattttgtggacattttaataatcgtcattctgactgtcctgagatagtatctcattgtgattttggttt

SEQ ID NO: 6300 - DNA, 601 bp, Human
ccaaaggctcttaagtcagcttgtggtgattgctgcctggcatgggactcacccttcagggtaatgggctcccctctgttccagcacaggtccagaaatgctacccaagggtcgtgtcctggaattgaggaccccaaaagcccacttggtgctctgctcccctgttgccatgctggtacctgaagccagctgtctagaaatgtcatctgggagctagggcctggaatgggggcctcatgactctatccagtgccttatcctgctgtggctgagctggtatccgggatgtaaaagagagacmtcctcactcttacctctcctttccctaagtagaagaaaggtgtctcttttggagccatgaactgtgcagccttgggttaggggacaggggatgcttccccagctgatgtctcagtatgctgcatgccaccctagtccactgtcctatgcccagttctgccttaggccttgcctaagagttgtagtccttatggtctaggctgccttttaagtttacttagagacctagagcactttggcccttggtggcaaggtttgtgagaattcaaatttggaccactgggatcagtggttccccacc

SEQ ID NO: 6301 - DNA, 601 bp, Human
aagtcagcttgtggtgattgctgcctggcatgggactcacccttcagggtaatgggctcccctctgttccagcacaggtccagaaatgctacccaagggtcgtgtcctggaattgaggaccccaaaagcccacttggtgctctgctcccctgttgccatgctggtacctgaagccagctgtctagaaatgtcatctgggagctagggcctggaatgggggcctcatgactctatccagtgccttatcctgctgtggctgagctggtatccgggatgtaaaagagagacctcctcactcttmcctctcctttccctaagtagaagaaaggtgtctcttttggagccatgaactgtgcagccttgggttaggggacaggggatgcttccccagctgatgtctcagtatgctgcatgccaccctagtccactgtcctatgcccagttctgccttaggccttgcctaagagttgtagtccttatggtctaggctgccttttaagtttacttagagacctagagcactttggcccttggtggcaaggtttgtgagaattcaaatttggaccactgggatcagtggttccccaccagatagggctgg

SEQ ID NO: 6302 - DNA, 601 bp, Human
cctgaagccagctgtctagaaatgtcatctgggagctagggcctggaatgggggcctcatgactctatccagtgccttatcctgctgtggctgagctggtatccgggatgtaaaagagagacctcctcactcttacctctcctttccctaagtagaagaaaggtgtctcttttggagccatgaactgtgcagccttgggttaggggacaggggatgcttccccagctgatgtctcagtatgctgcatgccaccctagtccactgtcctatgcccagttctgccttaggccttgcctaagarttgtagtccttatggtctaggctgccttttaagtttacttagagacctagagcactttggcccttggtggcaaggtttgtgagaattcaaatttggaccactgggatcagtggttccccaccagatagggctggtttaaatgctccctctgtgggcgattgtcagctgcgtttggtctggtatttctttctgctctaacagaacagcactgagttcaatggctcacaattgctgtattcttcctcccccagtgcccagagaagctctctgtaccatgaggccactgcagcagttggggga

SEQ ID NO: 6303 - DNA, 601 bp, Human
gatatctcaccaaaattttgttgaaaattatttatgtcttaacctgtgggcaactcctgttcaaatcccgtggacaatattaagtttaaatatgtttgctcagcaagtctttgtagaactctaaaaatctggaaaaatgggggttatgcatgcaatcacctggctaatcatagattctttttaaagaaaaacatgatgtcttaggatagtacagttcaatagaatttgtgcaataatgaaaatgttctacatctgcagtgtccaacgtagtagctactggccacatggagctgttgagaayttaaaatatgggtagtgcaagtaggaactgatgttttaaattaatctaattcatttaatttaaatctaaatttaaatgctcctttggggctaattaccatcatattgaacagagtagttgtgaaagacagaatagcaatggtgacattatccattaactaatatgtacatttcattatcaccttgagaattagaaaaatatatttttaagattattgccatttcacataaagtaattaaaagacagtgagtatgctgatcttggatttttcatctgacacaagcttgccttaatttgctt

SEQ ID NO: 6304 - DNA, 601 bp, Human
acatattcgttttcccagatgtattgtattcataaattggataattggctccgaaacttaagaactttggaacattttccttgttctttttatattatattatctttgtttctgtttatgcaacctctaataataacttacaatttccccatatagctcttattaaaaatgtagtgattctcttaatgtaaatccgttagtgtcaataccatcattaaatccatagttattgatttttctttcaccttaactagaacttaccttttatcacattagtaaaatatgtttactcaccaccatraccttggcatctaggagaatgctctcactatattagccactcagtattggaatgtcaaggattaaaagaatagtattaagtgccatggattttatgaagtacaatttagaaactattttttctacccataaatagacattttggatttgaaccttcctaaaaacctcttagaatatcattacaaaaattaaattatcattaatcactaaatttgtttagatcaaattatagtagtatgttatggtatttacttacattcaatgttgtcatgaaattctattttttcttaaaatatgcagt

SEQ ID NO: 6305 - DNA, 601 bp, Human
gatttttctttcaccttaactagaacttaccttttatcacattagtaaaatatgtttactcaccaccataaccttggcatctaggagaatgctctcactatattagccactcagtattggaatgtcaaggattaaaagaatagtattaagtgccatggattttatgaagtacaatttagaaactattttttctacccataaatagacattttggatttgaaccttcctaaaaacctcttagaatatcattacaaaaattaaattatcattaatcactaaatttgtttagatcaaattatartagtatgttatggtatttacttacattcaatgttgtcatgaaattctattttttcttaaaatatgcagtatatcaaataatagattttgcttgctaattttcaaatataaatacgtataacatgaaaatgtttttcttactatataatcaaggaaaagccaggttgattattgctctatctgagtaaaataggaatagaatgctcacgtttattgtatgaattaaaaacaaaataactaatatactttggttagctcttgtgaaatgtttttttaaataacgttggaacaaactaatgat

SEQ ID NO: 6306 - DNA, 601 bp, Human; identical to SEQ ID NO: 3691

SEQ ID NO: 6307 - DNA, 601 bp, Human; identical to SEQ ID NO: 3692

SEQ ID NO: 6308 - DNA, 601 bp, Human; identical to SEQ ID NO: 3693

SEQ ID NO: 6309 - DNA, 601 bp, Human; identical to SEQ ID NO: 1309

SEQ ID NO: 6310 - DNA, 601 bp, Human; identical to SEQ ID NO: 1310

SEQ ID NO: 6311 - DNA, 601 bp, Human; identical to SEQ ID NO: 1311

SEQ ID NO: 6312 - DNA, 601 bp, Human; identical to SEQ ID NO: 1312

SEQ ID NO: 6313 - DNA, 601 bp, Human
tgggaaaaaaataagtgtgcattacaacgtctagtggaagagtttaaaggatagattttcatttatatttaggaaagaatgtttctcttgccttcctggatttgctccatagcaaaagacataaatacatattgtaattataaattgtgcattgtaattataagttgtaaattctactacaaaggtcagctatggttagattcagtgagttttaccttaaaatattggcttaaaacaattcaaatcaaatggataaaacaactttttgctttccaatggcattatgattttgggtggtatrggaagagaagttctcaaaccaatagtcttcaaggttgcagagagaagcttctgtctgccactttcctgatgtactgaatggcccttggtatatctttataaaaatgttaaaacccacagagctatttaaagataaaaaaaaccttacataactttatttttcaaagactaatatgtctcaggtacatttagctacagtacaaaggataagaaaatagcacctaggaattttttaggttgtagagaatctcaactgctttaccttttgtattttctctccacttctctagcaaagaagaca

SEQ ID NO: 6314 - DNA, 601 bp, Human; identical to SEQ ID NO: 983

SEQ ID NO: 6315 - DNA, 601 bp, Human
agaactcagagatggttgtgaatgcaagcccctggaagcctggaaaggcacctttgccaccgtgtcccggagccgtcttgattcaggttcctcacggtcacctttatccccaagccccataacctctgagcccttggtagcagctttcatggggctcacttacctaccttgtgtcatcggcacctcaaaaatgaagtgcagacgagggtagtaaacctgaggggtggaatgtctttcagaccaggggacaagacctctaatcacatccatgatagatctggaacatcaccccaccatgctygaagggcaggcaggggcttcacattgagccagcaggacacgtgcacaaagtcctgcactcagaaagactctggctcggcttaaagtcctgctgtcactgtcttgaaatccttaatactttctgaacaaagagctgcacatttgcattttctcctgggtcccataaattctgtagctggtcgtgataccctgatttgctggctgggctgtgtccacctagaggatgggaggtgcctccctgtttctttccctttgtggggaagatagaagctgtgagtgttgggccatcatcaattgcctc

SEQ ID NO: 6316 - DNA, 601 bp, Human
tccacctagaggatgggaggtgcctccctgtttctttccctttgtggggaagatagaagctgtgagtgttgggccatcatcaattgcctcttatcctcagatagcgaggggagtcacctttccttgtagcccctgcaccttggcactgccctttctgattcttatcctgcatcattgtgctctgatcaaattcacttcatagaatggagggcactgggcagtcaccaggaaccgagttcttgtcttggccagaatccccagctgtgaatctagaaggagaaagaagaaagctaatggaatkacagacaggaacctggggtggtgggcaggtgggagaggatttggaaaccatctctttcattcgttgcctgtttaccaaaccccggagcactggctggggaggaagtgatgacttgagacatgtctgagagtctcaaccaacaccctgtgatctgtttaaaattctgtctcatgcatcctgcgatctgtttgaagtcctgtctcatgatttcgagtttgtcctgaaatgaagctgtggctctctgactttttccaggacagccaacttgataactttccccctgaagtgtgatttacctct

SEQ ID NO: 6317 - DNA, 601 bp, Human
agagcaattttcagaatttggcttacatgattgtgggggctggcaggccagaaatctgcatgccaccaggctgaaaattcccgagggagttgatgtcaaggaggtctggaagcagaattcttttctgttcgggaacctgtcttttctgtgaaggccctcaacagattggatgaggcccactacattttggagggtcagctgctttgctcaaagtctactgatttaaatgttaatcacatatcaaaaataccttcagggcaacatctaggctgctgtttgactaaacaactgggcacagtakcctagccaagttgacacctaaagtgacccataacggggatgtcagctcgaaccacatttcatggcggaccagcccctcagagcctggctgaagactgaaaacctgtttatccaatggctgactgagctgtgaagcacccagcaaagagccccactgtgctcctccccgccccatgagctgagggatcctgccatctgttcatccctctaaggacatctgagggaggcattgtgatgctggatggtgactgtgttttccaaaccaaaatctgacacacatgggctggcagataggaatgta

SEQ ID NO: 6318 - DNA, 601 bp, Human
tgtgattttgggatcccgataaaagtcaccctgggccaggcgcggtggctcacacctataaacccaacactttgggaggctgaggtgggcagatcacttgaagtcaggagtttgagatgagcctggccaacatggtgaaaccccgtctgtactaaaaatacaaaaaatagccaggcatggtggcatgtgcctgtagtcccagctactggagaggctgaagcaggagaatcacttgaacccaggaggtggaggttgcagtgagcagagatcacgccactgcactccagcctgggtgacagascaagattccatctcaaaaaaacaaaagtcaccctgacctgtgagccacacctggcagtatcattgttggacatgtggccatatgaggcagagggccagtctttctgccatcatggttttggaaaggggtcatgaatagtctgctactaatcatggatggtgaggatggctgaccatgactgtgacctcatgtcatctcatgggatcagcttgacagccccattagttggatgctattgtccctgtagtttacaggaagaagctgagcccaggaggcggagtcagttggccaaggttgcag

SEQ ID NO: 6319 - DNA, 601 bp, Human
tcgttcatttaatatgttttcccagagtgcctcacctgggtcagtattgaatggggctctgggacccaagaatgaataaaagacatggttccccatccgtgactgattaagggtggttttgttctttttgagacagtgtctcattctgtcgcccaggctgaagtgcagtgatgcaatcataggtcactgcaactttgaactcctgggctcaatcgaatctcccacctcagcctcccgagtagctggaaccacaggtgcgtgtcaccatgcctagctaatttagtaatttttttttttttttgtagagatcgggtcttgttacattgttagggctggggttttgttctttttgatagtgatgattcatatatataattctatgtaatcatatatttacccttttgcaagattatttttattaacatatgttaacacatgggcaaaacccaaatccttggtccatcacaagtcctaaattttattctggaaatgtagccttggcttgcatagaagcatgtgattttcctttagcctaccagagcccttggtggtttctctgtgggtaagaggggctggttgagtgtgcactccaagcaaacca

SEQ ID NO: 6320 - DNA, 601 bp, Human
gaaagatgttttcaggatgacacaagaaagtacacagggcgtggttagcacagcgcctacaatctagtaaacactcaacgtcttgaagatggtggccacaatgataacaacacaacctccagccctgcagaagcccttcctgggccaaaaccagtcctcctgccatatccaatcctgtgattggaggatgctggctggtgagtagaaagtccttgctcaagttctgctggggtccacctctttggaccttctgactctgatcttagctcctggagtgccccggagcaaacctgtccaccctgtcccctgcaggacggtctgttagcctcaattagcagaaagcttacagactctgggaaaaggtgtgcctggctgtctgctgttgctgataagcagcctgataaagactctgtggtcaaaggttgctgggctgggctgagattcagtcccgcccttccagcccctcctttctgctttctattgcttccctctccccttggtaaatcactgaaagttttcagtaatggggcatggcgctctttgcgggcacccgtctggggctgtgtctgtgaaataggaggtaggggtggtgattggggtg

SEQ ID NO: 6321 - DNA, 601 bp, Human
acccagcattgcccaggacctgaagtgggtgtcaccaactgggagtcaccaggaagcaatcgaggaaatcccacagacatctatttagaaaacatcatttcatgatgtgcttttgagacgggcatgtgaaagaagagggtgttggccagattaaaagggaccctgagcttgaggttctgactgatcatggtttcaggaggtttttcccctcacataaccatttctatctcttccttagaaattagcacacttttgggtaccagttttgagttggagtggcatatttcttagaacactggayggcaagatacttctttaaaattggggagacttagggctaagtttcgcagtttgttggaaaggtcagtcctacgaggacttttctgttggggatgcacaggtagaaagcccgttttctgccccagagtcagcaggaagtgtgagtggtccaggaacaaaaacagacttggtggaatgcaactaatctccacttgggagacagagggacttgaggctggaaggcagtttgatttgtagcaagaaaacttggtacaaagaggttgtgaccctgtgtgaccccgagggagaatttggatttgtg

SEQ ID NO: 6322 - DNA, 601 bp, Human
cccacctcagagtcttaggagggccaagagctttgggagaccttggggacattcacaggcttggaagcactggcctcttcttcttttgtggcctcctcagggcagacttggtgggagctcttaataaacagtaactcaggaacagaacagtcagggaggcctggtccctggcccagtaattgaaaaaccagaaacagcttcatttcatatgcattgatgacaaaagtaccgacagacgcaaccaaaaacatgactggcccgctggtggacagtttcgccccacaacttggggagcgcaaaattgctttgccgagagtcagaagcaactacatgagacagcagaggtccatgtaacttttctggatttttaggaatctgatttccatgggtctcttgcagggctgagaatagactggggtgagtgaggcactccctcatgtacaaactttcaggaggcaccagaaagtaggaaaaaacaagtaaaatgtaatgcactattttcagaaagccaaaatgagtgcaaaaaaaaattcataatcgaccaaatattgtttttagtaaaggcaggatccagccctgagcttgctccacttacctcacc

SEQ ID NO: 6323 - DNA, 601 bp, Human
agcaatgtcttgtgtggacctcccgtctcatccaatgagtaagaatgcctcaccttctggcaatgcagcctcattctacccagcccctattcaagatagagttgctctggttcgaacacctctgacagagctaccaaaagggcattacacaaggacacagacaattaggttaggtggaagatgagcgtatctttacggtcattgtgatggtaagcataagtcttgctcatgaagatcttttccatccttaacctggtatctcctgaaaattagcaagagtgtcttctcttgctttctttarattattcaaagcatgtatcatggtgtcggcattttttttaatccctttgcacataaccccatccttatgaaaatacttgctccctgttttccctcttctctttccactgctgggaactattttgagccctgtctgtctgcagctttgcataaagttataatgaggctgggccaggcagccatggatttctcatgcctacattcggcctggaattcagaagggtcactgggggctggggagagaaactctagcctaactcgtttgatgcattttggttgtaccagatggagggaaactgct

SEQ ID NO: 6324 - DNA, 601 bp, Human
tctttttaatctcagccttatggtaataggccatggaagagtgtaaacagtttgggctaaggctttctaaatacagttgatgagatcctgggaaccacttatcttgggtggagtggagcacctcactttgagtttggtgttagcgctggggcaaaggtctaaggccttctccagtgattgtgctatttaaggatgttcaagggatggtgagggcctttggaaacatctgagtggagtttggagccagagggaccctggagagacccagccagcccttttgtttctcagggccagaaggaargtgcccacctttcctgtgaatgagtcatccttgggactagaagcctgggtctgccagcttagtaaagcctctgttttgctctggtaccttacccatctacgcagcctagtttgtccaccaaggtgctgatgtggcctgcaggagttattgccaagacataattcttccacttcaagtaatctagaggccacaagtaatctagaaggttttctaggaaaacccctcaaagaccagctgatgaaggacaaaataagtagagatccattgagtcagccaagaatgtcatatgtttgggacact

SEQ ID NO: 6325 - DNA, 601 bp, Human
aggtgttaggacaggattgggggtctaggggtgcaccaaatggacaaggaggggcggggctgcttggcaaattgtagctccagagtgttttctgatctcgagttgcccctcttaggagtcttgggagagagtgggtcctattggcccagtttaggtctcctgaccagtcctcaggcagtggtaggtgaggcccatcaattgactgccccccagagacctcacacaatggaaggcggataattctccaaagagaaggtggcagactggatcctaggagacaaaaataaccaatgctggcctygggctccagagaattccctgcttctcagtccttggagtgcaggtgctcctgttcctggtcctatccctcccctttgtctccatgtgttgtgcgtagcagtgtctgctggatgtttgctgaagcaaagggtcactttcatgggcctttgaatagtcagccacttccacaccagagattgcatatgtaggtgtgctggagggcattttgttttttctaagggtatttggattaatctttctatttcaccctgtcttagtcattagagccacgttctgactggttcagattacagatggtaaa

SEQ ID NO: 6326 - DNA, 601 bp, Human
acaccaatcaaataatgaatgttctgaatacataagttgagtgataatttattggatgaacacacacaacaccagagattgcgtatgtaagtgtgctggagggcattttgttttttctaaggatatttggattaatcttctcacctgcttttcttttgcatggagctttgttttataactgagacatgaacagatggaagagctgcctacttgtataaaggattgtattctgaaaaccccgttgtattatagagcggtaggccccagccactgggcagggcatgctggtcaaaggttctcsgccaatttcacttcacgttcatggtccaccgttaggtctttcctgttcactactcagtaaacagccagcgatgaagcaggccacaaatgaaatatgaatgctcatgagatatgagtacgttatcactactgaaatagaagtgctcatgagctggtaatctggcgtcagagctcggtgagaaggtggtgtcgaatgaggtgacctgtggccttgggctccttattacccttctttattgctaagtcaaacatctcaaatgccaagcttagtaggtgggacttttctgatacaactcacttg

SEQ ID NO: 6327 - DNA, 601 bp, Human
gctttgttttataactgagacatgaacagatggaagagctgcctacttgtataaaggattgtattctgaaaaccccgttgtattatagagcggtaggccccagccactgggcagggcatgctggtcaaaggttctccgccaatttcacttcacgttcatggtccaccgttaggtctttcctgttcactactcagtaaacagccagcgatgaagcaggccacaaatgaaatatgaatgctcatgagatatgagtacgttatcactactgaaatagaagtgctcatgagctggtaatctggcktcagagctcggtgagaaggtggtgtcgaatgaggtgacctgtggccttgggctccttattacccttctttattgctaagtcaaacatctcaaatgccaagcttagtaggtgggacttttctgatacaactcacttgacctcccagaccagataaataacaatagtagctactgtttgcttatggcactttgctaagtattttccatgcagtatctcctttgctttgtccagccacacttttgtcgaccaggaagttgttgagagggtgaagtgatcatcatgtaacataagagcagtatt

SEQ ID NO: 6328 - DNA, 601 bp, Human
atacaggagataacactttttcgtttcagggcttatcagatcgattgaaacctttaaatgattagccctgtgggaggtgggcctccatcgcgaactctcattccagactctacaatgtcagcggcaggctctgctgggccgtcagcttccctcacctccgcacgggtcggtcagcagactgcacacccggaaggcccaggccttggtggaggggtttctgtgcctcaaggctgtagggcaggggagggggccgtgcctctctaaactgccagagcctgtttgcacaccagcactttaccgygcttggcggccggggaagtgctaagcctgtcttcattaacaaataccatgttgccttgtttccttacttaaaacactttggagtgttttggctcaagttgaggggctctacatgtgcaaatgcataatcagctgacagcagtttcaaaattgcaggtctcactattgatggagaaatgggagcgttgttattccttgtgtgtaattttctccaagaaatggggggattgatttaatgtcaacactcagagatttaatgtggccctgttactggaaaaatacacctttgccaaactctgcc

SEQ ID NO: 6329 - DNA, 601 bp, Human; identical to SEQ ID NO: 984

SEQ ID NO: 6330 - DNA, 601 bp, Human; identical to SEQ ID NO: 985

SEQ ID NO: 6331 - DNA, 601 bp, Human; identical to SEQ ID NO: 986

SEQ ID NO: 6332 - DNA, 601 bp, Human; identical to SEQ ID NO: 2968

SEQ ID NO: 6333 - DNA, 601 bp, Human; identical to SEQ ID NO: 2969

SEQ ID NO: 6334 - DNA, 601 bp, Human; identical to SEQ ID NO: 1760

SEQ ID NO: 6335 - DNA, 601 bp, Human; identical to SEQ ID NO: 1761

SEQ ID NO: 6336 - DNA, 601 bp, Human; identical to SEQ ID NO: 1762

SEQ ID NO: 6337 - DNA, 601 bp, Human; identical to SEQ ID NO: 1763

SEQ ID NO: 6338 - DNA, 601 bp, Human; identical to SEQ ID NO: 1764

SEQ ID NO: 6339 - DNA, 601 bp, Human; identical to SEQ ID NO: 1765

SEQ ID NO: 6340 - DNA, 601 bp, Human; identical to SEQ ID NO: 1766

SEQ ID NO: 6341 - DNA, 601 bp, Human; identical to SEQ ID NO: 3515

SEQ ID NO: 6342 - DNA, 601 bp, Human; identical to SEQ ID NO: 3516

SEQ ID NO: 6343 - DNA, 601 bp, Human; identical to SEQ ID NO: 3517

SEQ ID NO: 6344 - DNA, 601 bp, Human; identical to SEQ ID NO: 3518

SEQ ID NO: 6345 - DNA, 601 bp, Human; identical to SEQ ID NO: 3519

SEQ ID NO: 6346 - DNA, 601 bp, Human; identical to SEQ ID NO: 3520

SEQ ID NO: 6347 - DNA, 601 bp, Human; identical to SEQ ID NO: 3521

SEQ ID NO: 6348 - DNA, 601 bp, Human; identical to SEQ ID NO: 3522

SEQ ID NO: 6349 - DNA, 601 bp, Human; identical to SEQ ID NO: 3523

SEQ ID NO: 6350 - DNA, 601 bp, Human; identical to SEQ ID NO: 3524

SEQ ID NO: 6351 - DNA, 601 bp, Human; identical to SEQ ID NO: 3525

SEQ ID NO: 6352 - DNA, 601 bp, Human; identical to SEQ ID NO: 3526

SEQ ID NO: 6353 - DNA, 601 bp, Human; identical to SEQ ID NO: 3527

SEQ ID NO: 6354 - DNA, 601 bp, Human; identical to SEQ ID NO: 3528

SEQ ID NO: 6355 - DNA, 601 bp, Human; identical to SEQ ID NO: 3529

SEQ ID NO: 6356 - DNA, 601 bp, Human; identical to SEQ ID NO: 3530

SEQ ID NO: 6357 - DNA, 601 bp, Human; identical to SEQ ID NO: 3531

SEQ ID NO: 6358 - DNA, 601 bp, Human; identical to SEQ ID NO: 3532

SEQ ID NO: 6359 - DNA, 601 bp, Human; identical to SEQ ID NO: 3533

SEQ ID NO: 6360 - DNA, 601 bp, Human; identical to SEQ ID NO: 3534

SEQ ID NO: 6361 - DNA, 601 bp, Human; identical to SEQ ID NO: 3515

SEQ ID NO: 6362 - DNA, 601 bp, Human; identical to SEQ ID NO: 3516

SEQ ID NO: 6363 - DNA, 601 bp, Human; identical to SEQ ID NO: 3517

SEQ ID NO: 6364 - DNA, 601 bp, Human; identical to SEQ ID NO: 3518

SEQ ID NO: 6365 - DNA, 601 bp, Human; identical to SEQ ID NO: 3519

SEQ ID NO: 6366 - DNA, 601 bp, Human; identical to SEQ ID NO: 3520

SEQ ID NO: 6367 - DNA, 601 bp, Human; identical to SEQ ID NO: 3521

SEQ ID NO: 6368 - DNA, 601 bp, Human; identical to SEQ ID NO: 3522

SEQ ID NO: 6369 - DNA, 601 bp, Human; identical to SEQ ID NO: 3523

SEQ ID NO: 6370 - DNA, 601 bp, Human; identical to SEQ ID NO: 3524

SEQ ID NO: 6371 - DNA, 601 bp, Human; identical to SEQ ID NO: 3525

SEQ ID NO: 6372 - DNA, 601 bp, Human; identical to SEQ ID NO: 3526

SEQ ID NO: 6373 - DNA, 601 bp, Human; identical to SEQ ID NO: 3527

SEQ ID NO: 6374 - DNA, 601 bp, Human; identical to SEQ ID NO: 3528

SEQ ID NO: 6375 - DNA, 601 bp, Human; identical to SEQ ID NO: 3529

SEQ ID NO: 6376 - DNA, 601 bp, Human; identical to SEQ ID NO: 3530

SEQ ID NO: 6377 - DNA, 601 bp, Human; identical to SEQ ID NO: 3531

SEQ ID NO: 6378 - DNA, 601 bp, Human; identical to SEQ ID NO: 3532

SEQ ID NO: 6379 - DNA, 601 bp, Human; identical to SEQ ID NO: 3533

SEQ ID NO: 6380 - DNA, 601 bp, Human; identical to SEQ ID NO: 3534

SEQ ID NO: 6381 - DNA, 601 bp, Human; identical to SEQ ID NO: 1225

SEQ ID NO: 6382 - DNA, 601 bp, Human; identical to SEQ ID NO: 1226

SEQ ID NO: 6383 - DNA, 601 bp, Human; identical to SEQ ID NO: 1227

SEQ ID NO: 6384 - DNA, 601 bp, Human; identical to SEQ ID NO: 1228

SEQ ID NO: 6385 - DNA, 601 bp, Human; identical to SEQ ID NO: 1229

SEQ ID NO: 6386 - DNA, 601 bp, Human; identical to SEQ ID NO: 1230

SEQ ID NO: 6387 - DNA, 601 bp, Human; identical to SEQ ID NO: 1231

SEQ ID NO: 6388 - DNA, 601 bp, Human; identical to SEQ ID NO: 1232

SEQ ID NO: 6389 - DNA, 601 bp, Human; identical to SEQ ID NO: 1233

SEQ ID NO: 6390 - DNA, 601 bp, Human; identical to SEQ ID NO: 1234

SEQ ID NO: 6391 - DNA, 601 bp, Human; identical to SEQ ID NO: 1235

SEQ ID NO: 6392 - DNA, 601 bp, Human; identical to SEQ ID NO: 1236

SEQ ID NO: 6393 - DNA, 601 bp, Human; identical to SEQ ID NO: 1237

SEQ ID NO: 6394 - DNA, 601 bp, Human; identical to SEQ ID NO: 1238

SEQ ID NO: 6395 - DNA, 601 bp, Human; identical to SEQ ID NO: 1239

SEQ ID NO: 6396 - DNA, 601 bp, Human; identical to SEQ ID NO: 1240

SEQ ID NO: 6397 - DNA, 601 bp, Human; identical to SEQ ID NO: 1241

SEQ ID NO: 6398 - DNA, 601 bp, Human; identical to SEQ ID NO: 1242

SEQ ID NO: 6399 - DNA, 601 bp, Human; identical to SEQ ID NO: 1243

SEQ ID NO: 6400 - DNA, 601 bp, Human
cacattttaactggctgaggacaaggccaggcagcctggcctcactgtggaagggcagctggacgcatggcctctggtcaatcctggaagtgcttggtgagggcttccagcagctcctgcttcttcagcccactcttcagcccgtaagcccggcaggcctctttcaacatgggcacagtgaacttgcccagcgtgcccttgctaatgtgggtcttcagctcctcttctgaatactccaccttgggccttttgcttccagaaccttcattatcatgttttctcttggtaactttcccttcargattgtaatctggtgggtgaacaagctccttaaactcatccaccagggagcccagtcttctatttattgcttcaaccttgggcaatgtcaggtccactgcttgttctggctccatcaaatccaaggccaaggcctccaggttcctgaagtgctgctgcagcacggggttctcaaagctgtcacttctgtacgtgaagcgaagcttctcaatgatagccttcatcttgtccacctgctctggagttgccgtgactttttcagtaaagggcatcttccttttatcatcagcaaagggtaaaa

SEQ ID NO: 6401 - DNA, 601 bp, Human; identical to SEQ ID NO: 1711

SEQ ID NO: 6402 - DNA, 601 bp, Human; identical to SEQ ID NO: 1712

SEQ ID NO: 6403 - DNA, 601 bp, Human; identical to SEQ ID NO: 1713

SEQ ID NO: 6404 - DNA, 601 bp, Human; identical to SEQ ID NO: 1714

SEQ ID NO: 6405 - DNA, 601 bp, Human; identical to SEQ ID NO: 1715

SEQ ID NO: 6406 - DNA, 601 bp, Human; identical to SEQ ID NO: 1716

SEQ ID NO: 6407 - DNA, 601 bp, Human; identical to SEQ ID NO: 1717

SEQ ID NO: 6408 - DNA, 601 bp, Human; identical to SEQ ID NO: 1718

SEQ ID NO: 6409 - DNA, 601 bp, Human; identical to SEQ ID NO: 1719

SEQ ID NO: 6410 - DNA, 601 bp, Human; identical to SEQ ID NO: 1720

SEQ ID NO: 6411 - DNA, 601 bp, Human; identical to SEQ ID NO: 1721

SEQ ID NO: 6412 - DNA, 601 bp, Human; identical to SEQ ID NO: 1722

SEQ ID NO: 6413 - DNA, 601 bp, Human; identical to SEQ ID NO: 1723

SEQ ID NO: 6414 - DNA, 601 bp, Human; identical to SEQ ID NO: 1724

SEQ ID NO: 6415 - DNA, 601 bp, Human; identical to SEQ ID NO: 1725

SEQ ID NO: 6416 - DNA, 601 bp, Human; identical to SEQ ID NO: 1726

SEQ ID NO: 6417 - DNA, 601 bp, Human; identical to SEQ ID NO: 1727

SEQ ID NO: 6418 - DNA, 601 bp, Human; identical to SEQ ID NO: 1728

SEQ ID NO: 6419 - DNA, 601 bp, Human; identical to SEQ ID NO: 1729

SEQ ID NO: 6420 - DNA, 601 bp, Human; identical to SEQ ID NO: 1730

SEQ ID NO: 6421 - DNA, 601 bp, Human; identical to SEQ ID NO: 1731

SEQ ID NO: 6422 - DNA, 601 bp, Human; identical to SEQ ID NO: 1732

SEQ ID NO: 6423 - DNA, 601 bp, Human; identical to SEQ ID NO: 1733

SEQ ID NO: 6424 - DNA, 601 bp, Human; identical to SEQ ID NO: 1734

SEQ ID NO: 6425 - DNA, 601 bp, Human; identical to SEQ ID NO: 1735

SEQ ID NO: 6426 - DNA, 601 bp, Human; identical to SEQ ID NO: 1736

SEQ ID NO: 6427 - DNA, 601 bp, Human; identical to SEQ ID NO: 1737

SEQ ID NO: 6428 - DNA, 601 bp, Human; identical to SEQ ID NO: 1738

SEQ ID NO: 6429 - DNA, 601 bp, Human; identical to SEQ ID NO: 1739

SEQ ID NO: 6430 - DNA, 601 bp, Human; identical to SEQ ID NO: 1740

SEQ ID NO: 6431 - DNA, 601 bp, Human; identical to SEQ ID NO: 1741

SEQ ID NO: 6432 - DNA, 601 bp, Human; identical to SEQ ID NO: 1742

SEQ ID NO: 6433 - DNA, 601 bp, Human; identical to SEQ ID NO: 1743

SEQ ID NO: 6434 - DNA, 601 bp, Human; identical to SEQ ID NO: 3037

SEQ ID NO: 6435 - DNA, 601 bp, Human; identical to SEQ ID NO: 3038

SEQ ID NO: 6436 - DNA, 601 bp, Human; identical to SEQ ID NO: 3039

SEQ ID NO: 6437 - DNA, 601 bp, Human; identical to SEQ ID NO: 3040

SEQ ID NO: 6438 - DNA, 601 bp, Human; identical to SEQ ID NO: 3041

SEQ ID NO: 6439 - DNA, 601 bp, Human; identical to SEQ ID NO: 5688

SEQ ID NO: 6440 - DNA, 601 bp, Human; identical to SEQ ID NO: 5689

SEQ ID NO: 6441 - DNA, 601 bp, Human; identical to SEQ ID NO: 5690

SEQ ID NO: 6442 - DNA, 601 bp, Human; identical to SEQ ID NO: 5691

SEQ ID NO: 6443 - DNA, 601 bp, Human; identical to SEQ ID NO: 5692

SEQ ID NO: 6444 - DNA, 601 bp, Human; identical to SEQ ID NO: 5693

SEQ ID NO: 6445 - DNA, 601 bp, Human; identical to SEQ ID NO: 5694

SEQ ID NO: 6446 - DNA, 601 bp, Human; identical to SEQ ID NO: 5695

SEQ ID NO: 6447 - DNA, 601 bp, Human; identical to SEQ ID NO: 5696

SEQ ID NO: 6448 - DNA, 601 bp, Human; identical to SEQ ID NO: 5697

SEQ ID NO: 6449 - DNA, 601 bp, Human; identical to SEQ ID NO: 5698

SEQ ID NO: 6450 - DNA, 601 bp, Human; identical to SEQ ID NO: 5699

SEQ ID NO: 6451 - DNA, 601 bp, Human; identical to SEQ ID NO: 5700

SEQ ID NO: 6452 - DNA, 601 bp, Human; identical to SEQ ID NO: 5701

SEQ ID NO: 6453 - DNA, 601 bp, Human; identical to SEQ ID NO: 5702

SEQ ID NO: 6454 - DNA, 601 bp, Human; identical to SEQ ID NO: 5703

SEQ ID NO: 6455 - DNA, 601 bp, Human; identical to SEQ ID NO: 5704

SEQ ID NO: 6456 - DNA, 601 bp, Human; identical to SEQ ID NO: 5705

SEQ ID NO: 6457 - DNA, 601 bp, Human; identical to SEQ ID NO: 5706

SEQ ID NO: 6458 - DNA, 601 bp, Human; identical to SEQ ID NO: 5707

SEQ ID NO: 6459 - DNA, 601 bp, Human; identical to SEQ ID NO: 5708

SEQ ID NO: 6460 - DNA, 601 bp, Human; identical to SEQ ID NO: 5709

SEQ ID NO: 6461 - DNA, 601 bp, Human; identical to SEQ ID NO: 5710

SEQ ID NO: 6462 - DNA, 601 bp, Human; identical to SEQ ID NO: 5711

SEQ ID NO: 6463 - DNA, 601 bp, Human; identical to SEQ ID NO: 5712

SEQ ID NO: 6464 - DNA, 601 bp, Human; identical to SEQ ID NO: 5713

SEQ ID NO: 6465 - DNA, 601 bp, Human; identical to SEQ ID NO: 5714

SEQ ID NO: 6466 - DNA, 601 bp, Human; identical to SEQ ID NO: 5715

SEQ ID NO: 6467 - DNA, 601 bp, Human; identical to SEQ ID NO: 5716

SEQ ID NO: 6468 - DNA, 601 bp, Human; identical to SEQ ID NO: 5717

SEQ ID NO: 6469 - DNA, 601 bp, Human; identical to SEQ ID NO: 5718

SEQ ID NO: 6470 - DNA, 601 bp, Human; identical to SEQ ID NO: 5719

SEQ ID NO: 6471 - DNA, 601 bp, Human; identical to SEQ ID NO: 5720

SEQ ID NO: 6472 - DNA, 601 bp, Human; identical to SEQ ID NO: 5721

SEQ ID NO: 6473 - DNA, 601 bp, Human; identical to SEQ ID NO: 3014

SEQ ID NO: 6474 - DNA, 601 bp, Human; identical to SEQ ID NO: 3015

SEQ ID NO: 6475 - DNA, 601 bp, Human; identical to SEQ ID NO: 3016

SEQ ID NO: 6476 - DNA, 601 bp, Human; identical to SEQ ID NO: 3017

SEQ ID NO: 6477 - DNA, 601 bp, Human; identical to SEQ ID NO: 3018

SEQ ID NO: 6478 - DNA, 601 bp, Human; identical to SEQ ID NO: 3019

SEQ ID NO: 6479 - DNA, 601 bp, Human; identical to SEQ ID NO: 3020

SEQ ID NO: 6480 - DNA, 601 bp, Human; identical to SEQ ID NO: 3021

SEQ ID NO: 6481 - DNA, 601 bp, Human; identical to SEQ ID NO: 3022

SEQ ID NO: 6482 - DNA, 601 bp, Human; identical to SEQ ID NO: 3023

SEQ ID NO: 6483 - DNA, 601 bp, Human; identical to SEQ ID NO: 3024

SEQ ID NO: 6484 - DNA, 601 bp, Human; identical to SEQ ID NO: 3025

SEQ ID NO: 6485 - DNA, 601 bp, Human; identical to SEQ ID NO: 3026

SEQ ID NO: 6486 - DNA, 601 bp, Human; identical to SEQ ID NO: 3027

SEQ ID NO: 6487 - DNA, 601 bp, Human; identical to SEQ ID NO: 3028

SEQ ID NO: 6488 - DNA, 601 bp, Human; identical to SEQ ID NO: 3029

SEQ ID NO: 6489 - DNA, 601 bp, Human; identical to SEQ ID NO: 3030

SEQ ID NO: 6490 - DNA, 601 bp, Human; identical to SEQ ID NO: 3031

SEQ ID NO: 6491 - DNA, 601 bp, Human; identical to SEQ ID NO: 3032

SEQ ID NO: 6492 - DNA, 601 bp, Human; identical to SEQ ID NO: 3033

SEQ ID NO: 6493 - DNA, 601 bp, Human; identical to SEQ ID NO: 3034

SEQ ID NO: 6494 - DNA, 601 bp, Human; identical to SEQ ID NO: 3035

SEQ ID NO: 6495 - DNA, 601 bp, Human; identical to SEQ ID NO: 3036

SEQ ID NO: 6496 - DNA, 601 bp, Human; identical to SEQ ID NO: 3065

SEQ ID NO: 6497 - DNA, 601 bp, Human; identical to SEQ ID NO: 3066

SEQ ID NO: 6498 - DNA, 601 bp, Human; identical to SEQ ID NO: 3067

SEQ ID NO: 6499 - DNA, 601 bp, Human; identical to SEQ ID NO: 3068

SEQ ID NO: 6500 - DNA, 601 bp, Human; identical to SEQ ID NO: 3069

SEQ ID NO: 6501 - DNA, 601 bp, Human; identical to SEQ ID NO: 3070

SEQ ID NO: 6502 - DNA, 601 bp, Human; identical to SEQ ID NO: 3071

SEQ ID NO: 6503 - DNA, 601 bp, Human; identical to SEQ ID NO: 3072

SEQ ID NO: 6504 - DNA, 601 bp, Human; identical to SEQ ID NO: 3073

SEQ ID NO: 6505 - DNA, 601 bp, Human; identical to SEQ ID NO: 3074

SEQ ID NO: 6506 - DNA, 601 bp, Human; identical to SEQ ID NO: 3075

SEQ ID NO: 6507 - DNA, 601 bp, Human; identical to SEQ ID NO: 3076

SEQ ID NO: 6508 - DNA, 601 bp, Human; identical to SEQ ID NO: 3077

SEQ ID NO: 6509 - DNA, 601 bp, Human; identical to SEQ ID NO: 3078

SEQ ID NO: 6510 - DNA, 601 bp, Human; identical to SEQ ID NO: 3079

SEQ ID NO: 6511 - DNA, 601 bp, Human; identical to SEQ ID NO: 3080

SEQ ID NO: 6512 - DNA, 601 bp, Human; identical to SEQ ID NO: 3081

SEQ ID NO: 6513 - DNA, 601 bp, Human; identical to SEQ ID NO: 3082

SEQ ID NO: 6514 - DNA, 601 bp, Human; identical to SEQ ID NO: 3083

SEQ ID NO: 6515 - DNA, 601 bp, Human
aatgtctgggattgcaggatagctcaaccagctgtccctccctagtaaaggaggatgaaaccaacattggatctgaaggcaattccagatgtttgagtccaatgagaaatttatgtgtaaaaatatgcaagcctgattatccaggaagtttaattgattttatgttgtttacttatttattttcatatttctgaggcaggaagaacaatgtaggcataaactgcctttccttccagtttgaacaaagaggctggatgccatttactgctctcgttgggagcgagctgccgatctgggaacrgagcatggtttttttcagcttctgttccagagatccctcccctgtcctgcttgctgttctttttgccactcactccttgcctccaggaatgccgaggtggttttttttctgtaatccttgtcttgtttgagctctccccaggctgaaactgagtgtaatacttgcaaaattctgctgtcccagaaattaggggaaagtagaaaagacgcaaaaaggaagcaggaaatgctctttaccttgtaaaatgttttatggttgcgaaacatcaggcgcatgtctcgcacaaaccatgccaccgtg

SEQ ID NO: 6516 - DNA, 601 bp, Human
gcaaatctgagcatgatgcaaaatagcttaacaatttttgtaaatgcatttcttggaagcccactcgctgaggaaggatgaccctctgttctccaggactacggatatgccaggcactgagtggctctctggtcaaccctttctccctgcagctccatgagtggataccagtttacaatctgtggtttgtgaacatgccaactcctggcatggaagaagggaaggaagctgggtggagatgaaaatcttccttaggtacctcccaagaaatatctgtacaagtgaggataaaaatcaggamaaaccaaagttacaaatgtctgggattgcaggatagctcaaccagctgtccctccctagtaaaggaggatgaaaccaacattggatctgaaggcaattccagatgtttgagtccaatgagaaatttatgtgtaaaaatatgcaagcctgattatccaggaagtttaattgattttatgttgtttacttatttattttcatatttctgaggcaggaagaacaatgtaggcataaactgcctttccttccagtttgaacaaagaggctggatgccatttactgctctcgttgggagcgagct

SEQ ID NO: 6517 - DNA, 601 bp, Human
ttttttaggagcccagcagtaaggcagaatggatggggagatgctgctactaaaatgttgaaaagcatgagactccagctggttgttaatttccacctgacaggcgatttagactgaagggttagttttgatcatggcaaatctgagcatgatgcaaaatagcttaacaatttttgtaaatgcatttcttggaagcccactcgctgaggaaggatgaccctctgttctccaggactacggatatgccaggcactgagtggctctctggtcaaccctttctccctgcagctccatgagtggrtaccagtttacaatctgtggtttgtgaacatgccaactcctggcatggaagaagggaaggaagctgggtggagatgaaaatcttccttaggtacctcccaagaaatatctgtacaagtgaggataaaaatcaggaaaaaccaaagttacaaatgtctgggattgcaggatagctcaaccagctgtccctccctagtaaaggaggatgaaaccaacattggatctgaaggcaattccagatgtttgagtccaatgagaaatttatgtgtaaaaatatgcaagcctgattatccaggaagtt

SEQ ID NO: 6518 - DNA, 601 bp, Human
ttatttttttaggagcccagcagtaaggcagaatggatggggagatgctgctactaaaatgttgaaaagcatgagactccagctggttgttaatttccacctgacaggcgatttagactgaagggttagttttgatcatggcaaatctgagcatgatgcaaaatagcttaacaatttttgtaaatgcatttcttggaagcccactcgctgaggaaggatgaccctctgttctccaggactacggatatgccaggcactgagtggctctctggtcaaccctttctccctgcagctccatgartggataccagtttacaatctgtggtttgtgaacatgccaactcctggcatggaagaagggaaggaagctgggtggagatgaaaatcttccttaggtacctcccaagaaatatctgtacaagtgaggataaaaatcaggaaaaaccaaagttacaaatgtctgggattgcaggatagctcaaccagctgtccctccctagtaaaggaggatgaaaccaacattggatctgaaggcaattccagatgtttgagtccaatgagaaatttatgtgtaaaaatatgcaagcctgattatccagga

SEQ ID NO: 6519 - DNA, 601 bp, Human
tgaggaggccttgctatgttgctcaggctggtctcaaactcctggcctcagatgattccctcacctcggactcccaaaaagctgggattacagatgtgagtcaccatgcccagcctcactcttatttttttaggagcccagcagtaaggcagaatggatggggagatgctgctactaaaatgttgaaaagcatgagactccagctggttgttaatttccacctgacaggcgatttagactgaagggttagttttgatcatggcaaatctgagcatgatgcaaaatagcttaacaatttttktaaatgcatttcttggaagcccactcgctgaggaaggatgaccctctgttctccaggactacggatatgccaggcactgagtggctctctggtcaaccctttctccctgcagctccatgagtggataccagtttacaatctgtggtttgtgaacatgccaactcctggcatggaagaagggaaggaagctgggtggagatgaaaatcttccttaggtacctcccaagaaatatctgtacaagtgaggataaaaatcaggaaaaaccaaagttacaaatgtctgggattgcaggatagctc

SEQ ID NO: 6520 - DNA, 601 bp, Human
agtcaagtcctacctggccaaagtcagaagcctgaaagagaaaaaagcaaacaaacacattgaaggatgaaggattacagccatcaaatcactcatacttttttttgtgtttttgtttttgagtcagggtctttccccgtcacccaggctgtggtgcagtggcaccgtcatggctcactgcagccttgaattcctgggctcatgtgatcctcccacctcagctcctgagaagctgaaactacaggcacatgccactatgcccaaagttttaaaacatttttttctctttcagagatcggggtgaggaggccttgctatgttgctcaggctggtctcaaactcctggcctcagatgattccctcacctcggactcccaaaaagctgggattacagatgtgagtcaccatgcccagcctcactcttatttttttaggagcccagcagtaaggcagaatggatggggagatgctgctactaaaatgttgaaaagcatgagactccagctggttgttaatttccacctgacaggcgatttagactgaagggttagttttgatcatggcaaatctgagcatgatgcaaaatagcttaacaattttt

SEQ ID NO: 6521 - DNA, 601 bp, Human; identical to SEQ ID NO: 3037

SEQ ID NO: 6522 - DNA, 601 bp, Human; identical to SEQ ID NO: 3038

SEQ ID NO: 6523 - DNA, 601 bp, Human; identical to SEQ ID NO: 3039

SEQ ID NO: 6524 - DNA, 601 bp, Human; identical to SEQ ID NO: 3040

SEQ ID NO: 6525 - DNA, 601 bp, Human; identical to SEQ ID NO: 3041

SEQ ID NO: 6526 - DNA, 601 bp, Human; identical to SEQ ID NO: 5688

SEQ ID NO: 6527 - DNA, 601 bp, Human; identical to SEQ ID NO: 5689

SEQ ID NO: 6528 - DNA, 601 bp, Human; identical to SEQ ID NO: 5690

SEQ ID NO: 6529 - DNA, 601 bp, Human; identical to SEQ ID NO: 5691

SEQ ID NO: 6530 - DNA, 601 bp, Human; identical to SEQ ID NO: 5692

SEQ ID NO: 6531 - DNA, 601 bp, Human; identical to SEQ ID NO: 5693

SEQ ID NO: 6532 - DNA, 601 bp, Human; identical to SEQ ID NO: 5694

SEQ ID NO: 6533 - DNA, 601 bp, Human; identical to SEQ ID NO: 5695

SEQ ID NO: 6534 - DNA, 601 bp, Human; identical to SEQ ID NO: 5696

SEQ ID NO: 6535 - DNA, 601 bp, Human; identical to SEQ ID NO: 5697

SEQ ID NO: 6536 - DNA, 601 bp, Human; identical to SEQ ID NO: 5698

SEQ ID NO: 6537 - DNA, 601 bp, Human; identical to SEQ ID NO: 5699

SEQ ID NO: 6538 - DNA, 601 bp, Human; identical to SEQ ID NO: 5700

SEQ ID NO: 6539 - DNA, 601 bp, Human; identical to SEQ ID NO: 5701

SEQ ID NO: 6540 - DNA, 601 bp, Human; identical to SEQ ID NO: 5702

SEQ ID NO: 6541 - DNA, 601 bp, Human; identical to SEQ ID NO: 5703

SEQ ID NO: 6542 - DNA, 601 bp, Human; identical to SEQ ID NO: 5704

SEQ ID NO: 6543 - DNA, 601 bp, Human; identical to SEQ ID NO: 5705

SEQ ID NO: 6544 - DNA, 601 bp, Human; identical to SEQ ID NO: 5706

SEQ ID NO: 6545 - DNA, 601 bp, Human; identical to SEQ ID NO: 5707

SEQ ID NO: 6546 - DNA, 601 bp, Human; identical to SEQ ID NO: 5708

SEQ ID NO: 6547 - DNA, 601 bp, Human; identical to SEQ ID NO: 5709

SEQ ID NO: 6548 - DNA, 601 bp, Human; identical to SEQ ID NO: 5710

SEQ ID NO: 6549 - DNA, 601 bp, Human; identical to SEQ ID NO: 5711

SEQ ID NO: 6550 - DNA, 601 bp, Human; identical to SEQ ID NO: 5712

SEQ ID NO: 6551 - DNA, 601 bp, Human; identical to SEQ ID NO: 5713

SEQ ID NO: 6552 - DNA, 601 bp, Human; identical to SEQ ID NO: 5714

SEQ ID NO: 6553 - DNA, 601 bp, Human; identical to SEQ ID NO: 5715

SEQ ID NO: 6554 - DNA, 601 bp, Human; identical to SEQ ID NO: 5716

SEQ ID NO: 6555 - DNA, 601 bp, Human; identical to SEQ ID NO: 5717

SEQ ID NO: 6556 - DNA, 601 bp, Human; identical to SEQ ID NO: 5718

SEQ ID NO: 6557 - DNA, 601 bp, Human; identical to SEQ ID NO: 5719

SEQ ID NO: 6558 - DNA, 601 bp, Human; identical to SEQ ID NO: 5720

SEQ ID NO: 6559 - DNA, 601 bp, Human; identical to SEQ ID NO: 5721

SEQ ID NO: 6560 - DNA, 601 bp, Human; identical to SEQ ID NO: 3014

SEQ ID NO: 6561 - DNA, 601 bp, Human; identical to SEQ ID NO: 3015

SEQ ID NO: 6562 - DNA, 601 bp, Human; identical to SEQ ID NO: 3016

SEQ ID NO: 6563 - DNA, 601 bp, Human; identical to SEQ ID NO: 3017

SEQ ID NO: 6564 - DNA, 601 bp, Human; identical to SEQ ID NO: 3018

SEQ ID NO: 6565 - DNA, 601 bp, Human; identical to SEQ ID NO: 3019

SEQ ID NO: 6566 - DNA, 601 bp, Human; identical to SEQ ID NO: 3020

SEQ ID NO: 6567 - DNA, 601 bp, Human; identical to SEQ ID NO: 3021

SEQ ID NO: 6568 - DNA, 601 bp, Human; identical to SEQ ID NO: 3022

SEQ ID NO: 6569 - DNA, 601 bp, Human; identical to SEQ ID NO: 3023

SEQ ID NO: 6570 - DNA, 601 bp, Human; identical to SEQ ID NO: 3024

SEQ ID NO: 6571 - DNA, 601 bp, Human; identical to SEQ ID NO: 3025

SEQ ID NO: 6572 - DNA, 601 bp, Human; identical to SEQ ID NO: 3026

SEQ ID NO: 6573 - DNA, 601 bp, Human; identical to SEQ ID NO: 3027

SEQ ID NO: 6574 - DNA, 601 bp, Human; identical to SEQ ID NO: 3028

SEQ ID NO: 6575 - DNA, 601 bp, Human; identical to SEQ ID NO: 3029

SEQ ID NO: 6576 - DNA, 601 bp, Human; identical to SEQ ID NO: 3030

SEQ ID NO: 6577 - DNA, 601 bp, Human; identical to SEQ ID NO: 3031

SEQ ID NO: 6578 - DNA, 601 bp, Human; identical to SEQ ID NO: 3032

SEQ ID NO: 6579 - DNA, 601 bp, Human; identical to SEQ ID NO: 3033

SEQ ID NO: 6580 - DNA, 601 bp, Human; identical to SEQ ID NO: 3034

SEQ ID NO: 6581 - DNA, 601 bp, Human; identical to SEQ ID NO: 3035

SEQ ID NO: 6582 - DNA, 601 bp, Human; identical to SEQ ID NO: 3036

SEQ ID NO: 6583 - DNA, 601 bp, Human; identical to SEQ ID NO: 3065

SEQ ID NO: 6584 - DNA, 601 bp, Human; identical to SEQ ID NO: 3066

SEQ ID NO: 6585 - DNA, 601 bp, Human; identical to SEQ ID NO: 3067

SEQ ID NO: 6586 - DNA, 601 bp, Human; identical to SEQ ID NO: 3068

SEQ ID NO: 6587 - DNA, 601 bp, Human; identical to SEQ ID NO: 3069

SEQ ID NO: 6588 - DNA, 601 bp, Human; identical to SEQ ID NO: 3070

SEQ ID NO: 6589 - DNA, 601 bp, Human; identical to SEQ ID NO: 3071

SEQ ID NO: 6590 - DNA, 601 bp, Human; identical to SEQ ID NO: 3072

SEQ ID NO: 6591 - DNA, 601 bp, Human; identical to SEQ ID NO: 3073

SEQ ID NO: 6592 - DNA, 601 bp, Human; identical to SEQ ID NO: 3074

SEQ ID NO: 6593 - DNA, 601 bp, Human; identical to SEQ ID NO: 3075

SEQ ID NO: 6594 - DNA, 601 bp, Human; identical to SEQ ID NO: 3076

SEQ ID NO: 6595 - DNA, 601 bp, Human; identical to SEQ ID NO: 3077

SEQ ID NO: 6596 - DNA, 601 bp, Human; identical to SEQ ID NO: 3078

SEQ ID NO: 6597 - DNA, 601 bp, Human; identical to SEQ ID NO: 3079

SEQ ID NO: 6598 - DNA, 601 bp, Human; identical to SEQ ID NO: 3080

SEQ ID NO: 6599 - DNA, 601 bp, Human; identical to SEQ ID NO: 3081

SEQ ID NO: 6600 - DNA, 601 bp, Human; identical to SEQ ID NO: 3082

SEQ ID NO: 6601 - DNA, 601 bp, Human; identical to SEQ ID NO: 3083

SEQ ID NO: 6602 - DNA, 601 bp, Human; identical to SEQ ID NO: 6515

SEQ ID NO: 6603 - DNA, 601 bp, Human; identical to SEQ ID NO: 6516

SEQ ID NO: 6604 - DNA, 601 bp, Human; identical to SEQ ID NO: 6517

SEQ ID NO: 6605 - DNA, 601 bp, Human; identical to SEQ ID NO: 6518

SEQ ID NO: 6606 - DNA, 601 bp, Human; identical to SEQ ID NO: 6519

SEQ ID NO: 6607 - DNA, 601 bp, Human; identical to SEQ ID NO: 6520

SEQ ID NO: 6608 - DNA, 601 bp, Human
tacaaggcaaggaacactaaggatttccaacagctaccagaagctaggagataggcagctatcggattctcctcagggcctctagaaggaaccaaccctgtcaacaccttgattttggacttctggcctccacacctgagagaatatatttctgttgttttaagctacctggtttgtagtcattgttacagcagtccttatgacaccctagaaaccaacatagcccctatgacaccctctctcctaactacccccaccttctgtgataatgaacatgcctgggctgggccttccaaactcyggaagccctggtggtttgtggtttgagactttaataatcaggcatattggtgggggctgggctgccatggaagggttcaacatgactcaccatgtacattctcttagtgatgatggagttgtctaggaggccttcaaagaagggaaatggcttgtgtatggcataggcgatccccagcttctggtgcatgaagtgctgaaaaagagcctcttccatggctcttgtcatggtgaacatcctatggaaagaggcatgataaaaaatagaagcaaaggctgggcgcggtggctcatgcctgta

SEQ ID NO: 6609 - DNA, 601 bp, Human
aacatatcagagtgatgcatctacaaggcaaggaacactaaggatttccaacagctaccagaagctaggagataggcagctatcggattctcctcagggcctctagaaggaaccaaccctgtcaacaccttgattttggacttctggcctccacacctgagagaatatatttctgttgttttaagctacctggtttgtagtcattgttacagcagtccttatgacaccctagaaaccaacatagcccctatgacaccctctctcctaactacccccaccttctgtgataatgaacatgccygggctgggccttccaaactctggaagccctggtggtttgtggtttgagactttaataatcaggcatattggtgggggctgggctgccatggaagggttcaacatgactcaccatgtacattctcttagtgatgatggagttgtctaggaggccttcaaagaagggaaatggcttgtgtatggcataggcgatccccagcttctggtgcatgaagtgctgaaaaagagcctcttccatggctcttgtcatggtgaacatcctatggaaagaggcatgataaaaaatagaagcaaaggctgg

SEQ ID NO: 6610 - DNA, 601 bp, Human
attcttctccatcatttatttcagaagtaaatggtctcaaccagtgaatggaaaaaggaaagtaacttcaaattttggaaagggattcagaacaaaatcatcaggttgaagatcccggaagatgactgaagctcagccaggtcaggggcacatcagtgtgtgggtccccatggttctcagatgttcttaccatagcctttaaggccatgcctctcctagtattgcccagatgctgccaggacagtgggccctctgtagctgcccctacctggaggtggacttgcccctttcactgtccatktagctcaagaaatcatctctcccttcagggggaagccttttgatggtgaagtgtcagagagcaaaggaggaactgtcaacaatggtgattccactaatgaaaatatccaatgtgagctggtggtcctttgcttgttgttctgaggtaagtgaacatgtgatttggccacagtgttttacttccaacctaaaatgactttactgcctctctctttccctggctgatttcttcccaactctgccactgttctttttcctactcctttatttatccagtctcttttctttctctacgtacttc

SEQ ID NO: 6611 - DNA, 601 bp, Human
aataaaaattccttagcagggtgtattaggacatttatattctggtttctgctcatttctgcagagtcagcttctgtgccttctattgtaccctgtgatctggtcacacccagctttctctcccatccacaataccccagacccttggctttctgcatgctattcccttgcatggctagtgctgggtttctcttaagattcttctccatcatttatttcagaagtaaatggtctcaaccagtgaatggaaaaaggaaagtaacttcaaattttggaaagggattcagaacaaaatcatcargttgaagatcccggaagatgactgaagctcagccaggtcaggggcacatcagtgtgtgggtccccatggttctcagatgttcttaccatagcctttaaggccatgcctctcctagtattgcccagatgctgccaggacagtgggccctctgtagctgcccctacctggaggtggacttgcccctttcactgtccatgtagctcaagaaatcatctctcccttcagggggaagccttttgatggtgaagtgtcagagagcaaaggaggaactgtcaacaatggtgattccactaatgaaaa

SEQ ID NO: 6612 - DNA, 601 bp, Human
aataaacagatcatacttccccgaagcaaataagagaaaataaaaattccttagcagggtgtattaggacatttatattctggtttctgctcatttctgcagagtcagcttctgtgccttctattgtaccctgtgatctggtcacacccagctttctctcccatccacaataccccagacccttggctttctgcatgctattcccttgcatggctagtgctgggtttctcttaagattcttctccatcatttatttcagaagtaaatggtctcaaccagtgaatggaaaaaggaaagtaayttcaaattttggaaagggattcagaacaaaatcatcaggttgaagatcccggaagatgactgaagctcagccaggtcaggggcacatcagtgtgtgggtccccatggttctcagatgttcttaccatagcctttaaggccatgcctctcctagtattgcccagatgctgccaggacagtgggccctctgtagctgcccctacctggaggtggacttgcccctttcactgtccatgtagctcaagaaatcatctctcccttcagggggaagccttttgatggtgaagtgtcagagagcaaa

SEQ ID NO: 6613 - DNA, 601 bp, Human
aggcaccttaggctgaggatatacaggtgttggatgggatctgtttctcacctgaagtgcttcttccttcctggatgagtgcagggagaggcaggacagggtcagatgggctgggcgactcactcaggatctcatcgctttgctgggaggatgttccaggctcactgactcttggcgcacagggtgaacagcttggttgagggggttgtggtgggggcagcgccagtggggtatggagggagcttccttctgctaggccagttggggcttcaagtaggattggtgtgtctctgctctgccrttcataggaagcaccaactgggattggtgaagggacacacatcagtaccctggagactcagaattacttggggaaggggatttcttaatacatgccttccaataggatgggggcatggagctattcattgtcccccaggtgcagagaactgattcattgtcatcattatccatttgtggccccttaatattttatttatctggtttgggcattgagtgctacaataagtgcatctaagccctgatctaataccaaaatggtttcacacataaaagttgagtttgggtttgtacccagggg

SEQ ID NO: 6614 - DNA, 601 bp, Human; identical to SEQ ID NO: 3037

SEQ ID NO: 6615 - DNA, 601 bp, Human; identical to SEQ ID NO: 3038

SEQ ID NO: 6616 - DNA, 601 bp, Human; identical to SEQ ID NO: 3039

SEQ ID NO: 6617 - DNA, 601 bp, Human; identical to SEQ ID NO: 3040

SEQ ID NO: 6618 - DNA, 601 bp, Human; identical to SEQ ID NO: 3041

SEQ ID NO: 6619 - DNA, 601 bp, Human; identical to SEQ ID NO: 5688

SEQ ID NO: 6620 - DNA, 601 bp, Human; identical to SEQ ID NO: 5689

SEQ ID NO: 6621 - DNA, 601 bp, Human; identical to SEQ ID NO: 5690

SEQ ID NO: 6622 - DNA, 601 bp, Human; identical to SEQ ID NO: 5691

SEQ ID NO: 6623 - DNA, 601 bp, Human; identical to SEQ ID NO: 5692

SEQ ID NO: 6624 - DNA, 601 bp, Human; identical to SEQ ID NO: 5693

SEQ ID NO: 6625 - DNA, 601 bp, Human; identical to SEQ ID NO: 5694

SEQ ID NO: 6626 - DNA, 601 bp, Human; identical to SEQ ID NO: 5695

SEQ ID NO: 6627 - DNA, 601 bp, Human; identical to SEQ ID NO: 5696

SEQ ID NO: 6628 - DNA, 601 bp, Human; identical to SEQ ID NO: 5697

SEQ ID NO: 6629 - DNA, 601 bp, Human; identical to SEQ ID NO: 5698

SEQ ID NO: 6630 - DNA, 601 bp, Human; identical to SEQ ID NO: 5699

SEQ ID NO: 6631 - DNA, 601 bp, Human; identical to SEQ ID NO: 5700

SEQ ID NO: 6632 - DNA, 601 bp, Human; identical to SEQ ID NO: 5701

SEQ ID NO: 6633 - DNA, 601 bp, Human; identical to SEQ ID NO: 5702

SEQ ID NO: 6634 - DNA, 601 bp, Human; identical to SEQ ID NO: 5703

SEQ ID NO: 6635 - DNA, 601 bp, Human; identical to SEQ ID NO: 5704

SEQ ID NO: 6636 - DNA, 601 bp, Human; identical to SEQ ID NO: 5705

SEQ ID NO: 6637 - DNA, 601 bp, Human; identical to SEQ ID NO: 5706

SEQ ID NO: 6638 - DNA, 601 bp, Human; identical to SEQ ID NO: 5707

SEQ ID NO: 6639 - DNA, 601 bp, Human; identical to SEQ ID NO: 5708

SEQ ID NO: 6640 - DNA, 601 bp, Human; identical to SEQ ID NO: 5709

SEQ ID NO: 6641 - DNA, 601 bp, Human; identical to SEQ ID NO: 5710

SEQ ID NO: 6642 - DNA, 601 bp, Human; identical to SEQ ID NO: 5711

SEQ ID NO: 6643 - DNA, 601 bp, Human; identical to SEQ ID NO: 5712

SEQ ID NO: 6644 - DNA, 601 bp, Human; identical to SEQ ID NO: 5713

SEQ ID NO: 6645 - DNA, 601 bp, Human; identical to SEQ ID NO: 5714

SEQ ID NO: 6646 - DNA, 601 bp, Human; identical to SEQ ID NO: 5715

SEQ ID NO: 6647 - DNA, 601 bp, Human; identical to SEQ ID NO: 5716

SEQ ID NO: 6648 - DNA, 601 bp, Human; identical to SEQ ID NO: 5717

SEQ ID NO: 6649 - DNA, 601 bp, Human; identical to SEQ ID NO: 5718

SEQ ID NO: 6650 - DNA, 601 bp, Human; identical to SEQ ID NO: 5719

SEQ ID NO: 6651 - DNA, 601 bp, Human; identical to SEQ ID NO: 5720

SEQ ID NO: 6652 - DNA, 601 bp, Human; identical to SEQ ID NO: 5721

SEQ ID NO: 6653 - DNA, 601 bp, Human; identical to SEQ ID NO: 3014

SEQ ID NO: 6654 - DNA, 601 bp, Human; identical to SEQ ID NO: 3015

SEQ ID NO: 6655 - DNA, 601 bp, Human; identical to SEQ ID NO: 3016

SEQ ID NO: 6656 - DNA, 601 bp, Human; identical to SEQ ID NO: 3017

SEQ ID NO: 6657 - DNA, 601 bp, Human; identical to SEQ ID NO: 3018

SEQ ID NO: 6658 - DNA, 601 bp, Human; identical to SEQ ID NO: 3019

SEQ ID NO: 6659 - DNA, 601 bp, Human; identical to SEQ ID NO: 3020

SEQ ID NO: 6660 - DNA, 601 bp, Human; identical to SEQ ID NO: 3021

SEQ ID NO: 6661 - DNA, 601 bp, Human; identical to SEQ ID NO: 3022

SEQ ID NO: 6662 - DNA, 601 bp, Human; identical to SEQ ID NO: 3023

SEQ ID NO: 6663 - DNA, 601 bp, Human; identical to SEQ ID NO: 3024

SEQ ID NO: 6664 - DNA, 601 bp, Human; identical to SEQ ID NO: 3025

SEQ ID NO: 6665 - DNA, 601 bp, Human; identical to SEQ ID NO: 3026

SEQ ID NO: 6666 - DNA, 601 bp, Human; identical to SEQ ID NO: 3027

SEQ ID NO: 6667 - DNA, 601 bp, Human; identical to SEQ ID NO: 3028

SEQ ID NO: 6668 - DNA, 601 bp, Human; identical to SEQ ID NO: 3029

SEQ ID NO: 6669 - DNA, 601 bp, Human; identical to SEQ ID NO: 3030

SEQ ID NO: 6670 - DNA, 601 bp, Human; identical to SEQ ID NO: 3031

SEQ ID NO: 6671 - DNA, 601 bp, Human; identical to SEQ ID NO: 3032

SEQ ID NO: 6672 - DNA, 601 bp, Human; identical to SEQ ID NO: 3033

SEQ ID NO: 6673 - DNA, 601 bp, Human; identical to SEQ ID NO: 3034

SEQ ID NO: 6674 - DNA, 601 bp, Human; identical to SEQ ID NO: 3035

SEQ ID NO: 6675 - DNA, 601 bp, Human; identical to SEQ ID NO: 3036

SEQ ID NO: 6676 - DNA, 601 bp, Human; identical to SEQ ID NO: 3065

SEQ ID NO: 6677 - DNA, 601 bp, Human; identical to SEQ ID NO: 3066

SEQ ID NO: 6678 - DNA, 601 bp, Human; identical to SEQ ID NO: 3067

SEQ ID NO: 6679 - DNA, 601 bp, Human; identical to SEQ ID NO: 3068

SEQ ID NO: 6680 - DNA, 601 bp, Human; identical to SEQ ID NO: 3069

SEQ ID NO: 6681 - DNA, 601 bp, Human; identical to SEQ ID NO: 3070

SEQ ID NO: 6682 - DNA, 601 bp, Human; identical to SEQ ID NO: 3071

SEQ ID NO: 6683 - DNA, 601 bp, Human; identical to SEQ ID NO: 3072

SEQ ID NO: 6684 - DNA, 601 bp, Human; identical to SEQ ID NO: 3073

SEQ ID NO: 6685 - DNA, 601 bp, Human; identical to SEQ ID NO: 3074

SEQ ID NO: 6686 - DNA, 601 bp, Human; identical to SEQ ID NO: 3075

SEQ ID NO: 6687 - DNA, 601 bp, Human; identical to SEQ ID NO: 3076

SEQ ID NO: 6688 - DNA, 601 bp, Human; identical to SEQ ID NO: 3077

SEQ ID NO: 6689 - DNA, 601 bp, Human; identical to SEQ ID NO: 3078

SEQ ID NO: 6690 - DNA, 601 bp, Human; identical to SEQ ID NO: 3079

SEQ ID NO: 6691 - DNA, 601 bp, Human; identical to SEQ ID NO: 3080

SEQ ID NO: 6692 - DNA, 601 bp, Human; identical to SEQ ID NO: 3081

SEQ ID NO: 6693 - DNA, 601 bp, Human; identical to SEQ ID NO: 3082

SEQ ID NO: 6694 - DNA, 601 bp, Human; identical to SEQ ID NO: 3083

SEQ ID NO: 6695 - DNA, 601 bp, Human; identical to SEQ ID NO: 6515

SEQ ID NO: 6696 - DNA, 601 bp, Human; identical to SEQ ID NO: 6516

SEQ ID NO: 6697 - DNA, 601 bp, Human; identical to SEQ ID NO: 6517

SEQ ID NO: 6698 - DNA, 601 bp, Human; identical to SEQ ID NO: 6518

SEQ ID NO: 6699 - DNA, 601 bp, Human; identical to SEQ ID NO: 6519

SEQ ID NO: 6700 - DNA, 601 bp, Human; identical to SEQ ID NO: 6520

SEQ ID NO: 6701 - DNA, 601 bp, Human; identical to SEQ ID NO: 6608

SEQ ID NO: 6702 - DNA, 601 bp, Human; identical to SEQ ID NO: 6609

SEQ ID NO: 6703 - DNA, 601 bp, Human; identical to SEQ ID NO: 6610

SEQ ID NO: 6704 - DNA, 601 bp, Human; identical to SEQ ID NO: 6611

SEQ ID NO: 6705 - DNA, 601 bp, Human; identical to SEQ ID NO: 6612

SEQ ID NO: 6706 - DNA, 601 bp, Human; identical to SEQ ID NO: 6613

SEQ ID NO: 6707 - DNA, 601 bp, Human; identical to SEQ ID NO: 3037

SEQ ID NO: 6708 - DNA, 601 bp, Human; identical to SEQ ID NO: 3038

SEQ ID NO: 6709 - DNA, 601 bp, Human; identical to SEQ ID NO: 3039

SEQ ID NO: 6710 - DNA, 601 bp, Human; identical to SEQ ID NO: 3040

SEQ ID NO: 6711 - DNA, 601 bp, Human; identical to SEQ ID NO: 3041

SEQ ID NO: 6712 - DNA, 601 bp, Human; identical to SEQ ID NO: 5688

SEQ ID NO: 6713 - DNA, 601 bp, Human; identical to SEQ ID NO: 5689

SEQ ID NO: 6714 - DNA, 601 bp, Human; identical to SEQ ID NO: 5690

SEQ ID NO: 6715 - DNA, 601 bp, Human; identical to SEQ ID NO: 5691

SEQ ID NO: 6716 - DNA, 601 bp, Human; identical to SEQ ID NO: 5692

SEQ ID NO: 6717 - DNA, 601 bp, Human; identical to SEQ ID NO: 5693

SEQ ID NO: 6718 - DNA, 601 bp, Human; identical to SEQ ID NO: 5694

SEQ ID NO: 6719 - DNA, 601 bp, Human; identical to SEQ ID NO: 5695

SEQ ID NO: 6720 - DNA, 601 bp, Human; identical to SEQ ID NO: 5696

SEQ ID NO: 6721 - DNA, 601 bp, Human; identical to SEQ ID NO: 5697

SEQ ID NO: 6722 - DNA, 601 bp, Human; identical to SEQ ID NO: 5698

SEQ ID NO: 6723 - DNA, 601 bp, Human; identical to SEQ ID NO: 5699

SEQ ID NO: 6724 - DNA, 601 bp, Human; identical to SEQ ID NO: 5700

SEQ ID NO: 6725 - DNA, 601 bp, Human; identical to SEQ ID NO: 5701

SEQ ID NO: 6726 - DNA, 601 bp, Human; identical to SEQ ID NO: 5702

SEQ ID NO: 6727 - DNA, 601 bp, Human; identical to SEQ ID NO: 5703

SEQ ID NO: 6728 - DNA, 601 bp, Human; identical to SEQ ID NO: 5704

SEQ ID NO: 6729 - DNA, 601 bp, Human; identical to SEQ ID NO: 5705

SEQ ID NO: 6730 - DNA, 601 bp, Human; identical to SEQ ID NO: 5706

SEQ ID NO: 6731 - DNA, 601 bp, Human; identical to SEQ ID NO: 5707

SEQ ID NO: 6732 - DNA, 601 bp, Human; identical to SEQ ID NO: 5708

SEQ ID NO: 6733 - DNA, 601 bp, Human; identical to SEQ ID NO: 5709

SEQ ID NO: 6734 - DNA, 601 bp, Human; identical to SEQ ID NO: 5710

SEQ ID NO: 6735 - DNA, 601 bp, Human; identical to SEQ ID NO: 5711

SEQ ID NO: 6736 - DNA, 601 bp, Human; identical to SEQ ID NO: 5712

SEQ ID NO: 6737 - DNA, 601 bp, Human; identical to SEQ ID NO: 5713

SEQ ID NO: 6738 - DNA, 601 bp, Human; identical to SEQ ID NO: 5714

SEQ ID NO: 6739 - DNA, 601 bp, Human; identical to SEQ ID NO: 5715

SEQ ID NO: 6740 - DNA, 601 bp, Human; identical to SEQ ID NO: 5716

SEQ ID NO: 6741 - DNA, 601 bp, Human; identical to SEQ ID NO: 5717

SEQ ID NO: 6742 - DNA, 601 bp, Human; identical to SEQ ID NO: 5718

SEQ ID NO: 6743 - DNA, 601 bp, Human; identical to SEQ ID NO: 5719

SEQ ID NO: 6744 - DNA, 601 bp, Human; identical to SEQ ID NO: 5720

SEQ ID NO: 6745 - DNA, 601 bp, Human; identical to SEQ ID NO: 5721

SEQ ID NO: 6746 - DNA, 601 bp, Human; identical to SEQ ID NO: 3014

SEQ ID NO: 6747 - DNA, 601 bp, Human; identical to SEQ ID NO: 3015

SEQ ID NO: 6748 - DNA, 601 bp, Human; identical to SEQ ID NO: 3016

SEQ ID NO: 6749 - DNA, 601 bp, Human; identical to SEQ ID NO: 3017

SEQ ID NO: 6750 - DNA, 601 bp, Human; identical to SEQ ID NO: 3018

SEQ ID NO: 6751 - DNA, 601 bp, Human; identical to SEQ ID NO: 3019

SEQ ID NO: 6752 - DNA, 601 bp, Human; identical to SEQ ID NO: 3020

SEQ ID NO: 6753 - DNA, 601 bp, Human; identical to SEQ ID NO: 3021

SEQ ID NO: 6754 - DNA, 601 bp, Human; identical to SEQ ID NO: 3022

SEQ ID NO: 6755 - DNA, 601 bp, Human; identical to SEQ ID NO: 3023

SEQ ID NO: 6756 - DNA, 601 bp, Human; identical to SEQ ID NO: 3024

SEQ ID NO: 6757 - DNA, 601 bp, Human; identical to SEQ ID NO: 3025

SEQ ID NO: 6758 - DNA, 601 bp, Human; identical to SEQ ID NO: 3026

SEQ ID NO: 6759 - DNA, 601 bp, Human; identical to SEQ ID NO: 3027

SEQ ID NO: 6760 - DNA, 601 bp, Human; identical to SEQ ID NO: 3028

SEQ ID NO: 6761 - DNA, 601 bp, Human; identical to SEQ ID NO: 3029

SEQ ID NO: 6762 - DNA, 601 bp, Human; identical to SEQ ID NO: 3030

SEQ ID NO: 6763 - DNA, 601 bp, Human; identical to SEQ ID NO: 3031

SEQ ID NO: 6764 - DNA, 601 bp, Human; identical to SEQ ID NO: 3032

SEQ ID NO: 6765 - DNA, 601 bp, Human; identical to SEQ ID NO: 3033

SEQ ID NO: 6766 - DNA, 601 bp, Human; identical to SEQ ID NO: 3034

SEQ ID NO: 6767 - DNA, 601 bp, Human; identical to SEQ ID NO: 3035

SEQ ID NO: 6768 - DNA, 601 bp, Human; identical to SEQ ID NO: 3036

SEQ ID NO: 6769 - DNA, 601 bp, Human; identical to SEQ ID NO: 3065

SEQ ID NO: 6770 - DNA, 601 bp, Human; identical to SEQ ID NO: 3066

SEQ ID NO: 6771 - DNA, 601 bp, Human; identical to SEQ ID NO: 3067

SEQ ID NO: 6772 - DNA, 601 bp, Human; identical to SEQ ID NO: 3068

SEQ ID NO: 6773 - DNA, 601 bp, Human; identical to SEQ ID NO: 3069

SEQ ID NO: 6774 - DNA, 601 bp, Human; identical to SEQ ID NO: 3070

SEQ ID NO: 6775 - DNA, 601 bp, Human; identical to SEQ ID NO: 3071

SEQ ID NO: 6776 - DNA, 601 bp, Human; identical to SEQ ID NO: 3072

SEQ ID NO: 6777 - DNA, 601 bp, Human; identical to SEQ ID NO: 3073

SEQ ID NO: 6778 - DNA, 601 bp, Human; identical to SEQ ID NO: 3074

SEQ ID NO: 6779 - DNA, 601 bp, Human; identical to SEQ ID NO: 3075

SEQ ID NO: 6780 - DNA, 601 bp, Human; identical to SEQ ID NO: 3076

SEQ ID NO: 6781 - DNA, 601 bp, Human; identical to SEQ ID NO: 3077

SEQ ID NO: 6782 - DNA, 601 bp, Human; identical to SEQ ID NO: 3078

SEQ ID NO: 6783 - DNA, 601 bp, Human; identical to SEQ ID NO: 3079

SEQ ID NO: 6784 - DNA, 601 bp, Human; identical to SEQ ID NO: 3080

SEQ ID NO: 6785 - DNA, 601 bp, Human; identical to SEQ ID NO: 3081

SEQ ID NO: 6786 - DNA, 601 bp, Human; identical to SEQ ID NO: 3082

SEQ ID NO: 6787 - DNA, 601 bp, Human; identical to SEQ ID NO: 3083

SEQ ID NO: 6788 - DNA, 601 bp, Human; identical to SEQ ID NO: 6515

SEQ ID NO: 6789 - DNA, 601 bp, Human; identical to SEQ ID NO: 6516

SEQ ID NO: 6790 - DNA, 601 bp, Human; identical to SEQ ID NO: 6517

SEQ ID NO: 6791 - DNA, 601 bp, Human; identical to SEQ ID NO: 6518

SEQ ID NO: 6792 - DNA, 601 bp, Human; identical to SEQ ID NO: 6519

SEQ ID NO: 6793 - DNA, 601 bp, Human; identical to SEQ ID NO: 6520

SEQ ID NO: 6794 - DNA, 601 bp, Human
ccgacaccagagtgagagatacaaggagagcctggtgtagcccccaccagcttcctggctgtgaacccttaggctgtggcctgaggaggtggggatgtggctctccacctgtcctgggcctgctggcagcctctcccagaacagcttctaaaaccacaaatctgacccagagaatgttcccctttgcccaagcaggacgaatgccaacgcccttggcagccggcgtcgctcacctcgccagcacagctcccggctgagcgcgtacaccttgtgcgggtcggccgggtcccccgagttatcycgcagcatcacgaagcgacgcgtgctgcgcagtgcgcagcggaagttggttttccagccggcgcgctccgcagtctcagcctcggggggcgggccacctcccctgctgctaggcggccacctgccgcgggccacagcccaggcctgaagagggggacagaacacgtgtgccgggcccgcggggtcctaggcgggctctcccacccggggcggggcggggctggggtccccaccttgaagatgcgcgcgtcggcctcgctcaggtccttgcgcgcgaagtgcttccagggcacgcggaaac

SEQ ID NO: 6795 - DNA, 601 bp, Human
gtgtgtgccaggaatggccctgggggcccaccctgcagggaaaagtcagggtgaacgtaagcagctccgcggcctggcaggaggagaggcaggcagagagaagggtacctgtggtggtgggacagctgcgggggcctctgcctcagtctggtccgtgcctgggccttctgagagagaatggggcaggcgttaggccccgacaccagagtgagagatacaaggagagcctggtgtagcccccaccagcttcctggctgtgaacccttaggctgtggcctgaggaggtggggatgtggctctscacctgtcctgggcctgctggcagcctctcccagaacagcttctaaaaccacaaatctgacccagagaatgttcccctttgcccaagcaggacgaatgccaacgcccttggcagccggcgtcgctcacctcgccagcacagctcccggctgagcgcgtacaccttgtgcgggtcggccgggtcccccgagttatctcgcagcatcacgaagcgacgcgtgctgcgcagtgcgcagcggaagttggttttccagccggcgcgctccgcagtctcagcctcggggggcgggccacctcccct

SEQ ID NO: 6796 - DNA, 601 bp, Human
gggagggggcctggggcttggagtccagcatgtgtgtgtgccaggaatggccctgggggcccaccctgcagggaaaagtcagggtgaacgtaagcagctccgcggcctggcaggaggagaggcaggcagagagaagggtacctgtggtggtgggacagctgcgggggcctctgcctcagtctggtccgtgcctgggccttctgagagagaatggggcaggcgttaggccccgacaccagagtgagagatacaaggagagcctggtgtagcccccaccagcttcctggctgtgaacccttakgctgtggcctgaggaggtggggatgtggctctccacctgtcctgggcctgctggcagcctctcccagaacagcttctaaaaccacaaatctgacccagagaatgttcccctttgcccaagcaggacgaatgccaacgcccttggcagccggcgtcgctcacctcgccagcacagctcccggctgagcgcgtacaccttgtgcgggtcggccgggtcccccgagttatctcgcagcatcacgaagcgacgcgtgctgcgcagtgcgcagcggaagttggttttccagccggcgcgctccgc

SEQ ID NO: 6797 - DNA, 601 bp, Human
cccagcagggagccctgggcctgaggaggggaggacagtgggaacggtggtcccctcctaattctccagctccccaatccccagcccccttctaaagtgtccgtccaggtgcactggcccctcccgcgctccccccctccccgggcacgcccacacctccagcacaggccccagtcaggggaagcccttcttgtccctctccaggagccttggttgggactggatctgccccccatgacgctgtcagcagatggtctgccaggcagctctgttgcactgcctggagcaggaggtccccctygtcaccagctggggcagggagggggcctggggcttggagtccagcatgtgtgtgtgccaggaatggccctgggggcccaccctgcagggaaaagtcagggtgaacgtaagcagctccgcggcctggcaggaggagaggcaggcagagagaagggtacctgtggtggtgggacagctgcgggggcctctgcctcagtctggtccgtgcctgggccttctgagagagaatggggcaggcgttaggccccgacaccagagtgagagatacaaggagagcctggtgtagcccccaccagcttcc

SEQ ID NO: 6798 - DNA, 601 bp, Human
gggctggggaatgctacctgctgggggtctgtggcccggacagctgggtctggggggccgtataggaacgtgcagctcgggtgtcccaccaccttctgcagcaccgtgcggcccttgtacatgatggtcacgtccagcgcccctgggctgggctctgtgtggagaccaagctgtgagtgacgggggtgggcggggacaggctgtgagtgacgggggtgggcggggacaggatgtgagtgacgggggtgggcggggacaggatgtgagtgatgggtgggcggggacaagccgtgagtgacgrgggtgggcggggacaggctgccccttcctgggatgcactcaccttgcaccgcggtgcaggcgcttggggagggtgacaggtacggctctgcctggtgcggggactctggggccgcggcctcgcctgcatccggaagggaatcctgtgctggcacctcatccctagcctctccctgtgccccaggcctcccaacccctacccctctcacctgtcgttagtgccgcgggctggggcccggggctgggggtcgtctctactgcccacccgtacagctccccagcagggagccctgggcctgag

SEQ ID NO: 6799 - DNA, 601 bp, Human
accttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaacgacccctggagacagccccccaggcaggggcctcactgacctcggaagaagactctgaagtcgaagatgggggtgtcacagttccgaggcagcaggcaggctggggtggaggggctggcggagcctgggggkccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtctggggggccgtataggaacgtgcagctcgggtgtcccaccaccttctgcagcaccgtgcggcccttgtacatgatggtcacgtccagcgcccctgggctgggctct

SEQ ID NO: 6800 - DNA, 601 bp, Human
tcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaacgacccctggagacagccccccaggcaggggcctcactgacctyggaagaagactctgaagtcgaagatgggggtgtcacagttccgaggcagcaggcaggctggggtggaggggctggcggagcctggggggccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtctggggggccgtatagga

SEQ ID NO: 6801 - DNA, 601 bp, Human
ctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaacgacccctggagacagccccccaggcaggggcctcactgaccycggaagaagactctgaagtcgaagatgggggtgtcacagttccgaggcagcaggcaggctggggtggaggggctggcggagcctggggggccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtctggggggccgtatagg

SEQ ID NO: 6802 - DNA, 601 bp, Human
gacccggtgtatggcctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaacgacccctggagacagccccccaggcargggcctcactgacctcggaagaagactctgaagtcgaagatgggggtgtcacagttccgaggcagcaggcaggctggggtggaggggctggcggagcctggggggccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtct

SEQ ID NO: 6803 - DNA, 601 bp, Human
ctctgagggcgtcgggcgtctgtcagtgacccggtgtatggcctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaasgacccctggagacagccccccaggcaggggcctcactgacctcggaagaagactctgaagtcgaagatgggggtgtcacagttccgaggcagcaggcaggctggggtggaggggctggcggagcctggggggccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgg

SEQ ID NO: 6804 - DNA, 601 bp, Human
taaggaagcactcgatgtcgtcatagaggctgttggcgctggacaggcagaggctgaggctgctgctatccagggaagacacaccctcacgctgcgtgccctctaggtgcactcggcacagccagggttccagctgccaggagggatcgggcgtcttgtcagtgacccggcgtgtgtcctcccctccccctccccaggctctgagggcgtcgggcgtctgtcagtgacccggtgtatggcctcccctccccctctccgaggctctgagggcatcaggcgtctgtcagtgggcctgagcacrtggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaacgacccctggagacagccccccaggcaggggcctcactgacctcggaagaagactctgaagtcgaagatgggggtgtcacagttccgaggcagcaggcaggct

SEQ ID NO: 6805 - DNA, 601 bp, Human
atgccagtacgtgttctggagttctttttattagactgggcggccgcggccagctctaggtgggctgctccagctttctggagttctcattagactgggttctaggcgggctgctccagctccataaggaagcactcgatgtcgtcatagaggctgttggcgctggacaggcagaggctgaggctgctgctatccagggaagacacaccctcacgctgcgtgccctctaggtgcactcggcacagccagggttccagctgccaggagggatcgggcgtcttgtcagtgacccggcgtgtgkcctcccctccccctccccaggctctgagggcgtcgggcgtctgtcagtgacccggtgtatggcctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtac

SEQ ID NO: 6806 - DNA, 601 bp, Human
cccaattccccaccagccaagatgccagtacgtgttctggagttctttttattagactgggcggccgcggccagctctaggtgggctgctccagctttctggagttctcattagactgggttctaggcgggctgctccagctccataaggaagcactcgatgtcgtcatagaggctgttggcgctggacaggcagaggctgaggctgctgctatccagggaagacacaccctcacgctgcgtgccctctaggtgcactcggcacagccagggttccagctgccaggagggatcgggcgtcttgtcagtgacccggcgtgtgtcctcccctccccctccccaggctctgagggcgtcgggcgtctgtcagtgacccggtgtatggcctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaa

SEQ ID NO: 6807 - DNA, 601 bp, Human; identical to SEQ ID NO: 6794

SEQ ID NO: 6808 - DNA, 601 bp, Human; identical to SEQ ID NO: 6795

SEQ ID NO: 6809 - DNA, 601 bp, Human; identical to SEQ ID NO: 6796

SEQ ID NO: 6810 - DNA, 601 bp, Human; identical to SEQ ID NO: 6797

SEQ ID NO: 6811 - DNA, 601 bp, Human; identical to SEQ ID NO: 6798

SEQ ID NO: 6812 - DNA, 601 bp, Human; identical to SEQ ID NO: 6799

SEQ ID NO: 6813 - DNA, 601 bp, Human; identical to SEQ ID NO: 6800

SEQ ID NO: 6814 - DNA, 601 bp, Human; identical to SEQ ID NO: 6801

SEQ ID NO: 6815 - DNA, 601 bp, Human; identical to SEQ ID NO: 6802

SEQ ID NO: 6816 - DNA, 601 bp, Human; identical to SEQ ID NO: 6803

SEQ ID NO: 6817 - DNA, 601 bp, Human; identical to SEQ ID NO: 6804

SEQ ID NO: 6818 - DNA, 601 bp, Human; identical to SEQ ID NO: 6805

SEQ ID NO: 6819 - DNA, 601 bp, Human; identical to SEQ ID NO: 6806

SEQ ID NO: 6820 - DNA, 601 bp, Human; identical to SEQ ID NO: 6794

SEQ ID NO: 6821 - DNA, 601 bp, Human; identical to SEQ ID NO: 6795

SEQ ID NO: 6822 - DNA, 601 bp, Human; identical to SEQ ID NO: 6796

SEQ ID NO: 6823 - DNA, 601 bp, Human; identical to SEQ ID NO: 6797

SEQ ID NO: 6824 - DNA, 601 bp, Human; identical to SEQ ID NO: 6798

SEQ ID NO: 6825 - DNA, 601 bp, Human; identical to SEQ ID NO: 6799

SEQ ID NO: 6826 - DNA, 601 bp, Human; identical to SEQ ID NO: 6800

SEQ ID NO: 6827 - DNA, 601 bp, Human; identical to SEQ ID NO: 6801

SEQ ID NO: 6828 - DNA, 601 bp, Human; identical to SEQ ID NO: 6802

SEQ ID NO: 6829 - DNA, 601 bp, Human; identical to SEQ ID NO: 6803

SEQ ID NO: 6830 - DNA, 601 bp, Human; identical to SEQ ID NO: 6804

SEQ ID NO: 6831 - DNA, 601 bp, Human; identical to SEQ ID NO: 6805

SEQ ID NO: 6832 - DNA, 601 bp, Human; identical to SEQ ID NO: 6806

SEQ ID NO: 6833 - DNA, 601 bp, Human; identical to SEQ ID NO: 6794

SEQ ID NO: 6834 - DNA, 601 bp, Human; identical to SEQ ID NO: 6795

SEQ ID NO: 6835 - DNA, 601 bp, Human; identical to SEQ ID NO: 6796

SEQ ID NO: 6836 - DNA, 601 bp, Human; identical to SEQ ID NO: 6797

SEQ ID NO: 6837 - DNA, 601 bp, Human; identical to SEQ ID NO: 6798

SEQ ID NO: 6838 - DNA, 601 bp, Human; identical to SEQ ID NO: 6799

SEQ ID NO: 6839 - DNA, 601 bp, Human; identical to SEQ ID NO: 6800

SEQ ID NO: 6840 - DNA, 601 bp, Human; identical to SEQ ID NO: 6801

SEQ ID NO: 6841 - DNA, 601 bp, Human; identical to SEQ ID NO: 6802

SEQ ID NO: 6842 - DNA, 601 bp, Human; identical to SEQ ID NO: 6803

SEQ ID NO: 6843 - DNA, 601 bp, Human; identical to SEQ ID NO: 6804

SEQ ID NO: 6844 - DNA, 601 bp, Human; identical to SEQ ID NO: 6805

SEQ ID NO: 6845 - DNA, 601 bp, Human; identical to SEQ ID NO: 6806

SEQ ID NO: 6846 - DNA, 601 bp, Human; identical to SEQ ID NO: 6794

SEQ ID NO: 6847 - DNA, 601 bp, Human; identical to SEQ ID NO: 6795

SEQ ID NO: 6848 - DNA, 601 bp, Human; identical to SEQ ID NO: 6796

SEQ ID NO: 6849 - DNA, 601 bp, Human; identical to SEQ ID NO: 6797

SEQ ID NO: 6850 - DNA, 601 bp, Human; identical to SEQ ID NO: 6798

SEQ ID NO: 6851 - DNA, 601 bp, Human; identical to SEQ ID NO: 6799

SEQ ID NO: 6852 - DNA, 601 bp, Human; identical to SEQ ID NO: 6800

SEQ ID NO: 6853 - DNA, 601 bp, Human; identical to SEQ ID NO: 6801

SEQ ID NO: 6854 - DNA, 601 bp, Human; identical to SEQ ID NO: 6802

SEQ ID NO: 6855 - DNA, 601 bp, Human; identical to SEQ ID NO: 6803

SEQ ID NO: 6856 - DNA, 601 bp, Human; identical to SEQ ID NO: 6804

SEQ ID NO: 6857 - DNA, 601 bp, Human; identical to SEQ ID NO: 6805

SEQ ID NO: 6858 - DNA, 601 bp, Human; identical to SEQ ID NO: 6806

SEQ ID NO: 6859 - DNA, 601 bp, Human; identical to SEQ ID NO: 6794

SEQ ID NO: 6860 - DNA, 601 bp, Human; identical to SEQ ID NO: 6795

SEQ ID NO: 6861 - DNA, 601 bp, Human; identical to SEQ ID NO: 6796

SEQ ID NO: 6862 - DNA, 601 bp, Human; identical to SEQ ID NO: 6797

SEQ ID NO: 6863 - DNA, 601 bp, Human; identical to SEQ ID NO: 6798

SEQ ID NO: 6864 - DNA, 601 bp, Human; identical to SEQ ID NO: 6799

SEQ ID NO: 6865 - DNA, 601 bp, Human; identical to SEQ ID NO: 6800

SEQ ID NO: 6866 - DNA, 601 bp, Human; identical to SEQ ID NO: 6801

SEQ ID NO: 6867 - DNA, 601 bp, Human; identical to SEQ ID NO: 6802

SEQ ID NO: 6868 - DNA, 601 bp, Human; identical to SEQ ID NO: 6803

SEQ ID NO: 6869 - DNA, 601 bp, Human; identical to SEQ ID NO: 6804

SEQ ID NO: 6870 - DNA, 601 bp, Human; identical to SEQ ID NO: 6805

SEQ ID NO: 6871 - DNA, 601 bp, Human; identical to SEQ ID NO: 6806

SEQ ID NO: 6872 - DNA, 601 bp, Human; identical to SEQ ID NO: 1767

SEQ ID NO: 6873 - DNA, 601 bp, Human; identical to SEQ ID NO: 1768

SEQ ID NO: 6874 - DNA, 601 bp, Human; identical to SEQ ID NO: 1769

SEQ ID NO: 6875 - DNA, 601 bp, Human; identical to SEQ ID NO: 1770

SEQ ID NO: 6876 - DNA, 601 bp, Human; identical to SEQ ID NO: 1771

SEQ ID NO: 6877 - DNA, 601 bp, Human
tgaccctgccagatttttttactgatgcagaaatgatggctactggtgagcctgtttatgagaaatgcaaataaacattccaatgtgtagaaaagtcagatgctttatatctgtgttcttgtatagacagaaaaatcatggagaagccagcagttaaacatggagaaagcctttccatgagaagggggctctagtgtccagccagaacatgtggctcagactccagagagataacaaattgacatttgggccaagccaaagagctggcgaggggagggggtgggtgcttccattgcacaaygttaagtgcaaatcttgactctgccttccattagctgtgtgatagcaggggagctgtgacctctcagaactggcactttctgctgtatatgggagataatattgacctcatcaggttgttggaggatgaaatcagatgaattatgcaaataactttgataacaatggctatcttaaccaaatgcctaacatataggcctggcacaccgtagctggttgttttgcttttttttttttttttttttttttttttgagccagagtctcgctctgtcgctcaggctggagtgcagtggcgcgat

SEQ ID NO: 6878 - DNA, 601 bp, Human
gagcctgtttatgagaaatgcaaataaacattccaatgtgtagaaaagtcagatgctttatatctgtgttcttgtatagacagaaaaatcatggagaagccagcagttaaacatggagaaagcctttccatgagaagggggctctagtgtccagccagaacatgtggctcagactccagagagataacaaattgacatttgggccaagccaaagagctggcgaggggagggggtgggtgcttccattgcacaatgttaagtgcaaatcttgactctgccttccattagctgtgtgatagcrggggagctgtgacctctcagaactggcactttctgctgtatatgggagataatattgacctcatcaggttgttggaggatgaaatcagatgaattatgcaaataactttgataacaatggctatcttaaccaaatgcctaacatataggcctggcacaccgtagctggttgttttgcttttttttttttttttttttttttttttgagccagagtctcgctctgtcgctcaggctggagtgcagtggcgcgatctcagctcactgcaagctctgccttccaggttcacgccattgtcctg

SEQ ID NO: 6879 - DNA, 601 bp, Human
ctcagcctcctgagtagctgggactacaggcacccaccaccacgcctggctaattttttgtgtttttagtagagaccgggtttcaccgtgttagccaggatggtctcaatctcctgacctggtgatctgcctgcctcagcctctcaaagtgctgggattacaggcgtgagccaccacgcccagccatggttgttttgctttaattaagaaagatttcagacagtatctgcctcagaagcaagcctctcttttcatggattgattcccttcttttatgtcagaacataaaagatgactgccmgtcatctgccattaccaaagagtactgaactccaagtcaggagtctaggattttgcagtgctggttctcccttctcagtcatctcatctgtaaggtggggataagtagctgctgtgctctgtactgcctgcttctaggggctgtgtggacaaagggaggtgtgctttatcctgatggaatagtatctgtcacttagaatccaatggatatgactgaagaatgaaaagacaaaacaaaacaaaaacactgttcaacaataacaattaaacagctgcctattattaagtgcctgctgtgtgg

SEQ ID NO: 6880 - DNA, 601 bp, Human
catctcatctgtaaggtggggataagtagctgctgtgctctgtactgcctgcttctaggggctgtgtggacaaagggaggtgtgctttatcctgatggaatagtatctgtcacttagaatccaatggatatgactgaagaatgaaaagacaaaacaaaacaaaaacactgttcaacaataacaattaaacagctgcctattattaagtgcctgctgtgtggcgggcctctagtaggcattttgtgtgtgtttgcacacatactgttcacaacaactctaagagatagatgtatcccatctyctacaagacgggtaaactgagactccaagagtcaaggggacatgacagagttaacagctagcaagtgacaaggctggaactgaataacattttgatgccaaggtccttgccctttctattaagttaaactgaagtttatgtgaacagtattaactcactgaagttgagtggtagataagaggagtgtttagcaggctggttctagacctctgcgtccatcttggttagaaagaaatagctccagggctcagccaggtgcagtggctcacacctgtaatcgtaacactttgggaggccgag

SEQ ID NO: 6881 - DNA, 601 bp, Human
aaacaaaaacactgttcaacaataacaattaaacagctgcctattattaagtgcctgctgtgtggcgggcctctagtaggcattttgtgtgtgtttgcacacatactgttcacaacaactctaagagatagatgtatcccatctcctacaagacgggtaaactgagactccaagagtcaaggggacatgacagagttaacagctagcaagtgacaaggctggaactgaataacattttgatgccaaggtccttgccctttctattaagttaaactgaagtttatgtgaacagtattaactyactgaagttgagtggtagataagaggagtgtttagcaggctggttctagacctctgcgtccatcttggttagaaagaaatagctccagggctcagccaggtgcagtggctcacacctgtaatcgtaacactttgggaggccgaggtgattggatcatttgaggtcaggagtttgagaccagcctgaccaacgtcgtgaaaccctgtctctaccaaaaatacaaaattagctgggtgtggtggcacgtgcatgtaatcccagctacttgggaggctgaggcagcagaatcacttgaatctg

SEQ ID NO: 6882 - DNA, 601 bp, Human
tgtgtttgcacacatactgttcacaacaactctaagagatagatgtatcccatctcctacaagacgggtaaactgagactccaagagtcaaggggacatgacagagttaacagctagcaagtgacaaggctggaactgaataacattttgatgccaaggtccttgccctttctattaagttaaactgaagtttatgtgaacagtattaactcactgaagttgagtggtagataagaggagtgtttagcaggctggttctagacctctgcgtccatcttggttagaaagaaatagctccagrgctcagccaggtgcagtggctcacacctgtaatcgtaacactttgggaggccgaggtgattggatcatttgaggtcaggagtttgagaccagcctgaccaacgtcgtgaaaccctgtctctaccaaaaatacaaaattagctgggtgtggtggcacgtgcatgtaatcccagctacttgggaggctgaggcagcagaatcacttgaatctgggaggcagagattgcagtgaaccgagagatcgcactgttgcactccagcctgggtaacaaaagcaacactctgtctcaaaaaaaaaaaa

SEQ ID NO: 6883 - DNA, 601 bp, Human
gttaacagctagcaagtgacaaggctggaactgaataacattttgatgccaaggtccttgccctttctattaagttaaactgaagtttatgtgaacagtattaactcactgaagttgagtggtagataagaggagtgtttagcaggctggttctagacctctgcgtccatcttggttagaaagaaatagctccagggctcagccaggtgcagtggctcacacctgtaatcgtaacactttgggaggccgaggtgattggatcatttgaggtcaggagtttgagaccagcctgaccaacgtmgtgaaaccctgtctctaccaaaaatacaaaattagctgggtgtggtggcacgtgcatgtaatcccagctacttgggaggctgaggcagcagaatcacttgaatctgggaggcagagattgcagtgaaccgagagatcgcactgttgcactccagcctgggtaacaaaagcaacactctgtctcaaaaaaaaaaaaaaaaaaataggaaacaaaagaaaaaagaaataccctccagggctcaaaacaaagactcaagctttaaaacctcatcatttacactgtctttcctccagcatctca

SEQ ID NO: 6884 - DNA, 601 bp, Human
tcaggagtttgagaccagcctgaccaacgtcgtgaaaccctgtctctaccaaaaatacaaaattagctgggtgtggtggcacgtgcatgtaatcccagctacttgggaggctgaggcagcagaatcacttgaatctgggaggcagagattgcagtgaaccgagagatcgcactgttgcactccagcctgggtaacaaaagcaacactctgtctcaaaaaaaaaaaaaaaaaaataggaaacaaaagaaaaaagaaataccctccagggctcaaaacaaagactcaagctttaaaacctcaycatttacactgtctttcctccagcatctcatgaatatcagtggcttatataaagtaatcattaggctattaaaaaaatttattctcatgtctcaaaactcttttggtaaaatcttcacaagttttgttttgttttgctttttaaggaaagccacatttagcaacagtattaggtagactttcccatctgaaagattaagataaatgatctctttcttttctttttaggccactggagaatgcacggcaaccgtggggaagaggagcagtacgaaattctccgtggctacccagacctgcc

SEQ ID NO: 6885 - DNA, 601 bp, Human
atctgaaagattaagataaatgatctctttcttttctttttaggccactggagaatgcacggcaaccgtggggaagaggagcagtacgaaattctccgtggctacccagacctgccagattactccaggtggctggtttatcctctggcactgccctggtgggaaattaaccatttctgtgagccaggaacacaatcttgaccaggctctgcttgctcccagagggtggcagtagtaaagccatttgcagagttagggagcattgggtggagcggcagagcccggaggttgagccaggctygtgaccatcatccccttaggactatcccaactcttcccgtgtgctgcattgtacccagtgtgtgcaagggctcaacagaaggaccagaagacataagacctgccctccattgcaggcagcatcccagattgaggagcgcataggctttgagggcagacctggcctggaatctttcagagctccttgccttcttgcctctccttttccttgtctagaaaagggaggtaagagtacttcccacttcacaggactgttgtgaggctgaaatgagatgatatgcctggaggtacaatcataata

SEQ ID NO: 6886 - DNA, 601 bp, Human
gagcgcataggctttgagggcagacctggcctggaatctttcagagctccttgccttcttgcctctccttttccttgtctagaaaagggaggtaagagtacttcccacttcacaggactgttgtgaggctgaaatgagatgatatgcctggaggtacaatcataataacatactaacatattaatcataataacatattagcaacaatcaggataaaagtaatagctaagatatattgagtccttatgtcccagccatgactcaaagcaccttacatgtattatcttctttttctttttttcttttactgatacataatattttacatatttatgaggtacatgtgagtgttttttacatgcattgaacgtgtaatgattaagtcagggtatttggggtatccatcacctggaatagttatcatttctatgaattggtaatatttcaagtcctctcttttagctactttgaaatatacaatatattgttgctaactatagacactctagtctgctatgtaacattagaacgtatttcttctatctaactataattcagtacctattcaccaacctcttcatttcccccttctacccgctta

SEQ ID NO: 6887 - DNA, 601 bp, Human
tttccttgtctagaaaagggaggtaagagtacttcccacttcacaggactgttgtgaggctgaaatgagatgatatgcctggaggtacaatcataataacatactaacatattaatcataataacatattagcaacaatcaggataaaagtaatagctaagatatattgagtccttatgtcccagccatgactcaaagcaccttacatgtattatcttctttttctttttttcttttactgatacataatattttacatatttatgaggtacatgtgagtgttttttacatgcattgaacrtgtaatgattaagtcagggtatttggggtatccatcacctggaatagttatcatttctatgaattggtaatatttcaagtcctctcttttagctactttgaaatatacaatatattgttgctaactatagacactctagtctgctatgtaacattagaacgtatttcttctatctaactataattcagtacctattcaccaacctcttcatttcccccttctacccgcttaccccgctcagcctctggtatctgtcattctcttcccttctctatctccatgtgatggttttagcttcca

SEQ ID NO: 6888 - DNA, 601 bp, Human
atcataataacatactaacatattaatcataataacatattagcaacaatcaggataaaagtaatagctaagatatattgagtccttatgtcccagccatgactcaaagcaccttacatgtattatcttctttttctttttttcttttactgatacataatattttacatatttatgaggtacatgtgagtgttttttacatgcattgaacgtgtaatgattaagtcagggtatttggggtatccatcacctggaatagttatcatttctatgaattggtaatatttcaagtcctctcttytagctactttgaaatatacaatatattgttgctaactatagacactctagtctgctatgtaacattagaacgtatttcttctatctaactataattcagtacctattcaccaacctcttcatttcccccttctacccgcttaccccgctcagcctctggtatctgtcattctcttcccttctctatctccatgtgatggttttagcttccacatgtgagtgagaacaatgtgaagtttgtctttctgtgcttgagttgtttcacttaacgacctctagttctgtccatgtggctttaaat

SEQ ID NO: 6889 - DNA, 601 bp, Human
aggtacatgtgagtgttttttacatgcattgaacgtgtaatgattaagtcagggtatttggggtatccatcacctggaatagttatcatttctatgaattggtaatatttcaagtcctctcttttagctactttgaaatatacaatatattgttgctaactatagacactctagtctgctatgtaacattagaacgtatttcttctatctaactataattcagtacctattcaccaacctcttcatttcccccttctacccgcttaccccgctcagcctctggtatctgtcattctcttcycttctctatctccatgtgatggttttagcttccacatgtgagtgagaacaatgtgaagtttgtctttctgtgcttgagttgtttcacttaacgacctctagttctgtccatgtggctttaaatgatatgatttcaattctttgtttacggccaaatactatttcattgtgagtatataccacaatttctttctttttttttttcattttgagacagagtctcgcactgtcgcccaggctggggtgcagtggcacgatctaggctcactgcaacctcccgggttcaagcaattctccagcc

SEQ ID NO: 6890 - DNA, 601 bp, Human
aacctcccgggttcaagcaattctccagcctcagcctcagcctcctgaatagctgggattatgggcatcgccaccacgcccggataatttttgtgtttttagtagagatggggtttcaccatgttggccaggctggtctcgaactcctgacctcaggtgatccacccgcctcggcctcccaaagtgctgggattacaggtgtgagccactgtgcctggtcccccacattttctttattcattcaccttttgatggacatttaagttgatttcatatctttgctattgtgaatactgctgcracaaacctgggagtggaagtacccctttgataggctgatttactttcctctgggtagatgcccagtagctggactactggatatatggtatttggtgttttcattttttgaggaatctccgcactattttccatagtggttgcactaatttacattcttaccaacagtgcattagagttctcttttctccatttcctcctggctgtgtttaccgcttacatggcaggcagcgagagctctgtggtgaagaagtccaggctcccagggggtccctccaggtgtgccactcactctgcagct

SEQ ID NO: 6891 - DNA, 601 bp, Human
tatttttagtagagacgaggtttcaccatggtggccaagcgggtggtctcaaactcccaacctcaagtcatcctcccacctcggcctcgcaaagtgctgggattacaggcctgagccactgcactcagctacaaatcttcttaatgattcagtacacccagacttttcttcttttttttttttttttttttgttttttgaggaagagtcttgttctgttgcccaggctggaggctggagtgcagtggtgccatcttggttcactgcaacttccacctcccaagtttaagagatctcctgcytcagtatcccaagtaactgggattacaggcacccaccaccacgcccggctaatttttgtatttttggtagagacaaggtttccccatgtcggccaggctggtcttaaattcctgacctcaggtgttcctcccgtctcggcctcccaaagtgctgggattacaggcatgagccaccacgcccgcccctcccagacttttctgatagttgactgggtctcttgtatttcagcctcttattatgagtgattccctttggttagtaacattctctgcatttaataaaccttacaacttgctttc

SEQ ID NO: 6892 - DNA, 601 bp, Human
gctgggattacaggcatgagccaccacgcccgcccctcccagacttttctgatagttgactgggtctcttgtatttcagcctcttattatgagtgattccctttggttagtaacattctctgcatttaataaaccttacaacttgctttcatgcgagcatgctttactcaattatgtccgtatagtgctatcagggtgggagaggcccagaataaagtagaagaaatcttactacttggtaacctgggagcctgaggacccaacagtaaagaccactcccctctaaagttttctttatccrtctagaagggcattattattttatgaaattcagtaaacatttctctctgcagcctggcagaggaaatattgttaggattcacttaaggaaatccatgttccaaaactggctgaaaaatagaaaaatatatatattgcttgtcattttcagatggctagcggtgtatgtgtgtgtgtgtgtgtgtgtgtttgtgtgagagatatgagactcttaaggtgctcaatgtttattcagcatttttttgcctagtaataataatattttatatttcttgggcacttattatattgccacactgtt

SEQ ID NO: 6893 - DNA, 601 bp, Human
aagtaggcaaaaatttaatgataaagttcttagcattttgtttacattttgtggtaactatcaagctgggtgggaagactgtcacgaaaagtttagatgacattcagcaattcatattcacatttacttgggaagactaaagctcacgtcactggtcaagctgccttacctaactggccaaagaatctgcacagctagcaataagtatttttttataactttattttattttatttattttttgagacaggatctcaatctgttccccaggctggagcacagtggtgtgatctcatctcaytgcagcctccacctcgcatgttcaagctattctcctgcctcagcctcccaagtagctaggactacaggcgccaaccaccacgcatggctaatttttgtatttatagtagagacagggttttaccgtgttagccagagtggtctcgaactcctgacctcaggtgatccgcccaccttggcctcctaaagtgctggtattacaggcatgagccaccgtgcctggccagcaataagtatttacagagcataaccagggactacgaatagataaaatgcttgaacggtcaactgtatctttgtt

SEQ ID NO: 6894 - DNA, 601 bp, Human
tgctttttcttttttgagaagaggtcttgctctgtcaccttggctggagtgcagtggtgcgatctcggctcactgcaacctctgcctcccaggtttaagcaattctcatgcctcagcctccctgagtagctgggattacaggcgcccgctgcaacgccaggctaatttttgtattttgggtacagatgggggttttgccacgttggccaggctgttttcgaattcttgatctcaggtgatccacccaccttggccttccaaagtgctggtattacaggtgtaagccactgcatccggccgytttttctgattctttatattttttggaagtttttgatatttcccgagttttctaattgagcatgcatttattttataattggagaaaaaagtaaaaaggacactatcaagagagtaaaaatacaacccacagaatgagagaaaatatttgcaaatcatgtatctgataagagtttaacatgcagaatatataaagaacctctttttgttcataaaataacaagtattagaaagggcatggagaaattagaacttttgtacattgctggtaggactgtaaaatgctgcagccattatagaa

SEQ ID NO: 6895 - DNA, 601 bp, Human
ttctgattctttatattttttggaagtttttgatatttcccgagttttctaattgagcatgcatttattttataattggagaaaaaagtaaaaaggacactatcaagagagtaaaaatacaacccacagaatgagagaaaatatttgcaaatcatgtatctgataagagtttaacatgcagaatatataaagaacctctttttgttcataaaataacaagtattagaaagggcatggagaaattagaacttttgtacattgctggtaggactgtaaaatgctgcagccattatagaaaatmatttggcaatttctgaaaaacttaactatagaattactatgtgacccagaagttgcactcttaggtatatgcccaaaagaactggaaatgcatattcaaacacgtgtttatacatgaatttctatagcagcaaaattcataatagccagaaagtcaaaacaacccaagtgtctatcaataggtgaatggataaacaaaatgtgctattatatatacacaatgaaacactgttcaccctttaaaaagaatgaaattctgatacatgctacaatgtggatgaagcttgaaaatattatgtta

SEQ ID NO: 6896 - DNA, 601 bp, Human
aaaattcataatagccagaaagtcaaaacaacccaagtgtctatcaataggtgaatggataaacaaaatgtgctattatatatacacaatgaaacactgttcaccctttaaaaagaatgaaattctgatacatgctacaatgtggatgaagcttgaaaatattatgttaagtgaaataagccagacacacacaaaaaatattgtatgattccacttatataaaacacctagaataggcaaattcagtcagagactattggagttgctagaaatgtaatgtaggcttttcttttttttttttgagactgagttttggtcttgttgcccaggctggagtgcaatagcgcaatcttggctcactgcaacctccgcctcccgggttcaagtgattctcctgcctcagcttcccgagtagctgggattacaggcatgtgccaccacggccggctagttttgtatttttagtagagatgaggtttctccatgttggtcaggctggtctcgaactcccaacctcaggtgatccgcctgcctcagcctcccaaagtgacttatcacacagcacctggctatgtttgtttattattcttttttcccctca

SEQ ID NO: 6897 - DNA, 601 bp, Human
cagaaagtcaaaacaacccaagtgtctatcaataggtgaatggataaacaaaatgtgctattatatatacacaatgaaacactgttcaccctttaaaaagaatgaaattctgatacatgctacaatgtggatgaagcttgaaaatattatgttaagtgaaataagccagacacacacaaaaaatattgtatgattccacttatataaaacacctagaataggcaaattcagtcagagactattggagttgctagaaatgtaatgtaggcttttcttttttttttttgagactgagttttgstcttgttgcccaggctggagtgcaatagcgcaatcttggctcactgcaacctccgcctcccgggttcaagtgattctcctgcctcagcttcccgagtagctgggattacaggcatgtgccaccacggccggctagttttgtatttttagtagagatgaggtttctccatgttggtcaggctggtctcgaactcccaacctcaggtgatccgcctgcctcagcctcccaaagtgacttatcacacagcacctggctatgtttgtttattattcttttttcccctcacttctggagacctag

SEQ ID NO: 6898 - DNA, 601 bp, Human
taggtgaatggataaacaaaatgtgctattatatatacacaatgaaacactgttcaccctttaaaaagaatgaaattctgatacatgctacaatgtggatgaagcttgaaaatattatgttaagtgaaataagccagacacacacaaaaaatattgtatgattccacttatataaaacacctagaataggcaaattcagtcagagactattggagttgctagaaatgtaatgtaggcttttcttttttttttttgagactgagttttggtcttgttgcccaggctggagtgcaatagcgcratcttggctcactgcaacctccgcctcccgggttcaagtgattctcctgcctcagcttcccgagtagctgggattacaggcatgtgccaccacggccggctagttttgtatttttagtagagatgaggtttctccatgttggtcaggctggtctcgaactcccaacctcaggtgatccgcctgcctcagcctcccaaagtgacttatcacacagcacctggctatgtttgtttattattcttttttcccctcacttctggagacctaggcataggtctttctatttgtttgttctatttg

SEQ ID NO: 6899 - DNA, 601 bp, Human
aggtttctccatgttggtcaggctggtctcgaactcccaacctcaggtgatccgcctgcctcagcctcccaaagtgacttatcacacagcacctggctatgtttgtttattattcttttttcccctcacttctggagacctaggcataggtctttctatttgtttgttctatttgtttgttctatttgtttttctccctctgtttttaaattatgaaatcatgtcgagtcaaaaattaacttagaatgctgttctaataacattatatggaattctcatttttgttattttgtttttttttccttatccaagaaagaccctaactttattggcaagcatgtttatatttccaagtatattgtttttgtttgtttaaacatgttatgaatttttagagattattttttctttttggtgctgaggtgaaagaacataccctgtattgtttctgctttgtaaaatgtattggatctttttgtgacctggtgtaaaaacaattaaaaatatttgtatgatactggccgggcacggtagctcatgcctgtaatcccagcattttggtgggtggatcacttgagatcaggagttcgagaccagcctg

SEQ ID NO: 6900 - DNA, 601 bp, Human
ttttttttccttatccaagaaagaccctaactttattggcaagcatgtttatatttccaagtatattgtttttgtttgtttaaacatgttatgaatttttagagattattttttctttttggtgctgaggtgaaagaacataccctgtattgtttctgctttgtaaaatgtattggatctttttgtgacctggtgtaaaaacaattaaaaatatttgtatgatactggccgggcacggtagctcatgcctgtaatcccagcattttggtgggtggatcacttgagatcaggagttcgagaycagcctggccaacatggcaaaacctcatctctactaaaaatacaaaaaaattagccgggtgtggtggcagacgcctgtaatcccagacacttgggaggctgaggcaggagaatcacttgaatccaggaggcagaggttgcagtgagctgagattgcgccactgcactccagccttggtgacaaagagagactccatcacaaaaaaaaaaaaaaatatatatatatatatatacacacatatatatatacacatatatatatacacacacacaaatacatacaaattagtatgatacttat

SEQ ID NO: 6901 - DNA, 601 bp, Human
tgtatgatactggccgggcacggtagctcatgcctgtaatcccagcattttggtgggtggatcacttgagatcaggagttcgagaccagcctggccaacatggcaaaacctcatctctactaaaaatacaaaaaaattagccgggtgtggtggcagacgcctgtaatcccagacacttgggaggctgaggcaggagaatcacttgaatccaggaggcagaggttgcagtgagctgagattgcgccactgcactccagccttggtgacaaagagagactccatcacaaaaaaaaaaaaaaawatatatatatatatatacacacatatatatatacacatatatatatacacacacacaaatacatacaaattagtatgatacttataaagtatcatttaaaatcatatgtagcatatgaaaataccatttaaataaatctttaatatgttattcaaatcttctatgttcttgtttattttttattcacttgccctgtcttagatttgtaattgcatactaaattttcccaccatattatttctatccatttctattcacgtgtaattttttctactttaggtattttgattccatgccttc

SEQ ID NO: 6902 - DNA, 601 bp, Human
ttttattcacttgccctgtcttagatttgtaattgcatactaaattttcccaccatattatttctatccatttctattcacgtgtaattttttctactttaggtattttgattccatgccttctggtctatgcttttgaaaaataaaatgatcatttttactacctttaggaatgagtgttttgttctcgtgaattttactttgtccaatattactaatactgtagttcctgctacgtttatatttgtctcacgtagctttgttcatctgttatttttaagctttatacattgtttttatyataagatgattcttgaaactgtaatacattgatttggtgttttaacagtgtgaaagtcttaccttatttttttagaaatttacctttttacttacatggctgttatttctgtactagatcttcctgctttccacgtgctcatgtatatgcatgtatttgttgatgctattgatactattaccttagtatctcttttgcagtaaggctatgttttgcttctttcttttttttctatgcaatgatttggaaagtacacgtcctattcttcaattttactagttgtttacttttaagactcta

SEQ ID NO: 6903 - DNA, 601 bp, Human
tttgaaaaataaaatgatcatttttactacctttaggaatgagtgttttgttctcgtgaattttactttgtccaatattactaatactgtagttcctgctacgtttatatttgtctcacgtagctttgttcatctgttatttttaagctttatacattgtttttattataagatgattcttgaaactgtaatacattgatttggtgttttaacagtgtgaaagtcttaccttatttttttagaaatttacctttttacttacatggctgttatttctgtactagatcttcctgctttccaygtgctcatgtatatgcatgtatttgttgatgctattgatactattaccttagtatctcttttgcagtaaggctatgttttgcttctttcttttttttctatgcaatgatttggaaagtacacgtcctattcttcaattttactagttgtttacttttaagactctaaaaaatgtttttaactgagcacttatatgctttttaaaaaccaggataccggtgaatgtacagataatgcatacatcgatattcagctacgaattgcttccttctcacagaactgtgacatttatccaggtaag

SEQ ID NO: 6904 - DNA, 601 bp, Human
gtaaattaagtgccaatctccctgtatgcttcatcccggacaagtattttacaacattctctctgttttctatatgtaaaggactgaggtgaggatcaaataagttaatatatgtcaaatcactttttcaaactctaaaatgctatataaatacaatagcagctgggcgcggtggctcacacctgcaataccagcactttgggaggccaaggcgggtggatcacaaggtcaagagatcaagaccatcctggccaacatggtgaaaccctgtctctactaaaaatacaaaaattagccgggygtggtggtgcacacctgtagtcccagctactccagaggctgaggcaggagaatcgcttgaacctgggaggcagaggttgcagtgagccgagattgcgccactgcactccagcctggcaacagagcgagactctgtctaaataaataaataaataaataaataaatacaatagcaaccatgatataattaataaaattcagggctagggccaggaagacttacgctatgtctttctggactcatctctcattataacatcacataatgtcttgggctcagccatatcagtcaatccatcat

SEQ ID NO: 6905 - DNA, 601 bp, Human
gaggcaggagaatcgcttgaacctgggaggcagaggttgcagtgagccgagattgcgccactgcactccagcctggcaacagagcgagactctgtctaaataaataaataaataaataaataaatacaatagcaaccatgatataattaataaaattcagggctagggccaggaagacttacgctatgtctttctggactcatctctcattataacatcacataatgtcttgggctcagccatatcagtcaatccatcattgccaaggctccacgctttcttgcctccatgtctttcaccyactgttctctctgcctgggatcccgctctcctgcaaatgtaccctctggggattcatctctcctttcatgccctatcaatagaagactgacaggagtgtcttctgggagtcaggagactcagttccaccatagcatctgccgctcacatcccagatcactctgggtggtcattcaaacgttctaagcctttgtggccccgtctgtaaaatgagtgactgtattagaagagcctacattttgccgggcagagtgcctcatgcctataatcccagcactttgggaggctgaggcaggcagat

SEQ ID NO: 6906 - DNA, 601 bp, Human
ggggattcatctctcctttcatgccctatcaatagaagactgacaggagtgtcttctgggagtcaggagactcagttccaccatagcatctgccgctcacatcccagatcactctgggtggtcattcaaacgttctaagcctttgtggccccgtctgtaaaatgagtgactgtattagaagagcctacattttgccgggcagagtgcctcatgcctataatcccagcactttgggaggctgaggcaggcagatcacctgaggtcaggagttcgagaccagcctgaccaacatagagaaacytcatctctactaaaaatacaaaactagccaggtatggtggtacatgcctgtaatcccagctactcggaaggctgaggcaggagaatcacttgaacccgggaggcggaggttgcaatgagccgagaccgtgtcattgcactccagcctgggcaacaagagcaaaactccttctcaaaaaaagagaagagcctacatgtctagcaactccaatagtctctgactgatgtcattatggacagacccctattttagagactaaaaattggcttccctaaatacaagctaaataaaaataatcaa

SEQ ID NO: 6907 - DNA, 601 bp, Human
taaaatgagtgactgtattagaagagcctacattttgccgggcagagtgcctcatgcctataatcccagcactttgggaggctgaggcaggcagatcacctgaggtcaggagttcgagaccagcctgaccaacatagagaaacctcatctctactaaaaatacaaaactagccaggtatggtggtacatgcctgtaatcccagctactcggaaggctgaggcaggagaatcacttgaacccgggaggcggaggttgcaatgagccgagaccgtgtcattgcactccagcctgggcaacaaragcaaaactccttctcaaaaaaagagaagagcctacatgtctagcaactccaatagtctctgactgatgtcattatggacagacccctattttagagactaaaaattggcttccctaaatacaagctaaataaaaataatcaaaatagagccaaattgttacagcaagccaacataatcctcataatctggtgaaaaaattctcactaaaaagttcatacttttggctcagaattgaatttctaggaatctaaagtaggagtctttatatacaatgatattcactgcagttttaagtata

SEQ ID NO: 6908 - DNA, 601 bp, Human
acattctagtatgcatatgtgtctacattaaggatgtcagggggacacaaagaggtaacccatcagatagctgccaagtcaatctgaatattgcaagaatttcaaacttactttagagagataaatctttactaatttttgcatttaaagagagcaatttggttgcttggacatagtcacccaaggcagccttgatggaagcagccaatttactggaaatcaattaaacatatgatgaatttgctaaaagctagtctccaaaatgaccaatttgccaaattgctaaatatttatagttttmatcttgccttgggtttgcacatttagtcctgtttggatgcatgttgattccacgttgggttcatatttcagatatgaaacacttcctgaatcttccattttcacacattagtgattacagtttcatataagttttattttgccctaccaccactgctgctgtccccaaggctgttgatgctcctgtctgcctctgctgagatgaataaacttccaagatctgtgtgtgcacatgcagaaatttttcctttgacaaagtcctaggaatgtcaaataatatgtagatatataagacttgatg

SEQ ID NO: 6909 - DNA, 601 bp, Human
tattgtgatttttcagaagcagttttcatttttctctagtcaagttttagtattttccccttccttcagatttctttcctctgcttttcacctaagaaaggccttcctcatcctgggttttggtgaatatttatttatttgtttagttgttttttgtttgtttgtttttgttttgttttgtttcccgaaacagagtctcactctgtcacccaggcttgagtgtagtggcgtgatcttggctcactgtaacctctgccacccaggttcaagcgattctcctgcctcagcctcccaagtagcygggattagagatgcttgcaaccatgtccggctaatttttagtatttttaatagagacagggattcattatatgttagccaggacggtctcgaacccctgacctcaggtgatctgcccgcctcaggcccccaaagtgctggaattacaggcaggagccactattcccggccaacacatttaaatactatgatttaatactaaataatttggttgagaaattgggccacaaaatatttaatggaagatagtgttgagtagtgattaaaactgttgctagagattaaaataatttttttttct

SEQ ID NO: 6910 - DNA, 601 bp, Human
aaaacataggctcagaagctaccctagagattagctagttcaaccatccagatgaagcaaaaacactccagcttattttacagttttttttgttgttgtttggctgggtttttttgttttttttttgttgttgttgttgtttgttttttgttttttttgacagagtcactgtcgcctaggctggagtgcagtggcgccatctcagctcactgcaacctccacgtcctgggttcaagcaattctcctgcctcagcctcctgagtagctgggattacaggcatgtgccaccatgcccagctartttttgtatttttagtagagatggggtttcagcatgttggccaggctggtctcaaactcctgacctcaagtgatctgctcgccttggtctcccaaagtgctgagattacaggtgtgagccaccatgcctggctattttatggtattattaacaacaataattaatgtccacaaattttaagatcaatcaaaagacaaaaaaaattattcatcctttctggaatgttaatatagcatttaaaatctggcaaacacctcccccattgtaaactaagatagcattgccagatctcagtgtttt

SEQ ID NO: 6911 - DNA, 601 bp, Human
atgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccayacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcag

SEQ ID NO: 6912 - DNA, 601 bp, Human
aggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtytactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaa

SEQ ID NO: 6913 - DNA, 601 bp, Human
ttcccaaaatgggctagttatatcaaataaatactcccactgccctttctgagtgagagtgtttctcataagtcaaaaatttctgtttactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccraaattttatgaggaaattactctctagtctcactttatagtctttttgctatgactttgaagaccattgatttttgagaagcagaataataggattgcctttcattgccctatagtgcaaagaaggtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaacc

SEQ ID NO: 6914 - DNA, 601 bp, Human
tcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataayaggattgcctttcattgccctatagtgcaaagaaggtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgtttta

SEQ ID NO: 6915 - DNA, 601 bp, Human
aagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaargtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagta

SEQ ID NO: 6916 - DNA, 601 bp, Human; identical to SEQ ID NO: 6877

SEQ ID NO: 6917 - DNA, 601 bp, Human; identical to SEQ ID NO: 6878

SEQ ID NO: 6918 - DNA, 601 bp, Human; identical to SEQ ID NO: 6879

SEQ ID NO: 6919 - DNA, 601 bp, Human; identical to SEQ ID NO: 6880

SEQ ID NO: 6920 - DNA, 601 bp, Human; identical to SEQ ID NO: 6881

SEQ ID NO: 6921 - DNA, 601 bp, Human; identical to SEQ ID NO: 6882

SEQ ID NO: 6922 - DNA, 601 bp, Human; identical to SEQ ID NO: 6883

SEQ ID NO: 6923 - DNA, 601 bp, Human; identical to SEQ ID NO: 6884

SEQ ID NO: 6924 - DNA, 601 bp, Human; identical to SEQ ID NO: 6885

SEQ ID NO: 6925 - DNA, 601 bp, Human; identical to SEQ ID NO: 6886

SEQ ID NO: 6926 - DNA, 601 bp, Human; identical to SEQ ID NO: 6887

SEQ ID NO: 6927 - DNA, 601 bp, Human; identical to SEQ ID NO: 6888

SEQ ID NO: 6928 - DNA, 601 bp, Human; identical to SEQ ID NO: 6889

SEQ ID NO: 6929 - DNA, 601 bp, Human; identical to SEQ ID NO: 6890

SEQ ID NO: 6930 - DNA, 601 bp, Human; identical to SEQ ID NO: 6891

SEQ ID NO: 6931 - DNA, 601 bp, Human; identical to SEQ ID NO: 6892

SEQ ID NO: 6932 - DNA, 601 bp, Human; identical to SEQ ID NO: 6893

SEQ ID NO: 6933 - DNA, 601 bp, Human; identical to SEQ ID NO: 6894

SEQ ID NO: 6934 - DNA, 601 bp, Human; identical to SEQ ID NO: 6895

SEQ ID NO: 6935 - DNA, 601 bp, Human; identical to SEQ ID NO: 6896

SEQ ID NO: 6936 - DNA, 601 bp, Human; identical to SEQ ID NO: 6897

SEQ ID NO: 6937 - DNA, 601 bp, Human; identical to SEQ ID NO: 6898

SEQ ID NO: 6938 - DNA, 601 bp, Human; identical to SEQ ID NO: 6899

SEQ ID NO: 6939 - DNA, 601 bp, Human; identical to SEQ ID NO: 6900

SEQ ID NO: 6940 - DNA, 601 bp, Human; identical to SEQ ID NO: 6901

SEQ ID NO: 6941 - DNA, 601 bp, Human; identical to SEQ ID NO: 6902

SEQ ID NO: 6942 - DNA, 601 bp, Human; identical to SEQ ID NO: 6903

SEQ ID NO: 6943 - DNA, 601 bp, Human; identical to SEQ ID NO: 6904

SEQ ID NO: 6944 - DNA, 601 bp, Human; identical to SEQ ID NO: 6905

SEQ ID NO: 6945 - DNA, 601 bp, Human; identical to SEQ ID NO: 6906

SEQ ID NO: 6946 - DNA, 601 bp, Human; identical to SEQ ID NO: 6907

SEQ ID NO: 6947 - DNA, 601 bp, Human; identical to SEQ ID NO: 6908

SEQ ID NO: 6948 - DNA, 601 bp, Human; identical to SEQ ID NO: 6909

SEQ ID NO: 6949 - DNA, 601 bp, Human; identical to SEQ ID NO: 6910

SEQ ID NO: 6950 - DNA, 601 bp, Human; identical to SEQ ID NO: 6911

SEQ ID NO: 6951 - DNA, 601 bp, Human; identical to SEQ ID NO: 6912

SEQ ID NO: 6952 - DNA, 601 bp, Human; identical to SEQ ID NO: 6913

SEQ ID NO: 6953 - DNA, 601 bp, Human; identical to SEQ ID NO: 6914

SEQ ID NO: 6954 - DNA, 601 bp, Human; identical to SEQ ID NO: 6915

SEQ ID NO: 6955 - DNA, 601 bp, Human; identical to SEQ ID NO: 1610

SEQ ID NO: 6956 - DNA, 601 bp, Human; identical to SEQ ID NO: 1611

SEQ ID NO: 6957 - DNA, 601 bp, Human
ttttatcagaatcagcccaacacttttgaaaactgtaacttaataaatgtcattggctggtcacatggaaatacctggcttcactccatttctctgatgtgttgcacacctagactctggatgccctcgtcatcgctaccggactggtcactctggtgctggaggaagatggcaccgtggtggacacagaagagttctttcagaccttgggagacaacacgcatttcatgatcttggaaaaaggacagaagtggatgccggtaagcaaaaacactgtcacccaaacagctactgggtagactttttacctacaaatttgcgtgccctacttgggtgttgacttgtccactttctttcttttttttttttctttttttgagacggagtctcgctctgtcacccaggctggagtgcagtggcgcgatctcggctcactgcaagctccgcctcccgggttcccgccattctcctgcctcagcctccggagtagctgggactacaggcacccgccaccacgcccggctaactttttgtatttttagtagagacggggtttcaccgtgttagccaggatggtctcgatctcctgacctcgcgatcc

SEQ ID NO: 6958 - DNA, 601 bp, Human
cgcatttcatgatcttggaaaaaggacagaagtggatgccggtaagcaaaaacactgtcacccaaacagctactgggtagactttttacctacaaatttgcgtgccctacttgggtgttgacttgtccactttctttcttttttttttttctttttttgagacggagtctcgctctgtcacccaggctggagtgcagtggcgcgatctcggctcactgcaagctccgcctcccgggttcccgccattctcctgcctcagcctccggagtagctgggactacaggcacccgccaccacgccyggctaactttttgtatttttagtagagacggggtttcaccgtgttagccaggatggtctcgatctcctgacctcgcgatccgcccccctctgcctcccaaagtgctgggattacaggcgtgagccaccgcgcccggccaacttctccactttctaaatatgcactttgtattcacctaacaactggatccactgccctcaaagggattcttacaaatgtttctaggaaacttagtctctctgtgaactgaggctatttgatataaagcaaataattccagggaacaggctttggccagtg

SEQ ID NO: 6959 - DNA, 601 bp, Human
aaaaacactgtcacccaaacagctactgggtagactttttacctacaaatttgcgtgccctacttgggtgttgacttgtccactttctttcttttttttttttctttttttgagacggagtctcgctctgtcacccaggctggagtgcagtggcgcgatctcggctcactgcaagctccgcctcccgggttcccgccattctcctgcctcagcctccggagtagctgggactacaggcacccgccaccacgcccggctaactttttgtatttttagtagagacggggtttcaccgtgttarccaggatggtctcgatctcctgacctcgcgatccgcccccctctgcctcccaaagtgctgggattacaggcgtgagccaccgcgcccggccaacttctccactttctaaatatgcactttgtattcacctaacaactggatccactgccctcaaagggattcttacaaatgtttctaggaaacttagtctctctgtgaactgaggctatttgatataaagcaaataattccagggaacaggctttggccagtgagtagctacagatcctgtaaatgcacggaattgacttggcaactctt

SEQ ID NO: 6960 - DNA, 601 bp, Human
acgttctcacaatgcaagttcacaatcaaaacacagaacgtaaggactcaggcaccacattcatgagagtaagcagaagcaatcaagtcaggcctgccaggaccgcagatgttggaatcatcagacacacagtataaaattagtgtactaaaaatgctcacccatggctaagtttgactgactaaataaataaattaattaaatgctcaaagaaacattaaaaataatctaaaataagaatagctaggaattgaagaccagcctaggcaacagcaaaaccccaatctccaccaaaaaaaawttttttaaggcttagctgggcaagatgctacacacctgaagtcctagctactcaggaggctgaggcaggaggatcacttgagcccaggacttggatgctgcaatgaactatgatcacacctctgcactccagcctgagtgacagagcaagaccctatatcaaaaaaaacaaaaaataagaaaataccagcctgagcaacatggcaaaaccccatctctaccaaaaaatacaaaaattagcctggcgtagtggtgcatacctctagtcccagctacttgagaggctgaggcgggagaacca

SEQ ID NO: 6961 - DNA, 601 bp, Human
gaacaagagctaataagaactgactatacagatttgaaataatcaaatagaatttttggaaatgaaaaatataacaactaaaatcaagtaaatggagactcaggttagacagagctgaaggtaatgataaaagatctgaaagatgttgcctgtgatgtaacacaaagcagtagaggtggggaacacgaaggatgttagagaccagactgaaatctaatctctctctctttggcatcctcacgtagggaaggatttttttaaaacaagatacaatgcacaagtcatttttttttttttttttgagacagagtctcactctgttgcccaggcttgagtgcagtggtgtgatctcggctcactgcaacttctgcctcccgagttcaggtgattcttctgcctcagcctcccgagtagctgggactacaggcatgtgccaccacgcctggctaatttttgtattttcagtagagatggggtttcaccatattggacaggctggtctcgaactcctgaccttgtgatccacctgcctcggcctcccaaagtgctgggattacaggtgtgagccaccgcacccggccgatttttttatttttaagat

SEQ ID NO: 6962 - DNA, 601 bp, Human
ataatcaaatagaatttttggaaatgaaaaatataacaactaaaatcaagtaaatggagactcaggttagacagagctgaaggtaatgataaaagatctgaaagatgttgcctgtgatgtaacacaaagcagtagaggtggggaacacgaaggatgttagagaccagactgaaatctaatctctctctctttggcatcctcacgtagggaaggatttttttaaaacaagatacaatgcacaagtcatttttttttttttttttgagacagagtctcactctgttgcccaggcttgagtgcrgtggtgtgatctcggctcactgcaacttctgcctcccgagttcaggtgattcttctgcctcagcctcccgagtagctgggactacaggcatgtgccaccacgcctggctaatttttgtattttcagtagagatggggtttcaccatattggacaggctggtctcgaactcctgaccttgtgatccacctgcctcggcctcccaaagtgctgggattacaggtgtgagccaccgcacccggccgatttttttatttttaagatatagggcaacacactcctctactaccaccaacagctac

SEQ ID NO: 6963 - DNA, 601 bp, Human
ttcaggtgattcttctgcctcagcctcccgagtagctgggactacaggcatgtgccaccacgcctggctaatttttgtattttcagtagagatggggtttcaccatattggacaggctggtctcgaactcctgaccttgtgatccacctgcctcggcctcccaaagtgctgggattacaggtgtgagccaccgcacccggccgatttttttatttttaagatatagggcaacacactcctctactaccaccaacagctacttaatgcagcaatttgcttcatctcagagagtgaggcacaractatgacccagcagctgctttcctgggcatgaacctgagattccaacaacaccacgtcagcaggtgtgtgttagagcgtccatggcagcaatgccctaagtggtgagaacaaacactggaaacaaatcatgtacccttgcagcacacacgtgtgcccagcacatagaagtacttctaagtaaatacacacgaagaaactgtaatgtggtccctgaacagaatgctcttcagctgtgaaaatgtgtgaagttcagctacaggcatccatgtggatacacatcagctatgctgagcaaaag

SEQ ID NO: 6964 - DNA, 601 bp, Human
tttggcatgatctcggctcactgcaacctctgcctccctggctcaagtgtttcttgtgcctcagcctcccaagtagctgggatcacaggcaagccaccaccacgcctggctaatttttgtatttttagtagagacagggtttcaccatgttttccaggctggtcttgaacttctgacctcaagtgatccaccggccttggcctcccaaagtgctgggattacaggcatgagccaccacacccggcttgtatcaataaattctatagacatgtgccaatcagaggttctgagctgcagagaytttgtcccttgggggacatttgttaatgtctgaagacatgttaggctgttgcatctagtgtgtagagaccagagatgctgccaaacatcctgcaatgcacaggacaaccccgacagcaaagacttatccagcctccaatgtcgttagtgtcaaggtcgagaaactataagctatagatagatatagatattcccaatagtcaaaattgttttttgtttgtttgcttgttttttgagatggagtctcgctctgtcgcccaggctggagtgcagtggcgcgatctcggctcactgcaaccta

SEQ ID NO: 6965 - DNA, 601 bp, Human
gctaatttttgtatttttagtagagacagggtttcaccatgttttccaggctggtcttgaacttctgacctcaagtgatccaccggccttggcctcccaaagtgctgggattacaggcatgagccaccacacccggcttgtatcaataaattctatagacatgtgccaatcagaggttctgagctgcagagactttgtcccttgggggacatttgttaatgtctgaagacatgttaggctgttgcatctagtgtgtagagaccagagatgctgccaaacatcctgcaatgcacaggacaamcccgacagcaaagacttatccagcctccaatgtcgttagtgtcaaggtcgagaaactataagctatagatagatatagatattcccaatagtcaaaattgttttttgtttgtttgcttgttttttgagatggagtctcgctctgtcgcccaggctggagtgcagtggcgcgatctcggctcactgcaacctatgcctcctggcttcaagggatcctcctgcctcagcctcctgagtagctgggattacaagtgcctgccaccatgcccggccttttttttttttttttttttttttcatt

SEQ ID NO: 6966 - DNA, 601 bp, Human
ccaaacatcctgcaatgcacaggacaaccccgacagcaaagacttatccagcctccaatgtcgttagtgtcaaggtcgagaaactataagctatagatagatatagatattcccaatagtcaaaattgttttttgtttgtttgcttgttttttgagatggagtctcgctctgtcgcccaggctggagtgcagtggcgcgatctcggctcactgcaacctatgcctcctggcttcaagggatcctcctgcctcagcctcctgagtagctgggattacaagtgcctgccaccatgcccggccytttttttttttttttttttttttcatttttagtagagacggggttttgtcatattggccaggctggtctcgaactcctgacctcaggtgatccacccaccttggcctcccaaagtgctaggattacaggcatgagccaccgcccccagtggttttttttttttttttaatttgtttgctttttgtttggagacagtcttgctctgtcgcccactctggagtgcagtggcacgatctcagctcactgctacctcgacctcctgggctcccccacctcagcctcccaagtagctgggactac

SEQ ID NO: 6967 - DNA, 601 bp, Human
ctctgtcgcccaggctggagtgcagtggcgcgatctcggctcactgcaacctatgcctcctggcttcaagggatcctcctgcctcagcctcctgagtagctgggattacaagtgcctgccaccatgcccggccttttttttttttttttttttttttcatttttagtagagacggggttttgtcatattggccaggctggtctcgaactcctgacctcaggtgatccacccaccttggcctcccaaagtgctaggattacaggcatgagccaccgcccccagtggttttttttttttttttaatttgtttgctttttgtttggagacagtcttgctctgtcgcccactctggagtgcagtggcacgatctcagctcactgctacctcgacctcctgggctcccccacctcagcctcccaagtagctgggactacaggcatgtgccaccatgcctggctgatttttgtatcttcttgtagagacagggttttgccatgctggccaggctggcttcaaactcctggtttcaagctcctgagctccagcgatccactacctctgcctcccacagtgctgggattacaggcgtgagccaccccgc

SEQ ID NO: 6968 - DNA, 601 bp, Human
ggcgtgatctcggctcactgcaacctccacctcctgggttcaagcgattctcctgcctcagcctcccaagtagctgggattacaggtgcctgtcaccacgcccagctaatttttgtatttttagtggggtttcactatgttggccaggctggtcttaaacttctgaccttgtgatctgcctgcctcagcttcccaaagtgctggagttgcaggcacgagccaccacgaccagccaccaggttaatttaactcatatttttatgaaaagtgactattttccaaaacaaaaagatggaggaayggcattttttacatttttgtaaatttctttaatgtctggcttaatagaagattcttatatctgcttctttatattcagtctgttgtaacatattgttttgatggaagtatgaagaaaatccatcctgacacagatatgcagctgggaaaggaggaggattttaatagcctattcagataactgaggatattcttttttttatattatgccagaactcaccaagtcatggtttcagaatagtgagttgaggtgttttcagaaaggtcagatgcagcgtgtaatctgaaggtataccagtga

SEQ ID NO: 6969 - DNA, 601 bp, Human
gcatgtcaccacacccagctaaatgcttgtatttttttagagatgggatttctccatgttgcccaggctaatcttgaactcctgggctcaagtgatccacctgcctcagcctcccaaaatgttgggattacgggcataagccaccgtgcttggcctagttttgacctctcagtcccttaatagggcctcaggattcctggatgtctccagattacactttgataaactccacatcaaatcatttacagataattcaaaaatatgcaaaattaacaatataatgtttgagatacacatgtgytaaaaatagagaaaagtaaggggaaaacgcatggcataaaaacctcttgagaggaggggagatgtgggaggtggatggggtctctaagggatggcagtgtgtaggtttcattttacgtctttctgtcccttacttctacatatattatacatatacatatatattatatatataacctcacaattttcctgactgggaaagaaaccacagaccaattataaaagcataatatttagaataaaatgtaatctttaatgtagatgagggctgggcgcagtggctcacacctgtaatcccagc

SEQ ID NO: 6970 - DNA, 601 bp, Human
ggcaggtggggagatgtctgtagatgagactattaattgtggggtgaattagacaaatcatttaaagcaaatattggtgctgcatggctttttgcttgaggaaagtgtaacagcaaaaataatgcccccacagaccacagacacctctgtttgttttcttttctttttctttttcttttctttttttttttttttttttttgagacagttttgcttttgtcgcccaggagggagtgcaatggcgtgatctgggctcactgcaacctccacctccagggttcaagtaattctcctgcctcakcctcccgagtagctgggattacaggcgcccaccaccacgcccggctaatttttgtattattagtagagacggggtttcgccatgttggccaggctggtctcaaactcctgacctcaggcgatccacccacctcggcctcccaccgtgctaggattacaggcgtgagcccaggcggccggacagacgcccctgtcttaatcctcagccgtggcagatgggattaagtgaaggttactggggcggggttggggtggggtttgtcctggatcatctgggtagaggccgaagtcttcacaaggg

SEQ ID NO: 6971 - DNA, 601 bp, Human
tgccccgcagcccccacggcggccctgcgccctggctttgactctgacctcggcagtgggacagcattggtgtgtgggtttcatgccactgaggttctggtcgtttgttacagcagcagtaggagatgggaaaggcgggtttgtttttctaaaggagacactcagctaacagggaggagttggtggtgggcgctgggaacctggttgcagggcagggtggtgggggcggtcgatgccacgggtgtagatgccaccgccggccacgcgctccagggggctcgcggcccccgtttcggctgcscaaccacctccctggatcccagccacctgtaggcctttctgggcaaaaccagtttagactgagaccagaacgctggagcaggaagccgccagcaggtgtctcgctccccggtcccagcgccctcaggaagagcgcggccccgcagcccccgcccggcgaggccccagcggatccgcggcgggagggcgtcataattttaaccaagactggagacatttagggagagtaaaattaaaactttcaaaagtcagaaagggatgtgaggctcggaaaaagaggcgcgggacgggaggagaagcc

SEQ ID NO: 6972 - DNA, 601 bp, Human
cccaaaatgctgggattacaggtgtgcaccaccatgcccggctaatttttgtatttttagtagagacggggtttcgccatgttgaccagtctagtctcaaactcctgacctcaggtcacctgctcctcttggcctcccaaagtgctgggattacaggtgtgagccactgtgcccggcctcagctttgatttttaaagtaataagagggagctacaaccgcttagaaaaggatgatgaagtcaacctcacccgagattccacctcacaaaattttattttctttttccttctttttttttttgacaaggtcttgctctgtcatccagtctggagggcagtagcacaatcatagctcactgcagcctcaacctcctgccctgttcaaggggtgctcctgccccagcctccaaaagtgctgagactacaggcatgagccactgtgcctggccacaaaaagtttcctgaaagacaaattcaagtcaaagacaaatgcctgatatttgtaccttggggcagctttgctctcttatatttttaaagtgtcacaggagggagagcttttagttgacagattcctaatccatacataccccagatctat

SEQ ID NO: 6973 - DNA, 601 bp, Human
ggtgtgagccactgtgcccggcctcagctttgatttttaaagtaataagagggagctacaaccgcttagaaaaggatgatgaagtcaacctcacccgagattccacctcacaaaattttattttctttttccttctttttttttttgacaaggtcttgctctgtcatccagtctggagggcagtagcacaatcatagctcactgcagcctcaacctcctgccctgttcaaggggtgctcctgccccagcctccaaaagtgctgagactacaggcatgagccactgtgcctggccacaaaawgtttcctgaaagacaaattcaagtcaaagacaaatgcctgatatttgtaccttggggcagctttgctctcttatatttttaaagtgtcacaggagggagagcttttagttgacagattcctaatccatacataccccagatctattcaaacaaattctgtatgatccgaattagaggctacaactggaaccacaggtgggtttgtctgtatggtgggacaggggaataaagaaggctggccacggcgaggagggtttgggtaattttaggggtatttacattttaagttcccattcatga

SEQ ID NO: 6974 - DNA, 601 bp, Human
acaaaattttattttctttttccttctttttttttttgacaaggtcttgctctgtcatccagtctggagggcagtagcacaatcatagctcactgcagcctcaacctcctgccctgttcaaggggtgctcctgccccagcctccaaaagtgctgagactacaggcatgagccactgtgcctggccacaaaaagtttcctgaaagacaaattcaagtcaaagacaaatgcctgatatttgtaccttggggcagctttgctctcttatatttttaaagtgtcacaggagggagagcttttagwtgacagattcctaatccatacataccccagatctattcaaacaaattctgtatgatccgaattagaggctacaactggaaccacaggtgggtttgtctgtatggtgggacaggggaataaagaaggctggccacggcgaggagggtttgggtaattttaggggtatttacattttaagttcccattcatgaggtcactgtcattggtgaatttaccattcacagcttcagcggctcccaacctcgaaggctcacaagacctagtaaccctgtgtagacccgaatcctgagtgctgcaaga

SEQ ID NO: 6975 - DNA, 601 bp, Human
aaccattttgtggggaaaattctgttccggtgctgtttataaacctgggatgtgtagaggtcactgacttcctcctcccacccaggggggtctcctcccacccaggggttctgctgcatggctttgggcttccccatggagtccgctctcaaccctggggggttattaaaacacagaggtgctctgggaaggtgcccactctgccctcacttcagccatatgattctggtactttccacccagtagcccccataaaattgaaccaatgctgcctgcttctccattaccataactgtgttawagtgatgagatgagattcttttgtcaccaggtaaccatggtggcctccagggcgagtgggtccccaccactcatcagggcacatctatccactgagcaacggggtcctaaaatccaggccctgacgccacaccagactcaccctgagtccggaactgaaggcagatcagggacagatgcctcgtggctaattggacacagtcgtagtgtgtgcaaatgggtcctgctgaaagcatctctctatcgattagccacggagccactcacagaccttaaacagacacataggagaatctgaagc

SEQ ID NO: 6976 - DNA, 506 bp, Human
ggtgctctgggaaggtgcccactctgccctcacttcagccatatgattctggtactttccacccagtagcccccataaaattgaaccaatgctgcctgcttctccattaccataactgtgttatagtgatgagatgagattcttttgtcaccaggtaaccatggtggcctccagggcgagtgggtccccaccactcatcagggcacatctatccactgagcaacggggtcctaaaatccaggccctgacgccacaccagactcaccctgagtccggaactgaaggcagatcagggacagaygcctcgtggctaattggacacagtcgtagtgtgtgcaaatgggtcctgctgaaagcatctctctatcgattagccacggagccactcacagaccttaaacagacacataggagaatctgaagctggcataagagcagagtgatgacgtggggagggttagggaaggctcctgaagcctgcccctccccccattgtcacagggcag

SEQ ID NO: 6977 - DNA, 367 bp, Human; identical to SEQ ID NO: 1612

SEQ ID NO: 6978 - DNA, 601 bp, Human; identical to SEQ ID NO: 1613

SEQ ID NO: 6979 - DNA, 601 bp, Human; identical to SEQ ID NO: 1614

SEQ ID NO: 6980 - DNA, 601 bp, Human; identical to SEQ ID NO: 1615

SEQ ID NO: 6981 - DNA, 601 bp, Human; identical to SEQ ID NO: 1574

SEQ ID NO: 6982 - DNA, 601 bp, Human
gctcccaggcagtattcaggaggggaagagctggtggggatgggcagccaggctcccaacaccccagagcagaccttgggccatatcatccaacataggacttggaaaagtgggagaaccccaacactgtggacccagattccgttgtttgccagatagagtcaagaatatccaatgaaatgaccagaaaatacagttctgactcctggaactttccaaaaccatgagaaatcggtgcaggccaacttactccccaaggaaagccccttagagcaatggtcttcaaatgcctttgcttatrtgtgctcaaaataatataaagctgtgtgtatattttaaggtaacatacacatttttgtcaagatagttgcaaaaaatgtaataatatttcactcttccgaaccctttttgagtatctgacttcagcaagttgtctacaagtgaaagaaacgggaatcatttaataatcattttgtaagtcagtttaagaacagactaatacacaggactccagctcagcaaagccttttgatgtacttcccagaaattattaaaataaatggtgtgttgtaaatactgacatttcaaagtcgtttcttta

SEQ ID NO: 6983 - DNA, 601 bp, Human
tcagcctcccaagtagccagactacaggcgtatgccaccacgcctagctaatttttatatgtattttagtaaagacaggattttgccatgtttcccaggctggtcttgaactcctgaccttaagtgatccaccccccgcttggcctcccaaagtgctgggattacaggcatgagccaccacacctggcccagatattgcatttttaataaatggaaggtttgtggcaaccctgcaaacctattggctccatttttccaacagcatatgctcactttgtatctctatgttacattttggtarttctcacaacattttaagttttttaattagtgttatatctgttactatgatctgtgatcagtaatcttttttgttgtcgttgttcaaatccaggataatctctgtaaatgtgatgagtgatctttgatgttactattgtaattgctttggggtgccacaaagcacacctgtataagacagcagacttaaatgataaatgttaagtgtgttctgactgttccacccactggccattcctgtctctctccttctccttgggcctccctattccctgaggcaatattgaaattgggccaatta

SEQ ID NO: 6984 - DNA, 601 bp, Human
cactttgtatctctatgttacattttggtagttctcacaacattttaagttttttaattagtgttatatctgttactatgatctgtgatcagtaatcttttttgttgtcgttgttcaaatccaggataatctctgtaaatgtgatgagtgatctttgatgttactattgtaattgctttggggtgccacaaagcacacctgtataagacagcagacttaaatgataaatgttaagtgtgttctgactgttccacccactggccattcctgtctctctccttctccttgggcctccctattccctgaggcaatattgaaattgggccaattaatagccctacaatggcctctaggtgtctattgaaaggaagagtgatatgtctgtcactttaaatcaaaagctagaagtgattcaacttagtgaaggcatgttgaagccaagacaggctgaaagctaggcctcctgtgccaaacagccaagttgtgaatgcaaaggaaaagttcttgaaggaaattaaaagtgctattccagtgaacacacggataataacattattgctaattattgctgacttggagaaagtttgagtggtctggatag

SEQ ID NO: 6985 - DNA, 601 bp, Human
cttaagaaataatgtcttactatttgagaaatattatttcagaaatacattttataaggctatagttgccataaataatgttgggaataacattatagctatagtgttaccgctgatggatctgggcagttaattgaaaaccttctggaaaggatgcaccattctagatgccagtaagaacatttgcgatttatgggaggatgtctgaacattaataggagtttggaagaagttgattccaaccctcatggatgactttgatgggttcaagacttccttcaatggaggaagtaactgcagrtgtgccaatcatggtggaaatagcaagagaactagaattagaagtagacctgaagatgtggctgaattgctgcaatcttatgataaaacttgaacagataaggagtttcttcttatgaataagccaagtaagtggtttcttgagatggaatctactgctggtgaatgtgctgatacatttttgaaatatacatttagaatattacataaacttagttggtaaagcagccacagagtttgagaggattgacatgaattttgtatgtgttttaactctttttttgtttgttttcttttaaac

SEQ ID NO: 6986 - DNA, 478 bp, Human
tagcattttttagcaataaagtatgttttaattaagatatgtattttttggacataatgctgttgcgtatactcagactggagtacagtgtgaacataacttttctacccactgggaaaccaaaaaagtcaggcgactccatttattgcaatatttgctttcctgtggtggtctgaaactgagccgacggtatatctgagttgtgcctatatttgaatttggaacagcccagtgtggtcccacgtacccccattactagtgacatacttcccctttatcagactcatgtataagtaagaarcccaccacagtgcctgattcaaggagactcacagatacgtcttgtttgtctctttgtggatgacctggaggtttcatcaccctgtaagtgaggttcagggtgggtgagaaagtctgcccttcttttacacagtgggagatgggagaatgggcaagggaaaaagtggtatctctgaca

SEQ ID NO: 6987 - DNA, 439 bp, Human
tgtattttttggacataatgctgttgcgtatactcagactggagtacagtgtgaacataacttttctacccactgggaaaccaaaaaagtcaggcgactccatttattgcaatatttgctttcctgtggtggtctgaaactgagccgacggtatatctgagttgtgcctatatttgaatttggaacagcccagtgtggtcccacgtacccccattactagtgacatacttcccctttatcagactcatgtataagtaagaagcccaccacagtgcctgattcaaggagactcacagatacrtcttgtttgtctctttgtggatgacctggaggtttcatcaccctgtaagtgaggttcagggtgggtgagaaagtctgcccttcttttacacagtgggagatgggagaatgggcaagggaaaaagtggtatctctgaca

SEQ ID NO: 6988 - DNA, 601 bp, Human
caaggagccattgtaggtccaagaccaagccctggccagcagcctagaagatattctctcctaggaacctgagaaatcagaggctcccttctgagctctgctcaaggtcagaattcaagaaaaggaaaaaaaggggaaaacaggtttcccgcagtctcagattacccctgggcctccgtggagtctcgtgtgtctctgctgaggagtttgtttacccttctggtttcccagtggaagagagcaggagaaaagatctattctcaacatttgctaaactccctattttccaggcactggctckgatcacatgggttttacccttggcatcatctctgttttccagcctttgccccctggagggtggttaataaatgccacttggttataattctctctcctggaggcatcttgggcttcttcaccagtgagtgaagatatgtaaacacatccctataaaaaatgtgttatttgtataattataaggaagattcaagtggcatcctttttcatttggagaggggttaaaaaactgttttagaagacgcaatgctttggaattagagacaagaacaaagaaggcagaccttaattcattccaaag

SEQ ID NO: 6989 - DNA, 601 bp, Human
catttggagggttgagatggggaaatacagcaactcctggatcgttcactttatgcaagatcattgaaaaatgtttgtatgcctcatttaaaaatgaagggctttggtatgcttccgtggtctcctattatttttattcacttgagtacctttaaaggaaaaacataacctaatgaacttgaactctttaattcaccacacactcacttcctgtttttgttgattaacttacatatagtttgacatgttttgccgtcatgtgagtgccgttttgcagcctggtgtagatttgggacttcgstgggttgaccatgtgtgatgctcatcaacttgaactgtatgatggtttgttctgttgatactctgtctcttgcttagctattcccctgtcgttcccaatttttcactcttaaagattgtgctcctggctgcatgtttatggaaattttgttttcttttttcctttggaccccacgctcacagacagttgcttttttccacaggagccatcccagggttgggggatgctacaatggggagccggggcatttctgccggtcagcagagaagggagaggccagtgtgaccttcccagcccgag

SEQ ID NO: 6990 - DNA, 601 bp, Human
tttagacaaagtggctacgaaaaccagagctctagttccgaatgaaacagctctggggaaatgtgagcctggtggtgtgtttactttcatgctgatgaatgtctgcaggcagatagagctactgggaatcctattcatggtgatgctttagaaaattaatcgcagtgggcttcttgcatgcttatattcctttccaaatatagaaaggcataattcacattttgagtagcccaggggatccataagaggataaaacctgtatttatccactccagtgatggggaaaattacacttgcaccsggagtggattgtaaaaatccattgtactctttctaaggtttttcacttctttgtaaagtaggcagaatatttttatcctataacattttctgatacaagttgctgtaggctcttcaaggatgtctttttatctaaataatcatgagagcttggttataattttttgactcttgactgttgtagtgaaaatgactgagttgacctcacactgtgaaattagaagttgcaggaaatggctctctacctaagaagttaggacactctggttccttcctgatagttgatgctggcattatttgt

SEQ ID NO: 6991 - DNA, 601 bp, Human
ttcatgctgatgaatgtctgcaggcagatagagctactgggaatcctattcatggtgatgctttagaaaattaatcgcagtgggcttcttgcatgcttatattcctttccaaatatagaaaggcataattcacattttgagtagcccaggggatccataagaggataaaacctgtatttatccactccagtgatggggaaaattacacttgcaccgggagtggattgtaaaaatccattgtactctttctaaggtttttcacttctttgtaaagtaggcagaatatttttatcctataacrttttctgatacaagttgctgtaggctcttcaaggatgtctttttatctaaataatcatgagagcttggttataattttttgactcttgactgttgtagtgaaaatgactgagttgacctcacactgtgaaattagaagttgcaggaaatggctctctacctaagaagttaggacactctggttccttcctgatagttgatgctggcattatttgtgttcctagcagagatttatgcttatctgaacacatctggaaatgaagatagtggtacttgcccatactggcgaagaagctcaaca

SEQ ID NO: 6992 - DNA, 601 bp, Human
atatttttatcctataacattttctgatacaagttgctgtaggctcttcaaggatgtctttttatctaaataatcatgagagcttggttataattttttgactcttgactgttgtagtgaaaatgactgagttgacctcacactgtgaaattagaagttgcaggaaatggctctctacctaagaagttaggacactctggttccttcctgatagttgatgctggcattatttgtgttcctagcagagatttatgcttatctgaacacatctggaaatgaagatagtggtacttgcccataytggcgaagaagctcaacatgaagaaagagatgggatggttaggaagcactgggttcaacctgctgtgttaactttcctttgcattttagtgtacacttaagtgcacttaataagtcattctaccaagatattgtagtgtgttgtgatcttgcttgtctggctctaagcatagtgatttagtagccaggtttctttttttaaatctgcagtgaattgtggaacacagaagcttttaagcggatttagaactttcaattcactgctctggtttatcttggactttgcacttaatggcaggtt

SEQ ID NO: 6993 - DNA, 601 bp, Human
ggtacagcagttctcacatgcttcagcatcttctgcagtgaggtcctaggaacctggagaaacaacaacagccacttttagaaaatcatgtctttggggatgattgccagctgaagaagtttctaatctggacctttgaaagcattttattttccttctttttccctccccagctcccacccctgggagaacctgctggactgagctatggactgttgccttctttgtgccattggctaattaattagcacaatctcctgggagcccttgaggccctttcttctgtccaatagcagttgtktagctgatgatctgctcgactccagcagctgatttccaagcagacagtaactcttttattcgctgctgggactgagatcacaaagcatgtctcctctgactgtgctgagagtgaattactgctcacacctaggctgccctggggactctacacagtttgttacaaaggaaggagactctaaggatgacactgcctgctggggcatttcctggaaggattttggtggtggcattaaaggaatttcagtttaatgttcagctcagctgtcattgctgggagaccttgcaggttccaaggaga

SEQ ID NO: 6994 - DNA, 601 bp, Human
agagcgagctggtgttctccgccccacacaggagtgtgaatcggcaccacgcaggaatgtggggccaacatcttccatcaacttctccgcttccacgggctctggaagtaggcgaggggcttgaaacaagatcagagacagcaatgaaaggtcagagccaagagggcctatgcagtgggcggacaggcttgtcatcgtgaccctcaagcttcagagggtccgagatgctcagaccctctgctgctgccattgatcagcatgttgcttttgttctgtgcttaacactacttattggagatcrtcccaggagaacgcccacacctgacctgagactcattctgtaggtctagagcaaagcataggattccgaattttaacaaagttgagaaactctggaataggagacttggggttacaccttggaatgaatccaggctctattcctctctagctttgtaattttggacaagctgatttcatccctctctgtgaaatggaactaatacctcacagaactcttgaagattaaatgagataatatatgtaaagtggtaaatgatcaaaaaatgatgtttattataactgtatttattattgttgt

SEQ ID NO: 6995 - DNA, 601 bp, Human
tggtggacaacaggtcagaagatgatgtaccttgagcgttccagggtcctggcctgagggagcaagcagcatgatgcccaatgaactagggttgttgtgtgcagagacaagagacccagggatagtggccagctccaccgggtgggagccatcgtgggtgccctgggtcctgccatgccctgtgatcctccgcaagcaggtctgagccgtgcaggggagagctgcaccaggactggggccgacaggccagcagggacaccctgaaggcttcagaaaccctggaacggagtttcacagggarccctgggagggctttaagtggtgatggtggaatctgatttttgttgttgttgttgttgagacagtcttgttctgtcacccaggctggagtgcaatggcatgatctcggcttactcaaacctccgcctcccgggttcaagtgattcttctgcctcagcctcccgagtagcttgggattacaggcacaagccaccacgcccagctaatttttgtagagatggggtttcgccacgttggccaggctggtcttgaattccctacctcaggtgatctgcccgcctcagccttcccaaagtgctgg

SEQ ID NO: 6996 - DNA, 601 bp, Human
caggactggggccgacaggccagcagggacaccctgaaggcttcagaaaccctggaacggagtttcacagggagccctgggagggctttaagtggtgatggtggaatctgatttttgttgttgttgttgttgagacagtcttgttctgtcacccaggctggagtgcaatggcatgatctcggcttactcaaacctccgcctcccgggttcaagtgattcttctgcctcagcctcccgagtagcttgggattacaggcacaagccaccacgcccagctaatttttgtagagatggggtttcrccacgttggccaggctggtcttgaattccctacctcaggtgatctgcccgcctcagccttcccaaagtgctgggaatacagacgtgagccactgtgcccagcttgatttctctttttaaaggaacgctcaggctcacaggaatcttgggtgaacgttacccactctcctcttccattcccacatttctcttatccattggctttgttctgcccaatctttgccagtctgtcctcttggctcctcaagccacatggtaaaacatggcggccaccaactctcattttaaccaccttgacaga

SEQ ID NO: 6997 - DNA, 601 bp, Human
ttactcaaacctccgcctcccgggttcaagtgattcttctgcctcagcctcccgagtagcttgggattacaggcacaagccaccacgcccagctaatttttgtagagatggggtttcgccacgttggccaggctggtcttgaattccctacctcaggtgatctgcccgcctcagccttcccaaagtgctgggaatacagacgtgagccactgtgcccagcttgatttctctttttaaaggaacgctcaggctcacaggaatcttgggtgaacgttacccactctcctcttccattcccacmtttctcttatccattggctttgttctgcccaatctttgccagtctgtcctcttggctcctcaagccacatggtaaaacatggcggccaccaactctcattttaaccaccttgacagaatgactctttttctcaatttcaattctcaaattcccagggaagagggctgattgacccagcctagggatcaggtgccccctggaccaatcagtggtggctgcaaggtcaaggggacaggatggcaaatcactttctaccaatatggtggctctcactgtagcctcaaagggagaatagggatg

SEQ ID NO: 6998 - DNA, 601 bp, Human
tcaaacctccgcctcccgggttcaagtgattcttctgcctcagcctcccgagtagcttgggattacaggcacaagccaccacgcccagctaatttttgtagagatggggtttcgccacgttggccaggctggtcttgaattccctacctcaggtgatctgcccgcctcagccttcccaaagtgctgggaatacagacgtgagccactgtgcccagcttgatttctctttttaaaggaacgctcaggctcacaggaatcttgggtgaacgttacccactctcctcttccattcccacatttctcttatccattggctttgttctgcccaatctttgccagtctgtcctcttggctcctcaagccacatggtaaaacatggcggccaccaactctcattttaaccaccttgacagaatgactctttttctcaatttcaattctcaaattcccagggaagagggctgattgacccagcctagggatcaggtgccccctggaccaatcagtggtggctgcaaggtcaaggggacaggatggcaaatcactttctaccaatatggtggctctcactgtagcctcaaagggagaatagggatgaaag

SEQ ID NO: 6999 - DNA, 601 bp, Human
aaacctccgcctcccgggttcaagtgattcttctgcctcagcctcccgagtagcttgggattacaggcacaagccaccacgcccagctaatttttgtagagatggggtttcgccacgttggccaggctggtcttgaattccctacctcaggtgatctgcccgcctcagccttcccaaagtgctgggaatacagacgtgagccactgtgcccagcttgatttctctttttaaaggaacgctcaggctcacaggaatcttgggtgaacgttacccactctcctcttccattcccacatttctcttatccattggctttgttctgcccaatctttgccagtctgtcctcttggctcctcaagccacatggtaaaacatggcggccaccaactctcattttaaccaccttgacagaatgactctttttctcaatttcaattctcaaattcccagggaagagggctgattgacccagcctagggatcaggtgccccctggaccaatcagtggtggctgcaaggtcaaggggacaggatggcaaatcactttctaccaatatggtggctctcactgtagcctcaaagggagaatagggatgaaaggg

SEQ ID NO: 7000 - DNA, 601 bp, Human
tgactctttttctcaatttcaattctcaaattcccagggaagagggctgattgacccagcctagggatcaggtgccccctggaccaatcagtggtggctgcaaggtcaaggggacaggatggcaaatcactttctaccaatatggtggctctcactgtagcctcaaagggagaatagggatgaaagggatttaatccccaggggaaagaaggtgccttaaaacatcacagcttaggtggaagcctaatctcttggactctcattcttgcagaatatatctataagcagtggacttttagtycctctccccttttttctggtgctttcctcctgatgccttctagacaatcatttgcaccttttctttgtctccagttacatgttttaatcattggggtttgcttcctcaaagttaagctatggatggagttttcccaaggccagctcttcttaggaggatgaattgaattcatcctcctaagaagagattgaattgatagtcactcacaaacacacatctgtggtctgggaagatgtgggtttaacaaaaagctattttggttagaaggaaaaattaatattgactgactcaaatccagaa

SEQ ID NO: 7001 - DNA, 601 bp, Human
tcaggtgccccctggaccaatcagtggtggctgcaaggtcaaggggacaggatggcaaatcactttctaccaatatggtggctctcactgtagcctcaaagggagaatagggatgaaagggatttaatccccaggggaaagaaggtgccttaaaacatcacagcttaggtggaagcctaatctcttggactctcattcttgcagaatatatctataagcagtggacttttagttcctctccccttttttctggtgctttcctcctgatgccttctagacaatcatttgcaccttttctttctctccagttacatgttttaatcattggggtttgcttcctcaaagttaagctatggatggagttttcccaaggccagctcttcttaggaggatgaattgaattcatcctcctaagaagagattgaattgatagtcactcacaaacacacatctgtggtctgggaagatgtgggtttaacaaaaagctattttggttagaaggaaaaattaatattgactgactcaaatccagaaagaggaagcagataccaagttcattttgaaaaataagagttcattttaggggcagactagctaagct

SEQ ID NO: 7002 - DNA, 601 bp, Human
ggtggctgcaaggtcaaggggacaggatggcaaatcactttctaccaatatggtggctctcactgtagcctcaaagggagaatagggatgaaagggatttaatccccaggggaaagaaggtgccttaaaacatcacagcttaggtggaagcctaatctcttggactctcattcttgcagaatatatctataagcagtggacttttagttcctctccccttttttctggtgctttcctcctgatgccttctagacaatcatttgcaccttttctttgtctccagttacatgttttaatcatyggggtttgcttcctcaaagttaagctatggatggagttttcccaaggccagctcttcttaggaggatgaattgaattcatcctcctaagaagagattgaattgatagtcactcacaaacacacatctgtggtctgggaagatgtgggtttaacaaaaagctattttggttagaaggaaaaattaatattgactgactcaaatccagaaagaggaagcagataccaagttcattttgaaaaataagagttcattttaggggcagactagctaagctcttttgcttagaaggagaaattaat

SEQ ID NO: 7003 - DNA, 601 bp, Human
attaatattgactgactcaaatccagaaagaggaagcagataccaagttcattttgaaaaataagagttcattttaggggcagactagctaagctcttttgcttagaaggagaaattaatattggcggactcaaatccagaaggaggaagcagatattaagttcattttgaaaaataggagttcaatttaggggcaggctaggtatcacccttttgagatatttaccaggagtgaggaccacatttcatattcagttgtaaggtacttttcataaccatggacagtgttttcttaaagtgyttctctttcttcccctattgtgttctttttatgtaaccagttaattttccaaattttattctgatagaaccagagtccttttattttttacataacatatctaattctgtttttctcttaaaggatgcttgctggttttgttttgttcatcactgaggatgagctaatgacagcttttaaaacatcccagcttgttttttacttggatatcatcatagagatccataccacagaagaaagaagtaggacttttatctctgaaaggattttagtgcataaactgtgacttccagcctgcta

SEQ ID NO: 7004 - DNA, 601 bp, Human
taggacttttatctctgaaaggattttagtgcataaactgtgacttccagcctgctagacttcatgctagtcttaggatctttgaatagccttaaattagctgcaggatccaggaagcttgctctgaaattcagttgacatggtaagaaccctactttaggccagatgtggtagctcacacctgtaatcccaatactttgggagggcgaggcgggtggatcacctgaggtcatgagttcaagaccagccttggcaacatggtgaaaacctgtctactaaaaatacaaaaattagctgggcrtggtggtgcacacctgtaatcacagctactcaggaggccgaggcatgagaatcacttgaacctgggaggcggaggttgcggtgagccgagatcacgccactgcactccagcctgagcgacagagagagactccatctcaaaaataaataaataaataaaaactctactttacctattcagtgttcttttcttttatcccattctggcattttctgaagggttgcagagagcactggttgaagcctatcctgaagctaccttggtagaggagttaattgcaccaggagacctaatttcaga

SEQ ID NO: 7005 - DNA, 601 bp, Human
taaaaatacaaaaattagctgggcatggtggtgcacacctgtaatcacagctactcaggaggccgaggcatgagaatcacttgaacctgggaggcggaggttgcggtgagccgagatcacgccactgcactccagcctgagcgacagagagagactccatctcaaaaataaataaataaataaaaactctactttacctattcagtgttcttttcttttatcccattctggcattttctgaagggttgcagagagcactggttgaagcctatcctgaagctaccttggtagaggagttaawtgcaccaggagacctaatttcagaaaggtcacagattatattccaccctccacaaaagtaacctggaagatgagtaagtcctgtcctaaattttagtaccaaaaacagtgtttgctcaaagaaaaaatagtctagtagagaaaagcacaccctttggggtcagaccaccaggaatcacatacaaactctgaacctgaattttcttatctacacgaaggcagcatggctgtgagaacatgcagtgattttataaaactcctggcccataggtggcaggtattaataggaaatagctacgta

SEQ ID NO: 7006 - DNA, 601 bp, Human
atgtcctggagagtttccccaacattttcttctagtattttcatagtttcaggtcttagctttaaatcttccatccattttgatttaatttttgtatatggcaagagttaggggtccagtttcattcttttgcatatggctatctagttttcccagcaccatttattgaagacattgtccttaccccaatgtatgctcttagcccctttgttgaaaatgagtttactgtaaatgcatagatttctttctggattttctctttttttttccattggtccgtgtgtcttgtttttatgcaagycctatgctgttttggttattatagctttgtagtataatctgaagtcaggtaatgtgatttctccagttttgttccttttgctcaggatggctttggttattctgggtcttttgtggtttcatataaattttagaattttttcttctatctctgaagaatgtcattggtattttgatagggattgcatggaatctgtagattgctttgagcagtatggagatttttaacaattttaattctttgaatccatggccaacttgcttggatttggacttgctgtgccccctcacaaccctgagc

SEQ ID NO: 7007 - DNA, 601 bp, Human
agtttcaggtcttagctttaaatcttccatccattttgatttaatttttgtatatggcaagagttaggggtccagtttcattcttttgcatatggctatctagttttcccagcaccatttattgaagacattgtccttaccccaatgtatgctcttagcccctttgttgaaaatgagtttactgtaaatgcatagatttctttctggattttctctttttttttccattggtccgtgtgtcttgtttttatgcaagtcctatgctgttttggttattatagctttgtagtataatctgaastcaggtaatgtgatttctccagttttgttccttttgctcaggatggctttggttattctgggtcttttgtggtttcatataaattttagaattttttcttctatctctgaagaatgtcattggtattttgatagggattgcatggaatctgtagattgctttgagcagtatggagatttttaacaattttaattctttgaatccatggccaacttgcttggatttggacttgctgtgccccctcacaaccctgagctagttacttgcccaccccaagcctccgcagctcatccttaaagg

SEQ ID NO: 7008 - DNA, 601 bp, Human
tttgactgtgaatggacgtacagattattttctgctggaggccatcgctgaatggtattgctgtgacgtgtggacctatcttagtgaacgtgtttgcttttcccaggggagttgctgtggcataggttatgtatacattccatttcagtacattctgctggttttccacaatgggtgtacaaagtaggttcccaccagcaatgtttgataatccagggagctgaacattttgcatcttttacgctgtagccattctggtaagtgtgtactggtatcacatggtgattttaatttgcatttytctggcatctaataaaatttgccaggggaccctgttccacttaaacatgacaattaaacagagccgtctgtccacgccaggtcttttcttcaaggatactgcagttttcttaggcatcccccgctttcacactagtagtaaaatgaagagacgttactatacacacttcttccacagcccctgactctggaactttatatttcaccagtaagaagaagaaaaatgtcaccatgcgatccatcaagaccacccgggaccgagtgcctacatatcagtacaacatgaattttgaaaagctgg

SEQ ID NO: 7009 - DNA, 601 bp, Human; identical to SEQ ID NO: 1575

SEQ ID NO: 7010 - DNA, 601 bp, Human; identical to SEQ ID NO: 1576

SEQ ID NO: 7011 - DNA, 601 bp, Human; identical to SEQ ID NO: 1577

SEQ ID NO: 7012 - DNA, 601 bp, Human; identical to SEQ ID NO: 1578

SEQ ID NO: 7013 - DNA, 601 bp, Human; identical to SEQ ID NO: 1579

SEQ ID NO: 7014 - DNA, 601 bp, Human; identical to SEQ ID NO: 1580

SEQ ID NO: 7015 - DNA, 601 bp, Human; identical to SEQ ID NO: 1581

SEQ ID NO: 7016 - DNA, 601 bp, Human; identical to SEQ ID NO: 1582

SEQ ID NO: 7017 - DNA, 601 bp, Human; identical to SEQ ID NO: 1583

SEQ ID NO: 7018 - DNA, 601 bp, Human; identical to SEQ ID NO: 1584

SEQ ID NO: 7019 - DNA, 601 bp, Human; identical to SEQ ID NO: 1585

SEQ ID NO: 7020 - DNA, 601 bp, Human; identical to SEQ ID NO: 1586

SEQ ID NO: 7021 - DNA, 601 bp, Human; identical to SEQ ID NO: 1587

SEQ ID NO: 7022 - DNA, 601 bp, Human
tttcaggtgtgagccacagcgcccagcagagggttgactcttaatcctaatcctgacatttgtgtcagatttatggaataatgtgatttacagatcataaagagacattatgagatcatcctttttactctcagttagacttcagcctagtaacattctcagctacttaatctctgctttgtaccagtgagttatgttttgataatggcctccctggttgagttaaagtggacttggagatgaccatatagtagttgcagcttttagagcaccacacattattaaatcttgaatcagtttycatagggagaagccaattttttcttttaattttagttactttcattattgaccttgcctgctgttttggctgccatttgagaaaaggtcaactagaagagggtcaccagaatgacaccttaataaaagaaacagagaatggagagtttgagattgggtattctctttcagtgcagtaacagtcttatgaatctgagtaagtcacaacttccctttggtgccatttaccctgctataacatgtctgtttattcagagtcagttttaagaaaggaagataggccgggtgcggtggctcatgc

SEQ ID NO: 7023 - DNA, 601 bp, Human
aatgacaacttttatacagatgtcatgatttccatggtttaaacaaatgtaaaattagtttaaaatgccagaatgaaatggatactctcacaaatttgctcattgctatactaaagtgccttgataaagaattttacaataaaatcctgttaataagactgctgattcagagatgaccataattcacacgtgatcgagacttaaagcttattgttttacttgtgaaaaaagtttaagcagaatgtttaacttttaaaaacaaataaatgatattgaaagcaacggtttacattaacttacrtgctaatgtctctcattcagctttagcaggtcctcaaggacctttcttaatacttttttggttaacaaaagtataaatggaaacttgaagagaacctaagaagagaaatgaaaatgattgagggaatatagaccccaaaacacacaaacacacacacacaagcacgtttaagataggggttgaaaagacatactgaggaggaatttgaactttatttttgttttcacctttgagacagggtctcactatgttgcccaggctagagtgcagtcatagcttgctgcagcctcaaactcccag

SEQ ID NO: 7024 - DNA, 601 bp, Human
aaaaacaattatttttcccctcaaatctgatggtttttctgcttcacttggtattggctgaggtgtgggaaagaccttcacttctcctctatatgggcctttctctacctggctgcttggatttccttaaagtgtggtggcaaggttctaagaagggacattccaggagacaggaggtagagactgccagtcttctaaatcctagatttggaagtccaagaatgtcactgtgggtcaaagccagtcaaggccaactacagagggaggagaaataatgtctacctattgataggaagggtgrcgtgcataaacaaggaagggggaattgctgggggccaccttttgagacttgctaccgtaggtgctatgctagttggatgttaaggctaaaaataaaaatggtatcagccaagtttgtgggtcataatgctaggaatgtttaggaggcatctctttttttgaggttaacttcggaaggcactaacatgatctcctgcgtgacttcccttaatgatgtcactgttgacataatactgggtgaattaatgtgattaagtaaacttgcttacttacttcaggaaacagaggtatctaaacagat

SEQ ID NO: 7025 - DNA, 601 bp, Human
aaaacaattatttttcccctcaaatctgatggtttttctgcttcacttggtattggctgaggtgtgggaaagaccttcacttctcctctatatgggcctttctctacctggctgcttggatttccttaaagtgtggtggcaaggttctaagaagggacattccaggagacaggaggtagagactgccagtcttctaaatcctagatttggaagtccaagaatgtcactgtgggtcaaagccagtcaaggccaactacagagggaggagaaataatgtctacctattgataggaagggtggmgtgcataaacaaggaagggggaattgctgggggccaccttttgagacttgctaccgtaggtgctatgctagttggatgttaaggctaaaaataaaaatggtatcagccaagtttgtgggtcataatgctaggaatgtttaggaggcatctctttttttgaggttaacttcggaaggcactaacatgatctcctgcgtgacttcccttaatgatgtcactgttgacataatactgggtgaattaatgtgattaagtaaacttgcttacttacttcaggaaacagaggtatctaaacagatt

SEQ ID NO: 7026 - DNA, 601 bp, Human
tttcccctcaaatctgatggtttttctgcttcacttggtattggctgaggtgtgggaaagaccttcacttctcctctatatgggcctttctctacctggctgcttggatttccttaaagtgtggtggcaaggttctaagaagggacattccaggagacaggaggtagagactgccagtcttctaaatcctagatttggaagtccaagaatgtcactgtgggtcaaagccagtcaaggccaactacagagggaggagaaataatgtctacctattgataggaagggtggcgtgcataaacarggaagggggaattgctgggggccaccttttgagacttgctaccgtaggtgctatgctagttggatgttaaggctaaaaataaaaatggtatcagccaagtttgtgggtcataatgctaggaatgtttaggaggcatctctttttttgaggttaacttcggaaggcactaacatgatctcctgcgtgacttcccttaatgatgtcactgttgacataatactgggtgaattaatgtgattaagtaaacttgcttacttacttcaggaaacagaggtatctaaacagattacattttaaaat

SEQ ID NO: 7027 - DNA, 601 bp, Human
actacagagggaggagaaataatgtctacctattgataggaagggtggcgtgcataaacaaggaagggggaattgctgggggccaccttttgagacttgctaccgtaggtgctatgctagttggatgttaaggctaaaaataaaaatggtatcagccaagtttgtgggtcataatgctaggaatgtttaggaggcatctctttttttgaggttaacttcggaaggcactaacatgatctcctgcgtgacttcccttaatgatgtcactgttgacataatactgggtgaattaatgtgattmagtaaacttgcttacttacttcaggaaacagaggtatctaaacagattacattttaaaataaattgtcagatgtttcactgtaatggaattttctttacatcagtgaaattgattaccaggtagtgggatgaacatctgaaactagttcttagtttaagttgtctgagtttttgtgtatactttacctattcccagtttaaattggctttcaaacagtttgttttctgggtactcttataggtgttggggtatgaaattagtggtaattctttttgcctattttctttttttttgtctga

SEQ ID NO: 7028 - DNA, 601 bp, Human
aaggcactaacatgatctcctgcgtgacttcccttaatgatgtcactgttgacataatactgggtgaattaatgtgattaagtaaacttgcttacttacttcaggaaacagaggtatctaaacagattacattttaaaataaattgtcagatgtttcactgtaatggaattttctttacatcagtgaaattgattaccaggtagtgggatgaacatctgaaactagttcttagtttaagttgtctgagtttttgtgtatactttacctattcccagtttaaattggctttcaaacagtttsttttctgggtactcttataggtgttggggtatgaaattagtggtaattctttttgcctattttctttttttttgtctgagataccctgagtctcgctctgttgcccagactggagtgcagtggcacaatttcggttcactgcaacctccgcctcctgggttcaaatgattctcctgcctcagcctcctaagtagctggaattacaggcgtgtaccaccttgcctggctaattttgttgtatttttttttttttgagatggagttttggtcttgttgcccaggctggagtgcaatggtgca

SEQ ID NO: 7029 - DNA, 601 bp, Human
tactgggtgaattaatgtgattaagtaaacttgcttacttacttcaggaaacagaggtatctaaacagattacattttaaaataaattgtcagatgtttcactgtaatggaattttctttacatcagtgaaattgattaccaggtagtgggatgaacatctgaaactagttcttagtttaagttgtctgagtttttgtgtatactttacctattcccagtttaaattggctttcaaacagtttgttttctgggtactcttataggtgttggggtatgaaattagtggtaattctttttgcytattttctttttttttgtctgagataccctgagtctcgctctgttgcccagactggagtgcagtggcacaatttcggttcactgcaacctccgcctcctgggttcaaatgattctcctgcctcagcctcctaagtagctggaattacaggcgtgtaccaccttgcctggctaattttgttgtatttttttttttttgagatggagttttggtcttgttgcccaggctggagtgcaatggtgcaaactcagttcactgcaacctctgcttctgaggttcaagtgattctccttcctcagcc

SEQ ID NO: 7030 - DNA, 601 bp, Human
ggaattttctttacatcagtgaaattgattaccaggtagtgggatgaacatctgaaactagttcttagtttaagttgtctgagtttttgtgtatactttacctattcccagtttaaattggctttcaaacagtttgttttctgggtactcttataggtgttggggtatgaaattagtggtaattctttttgcctattttctttttttttgtctgagataccctgagtctcgctctgttgcccagactggagtgcagtggcacaatttcggttcactgcaacctccgcctcctgggttcaartgattctcctgcctcagcctcctaagtagctggaattacaggcgtgtaccaccttgcctggctaattttgttgtatttttttttttttgagatggagttttggtcttgttgcccaggctggagtgcaatggtgcaaactcagttcactgcaacctctgcttctgaggttcaagtgattctccttcctcagcctcccctgtagctgggattacaggcatgcaccaccacacccagctaattttgtatttttggtagagacagggcttttccatgttggtcaggctggtctcgaactcccaa

SEQ ID NO: 7031 - DNA, 601 bp, Human
gtctgagtttttgtgtatactttacctattcccagtttaaattggctttcaaacagtttgttttctgggtactcttataggtgttggggtatgaaattagtggtaattctttttgcctattttctttttttttgtctgagataccctgagtctcgctctgttgcccagactggagtgcagtggcacaatttcggttcactgcaacctccgcctcctgggttcaaatgattctcctgcctcagcctcctaagtagctggaattacaggcgtgtaccaccttgcctggctaattttgttgtatttttttttttttgagatggagttttggtcttgttgcccaggctggagtgcaatggtgcaaactcagttcactgcaacctctgcttctgaggttcaagtgattctccttcctcagcctcccctgtagctgggattacaggcatgcaccaccacacccagctaattttgtatttttggtagagacagggcttttccatgttggtcaggctggtctcgaactcccaacctcaggtgatctgcccgccttggcctcccaaagtgctgagattacaggcgtgagctgccgtgtccggcctctttt

SEQ ID NO: 7032 - DNA, 601 bp, Human
taaattatcaaaagtgaattattagatgtggagtaaaaattcaactttgagtagttttagaaattatttattgctaaattagaaaataaactttcaaaagagatctcttttttttaaaaaaacttaattgagacagggtctcactctgtcacccaggctggagtacagtggtgcaaccttggctcactgcagcccctacctcctgggttcaagcaattcttgtgcctcagcctcccaggtagctgggaatacaggcatgtgccaccacgcccagctaaattttgtgtttttagtagagacrgggtttcaccgtgttgcccgggctggtctcgaactcctgacttcaagtgatccgcccaccttggcctcccaaagtgctgggattacaggcgtgagtcactatgcctggcctagagatgggatctgctttttttttttttttttttttgagatggagtcttgctctgtcacccaggctggagtgcaatggcacgatctcaactcactgcaacctccgcttcccaggttcaggcaattctcctgtctcagcctcctaagtagctgggattacaggcacctgccatcatccctgactaatttt

SEQ ID NO: 7033 - DNA, 601 bp, Human
ttgagacagggtctcactctgtcacccaggctggagtacagtggtgcaaccttggctcactgcagcccctacctcctgggttcaagcaattcttgtgcctcagcctcccaggtagctgggaatacaggcatgtgccaccacgcccagctaaattttgtgtttttagtagagacagggtttcaccgtgttgcccgggctggtctcgaactcctgacttcaagtgatccgcccaccttggcctcccaaagtgctgggattacaggcgtgagtcactatgcctggcctagagatgggatctgctttttttttttttttttttttgagatggagtcttgctctgtcacccaggctggagtgcaatggcacgatctcaactcactgcaacctccgcttcccaggttcaggcaattctcctgtctcagcctcctaagtagctgggattacaggcacctgccatcatccctgactaatttttgtatttttgtagacggggtttcaccatgttggccaggctattcttgaactcctgacctcaggtgatccgaccgcctcggcctcccaaagtgctgggattataggcattagctaccgcgtctggcct

SEQ ID NO: 7034 - DNA, 601 bp, Human
tgtcacccaggctggagtacagtggtgcaaccttggctcactgcagcccctacctcctgggttcaagcaattcttgtgcctcagcctcccaggtagctgggaatacaggcatgtgccaccacgcccagctaaattttgtgtttttagtagagacagggtttcaccgtgttgcccgggctggtctcgaactcctgacttcaagtgatccgcccaccttggcctcccaaagtgctgggattacaggcgtgagtcactatgcctggcctagagatgggatctgctttttttttttttttttttwtgagatggagtcttgctctgtcacccaggctggagtgcaatggcacgatctcaactcactgcaacctccgcttcccaggttcaggcaattctcctgtctcagcctcctaagtagctgggattacaggcacctgccatcatccctgactaatttttgtatttttgtagacggggtttcaccatgttggccaggctattcttgaactcctgacctcaggtgatccgaccgcctcggcctcccaaagtgctgggattataggcattagctaccgcgtctggcctctagagatgggatcttgct

SEQ ID NO: 7035 - DNA, 601 bp, Human
attttttgtatttttagtagagatggggtttcaccgtgttagccaggatggtctcgatctcctgaccttgtgatccaaccgcctcagcctccctaagtgctgggattacaggcatgtgccaccgcacctggccagcaatattttaatatagcacagaagtcctttctaaatgtgtatagtgagaatccattgaggatgaaatagaaaatatttaccaaagtttaacaacttagtcaataaaaataaaactttctctttccgtaataagtcaatctcagcattctaaaataggcaatggagsggggaagaaatctctatgggaagggtccactggatcttaacagtttcaactagtgttccacaatatttctgctgtacttggggagaatttctggataattagaatagtctgaggcttattccttttagtttcccatagcctgattgagatagagctataagaccagctataacattgtacagaagactcagagataaacaagtgaaaaagataactgagattaatgttgaactaagaatatgattgttctctgaggcactacctgctagttcctggattacctttatatgtggccaaggt

SEQ ID NO: 7036 - DNA, 601 bp, Human
gagcaaaagccctagagctaagggagagagaatttctgcctgcctaagatgaaccttctgagttggatatttttttttcttcccccttgagacggagtctcactctgtcgccagactggagtgcagtggcatgatctcagctcactgcaacccccgactccctggttcaaatgattttcctgcctcagcctcccgagtagctgggattacaggcacgtaccaccacacccagctcatttttgtgtttttagtagggatggggtttcaccatgttggccaggacagtctcgatctcctcctygtgattcgcccgccttggcctcccaaagtgctgggattacagctgtgagccaccgtgcccggccttgagttggaatttctttctaaagtcttgctcctttctgtagtttggctttcctttcagggtatctgattttgccttcctgctcctaggcttgtgacctgacctgatgctgtcaattacaggagaatgcagaggtgcaagaaatttttttttttttgagatggagtttcgctcttgttgcccaggttggggtgcaatggcacaatctcggctcacagcaacctccgcctcccgggt

SEQ ID NO: 7037 - DNA, 601 bp, Human
acaggcacgtaccaccacacccagctcatttttgtgtttttagtagggatggggtttcaccatgttggccaggacagtctcgatctcctccttgtgattcgcccgccttggcctcccaaagtgctgggattacagctgtgagccaccgtgcccggccttgagttggaatttctttctaaagtcttgctcctttctgtagtttggctttcctttcagggtatctgattttgccttcctgctcctaggcttgtgacctgacctgatgctgtcaattacaggagaatgcagaggtgcaagaaatttttttttttttgagatggagtttcgctcttgttgcccaggttggggtgcaatggcacaatctcggctcacagcaacctccgcctcccgggttcaagctattctcctgcctcagcctcccgagtagctgggattacaggcatgcggcaccacacccagctaattttgtatttttagtagagacggagtttttccatgttggtcaggctggtcttgaactcccgaccttaggtgatccgcccgcctctgcctcccaaagtgctgggattacaggtgtgagccaccacgcccggccagaaga

SEQ ID NO: 7038 - DNA, 601 bp, Human
ctaggcttgtgacctgacctgatgctgtcaattacaggagaatgcagaggtgcaagaaatttttttttttttgagatggagtttcgctcttgttgcccaggttggggtgcaatggcacaatctcggctcacagcaacctccgcctcccgggttcaagctattctcctgcctcagcctcccgagtagctgggattacaggcatgcggcaccacacccagctaattttgtatttttagtagagacggagtttttccatgttggtcaggctggtcttgaactcccgaccttaggtgatccgccygcctctgcctcccaaagtgctgggattacaggtgtgagccaccacgcccggccagaagaaattttttgtgttttgttaatacagtcagccacgaatagctaacagctaacagctggtccctcatatttgtgggttccatatctgctaattcaaccattgattgaaaatattcagaaaaagagaccacaataaaaaataacaatataacaataaaagtgggaattaaaaacaatacgtataacaactacttacataacatttacattgcattattatatgtaatctagagatgatttgaaa

SEQ ID NO: 7039 - DNA, 601 bp, Human
tagattcagtattattattatccccatttctcatttaaggaaaattattccagagaggttaagtaacttgctcaaagtcatgctagcaggtatcctgagattaaatccaggcagtctgacttgagagccttacttacgtgcagtatacttcctctttgaagagcaggaaaactgtgggatatggtggcatgtttccttaatatctgttaaggcacactttggtaaatgctaaaatagaagcacaaagtgctatagaatttaagggaggggaagttcgtttttgtttttgtttttgtttttkcttttttttgagatggagtcttactctgtcacccaggctggagtgcagtagcgcaatctcagctcactgccacctccacctcccgggttcaagtgattctcctgcctcagcctcccgagtagctgggactacaggtgtgcaccaccacgcccggctaagttttgtattttttagtagtgctgggattacaggtgtgagccactgtgcctggccgggaagttcgttttaactgaagagctctttagcagctttgtagaagaaagcttcatattagatcttgatgaatagatagattttgac

SEQ ID NO: 7040 - DNA, 601 bp, Human
agattcagtattattattatccccatttctcatttaaggaaaattattccagagaggttaagtaacttgctcaaagtcatgctagcaggtatcctgagattaaatccaggcagtctgacttgagagccttacttacgtgcagtatacttcctctttgaagagcaggaaaactgtgggatatggtggcatgtttccttaatatctgttaaggcacactttggtaaatgctaaaatagaagcacaaagtgctatagaatttaagggaggggaagttcgtttttgtttttgtttttgttttttyttttttttgagatggagtcttactctgtcacccaggctggagtgcagtagcgcaatctcagctcactgccacctccacctcccgggttcaagtgattctcctgcctcagcctcccgagtagctgggactacaggtgtgcaccaccacgcccggctaagttttgtattttttagtagtgctgggattacaggtgtgagccactgtgcctggccgggaagttcgttttaactgaagagctctttagcagctttgtagaagaaagcttcatattagatcttgatgaatagatagattttgaca

SEQ ID NO: 7041 - DNA, 601 bp, Human
tgcacctaaacttaaggttgcaaagatcaggtgctgatatatttagatgtctggaaaactttcatgctttcactgaaaagtcatagagacagatatccaggaattatagcatgtggataaatatttttgtagcacagattcataaatccttgtatgcaggaagtactacaccaaactgttaatgtggttatttgtgagttgctgaattatgggtaatatttcaaaatatttaatggtattctgaaaatatactagtaaatacacagaaaagcattatttaggtgatatttcttttaattcttttttttttttttttgtatccccggagcgagtgcaccgttcctggaggtactgcaataccaggtcgatgcatggagtggacggagcaagctcctattccatctccctgctccaaaaatctatttaatatattgtcctcagatagaggacatatcagatactaaactgatgagaacagatactacacttgatcttagccaaaaggccgagaagtgattttaattctttttctttttttctttttaaaatttttttatttttattttttttttaagatggagtttcgctcttggtgcccagg

SEQ ID NO: 7042 - DNA, 601 bp, Human
ggtgctgatatatttagatgtctggaaaactttcatgctttcactgaaaagtcatagagacagatatccaggaattatagcatgtggataaatatttttgtagcacagattcataaatccttgtatgcaggaagtactacaccaaactgttaatgtggttatttgtgagttgctgaattatgggtaatatttcaaaatatttaatggtattctgaaaatatactagtaaatacacagaaaagcattatttaggtgatatttcttttaattcttttttttttttttttgtatccccggagcragtgcaccgttcctggaggtactgcaataccaggtcgatgcatggagtggacggagcaagctcctattccatctccctgctccaaaaatctatttaatatattgtcctcagatagaggacatatcagatactaaactgatgagaacagatactacacttgatcttagccaaaaggccgagaagtgattttaattctttttctttttttctttttaaaatttttttatttttattttttttttaagatggagtttcgctcttggtgcccaggctggaatacaatggcgcgatctcggctca

SEQ ID NO: 7043 - DNA, 601 bp, Human
ggagcgagtgcaccgttcctggaggtactgcaataccaggtcgatgcatggagtggacggagcaagctcctattccatctccctgctccaaaaatctatttaatatattgtcctcagatagaggacatatcagatactaaactgatgagaacagatactacacttgatcttagccaaaaggccgagaagtgattttaattctttttctttttttctttttaaaatttttttatttttattttttttttaagatggagtttcgctcttggtgcccaggctggaatacaatggcgcgatctcrgctcaccgcaacctccacctcccgggttcaagtgattctcctgccttagcttcctgagtagctgggattacaggcatgcaccaccacacccagctaattttgcagttttagtagagatggggtttctccatgttggccaggctggtcttgaactccggatctcaggtgatctgcccgcctcagccttccaaagtgctgggattactggcgtgagccaccgcgcttggccctttttttttttaattttttgagacagtctcactcactctgtcacccaggctgggtgatatttcttttctt

SEQ ID NO: 7044 - DNA, 601 bp, Human
gagtgcaccgttcctggaggtactgcaataccaggtcgatgcatggagtggacggagcaagctcctattccatctccctgctccaaaaatctatttaatatattgtcctcagatagaggacatatcagatactaaactgatgagaacagatactacacttgatcttagccaaaaggccgagaagtgattttaattctttttctttttttctttttaaaatttttttatttttattttttttttaagatggagtttcgctcttggtgcccaggctggaatacaatggcgcgatctcggctcmccgcaacctccacctcccgggttcaagtgattctcctgccttagcttcctgagtagctgggattacaggcatgcaccaccacacccagctaattttgcagttttagtagagatggggtttctccatgttggccaggctggtcttgaactccggatctcaggtgatctgcccgcctcagccttccaaagtgctgggattactggcgtgagccaccgcgcttggccctttttttttttaattttttgagacagtctcactcactctgtcacccaggctgggtgatatttcttttctttaatt

SEQ ID NO: 7045 - DNA, 601 bp, Human
ttttttttgagacgaagtttcgctcttgttgcacaggctggagtgcagtggtgcagtctcagctcactgcaacctctgccttccgggttcaagcaattctcctgcctcagcttcctgagtagctgggactacaggtgtgcatcaccacactcagctaatttttgtgatttttattagagacagggtttcaccatgttggccaggctggtcttatactcctgaacttaagtgatccacctgtcttggcctcccaaagtgctgggattataggcatgagccaccatgcctagacttctttcarttcttttatgttttacggattttctacagtgaatatatatcataatcggaaaaagtaaaatttagtatattgagtatatgcatttataaaacaaaatgatcatggactacattgtagcaagtgtactggccagtgggctgacagtggctgcttaaacgactccttactctgagctccagttttcttaaccagaaaatcagctattgttaattttacctacttagggtctctctctatttttcctttcagttcatgttaatttctaaattgccatgtataagtaaggggttgtcaatttac

SEQ ID NO: 7046 - DNA, 601 bp, Human
tcccattttagcctcctgagtaactaggactacaggcatgtgccaccacagtcagccaatgtttttcattttatactttctttagcagtgtatgggagtcccagttgctgaacattcttgcagtgctcacttaatatcgtcttttttgaggccgggtatagtggctcatgcctgtaatcccagcactttgggaggctggggcaggtagatcgcttgaggccaggagttcgagtctagcctggctaacgtggtgaaacctcgcttctactaaaggtacaaaagttagctggatgtggtggcrggcacctgtaatcccagctactcaggaggctgacgcacgagaatcgcttgaacctgggaggcggaggttgcagtgagctgagatggtactactggactccagctttggcgacagagcgagactccatcttaaataataataataataacatcgtctttttcgttgttgccactgtagtggatgatggtactatcccaccgttttaatttgtgtttccttaatgactactgtaaacaagcacctttttaggtttgttgactgtttagacatagtcttttgttgaagtgtttattcaagtct

SEQ ID NO: 7047 - DNA, 601 bp, Human
acactgacttccacaatggttgaactagtttacagtcccaccaacagtgtaaaagtgttcctatttctccacatcctctccagcacctgttgtttcctgactttttaatgattgccattctgactggtgtgagatggtatctcatagtggttttgatttgcatttctctgatggccagtgatgatgagcattttttcatgtgtttattgcggcattattcacaatagcaaagacttggaaccaacccaaatgtccaacaacgatagactggattaagaaaatgtggcacatatacaccatrgaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtat

SEQ ID NO: 7048 - DNA, 601 bp, Human
tgtttcctgactttttaatgattgccattctgactggtgtgagatggtatctcatagtggttttgatttgcatttctctgatggccagtgatgatgagcattttttcatgtgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatckcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtatgtaacctgcacaatgtgcacatgtaccctaaaacttaaagtataataaataaaaaaaaaaaaaagaaaagtttatccgcataaaaagtag

SEQ ID NO: 7049 - DNA, 601 bp, Human
atgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtatgtaacctgcacaatgtgcacatgtaccctaaaacttaaagtataataaataaaawaaaaaaaaagaaaagtttatccgcataaaaagtaggctgaactgaagattgaagatctctggaccagctgtactcaaattgttatgtgagagaaatatcaggatttggttttgagtaatttcataaccgctgtctattgggaacacagttttatcaagatctgccagataaggaggcacaaagctacagaggccaggtgctgcagggtggctaggagttggggaaaagaaattgactaggtgtctgttggcaactcaaccaggtgtgtggacgcaggggaacttagcaagggaaggtgat

SEQ ID NO: 7050 - DNA, 601 bp, Human
gaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtatgtaacctgcacaatgtgcacatgtaccctaaaacttaaagtataataaataaaaaaaaaaaaaagaaaagtttatccgcataaaaagtaggctgaactgaagattgaagatctctggaccagctgtactcaaattgttaygtgagagaaatatcaggatttggttttgagtaatttcataaccgctgtctattgggaacacagttttatcaagatctgccagataaggaggcacaaagctacagaggccaggtgctgcagggtggctaggagttggggaaaagaaattgactaggtgtctgttggcaactcaaccaggtgtgtggacgcaggggaacttagcaagggaaggtgatatgatttggctctgtacccacccaaatctcatgtctaattataatccccagtgttggaggtggggcctggtaggaggtgtttgga

SEQ ID NO: 7051 - DNA, 601 bp, Human
tataaattacccagtctcaggcatttctttatagcagtgcaaaaatggactcatatacaagggtatacattcagcaggagaataatggcagggagtctggggcagatattctggggagatcaataggcagaaagcatcagtgaatactagaaacaggtagcaaagcgttgcttcaagcttgaactcaaaagtggaactgggaaacctagcaaggaactaaataattgattcattcagcctatactgattagtgtctattgtaatagttctacactttaccctgtataggaattatttggartgcatgttaaaatgtagtacagattcttagttctttttcccccctcttcccttttacttggtacgcctaaaaaattggcatgttcagcaagcatatcagatgtttctgatgctggtgtttctcaggatcatgctttgacaaaatatctagtccactgtgtgctggccagtgtatcaacacaggggaagtgggggaaatgatgtggctagaaccagagtaaaaggtgaggccttgtacttgggaaacacagcaggaaggagctgaattaactggaatcaaaagtgatggcaggccagttgc

SEQ ID NO: 7052 - DNA, 601 bp, Human
cattcagcaggagaataatggcagggagtctggggcagatattctggggagatcaataggcagaaagcatcagtgaatactagaaacaggtagcaaagcgttgcttcaagcttgaactcaaaagtggaactgggaaacctagcaaggaactaaataattgattcattcagcctatactgattagtgtctattgtaatagttctacactttaccctgtataggaattatttggaatgcatgttaaaatgtagtacagattcttagttctttttcccccctcttcccttttacttggtacgcytaaaaaattggcatgttcagcaagcatatcagatgtttctgatgctggtgtttctcaggatcatgctttgacaaaatatctagtccactgtgtgctggccagtgtatcaacacaggggaagtgggggaaatgatgtggctagaaccagagtaaaaggtgaggccttgtacttgggaaacacagcaggaaggagctgaattaactggaatcaaaagtgatggcaggccagttgcagtggctcacgcctgtaatcctagcacttcgggaggctgaggcaggcggatcacctgaggtcaggag

SEQ ID NO: 7053 - DNA, 601 bp, Human
caagcatatcagatgtttctgatgctggtgtttctcaggatcatgctttgacaaaatatctagtccactgtgtgctggccagtgtatcaacacaggggaagtgggggaaatgatgtggctagaaccagagtaaaaggtgaggccttgtacttgggaaacacagcaggaaggagctgaattaactggaatcaaaagtgatggcaggccagttgcagtggctcacgcctgtaatcctagcacttcgggaggctgaggcaggcggatcacctgaggtcaggagtttgagaccagtctggccaaygtggtgaaaccccgtctctactaaaaataaaaaaattagccgctcatggtggcccaggcctgtagtctagctacttgggtggctgaggccagagaatcgcttgaaaccaggaggcggaggtttcagtgagccaagattatgccactgcactccagcatgtgtgacagagcaagactccatctcaacaacaacaacaacaagtgatggcagaatgagacaaatctcatggccaaggcttggactctctgaattccaactagttggtagtaagttggtttcagaaaacaatttacttctgta

SEQ ID NO: 7054 - DNA, 601 bp, Human
agtttattgaataggcattccactctcattccattttactctttaaatatatatttattcatgcctgctgtatgcaaatttttgattccaatttttttaatggacatacagtaaaatggatttttcttaatgtacacagttttaggaattctaatatgtgtagtagattcatgtaaaccacaatcaggataagaacaattgtatcactcccccgcaaaaaactcttatactcttcctccacctctaaccccctcttcctcacttcattttatgtttttgagaatgtcatataaatggaacygtgcaatatgaaatcttctgttactgacctcttccgttcagcataatgcctttgagctagattaatccatgtttttgcatgtatcaggagttcacgtcttactattgttgattagtattttattgtgtagtgtaccagactgtttattcactcctgaaggacatttgggttgtttctggttttggtgattataaataaagctgctataaataaacacttgtgtatagattttgtgtgaacattttcatttctctaaatacccatgagggagaattgcgtgataaatgtaggtttaacctt

SEQ ID NO: 7055 - DNA, 601 bp, Human
aagaagcaaacttaaatgattgctaattaaatgtttagtgttttttttgagttggttattagcttgaggttaaatttgtttaatgagtaaatatggaagaattatgtttttcacatttggaatgcatacttgctgatcattggtatgttactcccattttatgaagctggaacataatttccttctttttaatgactgtgagttttacagttatttaatctttgttttggtggtgttagtcatgtcagtactttatttgctaccgagttctcagttaggaaataggctcccaattataattttttttttttttttttttttgagacgaagtctcactctgtcacccaggctggagtgcagtggcgcgatcttggtgcactgcaacccctacctcccatgttcaagcgattctcctgcctcagcctcccaagtagctgggactacaggaatgagccaccacgcccggctaatttttgtatttttagtggagatggggtttcaccatgttggccaggctggtctcgaactcccaacctcaagtgatccgcccacttcggcctcccaaagtgctagaattacaggcatgaaccactgtgcccag

SEQ ID NO: 7056 - DNA, 601 bp, Human
gggaaaacatccgctttgaagcagtattcagtaatatattgaaatgagaaataggcggtcaagcagtgattcaggtttagtgttcagtgtaattaagaaaaggtgacttaagttgaagaacattgatgtatctgtttttaaattgcacctaattataatgacaacttacaagatctctttccttccttctctcttggaatgttgactataaatttcacataatttaaaaacaatttaaaagctagtcaaattaattgagaagaatcctgctttatcaaattttgcctgtaatcatatccaracatggcattttgaaaatcagaaaggattgcttccacttatatcagagtttgaaagtagaaactcttttcatgtaggtatgggtcacctttgattatatggtagtcttctgaatatggtcctcttacctgacacatatgcacctcatcaataaactacatacaattcttaggtttatatgtggtcatgttacaaaggatttcttaagtactcttaaatgtgttctactaatgtcttgtggaaaaatataatcttttgaaagcattcgtgttaaaaagaattagacgtgatttatctcatt

SEQ ID NO: 7057 - DNA, 601 bp, Human
tccttgtctaagtataagtgattgaaaccactattggcatagtggaaattacacaagaattggagtcagaagaactggtttcaagtcctgtcttaactacagtcatgcattgcttaacaatatgtgatacattatgagaaatacattgttaggtgattaagtggttgtgtgagcttcacagagtgtacatagacaaatctagatagtataccttactatacacaaatgccatgtgatataacctgttgcttgtgcagtttgttactgtacactgaatcctgtaagccattgtaacacaatsgtatttgtatatctaaacatagaaagggtacggtaaaaatacagtgttataattttatgagaccactgttgcatatctgaccatacttgactgaagtgtcagggggtgcatgactgtatttttacttattctctgaccttattcttgggtggtgataataataacaataataatggcagccaacacttgtagctcagtatataccgtgcaggattctagacactatatatattaactcatttgatcctctcatcttattaggtgtgtattattattatcatcctgatttacaaatgtgga

SEQ ID NO: 7058 - DNA, 601 bp, Human
aagtattcagaggagcaaacttggagactgtgtaaatatcttatttcacaacattgtttcacgcagtagttttaccatccattggtgattcttctgtggtagttgtaaaatcaacctatttatttttaggtagttctaaataatttttttctttctcaattttgaaatggtgagtgtttcctattttggaaagacattacatgggctttatcctctttatttcatttttgaacttagaccaattaaagtgtactttttacattgtaaaaaagataaagataacttttatctttagtgcaamacactactaaagctgcttagagaattgagttaagtttttaagggctttttgtaacaaaaagtatgtctgaattccctggaggacttgttgggccttccctggagattttttttttttttttttttttctgagacagggtctcactctttctcccaggttggagtgctgtggtgctatcacagctcattgcagccttgacctcccaggctcaagtgatcctcccacctcagcctccttagtagctgggactacaggcgtgcaccaccacgcccagctaatttttttatttttcacagagat

SEQ ID NO: 7059 - DNA, 601 bp, Human
ctttctcccaggttggagtgctgtggtgctatcacagctcattgcagccttgacctcccaggctcaagtgatcctcccacctcagcctccttagtagctgggactacaggcgtgcaccaccacgcccagctaatttttttatttttcacagagatagggttttgcccatgctgagtttgccattctttaggcctgggttggggtctgagaatttgcatttctaactagtttataggtgatgctgctggttctgggactacactttgaggactgctgtggcttctataagtcttcctttttwaaaaaaaaaaaaaaggctagtcaagttctgaagcaattggttgtgaacacctgcacttgccattcgagcagatattttgctcatgattatttggaccgttttcttcctttcttcttttctttcttcctttctttccttctttccaggctggagtgcagtggttcgatcatagcttattgcaactttgaatgcctaggcctagggagccctctcgcctcagccttctaaagtgctggggttacaggcatgagccactgtgctgaccttgggatacttttctacttgtttgctttctttaat

SEQ ID NO: 7060 - DNA, 601 bp, Human
gagaatttgcatttctaactagtttataggtgatgctgctggttctgggactacactttgaggactgctgtggcttctataagtcttcctttttaaaaaaaaaaaaaaaggctagtcaagttctgaagcaattggttgtgaacacctgcacttgccattcgagcagatattttgctcatgattatttggaccgttttcttcctttcttcttttctttcttcctttctttccttctttccaggctggagtgcagtggttcgatcatagcttattgcaactttgaatgcctaggcctagggarccctctcgcctcagccttctaaagtgctggggttacaggcatgagccactgtgctgaccttgggatacttttctacttgtttgctttctttaatagatatgagaataatatggatatagtatagcagagtaaattgaagtttgtattaggggattttgatgaatgttgggaaaattttggcaattggctaaattactgaataggatctcattaacctagctaattcaaaattatctatgttgtaatgaaaatggttatagggtattttatctatttatttatttattttttagagatgga

SEQ ID NO: 7061 - DNA, 601 bp, Human
tatggagttttaaaaacttttaagatgaactggggccaggtttggtggctgtcacctgtaatcccagcactttgggaggctgaggtgggaggattgcttgaggccaggagtttgagaccagcctggtcaacttagcaagacccatgtctctacaaacagaacaaaacagaacaaaattagcgtggcatggtggtgcacacctgtagtcccagctacttgctttgaggctgcagtgggctatgattcctccgctgcattccagcctgggacacagagtgagatcctgtctctaaaaaaaagaaaaaaaaaattagccgggcgtggtggcgggcacctgtagtcccagctactcaggaggctgaggcaggagaatggcgtgaacccgggaggtggagcttgcagtgagccgaaatcgcgccactgcactccagcctaggtgacagaacgagactctgtctcaaaaaaaaaaaaaaaaaagaaaagaaaaaaagtgaaactgactttttttgaacttggatgaaggatagatgagatgaattagaaggaagaaaaatactgtttccttaataaatgtatcatttgtcttatctaaaatgtcact

SEQ ID NO: 7062 - DNA, 601 bp, Human
cttttaagatgaactggggccaggtttggtggctgtcacctgtaatcccagcactttgggaggctgaggtgggaggattgcttgaggccaggagtttgagaccagcctggtcaacttagcaagacccatgtctctacaaacagaacaaaacagaacaaaattagcgtggcatggtggtgcacacctgtagtcccagctacttgctttgaggctgcagtgggctatgattcctccgctgcattccagcctgggacacagagtgagatcctgtctctaaaaaaaagaaaaaaaaaattagccrggcgtggtggcgggcacctgtagtcccagctactcaggaggctgaggcaggagaatggcgtgaacccgggaggtggagcttgcagtgagccgaaatcgcgccactgcactccagcctaggtgacagaacgagactctgtctcaaaaaaaaaaaaaaaaaagaaaagaaaaaaagtgaaactgactttttttgaacttggatgaaggatagatgagatgaattagaaggaagaaaaatactgtttccttaataaatgtatcatttgtcttatctaaaatgtcactaaatttgcatggagtc

SEQ ID NO: 7063 - DNA, 601 bp, Human
gcttgaggccaggagtttgagaccagcctggtcaacttagcaagacccatgtctctacaaacagaacaaaacagaacaaaattagcgtggcatggtggtgcacacctgtagtcccagctacttgctttgaggctgcagtgggctatgattcctccgctgcattccagcctgggacacagagtgagatcctgtctctaaaaaaaagaaaaaaaaaattagccgggcgtggtggcgggcacctgtagtcccagctactcaggaggctgaggcaggagaatggcgtgaacccgggaggtggagyttgcagtgagccgaaatcgcgccactgcactccagcctaggtgacagaacgagactctgtctcaaaaaaaaaaaaaaaaaagaaaagaaaaaaagtgaaactgactttttttgaacttggatgaaggatagatgagatgaattagaaggaagaaaaatactgtttccttaataaatgtatcatttgtcttatctaaaatgtcactaaatttgcatggagtcataggatttaagagtctagaaggaccatctaattcaaggcttttttttttaatttagtttttctattttctttgttctt

SEQ ID NO: 7064 - DNA, 601 bp, Human
aattagaaggaagaaaaatactgtttccttaataaatgtatcatttgtcttatctaaaatgtcactaaatttgcatggagtcataggatttaagagtctagaaggaccatctaattcaaggcttttttttttaatttagtttttctattttctttgttctttctttcttcttcttctttttttttttttttgtgtgttcttctacttgataattcaaggcttcttaacctttttttggttatggacttcactgaaaatctggtatcacaggatccttcctcttcccagacacacacacacwcatatgttttgtacaaaatttcaggaggttcagagatccctgaatcctatctatggaccctgggttaagaaccctgatctagcttgttttttttttgattcttgcatagtatatttttatttaaaaggttttgctgataattattattttaatataactaagttgtgacctgttttaataagggtctgactgtaaaacttgagcttcatcataaagtgccattttgagaagctaatgaaatgttgagtatgttgcctagtagtgtcaggaaaaatggtacagagatgacttggctggtag

SEQ ID NO: 7065 - DNA, 601 bp, Human
atttaagagtctagaaggaccatctaattcaaggcttttttttttaatttagtttttctattttctttgttctttctttcttcttcttctttttttttttttttgtgtgttcttctacttgataattcaaggcttcttaacctttttttggttatggacttcactgaaaatctggtatcacaggatccttcctcttcccagacacacacacacacatatgttttgtacaaaatttcaggaggttcagagatccctgaatcctatctatggaccctgggttaagaaccctgatctagcttgttttttttttgattcttgcatagtatatttttatttaaaaggttttgctgataattattattttaatataactaagttgtgacctgttttaataagggtctgactgtaaaacttgagcttcatcataaagtgccattttgagaagctaatgaaatgttgagtatgttgcctagtagtgtcaggaaaaatggtacagagatgacttggctggtagttatcaaaaatcctcccagaacatcctgttctcattcccctagctattcaggcaaggggccacaattaatccctgtctatgatgatg

SEQ ID NO: 7066 - DNA, 601 bp, Human
tggactcattctgttctattgttcatttatttatatcagtgccatactatcttattcatatagcttttttttgggcaaatcttttctattttaaaaaattcatattaaaaatttaacataataagtgtacatatttatggggtatatactgatattgtgatacatatagtgatcagattagtaattagtgtatgtatctcagtcatttatttttttttgtattgggaacattcaatattctcctagctatttgaactatatagtattttattgttaattattgtcattctacagtgctgtrgaacactaggacttattcctcctatatagctcacactgctttataatacaccttttttatggtagttaaggtctcataccttattttcttcttggctatttgtggctttttataccttcatgggacttttttttttttttttttgagatagcctcactctgttgcccaggctggagtgcaatggtgcgatcttggctcactgcaacctctgcctcctgggttcaagcgattctcctgcctcaccttcccgagttgttgggattacaggtgcccaccaccacacccggctgattttttttt

SEQ ID NO: 7067 - DNA, 601 bp, Human
attcaactgattatccacttgaatgttgcataattgtgattttttgtgtgtgtttttttttttttttttttttttttttttgctgatcttcccatactaataaatggtgccaccatttatccagttactgaagcctgaaacctggaatcatcattggctcctcactttttcttatgccgatatgcaattcacaagattttatctgttctacttccaaaatacatctcaaattcgtctacccctctctgcctacactgctatcaacttactttgggttattatcatttcttttatggaaaartttaacagttttctagctactctcccctttaaatctagtctgtctccacacaatagccagagtgatctttcagagatctaaaatgttctaatatcttccttttggactaaagctatgcatggtaaactttgttgttttgcctggcagagctggtcctttcccacctatgtctttgaccctgttaggtcattactcccagtcttcagttacagtcaagttacactggccttttgccaaacacctttttttttttttttttttttttttttgagacagggtctttctctgttgcccaggctg

SEQ ID NO: 7068 - DNA, 601 bp, Human
cacctatgtctttgaccctgttaggtcattactcccagtcttcagttacagtcaagttacactggccttttgccaaacacctttttttttttttttttttttttttttgagacagggtctttctctgttgcccaggctggagtgccatggaataaacacagcacagctcactgcagtcttgacctcctgggctcaagtgatccttctgcctcagcctctggagtatctgagaccacaggtgcacgccaccatgcctggctaatttttaaattttttgtacagacagggtctcactatgttkcccagcctggtcttgacctcttgggttcaagcgatctgtctacctcagccttccaaagtgttgagattataggtatgagctaaatttgccaaactcttgcaagaccactataaggcctttgcattggctgttttctccaactctgactttttggttgagtccttcgtttatcctttatatctcagttctaatcacctacttagagcctaccctatctaaagtaaatgcccctttccttatttgtctattatttctactagaaaagaaaataaagcccatgatagtaaaattttgtgtttt

SEQ ID NO: 7069 - DNA, 601 bp, Human
tttttgcaatatgcccaaagagaatgaatgagggaagaaaccattggcaacccctttgtgttgtggaattcccaatcttcagtaagtgacatttaaccatttaacatcagattaagggaacacgtatcaaaaaaaattttaaagattattttttaaactaaaaattaattgaaagttttttgttgttgttgttgttttctttttgagacagagtttcgttcttgttgcccaggctagagtgcagtggcggcatggtcttggctcactgcaacctccgcctcccaggttcaagcgattctcktacctcagcctcccaaatagttgggattacgggtgcccaccaccacacctggctaatttttttgtagttttagtagagacagggtttcaccatagtagagacagggtttcaccatgttggccagactggtctcgaactcctgacctcaggcgatccacctgcctcggcctcccaaagtgctggaattataggtgtaagcttccgcacccgaccaattaaaagttttaatattccccctgtggtgctatatatgtatacataggttttcatccatggtcctggttcataactcccatatcc

SEQ ID NO: 7070 - DNA, 601 bp, Human
gaagctccagaggcccagagttgtgactgatatctagggatatgggggacaatcttggagctctcaagatgaggcccgaggctctcttttaaggggtgttctggataagtcatagcagttaacaagaatgctaggacatacagggacacataattcatcagtcctgtcaaagtacatcacaaaaatccagtatcatgattccaacagcatttcagtcttggggttagggttgaagttagacaaaacaaaaacaaaaacaacccacatttggtcacagagaagtcttctgtgttgatgattwttgtagtatgagagtagtggaaaaacacgaggttggaaagagtctttccctacacactcccccaccctggaggatcatcttgcctacctcctggcatgtgcacaccctgctttggaaaccaccttgcctcacacaagggatgaaaatgcattgtggcagaattgagttctttgtcttttctcattttctctccagatttcatatattgtggaaaagcagttgaatgagaaaactaatctttcaaacaagcatagccagtgtaatgcagacttcgtagactgtagagcatgtccctctaaa

SEQ ID NO: 7071 - DNA, 601 bp, Human
attgagtctgtacctaggacttccagggcttttagtaattaaatgatagattttatagaacgcagacattgtttagctaaaaagagatatttccatctcaattctatttagaagatattatggagctagaggtggagatctatgactaagggcatgttgaatttttttatgaaagaaggggactctggtaattaattttttatgataatgtattctttcaatttggaaatggttcgagtacgaactcaattattttcaaatataaattttggaaatgggatatttttagatctaattgccratgactaatataatgaatctttataaaaatactattttgtatcttggaggttgggggacatgtagatgttgcttaaaatcattgaaaaagtattctttttgcagcatcctgcttgcctggcttgtggatttcaccttgtttctgctggggatattagtttgtttcttaaataaggatttttgtctatttaaagactcagttgtctagtttcaaaggtaaagcttaaagcaggtccttcttccgcttccctactccacaaaatacatagtcacagactgactagtaatgagtaaaacaaaa

SEQ ID NO: 7072 - DNA, 601 bp, Human
tgtatcttggaggttgggggacatgtagatgttgcttaaaatcattgaaaaagtattctttttgcagcatcctgcttgcctggcttgtggatttcaccttgtttctgctggggatattagtttgtttcttaaataaggatttttgtctatttaaagactcagttgtctagtttcaaaggtaaagcttaaagcaggtccttcttccgcttccctactccacaaaatacatagtcacagactgactagtaatgagtaaaacaaaagcaaactgcctcttaatctaggaacagagaagaaatamagaagtccctatttcagagagagtaagggttaaaattcttagcagtcggggcagggtataacactcttgagaagagtgataagggctttcccagtagcctgcagttccctgtagagtagtacatggctagacttgtcagattagggcaagaatagcaatttgaccagtgagttccagcaggtgtagcagcaaaagcacagatttcttacacatacatgtaatgcatgtctgcttatagcggacagcccttgagatgaggtctgaggtgttctgaatgagtcatagcagttaccaagaatg

SEQ ID NO: 7073 - DNA, 601 bp, Human
tggtctcactgtgttgcccaggctggtctcgagcgaggtaaagattttaaatggagttcagctagtattaagcccactactcacttgttctgtggtactcttaacaaataatgttggattacgacagcaaaatatgtggtatagaactattttcatttttgatctacttaggacaggtattaatggacactttctcatagctcataatcatgttggtattgctgtctcttgtttgtgaaagtctgtggaaacatcagtcactactaacggtagacagtctttagatttcagcagatattcrtcagggtttgttgatgtttgtttttacatgatgaaagtccctatcaaagtaattctatctccaaaagattttttttttttttttgagacagagtctcactctgtcacccaggctagagtgcagtggcatgatcttggctcaccggaacctccgcctcccggattcaagcaattctcctgcctcagcctccaaagtaactgggattacaggcatctgccacctcgcctggctaatttttggtatttttagtagagacgaggtttcaccatgttggccaggttggtctcaaagtcctgacca

SEQ ID NO: 7074 - DNA, 601 bp, Human
ggctggtctcgagcgaggtaaagattttaaatggagttcagctagtattaagcccactactcacttgttctgtggtactcttaacaaataatgttggattacgacagcaaaatatgtggtatagaactattttcatttttgatctacttaggacaggtattaatggacactttctcatagctcataatcatgttggtattgctgtctcttgtttgtgaaagtctgtggaaacatcagtcactactaacggtagacagtctttagatttcagcagatattcgtcagggtttgttgatgtttgtttttacatgatgaaagtccctatcaaagtaattctatctccaaaagattttttttttttttttgagacagagtctcactctgtcacccaggctagagtgcagtggcatgatcttggctcaccggaacctccgcctcccggattcaagcaattctcctgcctcagcctccaaagtaactgggattacaggcatctgccacctcgcctggctaatttttggtatttttagtagagacgaggtttcaccatgttggccaggttggtctcaaagtcctgaccacaggtgatccactcgcctcg

SEQ ID NO: 7075 - DNA, 601 bp, Human
gcatctctgtattagagtattgatctgctgcttggtaggtactgtgtaaaataagtcttctagtaaagatgtattaagtggtttaagagcagtttatattacaaataaggtggaagaaggtggagttctgtaagaccggacacatgctataaatatccataaaattaagtattttatctaaaaatgtgtgttgaaaatttctttttttctttttttctttttttgtttttttgagacggactcttgctctgtcgctggagtacagtggcgcgatctcagctcgctgcaagctctgccttcygggttcacaccattctcctgcctcagcctcccgagtagctgggactacaggtgcccgacactgtgcccagataatgttttgtattttttagtagagactgggtttcatcgtgttagccaggatgttctcaatctcctgacctcgtgatctgcctgccttgacctcccaaagtgctgggattataggcatgagcaactgcgcccagctgaaattttcttattttaattcatatttaattgcacatagttgaacattatctgagtgtgagttgcgtacactaataccatcatcctttgccct

SEQ ID NO: 7076 - DNA, 601 bp, Human
atctcagctcgctgcaagctctgccttccgggttcacaccattctcctgcctcagcctcccgagtagctgggactacaggtgcccgacactgtgcccagataatgttttgtattttttagtagagactgggtttcatcgtgttagccaggatgttctcaatctcctgacctcgtgatctgcctgccttgacctcccaaagtgctgggattataggcatgagcaactgcgcccagctgaaattttcttattttaattcatatttaattgcacatagttgaacattatctgagtgtgagttgygtacactaataccatcatcctttgccctttagtggaggattttatatttgatgttcctgtgttgtggttgaaaactgtgttgtaaactcgtcagttataagaaataatattgaccataggaacagtgttttaaagtaatccgttgaatattttcatgaaaatccaggttgattttgcctgagcataagttggtcttcatcaataacctcttcactgtatacattgcctggttttgcctggctaaccgaaatctggcctttcatgtaggtatagagaagaaaccttttttgttttttttct

SEQ ID NO: 7077 - DNA, 601 bp, Human
ttttttttagaatttttaaaaagctcattcccttttgctgttatttaatggtagcaggtcatgtatgactcatgacttaggtcatacaacttaggatattaaatggttcagatacccagcaaacagttcaaagattgcattaacaagctagctaacattttgtaaaggagttcaaaatgaaagactgtcagtacctatattccgtgtgcctagctgttgttgccccactggaatgtcacaatgcaaggatgtgaatctccctttctcctaacagaagtttttaaagctaacagattttaayagatttgcaaacagaagtttgcaagcagaagtttgtaaatctgttaaaatgttttacattaaaatttgatgcactgatttttagattggtgtctaaagtaggcaatatcatcaggttgtgcatttgagatttaccagtttacatcttggcttatgataaattggattggaagatcaggtactttattttcctggaagaaaaaaaaattaggtatattcatcattcccatttcacaatttcttgtcatatctcacttgcttcagaaatactcattttggatccttcttgtgaatatgtaac

SEQ ID NO: 7078 - DNA, 601 bp, Human
gaacatgacacttggtctttgaaattgttatttatttcatatattgtagctgccaatcagtcagtgatttgcaaatagcaaagtaaatacactgctgaaaatgagtttcttctttgtgctgatctgtgatgtgcgggaaatcagatgtaatatggttgcatttatttatgtaggcatctattctctttcttaatgagcaagtaattttcttttctctacttctacacaaaagttaaattaaggagtacccaagagggctgggaaacttggtttgcagtcattgaaatactgctgagtatcgggatcctttcatgagtggagtttccctctccttaagaagaaagctccagatagctcccttttgaactcattgttagagcaaacacatctgtagaggaagatgatccataagtctaatgctaaggatttgcctcctctccctatcaatgagaagggtttgcctcctctccctgtcaaaggattttactctggcttatttggctgtttttgcctgggaagtgaggggcaagagctctgatctttcctatgacggccagcctggccttaatatgtagattattaacatgataccagcctctgt

SEQ ID NO: 7079 - DNA, 601 bp, Human
tgtaaatccatctaggggaagaaaagagtgttgcaaatgcctttcatcaaaatggaagactacttcaacttctatttgctcttcttgttataaccaagctttttcttttttcattttcctctgcctttctttccctccttttttccgtccccactatcctccatctttcagaaatatcaaaagctgaatcttcccaccgaacactgcaatcatttgaaatttgtgtataggccagcttcacatcatcagaaattgtgtaaccccatgattcccaggcctcagctggtagtgtagttatttmaaataatatttaatacaataaattctatggcaataaaagaatttggacagtcccttcgaacttattgcaatgagatttgacttgaatttaatacaatgaagtttcagaatagccaagtaattttgttgtggcatgatttaaagggtatttaagtacaggtataggtgattgagtttgtaaaacctaatcagaggtaaattgcagttttactcttatcacgtgaatgagcattcaaaaatacagaaattctttacttagcataaggtgatttttaacagtgtggcaaagagtgtaagtgaa

SEQ ID NO: 7080 - DNA, 601 bp, Human
aaagagtgtaagtgaacatccttaactttttgttctgtcaaggggagaataaagataccacctggctgtatgtataaatttgcttactaagatggttgattgatttcttttaggtgggtattaaaagtggcttttttggtatagaaaacatgtagcatcaaagcagtgttgtgatgccctgctgtcttctgatgttgaatattttatgggattaaaaacaattgtttttatcttactctttcagattcaacaatcttatagtaaaagcagccatagactaaatatttagaatttattatgytgatacaaatgaaagaaacataaaatacaaatattgagtgaattaagaaaaagaggctgcttgcagtggctcacacgtgtaatcctggcactttctgaggctgagtcgggaggatctcttgaggccaggagtttgaggctgcagtgagctatgattatgccactgcactccagcctgggtgacagagcgagacctcatctcaaaaaaaaaaaaaaaaagaaaaagaaaaacaatgtttctttctagagtgcttagcagggcaaaaaaagaaggaaaaaagaaaaacagaatgttgatgtt

SEQ ID NO: 7081 - DNA, 601 bp, Human
atgtaattatatacttagtaaccctgctctacaaagcagtagaaattcaagtaagaataatttactgcttatgcatagttattagaattttaaagcatttgtttgttcaaaattctagtttatcagtgttgtatttgactaattgcctacttaataaataatgaatataatttattttagaaggcacccaaattttaacaattgtaaataaacattaggagctgctccccctcttcgctttcttgtttaaagggattctcatccctttagtccaagtttcgtggagaaaataattcctatyttaaaaattctatattagaagtattatagatggacttaaattacagaattgtggaattttattgctgtaaggtagttagaaatatcttattctatccattttaccagcaaagaaggtgaagtgtatagaaattaagtgaacttctcaaagtcatacaattggtttgaggacaagtctgttccacaacctgatatgtcatgccttctcagttgtcatgataattcagcagttcatttcaccagggattccttgaacactgctgtgtgtacaacagtgggctaagcatccagaggttgtaac

SEQ ID NO: 7082 - DNA, 601 bp, Human
ctatcttaaaaattctatattagaagtattatagatggacttaaattacagaattgtggaattttattgctgtaaggtagttagaaatatcttattctatccattttaccagcaaagaaggtgaagtgtatagaaattaagtgaacttctcaaagtcatacaattggtttgaggacaagtctgttccacaacctgatatgtcatgccttctcagttgtcatgataattcagcagttcatttcaccagggattccttgaacactgctgtgtgtacaacagtgggctaagcatccagaggttrtaacaatagtgtgagtttatatggtctaacaataatgatatcagactagtaatattttacatttgaatctcagttttatctggtgttttctaatgtttataaatgttaatgtgtggtggctaaacctttaaatctctttttctctactagattataacctctttaaaagcagggactcatttagcttttgtaaagtcaatccagtttcatttttaaagacttaaattaaaatttctaagcattgatggcattgttggaataaatgtagcttcctgaggtgtcttctctggggacgataca

SEQ ID NO: 7083 - DNA, 601 bp, Human
gtgagctactgcacctggcccatttagttctttatatctgttgtttctttgctggtactctctttctttcaagagtgtttttagttattggaacattttaatcctatctatgtgtatgtgtgtgtgtgtatatatatatatatatatatatatatatttttttttttttttttttgagacagagtctcgctctgtcacccaggctggagtgcagtggcgcatctcagctcactgcaagctccgcctaccgggttcacgccattctcctgcctcagcctctcgagtagctgggactacaggygcccgccatcatgcctgactaattttttgtatttttggtagagacggggtttcaccgtgttagccaggagggtctcaatctcctgaccttatgatccgccctcctcggcctcccaaagtgctgggattacaggtgtgagccaccgcgcccagccaatcctagctatattacagtctttgcctttaaagttaatttcaccgtctgtgccatcttggtattggcatctgttgataccagttgaagttttcccctttttagtataccaagtaatttttgcgttatatccttggcttttttaat

SEQ ID NO: 7084 - DNA, 601 bp, Human
tctttgctggtactctctttctttcaagagtgtttttagttattggaacattttaatcctatctatgtgtatgtgtgtgtgtgtatatatatatatatatatatatatatatttttttttttttttttttgagacagagtctcgctctgtcacccaggctggagtgcagtggcgcatctcagctcactgcaagctccgcctaccgggttcacgccattctcctgcctcagcctctcgagtagctgggactacaggtgcccgccatcatgcctgactaattttttgtatttttggtagagayggggtttcaccgtgttagccaggagggtctcaatctcctgaccttatgatccgccctcctcggcctcccaaagtgctgggattacaggtgtgagccaccgcgcccagccaatcctagctatattacagtctttgcctttaaagttaatttcaccgtctgtgccatcttggtattggcatctgttgataccagttgaagttttcccctttttagtataccaagtaatttttgcgttatatccttggcttttttaatattatgcaactcagttttgtttaaattgtattgaaaatgttgata

SEQ ID NO: 7085 - DNA, 601 bp, Human
cagtggcccacccctgtaatcccagcatttgggaggctgaggcaggtggatcatctgaggtcaggagttcaagaccagcctagccaacacggtgaaaccctgactctactaaaaatacaaaaaaattagctgggcgtggtggtgggcgcatgaaagcccagctatttgggaggctgaggcagggcaatcgcttgaaccggggagacggaggttgcagtgaaccaagattgtgccactgcactccagcctgggcgacaagagcaaaactccatctcaaaacaaaaacaaaaaacaaaaaaarccacacaaaacattgaggtaaagttcacataatataaaattaaccattttaaagtgaacaattctgtgtagtttagcaactactacctctatgtagttgaaagacatttacatcattccaagtaaaagcttttatccagtaagcagtttctttctattcccttccttcagcccttggcaatcaccaatctgcattctgcccatatgaatttatctattctggacatttcatataaatggaagcatacaatatgtgactttttgtgtatgacttctttcacttaccatatttttgaggttt

SEQ ID NO: 7086 - DNA, 601 bp, Human
actgataaagcttcttctagtacatctggatttcctggtatgcttctctcctaatatatctggatggctgctttttagctttctttagttctttttttaaacttaccatactagtgggtgtgaagggtacattatcgtggttttgattttcattttcccaatgaccgctgatgtcaagaagagtaccctggctgcgcagggtggctcacacctgtaattccagcacttttggaggccaaggtgggcggatcatgaggtcaggagttggagaccagcctggccaacatggtgaaaccccgtmtctactaaaaatacaaatattagccaggcacgatgatgcgtgcctgtaatcccagctgcttggaggctgaggcaggagaattgcttgaatctgggagtcggagattgcagtgagccgagatcatgccactgcactccaacctgggtgacagagcaagactctgtcttggacaaaaaaaaggaagagtacccttttaatgtgctgttgagagtaatatcttttcagttattttgcccattttttaattgagttgtctttttttatttttttgagttgtaaaagtatattctggatagtcaa

SEQ ID NO: 7087 - DNA, 601 bp, Human
ttgtctttttttatttttttgagttgtaaaagtatattctggatagtcaactgttcttagagatatgatttacaaaacaatatgcatctttaacttaacacagcctggaaatatttcacttcacatatactgtattttcagttttctacattcctatcctttgtgttattattgtcatacgttttgttttcatgtatattatgaacactgtaacttattatttttgcttaaattgcttactttttaaaaaaattttaaatgaaacaattttaaaaatattgacatttgtatttctggcactttttttttttttttttttgagacagtgtcactctgtcgcccaggctaaagtgcactggggcaatctcagctcactgcaacctctgcctcctgggttcaagcagttctcctgcttcagcctcctgagtagctggcattacaggtgcaggcccctacgcctggctattttgttttttcagtagagatgggatttcaccatgttggccaggctggtctcgaactcctgacctcaagaaatctacctgcctcggcctcccaaagtgctgggattacaggcatgagccactgcacctggccattt

SEQ ID NO: 7088 - DNA, 601 bp, Human
catctttaacttaacacagcctggaaatatttcacttcacatatactgtattttcagttttctacattcctatcctttgtgttattattgtcatacgttttgttttcatgtatattatgaacactgtaacttattatttttgcttaaattgcttactttttaaaaaaattttaaatgaaacaattttaaaaatattgacatttgtatttctggcactttttttttttttttttttgagacagtgtcactctgtcgcccaggctaaagtgcactggggcaatctcagctcactgcaacctcygcctcctgggttcaagcagttctcctgcttcagcctcctgagtagctggcattacaggtgcaggcccctacgcctggctattttgttttttcagtagagatgggatttcaccatgttggccaggctggtctcgaactcctgacctcaagaaatctacctgcctcggcctcccaaagtgctgggattacaggcatgagccactgcacctggccatttctggcactttttatagttttgtatgggttggtctattatcattcttcagatatatttggaaatatgcattttccaaatatattt

SEQ ID NO: 7089 - DNA, 601 bp, Human
ttacaggtgcaggcccctacgcctggctattttgttttttcagtagagatgggatttcaccatgttggccaggctggtctcgaactcctgacctcaagaaatctacctgcctcggcctcccaaagtgctgggattacaggcatgagccactgcacctggccatttctggcactttttatagttttgtatgggttggtctattatcattcttcagatatatttggaaatatgcattttccaaatatattttctgcttctgcccatccctgttctctaattttcttttgagacaccagatatrcatgtgttagaccacttacaatttcctataggtcactgaagctttgttcagtttgtttccttagtcttttttctcttagtgctttatttttgcttcctcgggttcactgatcttctacagagtttaaatgtgctgctagtcctatttcatgaaattatcatttcaaacattgtatttttcattctggaactttttatttcattctttttttataccctacatcactatgttcatgttattatagctgttttaatttttaggtctgctaatttcattgtcagtttttttctgggtctgctt

SEQ ID NO: 7090 - DNA, 601 bp, Human
ttttgagacaccagatatgcatgtgttagaccacttacaatttcctataggtcactgaagctttgttcagtttgtttccttagtcttttttctcttagtgctttatttttgcttcctcgggttcactgatcttctacagagtttaaatgtgctgctagtcctatttcatgaaattatcatttcaaacattgtatttttcattctggaactttttatttcattctttttttataccctacatcactatgttcatgttattatagctgttttaatttttaggtctgctaatttcattgtcagtttttttctgggtctgcttccattgactgatagtcctcctagttatgaatcatattttgtgcctcttgtcttgtaattttagatttagttgtagacattgtgatattacatttttgaatatttgtattttaaaaatctttttaaaaggatgttgagtttattttggtgctcttaagttttttgcagatcaacttgatgctcttgtggctgattttaagctttattctgatagttttagtgtagcttttattctagtgtagttcatcccagcaactgagatgtgagctttctaaggctccta

SEQ ID NO: 7091 - DNA, 601 bp, Human
tttgtttccttagtcttttttctcttagtgctttatttttgcttcctcgggttcactgatcttctacagagtttaaatgtgctgctagtcctatttcatgaaattatcatttcaaacattgtatttttcattctggaactttttatttcattctttttttataccctacatcactatgttcatgttattatagctgttttaatttttaggtctgctaatttcattgtcagtttttttctgggtctgcttccattgactgatagtcctcctagttatgaatcatattttgtgcctcttgtcttgtaattttagatttagttgtagacattgtgatattacatttttgaatatttgtattttaaaaatctttttaaaaggatgttgagtttattttggtgctcttaagttttttgcagatcaacttgatgctcttgtggctgattttaagctttattctgatagttttagtgtagcttttattctagtgtagttcatcccagcaactgagatgtgagctttctaaggctcctagtgaatgtcataagtattcattaggcttctgaaatctgaccagtcagaacagaaatgtgccccaggtctg

SEQ ID NO: 7092 - DNA, 601 bp, Human
tattttatagaaatagataatcaaaagtggaaattggccaacagatatgaaacaaagtaacaaaaaatgataaccctttcattgaaatttgagagaaatgtaaatgaagttatagaagaaatagttgaccataggaaaattgacactgtcaccatttgatagactctagatatgcagccagaggaacttattgaaggtgaacttattaacataaatgagggaagtggtttttttgtttgtttgttttgggtttgtttttgagatggagtcttgctctgtcgcccaggctagagtgcagtgrtgcaatctcggctcactgcaacctctgcctctcactgcaacctctgcctcctgtgttcaggcaattctcctgcctcagcctcctgagtagctgggattataggtgcccaccaccacgcctggctaatttttgttttgttttgtttttttgacagagtctcgctctgttgcccaggctggagtgcagtggtgcaatctcggctcactgcaggctccgcctccagggtttacaccattctcctggctcagcctcccgagtagctgggactacaggcacctgccaccacgcctggctaatttt

SEQ ID NO: 7093 - DNA, 601 bp, Human
ggactacaggcacctgccaccacgcctggctaatttttgtatttttagtagagatggggtttcaccatcttggccaggctggtctcaaacacctggcctcaggtgatccacccgccttggcctcccaaagtactgggattacaggtgtgagccactgcacccagcctgagggaagtggttttgatgcaaaagatgaagatgtcccagaggaaatctttacattaaaggaaaaaaaaactttatattaaaagaccttgagatatttcacaaaattgaaagtacaaaggataaaatgttagawtgtgaccttgctttgtttctaatcttctcttaaaccaatctaatgaattcttaatttcaactttcgtgtttttttatatacaggattttcatgttatatattttaaattttagattccaattttctggtgtaactttttaatctgttttgttgaatatcttaaatatggttattttaaagtctgtgattacttatcacattgggggctgttgtttttaactgtgttaatatgtacataccataaaattgaccatcttaaccatttttaagtgtacaattcagtagttttagcacattcac

SEQ ID NO: 7094 - DNA, 601 bp, Human
aatgttagattgtgaccttgctttgtttctaatcttctcttaaaccaatctaatgaattcttaatttcaactttcgtgtttttttatatacaggattttcatgttatatattttaaattttagattccaattttctggtgtaactttttaatctgttttgttgaatatcttaaatatggttattttaaagtctgtgattacttatcacattgggggctgttgtttttaactgtgttaatatgtacataccataaaattgaccatcttaaccatttttaagtgtacaattcagtagttttarcacattcacatcattgtgcaaccagtcttcagaactttttcctcttgcaaaactgaaattctatactcattaaataacaactccccattacccatcacctctcagctcctggcaaccaccatcctactttctgaatttgactactctaggtaactcatataagtggatttatacagtacaggcatgcactgtataatgacatttcagtcagtgatggactgtgtacacgatggtggtcccttgagattataatggagctgaaaaattcctatcacctagtgacattgtagccaatgtaac

SEQ ID NO: 7095 - DNA, 601 bp, Human
ttattggcatattattttgtcatctaatccacagatcccattcaagtttctctagtaatctcagtcaatgtcctttatataatagaataaatatctagttcaggatcacatgatacatttagtagtcatacctctttagtctcgtttactctggaacagttcttcagtctttccttggctttcataacattgacatttttgaggattacacgccagtatcttgcagaacatttttcaaattgggtttttctgatgtattctcatgattagatccaaattaggtatcttcgacaggaatatyacagaggtgatgttgtgtttttattgaatagtatcaggtgacacataatgtgaatttcttccaatattagtgatattaatgttgattacttgattaagatatcagggtttttttcccactatagaattaactttatatttttccaattaaaacgaagtagtattttgtggggaggtattttgagactatttaagtatcctcctccttatcaaacttacagtttatattttgtttcattttattttatttcattttagagatagggtcttgttctttcactcagggtggagtgcagtggcg

SEQ ID NO: 7096 - DNA, 601 bp, Human
atatcagggtttttttcccactatagaattaactttatatttttccaattaaaacgaagtagtattttgtggggaggtattttgagactatttaagtatcctcctccttatcaaacttacagtttatattttgtttcattttattttatttcattttagagatagggtcttgttctttcactcagggtggagtgcagtggcgtgatcctcattgtaactcctgggctcaagtgatcttcctgctcagtctcccaagtagctggaactacagatgcgtgtcaccatggcttctttttttccygttaattctttttgtagaggcaggatctcaaaatgttgctctgactggtctctaattcttggcctcaggcaatctgctgggttacaggtgtgacccaccacacttgtccccagtttattttttatgtcattaatggagtcatagatttcaactttattcagtggcttattttattagttatctattattacataacaaattacctcaaattgagtggcttataataacacatacatttaggctgggcacagtggctcacaccagtaatcccagcactttgagaggccgaggcaggtgggt

SEQ ID NO: 7097 - DNA, 601 bp, Human
gctaattaacatatctgtaacctagcatacatgtaacatctcacagtttcttttctttctttctttcttttttttttttttgatacagagtctcgctctgtcacccaggctggagtgcagtggcacgatcttggctcactgcaacctctgcctcccaggttctggcaattctcctgcctcagcctctggagtagctggaattataggcacacaccaccatgcctggctaatttttatatttttagtagagacagggtttcaccatgttgaccaggctggtctcgaactcctgacctcaggygatccacccacgtcggcctcccaaagtgctgggattacaggtgtgaaccacttcgtctggccagtacctcacagtttctttcaatcaggagtctgggcacagctgacctgggccttctgctttagaatctctctcacaaggccataatcaaggtggtgtctagggctgaggtctcatttgaaggttttatttcgagaaaaagccacttccaagcttattgttgttggtggtggtggaattcttttcttcaagggctgttggactgagcctcaattcttagttgtttgttgactgggtcac

SEQ ID NO: 7098 - DNA, 601 bp, Human
tcccaaagtggtgggattatacacatgagccaccttgcctgaccctctctgggtcttatttaccttactagtttattatacaggtgaatgaattggggaagagcttgttccgcaattcattgccaaacaatgaattgttagactgacaaagctaactaacaaagcttgttagtttgttatacagagaatgttatacagatgcagcttgttagtttgttatacatatagtaacaagtgctacaataaaattaaagtctgtgactgagcttttctaaatatttgaaaatttacctaaacttayagtagctgttgtctaatgcaatttagtacattgttaaattttttcttgtagttactatttgttagtagtttatctccttgaaatagagtgtaaactacttgagtctgtggatttgtggagacaaacacatttgagtattatttctgccattgtcatttaggcactataacttcactgaacttgagtgtactctcttgttaaggcaaaagtactaataattctttgacaagaaggtaatgcttaaatgaaataatgtacttaagggatctagtacaatgcctggcagacagtttattcccg

SEQ ID NO: 7099 - DNA, 601 bp, Human
aaaaaaaagaatccttgttttagttttaccacaaccttgtgcaataaggctgggcagatatgattatcctatctgacaggtgggagttttgtttttggagtgaactaaattgggattcttaagaggcaatcattggatttgtaggtaaagtctgaatgtattacatgattatggtatactgcatttctctgaatttcttagttgatatagtagtgaaaagggaattcttctattccatggcttaaggatacgtaaactctcagtacagcaatctttttattgttgattattatagcttctrttactcctagaagttgaccaacagggaccttaatttaggagattttgtcattcagctttcgtatagtaaatgctgaggctagccctttgcctgcagggctatcagtgaagaggatctgtgacattactccagacagccaagtgtagggggaagagttgagattttcagtgttctctgtgtaaatgaattgtgccattgaacctgatgggcactagatactatattcttcttgaagcactggaggcccttcattgcaatcttgttttttcaacttttattttaaaattggggtatatgtgc

SEQ ID NO: 7100 - DNA, 601 bp, Human
atgatttcattattttttatggctacttagtattccatggtatatgtgtactgcattttctttatccagtcttccgttgatgggtacctgggttgattctgtgtctttactatcgcattgcagcatttcaattttttttctgattcaggtagtagaaaacatgttcagtcttatttttttctgtgctgtgtatgctttttaaaggctagtgaagtcattcagttggataacaacaattataatacattgttatactcttcaactttctttgattttgcaaaggagagtcaattggggtgamgttaggtgggaactgagctgaagaaactaatatgtgctgtgcagggctggatttgtgtaggatgcagtcattatctgttaactttgtcatagcttttgagactgcatgtaaggagtaggtgatttgcaagttatttaacagttaacagaaggtaaatatttaaacaggagaatgcgtagttgctgcttagtttaaaacctgcttttttttttttttttaattaaaaaaaatgttttttagccaggcgtggtggtgcacgcctgtagtcccagctactgggcaggctgaggcagaaggatt

SEQ ID NO: 7101 - DNA, 601 bp, Human
ttttttttttttgagacggagtcttgttctgtcgccaggctggagtgcagtggcacaatctcagctcactgcaacctccgccttccgggttcaagcgattctcctgcctcagcctcctgagtagctgggactataggcgtgcaccaccatacccagcttatttttgtatttttagtagagatggggtttcaccgtgttggccaggatggtcttgatctcttgaccttgtgttccacccaccttggcctcccaaagtgctgggattacaggcgtgagccaccgtgcccagcctgtgtacagyatttcttataacaatgagttacttttatgttaaggatttttttttttttttttgagacgggtcccttccttccttccttcttctctttcttctcttactttcttttctttcttctttctttccacagggtcttgctttgttgcccaggctggtgtgcagtggcatgatcaccgctcattgctgccctgatatccctggctcaagcagtcctcccatctcagcctccccaagtagctaggaccacaggcatgtgccaccatgcccagctattttttaaattttttgtagagatggggtctc

SEQ ID NO: 7102 - DNA, 601 bp, Human
gcctcagcctcctgagtagctgggactataggcgtgcaccaccatacccagcttatttttgtatttttagtagagatggggtttcaccgtgttggccaggatggtcttgatctcttgaccttgtgttccacccaccttggcctcccaaagtgctgggattacaggcgtgagccaccgtgcccagcctgtgtacagcatttcttataacaatgagttacttttatgttaaggatttttttttttttttttgagacgggtcccttccttccttccttcttctctttcttctcttactttcttytctttcttctttctttccacagggtcttgctttgttgcccaggctggtgtgcagtggcatgatcaccgctcattgctgccctgatatccctggctcaagcagtcctcccatctcagcctccccaagtagctaggaccacaggcatgtgccaccatgcccagctattttttaaattttttgtagagatggggtctcccacattactgaggctggtcttgaacttctaggctcaagggatccacctgcctcgccctcccaaagtgctgggattataggattgagccaccacatctggctcca

SEQ ID NO: 7103 - DNA, 601 bp, Human
ctgggactataggcgtgcaccaccatacccagcttatttttgtatttttagtagagatggggtttcaccgtgttggccaggatggtcttgatctcttgaccttgtgttccacccaccttggcctcccaaagtgctgggattacaggcgtgagccaccgtgcccagcctgtgtacagcatttcttataacaatgagttacttttatgttaaggatttttttttttttttttgagacgggtcccttccttccttccttcttctctttcttctcttactttcttttctttcttctttctttccwcagggtcttgctttgttgcccaggctggtgtgcagtggcatgatcaccgctcattgctgccctgatatccctggctcaagcagtcctcccatctcagcctccccaagtagctaggaccacaggcatgtgccaccatgcccagctattttttaaattttttgtagagatggggtctcccacattactgaggctggtcttgaacttctaggctcaagggatccacctgcctcgccctcccaaagtgctgggattataggattgagccaccacatctggctccaggacagtgtctactaccag

SEQ ID NO: 7104 - DNA, 601 bp, Human
tggcaggatgacagggagaaggaaattataagtttaaagacaggggtaagatgagtatttgaacaaaatatcaaggtaggtagttagctagagtgccagggccaattagaagattagagaaggtgagttgatgttggcagtgggggaaatgtcagattgacagagtgcttggatttcatacagtagatatctcatcatgaattattgatgagagtgacatgataacaaagtgaagacaattatttttctatttagctgctgtttataaaatggatcgtagcttgaggtgaggaaacgttgraaacagtgaacaaagttcagagattgttggagtaattcaaagcagtttagctgttttgcttggtatgttatctggtgatgcctttagcagatacccttcttttgaagcccagtgtccactttatgactgagggatggatggaggcaggaggaagaattctgcactagaaagcaacaggccaagattctagtccctacttccctactttgtaaattcataatcatggataaatacttaatttttcctgggcatcagtcaccttacctataaaatgaggataatgtattaagcgtagtccta

SEQ ID NO: 7105 - DNA, 601 bp, Human
ttgtttcccaatattactttctacaactatattgttttaaggagaaaaaagtctatgacaatataaaatatttcaaagtctgtaattttaaggtttaatgttacctatattgactactatattttaaaatatgtatccctgtttttatatgtgccatgattaggtatttagttttttagttattattagactgtaatagcactcaagttgatggataaaatttcatcctgggatacttttagagaaacatgaagaatataaaaatagttttgaaaagtatggtttctttcttacaaagctrtagctgcaataatactaatgtcagttacttagagctactagaaatgtgtaatttctaccttttttgactactgaatataccatatgtattatatatatgtacattcttaggtatttttgtttgtttgtttagaaggttttaataccaacagctttctaggtgtcgtcttcttcctcttcctctcccctccccccctcccctccctcccttcctcctcctcctcctcctcctttttcttcttcttctctctctctcctttctctctcttttctctctcctttttctctgtctctcctttct

SEQ ID NO: 7106 - DNA, 601 bp, Human
ttatttatatcttgattaacatttctaatttctaggtggaaaaacctttgagacctttaggtacagtattcaccttgagacactctagctagtgtttcatgaattaacagattccagttcccctcagcctttcttttttttttttttttttttttttgagacggagtcttgcttcatggcgcaagctggagtgcagtggcgtgatctcagctcactgcatcctgcgcctcctgggttcaagcaattctcctgcctcagcctcctgagtagttgggattacagttacgcgccaccacgcctrgctaatttttgtatttttagtagagactgggtttcaccatgttggccaggctggtctcgaactcctgacctcaggtaatccacccatctcggcttcccaaagtgctggaattacaggcaagaaccaccgcacacagacccctcagcctttcttagaggccaggatgtcagttccaggatgtgcgagaaacttatagagaaataatgtggaaaattgtagacaaaaacgtaggaaagagtttggtgctcattgcttacagattagggtaccatacatgattgttttcttgactgagtctta

SEQ ID NO: 7107 - DNA, 601 bp, Human
tttcttttttttttttttttttttttttgagacggagtcttgcttcatggcgcaagctggagtgcagtggcgtgatctcagctcactgcatcctgcgcctcctgggttcaagcaattctcctgcctcagcctcctgagtagttgggattacagttacgcgccaccacgcctggctaatttttgtatttttagtagagactgggtttcaccatgttggccaggctggtctcgaactcctgacctcaggtaatccacccatctcggcttcccaaagtgctggaattacaggcaagaaccaccrcacacagacccctcagcctttcttagaggccaggatgtcagttccaggatgtgcgagaaacttatagagaaataatgtggaaaattgtagacaaaaacgtaggaaagagtttggtgctcattgcttacagattagggtaccatacatgattgttttcttgactgagtcttatctgcgtacctcaggtatttggaatttgtgtttagcattttatagtaatacacaacaaattagtttttatattaatatttgcctgcttttaacctgttgttcatatctatttagaagaatttcaaagat

SEQ ID NO: 7108 - DNA, 601 bp, Human
atttttgtatttttagtagagactgggtttcaccatgttggccaggctggtctcgaactcctgacctcaggtaatccacccatctcggcttcccaaagtgctggaattacaggcaagaaccaccgcacacagacccctcagcctttcttagaggccaggatgtcagttccaggatgtgcgagaaacttatagagaaataatgtggaaaattgtagacaaaaacgtaggaaagagtttggtgctcattgcttacagattagggtaccatacatgattgttttcttgactgagtcttatctgygtacctcaggtatttggaatttgtgtttagcattttatagtaatacacaacaaattagtttttatattaatatttgcctgcttttaacctgttgttcatatctatttagaagaatttcaaagataggctgtaagtgtcagaaggcttgtgactaaattttagctaaaagaggggaacttaggttttccacattcctaacctatgctaagagttgttaatttttaatgatactatttagtgatcataaagctggatattttcatttttcctttacaaaatttaatatcttaagattttcag

SEQ ID NO: 7109 - DNA, 601 bp, Human
ctgtttatctcatagatagctgctcacatgtttttgaattgaacaaagtttgaatttggcttatatctgaccaccacctccctctcatgtaattgttagtcatttcaaattttgcagttccccaaaggtgcagtgtgttcttttatatatctgtgtctttgcatataccgttctgcttacctgaaaaaacccctccacaaacacctattgtcccttacccactctctgcctttgtctacctaatcttcaagattcagctcaagctgagctagaattaaagtcttccctgatctttatcttygctctcttaaactagtcagaggatctgtacccagagcatgcatggaattctgtgccctgtaaaattgacatgaagaaaaggagtattcattttcgtacttgattctttaacaaaaaattcctgattgggtctaactttttacgtgtgttggattagatggtcatatacagaagggaaagaatagcaatataagtcttctcacgtctgtaatcccagcactttgggaggccaaggaaggcagatcacaaagtcaggagattgagaccatcctggctaatgcggtgaaaccccgtctttact

SEQ ID NO: 7110 - DNA, 601 bp, Human
gaaagtacataattagttttaccaaaatatagttgctactgttcattgtagtttctaccctttatatgagccattgtttgggggagtacttgttttgttactggtaataaactacaagggaaatttgtaatataatattagtatatttcccctagatttttaaaaagcaggtcattatttttttaagcacttcaactgcagcacagtgcaatcttttggggagaattggtaaaatgaggataaaattagtacaggattccagcagcttgaaaataacacaatatttgaccaaaatctcttytgtattccctactctggttcaattccagtagtcctggaaatgtgcctatggactatttacagtgagattataaaactgaatcatgattttggtgaatagaagccagagcatgtggctacagcaccccagctggcagtaagctctccctaggtttatgaatgtagttagatggtccccaactgtttacaagacagcagaggtgagatatttgattgacaagtcagaaatgcattagatcattctctctgccagtctctggttcatgctgttaaaaatgtcagcctccaagtttgaatggca

SEQ ID NO: 7111 - DNA, 601 bp, Human
tttggggcattgaatttacaagtaaagttttaactgagaatgaatggccttttgcagttcttctggagtatggaaaagagtttgtattgaaagttcctcaatggctgggcactgtggctcatacctataatctcaatactttgggaagctgaggtgggtggatcacttgagctcagaaattcgagaccagcctgggaaacatggtgaaaccccatctttaccaaaaatacaaaaaattagccagtcatggtggtgccagtctgtggtcccagctactcgggaggctgaggtgggaggatcrcttaagccttggaggtggtggttgcagtgagccgaaatcatatcactacactccagcctgggttgacagagtgagactccatctaaaaaagaaaaaaaaaggcaactatttagcttagccctctcctctgaaaatgtgaaaggcaagagctgttctgcatcagtctagtgaaatgcactggaaaaatggtgttggtaattcctgctttgaggtcatgctagaaagagagaagataatacttgtaaaatataagtcctgctcctttgtagccagatttttgtccttacttaaaaatattgt

SEQ ID NO: 7112 - DNA, 601 bp, Human
tgagaatgaatggccttttgcagttcttctggagtatggaaaagagtttgtattgaaagttcctcaatggctgggcactgtggctcatacctataatctcaatactttgggaagctgaggtgggtggatcacttgagctcagaaattcgagaccagcctgggaaacatggtgaaaccccatctttaccaaaaatacaaaaaattagccagtcatggtggtgccagtctgtggtcccagctactcgggaggctgaggtgggaggatcgcttaagccttggaggtggtggttgcagtgagccraaatcatatcactacactccagcctgggttgacagagtgagactccatctaaaaaagaaaaaaaaaggcaactatttagcttagccctctcctctgaaaatgtgaaaggcaagagctgttctgcatcagtctagtgaaatgcactggaaaaatggtgttggtaattcctgctttgaggtcatgctagaaagagagaagataatacttgtaaaatataagtcctgctcctttgtagccagatttttgtccttacttaaaaatattgtgctcagaaagtaataccaaaaggagggatattaa

SEQ ID NO: 7113 - DNA, 601 bp, Human
ccattattggtgaatcaaacttcttgaagcatcttgcttttactttgttggttctactagaaagttttttcttggccgggcgtggtggctcatgcctataatcccagcactgtgggaggctgaggcgggcggattgcctgagctcacgaatttgagaccagcctgggtagcatggtgaaacccagtcactactaaaaatccaaaaaattagccaggcgtggtagtacatgcctgtgatcccagctgcttgggaggctaaggcacgcgaatcgcttgaacctgggaggcggagatagcagtsagccgagatcacacccactgcactgcagcctgggtgacagagtgagactgtctcaaaaaaaaaaaaaaaaaaaaaagtgtaataagtcagaatacaatgtagacacgtcttgttttgaacacaatttaaataatgtaatttaattactgcctaagattgcatatacttctttgatttgaatgatggaaaaatttctaggaacttagcctgggtttgtttcctcatcttttctttgaagccagaaaagcatagaaaagcatatgtaagcactttgacaaatgacataatgtagcggcatat

SEQ ID NO: 7114 - DNA, 601 bp, Human
agcagtcagccgagatcacacccactgcactgcagcctgggtgacagagtgagactgtctcaaaaaaaaaaaaaaaaaaaaaagtgtaataagtcagaatacaatgtagacacgtcttgttttgaacacaatttaaataatgtaatttaattactgcctaagattgcatatacttctttgatttgaatgatggaaaaatttctaggaacttagcctgggtttgtttcctcatcttttctttgaagccagaaaagcatagaaaagcatatgtaagcactttgacaaatgacataatgtagckgcatatcagagtggcacaggtattttaaacctagctccagttcctgaagatggtgaacatctgcttagaggtactgtagagctccacaatgcactaattgaattactcttttctggagttgcgactgcactaattgaattagaatctctctctctctctctctctgtctctgtgtgtatgtgtgtgtgtgtgtgtgtgtgtaaatgagataattccaaccttaacgggagagactatgagagacatgactgatggtgtgtactgtgctgctatctaatggcagcctatggaactactacg

SEQ ID NO: 7115 - DNA, 601 bp, Human
cgagatcacacccactgcactgcagcctgggtgacagagtgagactgtctcaaaaaaaaaaaaaaaaaaaaaagtgtaataagtcagaatacaatgtagacacgtcttgttttgaacacaatttaaataatgtaatttaattactgcctaagattgcatatacttctttgatttgaatgatggaaaaatttctaggaacttagcctgggtttgtttcctcatcttttctttgaagccagaaaagcatagaaaagcatatgtaagcactttgacaaatgacataatgtagcggcatatcagwgtggcacaggtattttaaacctagctccagttcctgaagatggtgaacatctgcttagaggtactgtagagctccacaatgcactaattgaattactcttttctggagttgcgactgcactaattgaattagaatctctctctctctctctctctgtctctgtgtgtatgtgtgtgtgtgtgtgtgtgtgtaaatgagataattccaaccttaacgggagagactatgagagacatgactgatggtgtgtactgtgctgctatctaatggcagcctatggaactactacgtggtctccag

SEQ ID NO: 7116 - DNA, 601 bp, Human
agcctggagaaaaaattcagcatttaagtacattttgttctcttccccccccacccccccaaccccctccgtgctcagaagttaactaaaacagatatgttctaggtttattaagccatccatgtactagtaagagatcaggatagccagtagcctcaagctacataatttcctgtggaaacggaaaaatcctactagcctctaaggtattctaaatgtgagctcttttgtccctcacatcctgtgtcccttgccattattgtgaggttgtctttggttacttgtctcttgcctttttctrtagtgtttgctagatgtgcagctacctctagggccaaaggcagaccttttcctcccaaagaagcaaattatccagtacattttttgctatttgatatacctggcttctatttggttgtaattgtgactaagaattataatgagactgttgaactattcagagagatgaaaatttgaggcattacaaattcttgcttttttggctactgctattgtaaaaacagttgatgctgtgtatatttcattttgttgagaggcactttgctttctatatggactaaaaaattaggccaggaaagat

SEQ ID NO: 7117 - DNA, 601 bp, Human
gtgttcgcgtgcaggttggactttttgcgggtcaaggcagaccagacgagtagcttatcttgagggacgcaagtaatagaccaaatatagagcagctatttcaggaatcatgtaggtcatttaattatccattatgattgagtggctaatgctcttttggcaattacatgacctctgttattcttgaaacctatccaggccctcgtgggtcaagtgacccacaagtcagtgctctcagacttgattccactcagaaagaaaggagatgttgggaaccactggcatttagaaatggccatgytttctttactgaccactacccagaatgtcctttgtacagcagtgataggcaactggttttgaagtcaactattccttcattgtatataggagcaaaagatgcattatacattggtttccacaagagggtattttggcaggagatactttaataccacaattagctattatggtattcactaattctgtactgtaagaacaactactatgatattaaaattaatgtttgatatctgtcaaaccaattatctattaccaaactctgtagtggtattttccattccataacgcaacaagtgct

SEQ ID NO: 7118 - DNA, 601 bp, Human
aatatagagcagctatttcaggaatcatgtaggtcatttaattatccattatgattgagtggctaatgctcttttggcaattacatgacctctgttattcttgaaacctatccaggccctcgtgggtcaagtgacccacaagtcagtgctctcagacttgattccactcagaaagaaaggagatgttgggaaccactggcatttagaaatggccatgttttctttactgaccactacccagaatgtcctttgtacagcagtgataggcaactggttttgaagtcaactattccttcattgwatataggagcaaaagatgcattatacattggtttccacaagagggtattttggcaggagatactttaataccacaattagctattatggtattcactaattctgtactgtaagaacaactactatgatattaaaattaatgtttgatatctgtcaaaccaattatctattaccaaactctgtagtggtattttccattccataacgcaacaagtgctattgatgatagctaataacagatattagtatattattaattactaatagtaattatagtaacagattagtaataataacaaaa

SEQ ID NO: 7119 - DNA, 601 bp, Human
catttagcaaaaagaaacaaaaaaccaggaaacaaggatgacagaaaaaaaaaattcatcagagagaaagaattttgtcatacgtcctaagggttctatagttctcagtcctattttgataaaaaaactacttaagaaaatctacagaggtcgagttacaaaaataaccagatgtccttattagtggaagcaaatgtttgcctcttaatttacacaaaactatatgcagaggatctctggatgaaatatttttgtaaatatggcagcaaagaaaatcatggcacaaaaaaatctgtccaamacacataatcgtgaaggtaatgtcttaaagaggaaagcagttttttaaaagattcctatagatttaaaggtaaaaggtaagttaagctagttatattttggtttacatgatacgtattcttggctttttattatgtatgtctttctatctgaaatccccctggtgaattttaattcattttgccttgcttatttctctactttgtacattgttgttgcattttgaacagtgtaaacgtatgtgtggattgcttttttttttccctgaaagaatggttgtccttttagttccatcacgaaa

SEQ ID NO: 7120 - DNA, 601 bp, Human
cattgttgttgcattttgaacagtgtaaacgtatgtgtggattgcttttttttttccctgaaagaatggttgtccttttagttccatcacgaaaaacacaacctacagtggtataagatgcctgctttgcaagcctgtttgggattttaaaatattaacccacattttaataagtagatgtagttttgtaattgcattcgtacattaagcaggataaaaatgtaaaaaaaaaaaactacttgaaagggtaaggtaggaagtgtttttttttgtttgtttttaaattaaggctttagagccaaaaaaaaaaacctgtaaagtttaaatggactattacttctgatgtggagcatattagcataattacaaactcttttatatactcatagtcattgctaagttgatgttcaaacctttgattaagaagtcacaaagctgactgtgttcagacagctgtgtaatatcgctcctattcacaaaacagataactgttttagccccctcccttttttggtccccatatttattgctacaaatttgtctttctcctatagctagacttttaattaatggtgaaacattaaaatgttgtattgtgata

SEQ ID NO: 7121 - DNA, 601 bp, Human
aaatggactattacttctgatgtggagcatattagcataattacaaactcttttatatactcatagtcattgctaagttgatgttcaaacctttgattaagaagtcacaaagctgactgtgttcagacagctgtgtaatatcgctcctattcacaaaacagataactgttttagccccctcccttttttggtccccatatttattgctacaaatttgtctttctcctatagctagacttttaattaatggtgaaacattaaaatgttgtattgtgatattttcggtgacttgaaagttaasagaaagcagcactgctcattcatgcccttgccttgtcactccctggtgcagttcatctcttctatccttcttatcagagtatctcagtgcttagttgagcttgtttatcttaaaagagcaggaggcaggcttttagggaataagctacatgttccagtataacaggcaccaatgctgtttgacttgaaaaacatttgatctcttacattaacagcccatgtcactgtaataggtagtacagccgagttgttcagttttctattattttagctttgaaataactgttagtgctgccccaaa

SEQ ID NO: 7122 - DNA, 601 bp, Human
ttatttgattatataatcaactcttaattatccattttatcaggagttgtgtgttcaaatagataactgaaaatagtaaataagccacttactaggtcatggggaatattgccccagctatgaacctgctgtgtgctgccatcaaaacatctttacttcttgaattggacagtcaaaaatacaaacagcctcaaagttaggaatgctttggttaagggttgccaaactttgtctgtaaaggggcagataataaacatttgaggctttgtgggagataggatctttcttgtggccacttacstcttccgttgtagtgtgaaagcagccacagacaaatcgtaaatggatgggcatggctatgggccagttaaactttatttgcaaaaatatgtgtcaggccagagcttgtaagtgctgttaactgatcatactggcattataagtagtgggacagtaggactgcagttgggctgccactgaagttcctctgctattaaaaacaaaacaaaacaaaacttttttttaagctagctggacagtctgggtttagggtttcaattattcattgagcatctgttatctgtatacttacgtaatgtgt

SEQ ID NO: 7123 - DNA, 601 bp, Human
ccccagctatgaacctgctgtgtgctgccatcaaaacatctttacttcttgaattggacagtcaaaaatacaaacagcctcaaagttaggaatgctttggttaagggttgccaaactttgtctgtaaaggggcagataataaacatttgaggctttgtgggagataggatctttcttgtggccacttacctcttccgttgtagtgtgaaagcagccacagacaaatcgtaaatggatgggcatggctatgggccagttaaactttatttgcaaaaatatgtgtcaggccagagcttgtaastgctgttaactgatcatactggcattataagtagtgggacagtaggactgcagttgggctgccactgaagttcctctgctattaaaaacaaaacaaaacaaaacttttttttaagctagctggacagtctgggtttagggtttcaattattcattgagcatctgttatctgtatacttacgtaatgtgttagtgggtagagggagctacaaagacttttcccagtaatctttcaatcttactggttagtcgaaagtaacagtgcagacatttatctaattaagtgcctgttgtgtggatc

SEQ ID NO: 7124 - DNA, 601 bp, Human
ggttgccaaactttgtctgtaaaggggcagataataaacatttgaggctttgtgggagataggatctttcttgtggccacttacctcttccgttgtagtgtgaaagcagccacagacaaatcgtaaatggatgggcatggctatgggccagttaaactttatttgcaaaaatatgtgtcaggccagagcttgtaagtgctgttaactgatcatactggcattataagtagtgggacagtaggactgcagttgggctgccactgaagttcctctgctattaaaaacaaaacaaaacaaaacttttttttaagctagctggacagtctgggtttagggtttcaattattcattgagcatctgttatctgtatacttacgtaatgtgttagtgggtagagggagctacaaagacttttcccagtaatctttcaatcttactggttagtcgaaagtaacagtgcagacatttatctaattaagtgcctgttgtgtggatcaagattaaaatttagttagggaatttccagtagagtaaggtggagtagttttatggtttcttggagaagatgacagttaaacctcattttaagaatgtgtaagac

SEQ ID NO: 7125 - DNA, 601 bp, Human
tgatagagcaagaccctgtctttaaaaaacaatcctttcaaccccgaaatttcaagatcatatcacctgttggtgagactatgaagaaacttgcttaactggggcagaaaagatgtgttgtgggaaataacttggtgtaatatagtagggaattctggatggtcctgaaaaccaggcctagaacttcatatttgatttcatagaaataaagagccactaaaaatattttagggaaagaccattacgacagtagcagtgttaagaaagattaacctggcaataatattcaatccaagaaactttttttttttttttctttgagacagggtctcactctgtcgcccaggctagagcacaatggcatgattacaccccaaactcctgggcttaagcgatcctcccgccttagcctcctgagtagctaggacgacaagcatgtgccactatgcccagctaattttttttttttttttttatgtagaggtagggtcttgctatgttacccaggctggtcttgaactcctggccccaagcaatcctcctgtctctacctcccgacaagaaaacattttaaaattcacattatattctctagctttgt

SEQ ID NO: 7126 - DNA, 601 bp, Human
ttaacaacaataagaataaaatagaacagttataactatactgtaataaaagttacatgaatatgctctctcaaaatatcttactgtactgtactcacccttcttatgatgatgtgagacagtaaaatgtctatgtgatgagatgaagtgaggtaaatgacctaggcattgtgacacagcattaggttactactgaccctttgacagcatgctacctgctttaggtgatcctggattattgagccatgaagatgttggtggtgggatgtcaggagcagacaatgtcaatgactcatggtcragtagcatgtacagtgtggatacactggaccaagggataattcacatcctgggcaggacagagctaccagaaaggtgcacaattgaaaactatttctaaaaatttccattcaatattttaggacctcagttgactgtagtaactgaaattgcgtgagtgaaactgtggataagggaggactactgtaatgctattcatagactattattactcaaggactacaaacacattctgcaatttatttactataatgaaactttccatctgagtattgggaatctgttgttctgagcagtcaag

SEQ ID NO: 7127 - DNA, 601 bp, Human
ccaattgcctcaacagtgtgtgctatacctctttagtttcctttaatctgaaacaattccttagtctatttcatggccttgacatttcttaggtacaaactagtaactttatggaatgaaatactcatttttgggttagcctgatgttttcttataagtagatttaagttttgtggttttgacaaggatacctcacaagtgatgtgctgttttcagtacatcatattaaaaggcacataatcttaaggtggcatctgctggatttctccactatgaggttactcttttttcattgtaactrtcaagtatcttatagaaaaaatattttgagattatgtgaccatcctgttaacttgtcaaactttcactcacttattgtagttttaaattttacttaggtttttgagatggtgtcttgctgtgatgcccagactgctctcaaactcctggactcaggcagtccctctgcctccacctcctgagcagctgggattacacgcatatgccaaagtactaggctcacttgctaattttagcacccaatgatgattcttccttatattaatcacttatccttaaatagaatttattggatataatt

SEQ ID NO: 7128 - DNA, 601 bp, Human
catttaaatattctttgccctagtgggatagaaaggggaaaggaactcctaagaagctctgtgttctatgttaggttagtaacaccctttaagctccctttgtgttttcattctttagacattttcataatacccacccagtggttatccatctaaatctgataaaatagagggtcagtaaaaagaaaattgtgagtatgggctagtcaatactcaggctgttaaggttgagatgactatttttcactttataattcagtatagaggagtttgccagcaattgtgtatcagcccaagtacstgtataataaaaatgtgatttatagtatctttggtatgacaaacttccagcaaaaagtaattaggctccaagttatatgataacatttcaaaaaacataattaattttgaaatacaggatcttacactgaattaaacaggtttagtttatctgatctttttatttatttatttaaaggaggaatttcatgacctgaaagagagttacttgcaaattctaagtttataattggatactggcttaagcttctattatataaggcatttaattttggtatttaaaacattgatctttacattt

SEQ ID NO: 7129 - DNA, 601 bp, Human
taattcagtatagaggagtttgccagcaattgtgtatcagcccaagtacctgtataataaaaatgtgatttatagtatctttggtatgacaaacttccagcaaaaagtaattaggctccaagttatatgataacatttcaaaaaacataattaattttgaaatacaggatcttacactgaattaaacaggtttagtttatctgatctttttatttatttatttaaaggaggaatttcatgacctgaaagagagttacttgcaaattctaagtttataattggatactggcttaagcttctrttatataaggcatttaattttggtatttaaaacattgatctttacatttaaaaaaaaaaagttaaacatacaacttgatgttatggggtaaataaatgttgacctttccctttctttgtttgatactcttacatagcatgtattgccagtcgcctcatttgtcaagctttgtagtcattaattcaattatatccttcctccattttttggtagatgatctccattcctttttttccaaacagggaggaaaagaagttagaactctgaagttcttgagtctctgtccctttctttgtaata

SEQ ID NO: 7130 - DNA, 601 bp, Human
atatccttcctccattttttggtagatgatctccattcctttttttccaaacagggaggaaaagaagttagaactctgaagttcttgagtctctgtccctttctttgtaatatagcatgctttttctttaattttagggacttttacaagggatcatcacaaatgtaaaatatcaagttaaacctcataagatatttctgcccaaaagaaacacattagggtactggcctgtcaggcttactaaaggtgacacacaggtgtcagccacagaggtgaaagggcctcagaatgacacagtacrttttttatctctcagtatctttcaaaatgtaatatctaatagaaaccaaaaaagtgaaatttacatgtaggtttagaacacagtaatgattgtatattaataatttcatgcttgtatgaaaattttcagataaactctcatgttaaaaataatttctgaacctacaaataaactaaccctcctgttagaacgttatgactatatgtaatgtaaggaatatattaactgtaagttttttgttgttgttgttttgagacggaaccttgctctgtcactcaggctggagtgcagtggtgtgat

SEQ ID NO: 7131 - DNA, 601 bp, Human
gtgtcagccacagaggtgaaagggcctcagaatgacacagtacgttttttatctctcagtatctttcaaaatgtaatatctaatagaaaccaaaaaagtgaaatttacatgtaggtttagaacacagtaatgattgtatattaataatttcatgcttgtatgaaaattttcagataaactctcatgttaaaaataatttctgaacctacaaataaactaaccctcctgttagaacgttatgactatatgtaatgtaaggaatatattaactgtaagttttttgttgttgttgttttgagayggaaccttgctctgtcactcaggctggagtgcagtggtgtgatctcggctcactgcaacctcggcctcctgggttcaggcgattctcctgcctcagactctcgagtagctgggattacaggcacccaccaccacacttggctaattttgtatttttagtagagacacagtttcagcatgttggccaggctggtctcaaactcctgacctcagatgatctgcccgccttggcctcccaaagtgctgggattacaagtgtgagccaccgcacctagcacaactgcagggttttaaatattaa

SEQ ID NO: 7132 - DNA, 601 bp, Human
tgtattttggggtttttttttttttgagacacagtcttgctctatcgcccaggctggagtgcagtggtgtgatcttggctcaccacaacctccacctccagggttcaagcgactcttctgcctcagcctcctgcgtaactgggactacaggtgcccactaccacaccgggctaatttttgtatttttagtagaaacggggtttcaccatgttggccaggctggtcgcaaactcttgaccttgtgatctgcccacctaagcctcccaaagtgctgggattacaggcatgagccactgttccygacctaatttttgtatttttagtagagacagggtttcaccatgttggccaggctgttctcagacccctgacctcaggtgatctgcccagcttggcctcccaaagtgctgggattacagacatgagccaccacacctggccctgtattcatttttaatataaaattggatacaatgagcctgagcagcagtaaaaataattctaatttacttggatttatagcattgttctaggaaataggagatctaatatttgttgagcacccaccgtgaacatgatgcttatttgatttaaccctcac

SEQ ID NO: 7133 - DNA, 601 bp, Human
aaatattggaggagcaaacaactttataccaaaaatttggcaagttgaacaaattccttgaaaaatacaacttaccaaaactcttaacacagggtgaagcaaaatttgaatagcctgatgtctattaaataaatttaattaatcatcagaagggacatgtggttttactggtgaattcaacaaatatttaaggaagaaatgatacgaattttatgccagaccctttcacagaatagagaaggaaagaacactccttgacttaaaaatccaccataacagtaattccaaaacccgacaaagrtattaccagaacaagaaataatgaaggtggaaattaagagacactgttccctgtgtctgtcaccaagtcattttgtatacctgctttttcgtttcatttccagcatctgaagatggaagagtttggggtagggagaggaagtagagcagtgtatccttgtaaagaaagttaattttcttagtttcagaataatctcatttcttggcattaaatatgaacttttatttaaaggatgtacaaaatagctacaatttttgttttactcctaaaaatgtgaagtcaaggaaaggatagccactg

SEQ ID NO: 7134 - DNA, 601 bp, Human
gcaaacaactttataccaaaaatttggcaagttgaacaaattccttgaaaaatacaacttaccaaaactcttaacacagggtgaagcaaaatttgaatagcctgatgtctattaaataaatttaattaatcatcagaagggacatgtggttttactggtgaattcaacaaatatttaaggaagaaatgatacgaattttatgccagaccctttcacagaatagagaaggaaagaacactccttgacttaaaaatccaccataacagtaattccaaaacccgacaaagatattaccagaacmagaaataatgaaggtggaaattaagagacactgttccctgtgtctgtcaccaagtcattttgtatacctgctttttcgtttcatttccagcatctgaagatggaagagtttggggtagggagaggaagtagagcagtgtatccttgtaaagaaagttaattttcttagtttcagaataatctcatttcttggcattaaatatgaacttttatttaaaggatgtacaaaatagctacaatttttgttttactcctaaaaatgtgaagtcaaggaaaggatagccactgttttcctaccttt

SEQ ID NO: 7135 - DNA, 601 bp, Human
tgactgtgttgtcatcttctgttaatgactgggccttataaaaggaactacataagtcttttagaaggaataagtagctgttttccttttctaccatattcccctcccctgaaaaaattcctgcgttctaaacattgccttggagtagatccacaaaaaacagcagtgaagaacttaaatcagccagtataagcatggaagtctgatgggcatagctcctttatacagttggatgagtaggaggaaaaagcacatcactgacacagaaaatgacattatagtgtgtattaacaaaacaacmacaacaacaaaaagtcattcataagccagtgaactgagagaaaacatactgtatttctgttctttggaggacaatttattttcaagcagcatccagatgggtaaataccaagacatttcttttttcaagagagctccttttcttcctttaaaaaaaaaaaaaacacagaatttgcttcctttaatagctctgtaatgttcatatatgatggcattcccttctttctgatttgattgatgagggaaaaaggtttaatgaagtccctgatatcaggcaggcagggttttttttttttttttc

SEQ ID NO: 7136 - DNA, 601 bp, Human
cacaacaacaaaaagtcattcataagccagtgaactgagagaaaacatactgtatttctgttctttggaggacaatttattttcaagcagcatccagatgggtaaataccaagacatttcttttttcaagagagctccttttcttcctttaaaaaaaaaaaaaacacagaatttgcttcctttaatagctctgtaatgttcatatatgatggcattcccttctttctgatttgattgatgagggaaaaaggtttaatgaagtccctgatatcaggcaggcagggttttttttttttttttctctctatttgttttaggttagtcactttaattgtattgagtaattagaaggtacacacagccaagggagctttgttctgataattgctcgagaaaacccattccctatctgccgttgctttgtgttaagacacttctccctctagtggcaatagtaagcactttggcttggcagtaggcaaggtgtaattgcaatatgacaaactatgcttaagggactgtcttgtaaatactttcgtttggggtttgcattatttcattatatatgtgtggttggttgttgttggttttttttactcta

SEQ ID NO: 7137 - DNA, 601 bp, Human
atggcattcccttctttctgatttgattgatgagggaaaaaggtttaatgaagtccctgatatcaggcaggcagggttttttttttttttttctctctatttgttttaggttagtcactttaattgtattgagtaattagaaggtacacacagccaagggagctttgttctgataattgctcgagaaaacccattccctatctgccgttgctttgtgttaagacacttctccctctagtggcaatagtaagcactttggcttggcagtaggcaaggtgtaattgcaatatgacaaactatrcttaagggactgtcttgtaaatactttcgtttggggtttgcattatttcattatatatgtgtggttggttgttgttggttttttttactctataaaacttgctacctctttttgccctcctaaagtgctttgggctttgggtaaaaaaaaaattgcctgagatgtttattaataaaaaaaatcacaatgcattctgggtaatgttttgcagcttgacttaattttagtcatctgttttaattacctatttataaaaatgcctttgcatttgtagacattatttaatactttggaagaagc

SEQ ID NO: 7138 - DNA, 601 bp, Human
gtgtaattttaaatatataccttctagtaaataagggcaagtctggcaatcaatcccttttagtgtgttatatgtttcacctgacaactaaaccttctattgattagccattactttgttagataatcctatgtcattgaatccattgtaaaaaattaaactctttaaaatgttttaccctagcagcagtgtgaaaattgaaaacttgttcagaattacagcctgctttcacaaagaaggtagttttcagcaaggcatcttactagtttatgcttatgtgctttatatgcgatataaaaaygtattaaagtactccaacgcaaaactctctgcctctggttcagcaatgaagctaccttttcaagtgttgcatggggacagaacctatcttgcctgtggctattatattcactagttggatttcaaactggagagagtcttacaggaaaatattgaatggaaaatattgaatgttttagccttttaattgcagagtggtaaaggaactatgacaaattttagtttattgatctgtgttacttccttgggagatcagcaaagtcatttacccattttacagatggaatgtctagaaaataaa

SEQ ID NO: 7139 - DNA, 601 bp, Human
acatattcattcatgaagggaaaagagggtaattttgaaggaaaataaattttctttttataacttagtattttcagaaaaatagcatgatacatttattgatgactggacaaacctctgtaaaaaatttactcctaagatacttctattggaagttttcatacagtgaattttacagatattaattgtataagtctgaatttttgataaatctaaccacctgtgtaaccaccaccctaattaaactatagaatattttcataacctaggaatgtctcttgttctcctttctacttatttyctgcaccaccaatggatcaaatactgatcagcttactgtcactgtaattttgccttttctagaattttgtgtaatggaatgctatatttttggggtctgacattcactttgcataatgtttgtgagattcctctatgttgctgtgtatatcagtagtttattctctttcattgagttgaataaatatatcgcagtttgttttctgtctccttttggtggatatctgagccatttccatcattataagtgaagttactatgaacgttcttctataaaggtttttggtgagcatatgttaag

SEQ ID NO: 7140 - DNA, 601 bp, Human
cctttctacttattttctgcaccaccaatggatcaaatactgatcagcttactgtcactgtaattttgccttttctagaattttgtgtaatggaatgctatatttttggggtctgacattcactttgcataatgtttgtgagattcctctatgttgctgtgtatatcagtagtttattctctttcattgagttgaataaatatatcgcagtttgttttctgtctccttttggtggatatctgagccatttccatcattataagtgaagttactatgaacgttcttctataaaggtttttgrtgagcatatgttaagtactttttcatgtgcttattggttattcagacattttctttgtgaagtatcttttaagtttttagccatttttaaaaattgcattgtttgcctttttattattgagttgtagactcaactgtattgaattctggataccattcatttgtcagatatatgtactctgattatatctcacagtctatggtttgcctgtttatggtatgttttgatgagaagtttctaatagttggatgaaatccagtttaccaatttttctttctttttttttttttttttttttga

SEQ ID NO: 7141 - DNA, 601 bp, Human
cgttcttctataaaggtttttggtgagcatatgttaagtactttttcatgtgcttattggttattcagacattttctttgtgaagtatcttttaagtttttagccatttttaaaaattgcattgtttgcctttttattattgagttgtagactcaactgtattgaattctggataccattcatttgtcagatatatgtactctgattatatctcacagtctatggtttgcctgtttatggtatgttttgatgagaagtttctaatagttggatgaaatccagtttaccaatttttctttcyttttttttttttttttttttgagacggagtctcgctgtgtcgcccaggctggagtgcagtgacacaatctcggctcactgcaacctctgcctcccaggttcaagcaattcttgtgcctcagcctcctgagtagatgggattacaggcatgcgccaccacatgctaatttttgtatttttagtagagacggggtttcaccatgttggctaggctggtctcgaactccagacctcaggtgatccgaccgcctcagcctcccaaagtgctgggattacaggcgcgagccaccgcgcctagccg

SEQ ID NO: 7142 - DNA, 601 bp, Human
ctctagatttgttgttttattttttgttattccagatagttcacatttctatataaattttagaatcaaccttgcactttctattaaaaagcagtctgtgaggggctgggtgtggtggctccctcctgtaatcccaacactttgggaggccgaagtgggaggatcgctggagcccactgagttggaggctacagtgagttatgatcacaccactgcactccagcctgggcaacagaaagagaaactatctccaaaaatagacagacagatagataactactttttttttcatctgagatayataggattttgcccccgttattctgttaatacgacaaattaccttgatttttgttaagagtttttgtgtctgtttcatgtgaggtactggtttgcagttttcttttttaagtgtttgccaggttttggtatcagagttatgctggtcttataaaatgaattgggaaatcttcctcccatcctcctctgttttctaaaagcacttgtgtataatcctggtggtgtttcttccttcagatttcatagaattcacaaaccacttgggcctgtagttttctttgtgaaagattttttaaactta

SEQ ID NO: 7143 - DNA, 601 bp, Human
ctagatacctaacatcccctttttccttggctccgttcaaggttttatctttatcactcgttttcagcagttctgactgtgatgggcctatatgtgttgttttctttgtatttttaacatgactggggtttgctgatctgaaatcagaaagccgctagttttcacaaaatttggggaagtatttgatcactatttttataacttctttgctgtaccgttctcttctcccttccttggactccagccacgcatatattctagataatccagaattgtcccacacagtgactaagaccgatcttttttttttcttttcttaatctcctttttttctctctgttcttcagtttatatgatttcagtttatctatctttttttttttcggtttatctgtcttcattgaccttttcttctgtcacttccagtctgctttttaagcctctccagtaaattttttgatttttttgagatagggtctcactctgttgctcaggctgaagtgcagtggcatgaacatggctcactgcagccttgaccttctgggctcaagcaaccgcccaccccagcctcctgagtagctgggactacaggtgtgcacca

SEQ ID NO: 7144 - DNA, 601 bp, Human
ctgactgtgatgggcctatatgtgttgttttctttgtatttttaacatgactggggtttgctgatctgaaatcagaaagccgctagttttcacaaaatttggggaagtatttgatcactatttttataacttctttgctgtaccgttctcttctcccttccttggactccagccacgcatatattctagataatccagaattgtcccacacagtgactaagaccgatcttttttttttcttttcttaatctcctttttttctctctgttcttcagtttatatgatttcagtttatctatctttttttttttcggtttatctgtcttcattgaccttttcttctgtcacttccagtctgctttttaagcctctccagtaaattttttgatttttttgagatagggtctcactctgttgctcaggctgaagtgcagtggcatgaacatggctcactgcagccttgaccttctgggctcaagcaaccgcccaccccagcctcctgagtagctgggactacaggtgtgcaccactatacccaactaatttttcttttttctctttttttttttttttttttttttgagacagaatctcaatctgt

SEQ ID NO: 7145 - DNA, 601 bp, Human
atactcttgaatctaaactcatggtctctttgaatttttaatggaaagcctaagatgttattacatccctctaacttgatagaagtcaaactctaaactctttctccccccatgagcagcagctggaatatctgcacaggcctttcaaccctccagctgttgctctccattgaaatccttggaatctccccttcatgtacgtagtttgggtgttagccatagatttgaggggaatttatatgtaattttttagtcttcctccttcccctgtggttctctttcatttctgggatttctgttytctattgccagccactatggcagttttgaactcttatcacttgatatctcaagccaatagactgtggctttcagattgaattctagtcaccctgcaccaagtggactcgtgagtgccttcaggggaaaagcacataaacacacatctcacccagtgtggttctcttctttcaagatcaggccactccttccccattttccgtcttttttaagtcgatctccagtgcctttatgtagctttaaaatgtttttcctatctgcaagagggtttatctgatacaaacatttctgccattactgg

SEQ ID NO: 7146 - DNA, 601 bp, Human
ctcacccagtgtggttctcttctttcaagatcaggccactccttccccattttccgtcttttttaagtcgatctccagtgcctttatgtagctttaaaatgtttttcctatctgcaagagggtttatctgatacaaacatttctgccattactggaagcggaactctttgagtcaagttatatttttttcagcaaatactgattacttcataaatttatctttaaaacatagtgaattttattttaaaaatatttatgtttgtgtgtgtatgaatagtaaatgtttgtggaattagacaaygcaaaagaaataacaaatctagagcccagaatttacatgcaccaatatttaaatctgtacactaatttctaatgctctattttttcatatatattttgaaataatttttacttaaattataagaataaaacaagttggtaaattttttaaggtttagcctgtttaaaagaaaaacagctgggcgtggtggctcacgcctgcaatcccagcactttgggaggccaaggcaggtggatcaattaaggtcaggagttcaagaccagcctggccaacatggtaaaaccctgtctctactaaaaa

SEQ ID NO: 7147 - DNA, 601 bp, Human
cttagtttcgataaatgttctgtaattatgtaagatattaacatatggagaagctgggtgacaagtatataggaaatctttactttttctttctttctttttttaaagagatgatgtcttgatttgttgcccaggctggagtgcaatggcataatcatagctccctgcagtcttcaactccagggctcagtcagtcctcctgagtagccaggactacaggcctgtgctgccacgcccagttaatttttttttttttttaaatagaaatgtgggcttgtatggaactcccggtttcaagtarccctcctgcctctacctcccaaagtgctgggattataggcatgagccactgtgcttgaactttactatttttgtacttgttctataaatctaaaattatctcaaaatgttaaaaaattgaattctttgttactgttggttttgagtgtcttaagatttttcttcttaaatccaacacaagtatttatagcaatggttctcgaagagtgttcctggatcagcagcactaacgtcaactggggccttgttaaaaatgcaaatgttcagaagctctggggatggaaacctagcaatctgtgtt

SEQ ID NO: 7148 - DNA, 601 bp, Human
atgttctgtaattatgtaagatattaacatatggagaagctgggtgacaagtatataggaaatctttactttttctttctttctttttttaaagagatgatgtcttgatttgttgcccaggctggagtgcaatggcataatcatagctccctgcagtcttcaactccagggctcagtcagtcctcctgagtagccaggactacaggcctgtgctgccacgcccagttaatttttttttttttttaaatagaaatgtgggcttgtatggaactcccggtttcaagtagccctcctgcctctrcctcccaaagtgctgggattataggcatgagccactgtgcttgaactttactatttttgtacttgttctataaatctaaaattatctcaaaatgttaaaaaattgaattctttgttactgttggttttgagtgtcttaagatttttcttcttaaatccaacacaagtatttatagcaatggttctcgaagagtgttcctggatcagcagcactaacgtcaactggggccttgttaaaaatgcaaatgttcagaagctctggggatggaaacctagcaatctgtgtttgttttgttttgag

SEQ ID NO: 7149 - DNA, 601 bp, Human
tgctgggattacaggtgttagccaccaggccccaccgtgatctgtgttttaacaagccctccttccagatgattctgatgcgcactaaagtttgataaacataatttataccatcagtaaaaacttaagactaaaaggaaacatttctattaatatattgtccagtaattaataagtttgcttttcataaagtataactatagtattaccaatgttttgttttgtttttggtagagacagggcctcgctgtgctgcccaggctgatctcaaactcctaggctcaagtgattcccctgcctyggcctcccaaagtgctgggatcacaggcatgagccactgtgcccagctatcaccagtttttaaaatccatttcctatgatttttttctttcttttttatttggagacaatgtcttgctctgttgcccaggctggagtgcagtggcgtgatctcagctcactacaacctccatctcctgggctcaagcgattctcgtccctcagcctcctgagtagctggaactacaggcacccaccaccatgcctggctaatattttgtattttagtagagacagggtttcaccatgttgcccagggtgg

SEQ ID NO: 7150 - DNA, 601 bp, Human
gaggatcacttgagctcaggagttcaagaccagtttaggcaacatggcaaaaccccatctctacaaaaaatacaaaaaattagctgggcgtggtagcgtgcccctgtagtcccccacctactctggaggatcacttgagtcccagaggcatagattgcagagagccaagatctcaccactgtacttccagctggggtgacagagtaagaccctatctcaaaaaaaaaaaaaaagaaaagaaaaaaagagaaagaaacatgtcctctgtgggaggctgaggcaggagaatcgcttgaacccyggtggcggaggttgcagtgagccgagatcacgccactgcaccccagcctgggtgacagagcaagactccatctggggaaaaaaaaaaaaaaaaaagaaacatgccctctaactaccttcagatcttgatggttttgaaagtttagaaggaaaaacaacaaaaataaatcttttctcagaacggtaactgctgttttaaacagaactaagctcttccaatttgcattttaaaatgctacataatcagtacccccagcttccattaatcattaatacagtgaagccactgctgcttacatac

SEQ ID NO: 7151 - DNA, 601 bp, Human
gatcacttgagctcaggagttcaagaccagtttaggcaacatggcaaaaccccatctctacaaaaaatacaaaaaattagctgggcgtggtagcgtgcccctgtagtcccccacctactctggaggatcacttgagtcccagaggcatagattgcagagagccaagatctcaccactgtacttccagctggggtgacagagtaagaccctatctcaaaaaaaaaaaaaaagaaaagaaaaaaagagaaagaaacatgtcctctgtgggaggctgaggcaggagaatcgcttgaaccccggwggcggaggttgcagtgagccgagatcacgccactgcaccccagcctgggtgacagagcaagactccatctggggaaaaaaaaaaaaaaaaaagaaacatgccctctaactaccttcagatcttgatggttttgaaagtttagaaggaaaaacaacaaaaataaatcttttctcagaacggtaactgctgttttaaacagaactaagctcttccaatttgcattttaaaatgctacataatcagtacccccagcttccattaatcattaatacagtgaagccactgctgcttacatacttg

SEQ ID NO: 7152 - DNA, 601 bp, Human
cctgggtgacagagcaagactccatctggggaaaaaaaaaaaaaaaaaagaaacatgccctctaactaccttcagatcttgatggttttgaaagtttagaaggaaaaacaacaaaaataaatcttttctcagaacggtaactgctgttttaaacagaactaagctcttccaatttgcattttaaaatgctacataatcagtacccccagcttccattaatcattaatacagtgaagccactgctgcttacatacttgttcatgggcacatcagtggcttttgtagcctctatctttgccccccttttctaacttacctctcagttcccataagtcttaacttatagataaaatctatttgtgttttgacttgagaaatagagcagaatttgaaaacaggatatggcagtatttcaatattttaaaaacctgtttccaacaaattctctttacagacatacaacagctgtgccagactctgcttaaaccaagaaacagtatgtttagcaagcactgctatgaagactgagaattgtgtggccaaagtaagtaatattgctcatcaatgtatattacaccacaccataacagtgccatatctg

SEQ ID NO: 7153 - DNA, 601 bp, Human
attgaggagcgcataggctttgagggcagacctggcctggaatctttcagagctccttgccttcttgcctctccttttccttgtctagaaaagggaggtaagagtacttcccacttcacaggactgttgtgaggctgaaatgagatgatatgcctggaggtacaatcataataacatactaacatattaatcataataacatattagcaacaatcaggataaaagtaatagctaagatatattgagtccttatgtcccagccatgactcaaagcaccttacatgtattatcttctttttctttttttcttttactgatacataatattttacatatttatgaggtacatgtgagtgttttttacatgcattgaacgtgtaatgattaagtcagggtatttggggtatccatcacctggaatagttatcatttctatgaattggtaatatttcaagtcctctcttttagctactttgaaatatacaatatattgttgctaactatagacactctagtctgctatgtaacattagaacgtatttcttctatctaactataattcagtacctattcaccaacctcttcatttcccccttctacc

SEQ ID NO: 7154 - DNA, 601 bp, Human
cactgcaagctccgcctcctgggttcatgccattctcctgcctcagcctcctgagtagctgggactacaggcgcccgccaccacactggctaattttttttattattattatttttagtagaggcggggtttcaccatgttagccaggatggtctcaatctcctggccttaggattttaagaaaactatattatcacctagccatcatgagttaaacacagctccaaaatattaaattgtgtctaaaatggtcggcatggctttctgggtacccactaattacagttcccatatcatcagaaaaaaaaaagtatatatccgtaattttttttttttgacagtctcgctgtgttgcctaggctggagcagtggcgcgatcttggctcactgcaacctctgcctcccaggttcaagcaattctcctgcctcagcctcccaaggaactgggattacaggcgctcatcaccatgtcttgctaatttttgtatttttagtagagacgaggtttcaccatggtggccaagcgggtggtctcaaactcccaacctcaagtcatcctcccacctcggcctcgcaaagtgctgggattacaggcctgagc

SEQ ID NO: 7155 - DNA, 601 bp, Human
ggattttaagaaaactatattatcacctagccatcatgagttaaacacagctccaaaatattaaattgtgtctaaaatggtcggcatggctttctgggtacccactaattacagttcccatatcatcagaaaaaaaaaagtatatatccgtaattttttttttttgacagtctcgctgtgttgcctaggctggagcagtggcgcgatcttggctcactgcaacctctgcctcccaggttcaagcaattctcctgcctcagcctcccaaggaactgggattacaggcgctcatcaccatgtgttgctaatttttgtatttttagtagagacgaggtttcaccatggtggccaagcgggtggtctcaaactcccaacctcaagtcatcctcccacctcggcctcgcaaagtgctgggattacaggcctgagccactgcactcagctacaaatcttcttaatgattcagtacacccagacttttcttcttttttttttttttttttttgttttttgaggaagagtcttgttctgttgcccaggctggaggctggagtgcagtggtgccatcttggttcactgcaacttccacctcccaagttta

SEQ ID NO: 7156 - DNA, 601 bp, Human
ccatcatgagttaaacacagctccaaaatattaaattgtgtctaaaatggtcggcatggctttctgggtacccactaattacagttcccatatcatcagaaaaaaaaaagtatatatccgtaattttttttttttgacagtctcgctgtgttgcctaggctggagcagtggcgcgatcttggctcactgcaacctctgcctcccaggttcaagcaattctcctgcctcagcctcccaaggaactgggattacaggcgctcatcaccatgtcttgctaatttttgtatttttagtagagacraggtttcaccatggtggccaagcgggtggtctcaaactcccaacctcaagtcatcctcccacctcggcctcgcaaagtgctgggattacaggcctgagccactgcactcagctacaaatcttcttaatgattcagtacacccagacttttcttcttttttttttttttttttttgttttttgaggaagagtcttgttctgttgcccaggctggaggctggagtgcagtggtgccatcttggttcactgcaacttccacctcccaagtttaagagatctcctgcctcagtatcccaagtaa

SEQ ID NO: 7157 - DNA, 601 bp, Human
tctatagcagcaaaattcataatagccagaaagtcaaaacaacccaagtgtctatcaataggtgaatggataaacaaaatgtgctattatatatacacaatgaaacactgttcaccctttaaaaagaatgaaattctgatacatgctacaatgtggatgaagcttgaaaatattatgttaagtgaaataagccagacacacacaaaaaatattgtatgattccacttatataaaacacctagaataggcaaattcagtcagagactattggagttgctagaaatgtaatgtaggcttttcttttttttttttgagactgagttttgctcttgttgcccaggctggagtgcaatagcgcaatcttggctcactgcaacctccgcctcccgggttcaagtgattctcctgcctcagcttcccgagtagctgggattacaggcatgtgccaccacggccggctagttttgtatttttagtagagatgaggtttctccatgttggtcaggctggtctcgaactcccaacctcaggtgatccgcctgcctcagcctcccaaagtgacttatcacacagcacctggctatgtttgtttattattctt

SEQ ID NO: 7158 - DNA, 601 bp, Human
tagagatgaggtttctccatgttggtcaggctggtctcgaactcccaacctcaggtgatccgcctgcctcagcctcccaaagtgacttatcacacagcacctggctatgtttgtttattattcttttttcccctcacttctggagacctaggcataggtctttctatttgtttgttctatttgtttgttctatttgtttttctccctctgtttttaaattatgaaatcatgtcgagtcaaaaattaacttagaatgctgttctaataacattatatggaattctcatttttgttattttgtttttttttccttatccaagaaagaccctaactttattggcaagcatgtttatatttccaagtatattgtttttgtttgtttaaacatgttatgaatttttagagattattttttctttttggtgctgaggtgaaagaacataccctgtattgtttctgctttgtaaaatgtattggatctttttgtgacctggtgtaaaaacaattaaaaatatttgtatgatactggccgggcacggtagctcatgcctgtaatcccagcattttggtgggtggatcacttgagatcaggagttcgaga

SEQ ID NO: 7159 - DNA, 601 bp, Human; identical to SEQ ID NO: 7153

SEQ ID NO: 7160 - DNA, 601 bp, Human; identical to SEQ ID NO: 7154

SEQ ID NO: 7161 - DNA, 601 bp, Human; identical to SEQ ID NO: 7155

SEQ ID NO: 7162 - DNA, 601 bp, Human; identical to SEQ ID NO: 7156

SEQ ID NO: 7163 - DNA, 601 bp, Human; identical to SEQ ID NO: 7157

SEQ ID NO: 7164 - DNA, 601 bp, Human; identical to SEQ ID NO: 7158

SEQ ID NO: 7165 - DNA, 601 bp, Human
aatacaataataggcagagagtaatttattactctatgggtctgctctgtaaatagctgaagactctggagccagatggttctgcaaattctccaaacaggagtcacgttaagaagcacgagtgggcacaaaaactgtttttcaagacacaatttcaatttggcttgtggaaactggatacgagtaagtttccttaaaattcgagtagaaagcagctgtcctccccgggccccttgatgagaatacgcacaccgcccccaagcggccggccgagggagcgccgcggcagcgggagaggcgyctctgtgggccccctggcagccgcggcaggaaagggcccgaaggcagcgaaggcgaacgcggcgcaccaacctgccggccccgccgacgccgcgctcacctccctccggggcgggcgtggggccagctcaggacaggcgctcgggggacgcgtgtcctcaccccacggggacggtggaggagagtcagcgagggcccgaggggcaggtactttaacgaatggctctcttggtgtcccctgcgccccgtcggcccatttttctttttacaaaacgggcccagtctctagtatccacctctc

SEQ ID NO: 7166 - DNA, 601 bp, Human
atgcttgctgatcaccccgagcccgcgtggcgcaagagtacgagcgccgagcccgtgcgcgccaaggctgcgtgggcgggcaccgacttttctgagaagttctagtgctcccaagccccgacccccgcccccttcactttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccrctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggtaagtcgcccccggcggccgccgaggaccaaagctgcccgggacatccacctggagcgctgaggcttcagtccctctggtggaccccggaacctacactctccccgctcgcctaccccagcccgctcctctcagccgctggaggactcttcagg

SEQ ID NO: 7167 - DNA, 601 bp, Human
gtacgagcgccgagcccgtgcgcgccaaggctgcgtgggcgggcaccgacttttctgagaagttctagtgctcccaagccccgacccccgcccccttcactttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgycgctctccaggagcaacctctactccggacgcacaggcattccccgcgcccctccagccctcgccgccctcgccaccgctcccggccgccgcgctccggtacacacaggtaagtcgcccccggcggccgccgaggaccaaagctgcccgggacatccacctggagcgctgaggcttcagtccctctggtggaccccggaacctacactctccccgctcgcctaccccagcccgctcctctcagccgctggaggactcttcagggcaaggctccagagccatcctctccagccttgaggtt

SEQ ID NO: 7168 - DNA, 601 bp, Human; identical to SEQ ID NO: 2377

SEQ ID NO: 7169 - DNA, 601 bp, Human; identical to SEQ ID NO: 2378

SEQ ID NO: 7170 - DNA, 601 bp, Human; identical to SEQ ID NO: 2379

SEQ ID NO: 7171 - DNA, 601 bp, Human; identical to SEQ ID NO: 2380

SEQ ID NO: 7172 - DNA, 601 bp, Human; identical to SEQ ID NO: 2381

SEQ ID NO: 7173 - DNA, 601 bp, Human; identical to SEQ ID NO: 2382

SEQ ID NO: 7174 - DNA, 601 bp, Human; identical to SEQ ID NO: 2383

SEQ ID NO: 7175 - DNA, 601 bp, Human; identical to SEQ ID NO: 2384

SEQ ID NO: 7176 - DNA, 601 bp, Human; identical to SEQ ID NO: 2385

SEQ ID NO: 7177 - DNA, 601 bp, Human; identical to SEQ ID NO: 2386

SEQ ID NO: 7178 - DNA, 601 bp, Human; identical to SEQ ID NO: 2387

SEQ ID NO: 7179 - DNA, 601 bp, Human; identical to SEQ ID NO: 2388

SEQ ID NO: 7180 - DNA, 601 bp, Human; identical to SEQ ID NO: 2389

SEQ ID NO: 7181 - DNA, 601 bp, Human; identical to SEQ ID NO: 2390

SEQ ID NO: 7182 - DNA, 601 bp, Human; identical to SEQ ID NO: 2395

SEQ ID NO: 7183 - DNA, 601 bp, Human; identical to SEQ ID NO: 2396

SEQ ID NO: 7184 - DNA, 601 bp, Human; identical to SEQ ID NO: 2397

SEQ ID NO: 7185 - DNA, 601 bp, Human; identical to SEQ ID NO: 2398

SEQ ID NO: 7186 - DNA, 601 bp, Human; identical to SEQ ID NO: 2399

SEQ ID NO: 7187 - DNA, 601 bp, Human; identical to SEQ ID NO: 2400

SEQ ID NO: 7188 - DNA, 601 bp, Human; identical to SEQ ID NO: 2401

SEQ ID NO: 7189 - DNA, 601 bp, Human; identical to SEQ ID NO: 2402

SEQ ID NO: 7190 - DNA, 601 bp, Human; identical to SEQ ID NO: 2403

SEQ ID NO: 7191 - DNA, 601 bp, Human; identical to SEQ ID NO: 2404

SEQ ID NO: 7192 - DNA, 601 bp, Human; identical to SEQ ID NO: 2405

SEQ ID NO: 7193 - DNA, 601 bp, Human; identical to SEQ ID NO: 2406

SEQ ID NO: 7194 - DNA, 601 bp, Human; identical to SEQ ID NO: 2407

SEQ ID NO: 7195 - DNA, 601 bp, Human; identical to SEQ ID NO: 2408

SEQ ID NO: 7196 - DNA, 601 bp, Human; identical to SEQ ID NO: 2409

SEQ ID NO: 7197 - DNA, 601 bp, Human; identical to SEQ ID NO: 1925

SEQ ID NO: 7198 - DNA, 601 bp, Human; identical to SEQ ID NO: 1926

SEQ ID NO: 7199 - DNA, 601 bp, Human; identical to SEQ ID NO: 1927

SEQ ID NO: 7200 - DNA, 601 bp, Human; identical to SEQ ID NO: 1928

SEQ ID NO: 7201 - DNA, 601 bp, Human; identical to SEQ ID NO: 1929

SEQ ID NO: 7202 - DNA, 601 bp, Human; identical to SEQ ID NO: 1930

SEQ ID NO: 7203 - DNA, 601 bp, Human; identical to SEQ ID NO: 1931

SEQ ID NO: 7204 - DNA, 601 bp, Human; identical to SEQ ID NO: 1932

SEQ ID NO: 7205 - DNA, 601 bp, Human; identical to SEQ ID NO: 1933

SEQ ID NO: 7206 - DNA, 601 bp, Human; identical to SEQ ID NO: 1934

SEQ ID NO: 7207 - DNA, 601 bp, Human; identical to SEQ ID NO: 1935

SEQ ID NO: 7208 - DNA, 601 bp, Human; identical to SEQ ID NO: 1936

SEQ ID NO: 7209 - DNA, 601 bp, Human; identical to SEQ ID NO: 1937

SEQ ID NO: 7210 - DNA, 601 bp, Human; identical to SEQ ID NO: 1938

SEQ ID NO: 7211 - DNA, 601 bp, Human; identical to SEQ ID NO: 1939

SEQ ID NO: 7212 - DNA, 601 bp, Human
cactagggaaggcctccgtacctgcagttttcttcatggagaggttttgaactacaaattcaacttcttcaatagataaagggctgttcaggttgtttttcttccatgagcttgtagctttcaagaagtttgtccattttatctaaacggttgaatttagaggcatgaagtggttcctaatatgcccttattcttcttttactgtctgcaggatctgtcatgatataacctgtattattcctgatactggtttgtgtgctcttttttttcctgctcttctggctggagggttttttttttwaaatttagattttatatatacatacatatatattttaagagacagggtctctgccaggcgcagtggctcacacctgtaatcccagcattttgggatgccaatgcgggtggatcacctgaggtcaggagtttgagacctgcctagccaacatggtgaaaccccatctctactaaaaatacaaaaattagccaggagttgtggtatgcacctgtaattccagctacttgggaggctgaggtaggagaattgcttgaatcctggaggtggaggttgcagtgaaccaagatcgcgccactgcac

SEQ ID NO: 7213 - DNA, 601 bp, Human
cttgctctgtcacccatgctggagtgcagtggtgcgatcttggctcactgcaacctctgcctcctggattcaagtgattcttttgactcagtctcccgagtagctgggactacaggcatgcgctaccatgcccggctaatttttgtatttttagtagaggcgaggtttcaccatgttggccaggctggtctcaaactcctgacctcaagtgatctgcctgcctcggcctcccagagtgctgggattggtgtgagccaccacgcccagtctcctataatattcttgtgcttggttttgggaagcagtaaagttacttgtaaacagtttaatccttttgagtcttgcttttgagatgtgttagggtctggatcagtgcttagtccagggttaatattcccctgtactgaggtaagaccctttgagctttctacccaatgcaccctgtatcatgagatttttgagtttgactggtgggattaggtgctgttcccggccttgtgtgagcactgggcacttttctctcattgttttggatggtatttttcccaggcctggagtagttttctcctaagcatgtgctaatcacaatacccaagggaat

SEQ ID NO: 7214 - DNA, 601 bp, Human
cagattctcagccttgtctcctcaactcagggagccttctaggttctacctggctgccccttctctgtactctctcctggaaactctcaaggcagaaagctggggtaaccccagggctcacctcctttgtctctcgttattcaggggttacttttctttgttacctgttgtctagtgtcctgaagagtgtggtttcagttattttaaaaaaattttaaataactggctgggggggttgttatttgagatgggagagtaaatgcagtccctgctattccatcttgggcagaggtggaggacrcacattctctcttgtagccaggagagagcactcccgttacagagctgtgtaccttgtgactgttgtgggaatcttgtcaaccactcttttggggtttaggaatgtgtttgtgagacctctggtttgttcctgtgtgataatagtaccacaaaggtagcagctgaaaacaacccacgtttattattctacagtttatctgggcggagagcccaggcccggctgaacaaggtgctgtgctcaggatctcacaaggctgcgatcgaggtgtcagtgggggctgcagtctcatctgaaacttgc

SEQ ID NO: 7215 - DNA, 601 bp, Human
ctcttttggggtttaggaatgtgtttgtgagacctctggtttgttcctgtgtgataatagtaccacaaaggtagcagctgaaaacaacccacgtttattattctacagtttatctgggcggagagcccaggcccggctgaacaaggtgctgtgctcaggatctcacaaggctgcgatcgaggtgtcagtgggggctgcagtctcatctgaaacttgcctggaaaggatctttcttcaggctcacgtggttgttggcagcattcagttccctgtgggttcttgctgggtgttggctggaggscgctcttagctgtttgcccttaggccttgccaacatggctgcttgcttcctaaaagccagcaagagacacagtctcctagcacaatgggttatcgtcttatgtaatgttatcaagggtgtcacatctcatcacctttcccctgttctgtggattagaagcaagtctcaggccccacccacatttgaggggaagggattatgcaagatgtgaataccagtggccaggatcctggggcataccttaaagcaagtttgtctaactaaaggcctgcaggccacatgtagcccaggatactttga

SEQ ID NO: 7216 - DNA, 601 bp, Human
gattcactgcagcctcctcctcccgggttcaagtgattcttgtgcctcagcctcctgagtagctgggattgcaggcgcatgccaccaggcccagctaattttttttgtatattttgtagagactggatttcaccatgttggccaggctggtctcgaacttctgacctcaaatgatgtgcccaccttggcctcccaaagtgctaggattacaggagtgagccaccacacctggctagattctaattggctttgtagttattgctttatccagttgtgttttaaatcagacaggagaaaaaargggtcacaagcagaaaatacatttatggggtcttttatatctacccatgtagttgcctttatttcttcatgtagatttgagttactctctccaaaggactccctttggtatttcttgaagggcaggtttgctgtgacagattctctaagctcatctttatctgggcatgtcttagtttctccttcattttttgaaggatagtcttgctgggtatagaattcttggttgacagtctttcagccctttggacgtgtcattccattgcctgcatactttctgatgggaaagcagctattgatc

SEQ ID NO: 7217 - DNA, 601 bp, Human
ctttatctgggcatgtcttagtttctccttcattttttgaaggatagtcttgctgggtatagaattcttggttgacagtctttcagccctttggacgtgtcattccattgcctgcatactttctgatgggaaagcagctattgatctcattgagggctccttatatgtgacaagttgctactctattgctgctttcaagtgtcgtcttttgtcttttgagtgtgtgattatcatgtgttaggtgtggatctctgtgagtaaattacatggagtttgtggaccttcttggatgtttagattsgtgtttttcatcaaatttggggagttttcagccattattttttcaggtattctttctgcccttattctactctcgtctccatctacaactcccattatgaatcagttgattcacttgataatgccccacagatctctgaagctctgttcattttcctccatttttttctttctgatcttcaggctggatcttctcaatggacctctcttcaagtttgctgatcattctctcctgttgaatccttctagtgaatttcagttattgtacttttcaactccagaatttctgtgtggtgctttt

SEQ ID NO: 7218 - DNA, 601 bp, Human
gtggtactttttaaaaaattattcctgtctctttattgatattctcttatttggtgagacattattctcatattttatttctttagacttgtttcccttttgctgtttgaacatacttagaatcgctgatatttcaagtctttgtctagtaagatcagcatctgggctttctctagtatccagtttatttatttatttatttaattttttggagatggagtctcactctgttgctcaggctggagtgccgtagcgtgatctcggcctgctgcaacctccgtctcctaggttcaagcgattstcctgccttagcctcctgagtagctgggattacaggcgtccaccaccacgcctggctgatttttgtatttttagtagagatggggtcaccatgttggccaggcaggtgtcgaactcctgactcaggtgatctaccaaccttggcctcccaaagtgttgggattacaggcgtaagccactgctcctggcctcaagtatctgttgattgccttttttcccctgaatattggccatattttcatgactctctacgtgccttgtagttttttgttgaaaatggatgattttaaataatagaatg

SEQ ID NO: 7219 - DNA, 601 bp, Human
ttgtttagtgacttttctggactaattctgtaaaatctgtattttttgtcttgcgtggccactaaagtctaatacaacttagtggccagctagtgattagacagaaatccccctgaactcctggagccataaatgccccagtctttgctgagtggctctgtgtgtgtgcttgggcacacctccaacacagagccaggctgtttgtgactctcagctttcacttcccgtttgtgcagtgcgttgagctgagccacagatgagagctgagggcctcccgaggtctttcctgagccctgtacawgtgtgtggccttctagattcccaggaatatgttggagcttttcaaagccccctgaggatatctcattccccagcttaaaactttggttatcctatcatttgctccgaccattattctctgtcttagaaaactgtgatgttcaacaattacctctgattgtttttgacagacaccaccagggaaaaggctgtttgtattacatgagctcagataaagtcttttgagtgtggtctaccagaggattcccagacagatgagataagcacagtttctggagtggggcttttcaggaatgccaac
